United States Patent 7,572,902 (NUCLEIC ACID MOLECULES SEQ ID NO. 16372 AND OTHER MOLECULES ASSOCIATED WITH PLANTS) - sequence listing, part 2

SEQ ID NO: 5422 - DNA, 375 bp, Zea mays
  Clone ID: LIB3279-049-P1-K1-E6
cggacgcgtgggtcagatttcatcaacaggtttcctgttcaattttctattgaggtgatcaaggcaagattagcgacaaatattacagaactctgggggctgtcagacatgataccactgtgatgctttcaaatgcagaatcttacttttcaaagagcagtgaaatgaccaaaaagatccgcaagctctctgagttgctcgaccagatcttttcatcactgtagggaacattgcttgatgcctgattgacaatttcccttttcgtttctgcaaaaaaaatttggccttaggcatcgagatgatttttactggtcctactgaggcattagagaattagccaaagtagttctcaggacagaaagggtttccggtgta

SEQ ID NO: 5423 - DNA, 365 bp, Zea mays
  Clone ID: LIB3279-049-P1-K1-E7
gggggagccaagggaagctctcttctttcttcctcctcctcgtcctctcgaattccgtctcttgtctctgtctcctcgctcggcttccccggttcttgagaggggaaagaggaggcggaggagagggatggggagggacgagaggttcccagtgtgggaggccgcgctcggcgctggggtcgccgccgccttcgccgctgggctcgtcggggtttacctttccatgccggactccgactacagcttcctcaagctgccacgtaatctccaggaactccaaatcctcactggccatcttgagaactatactagcgactacaccctacaggtgttggtaggctactgcgccgtgtacatcttcatgc

SEQ ID NO: 5424 - DNA, 371 bp, Zea mays
  Clone ID: LIB3279-049-P1-K1-E8
cgacgattcaccgagccggcgcccagtgacccttccagaagcttccagaaggtcaccgccatggccgcgcccttcttttccactcctttccagccctacgtctaccagagccagcaaggatctgtgacggcgtttcagatatccggtggagatgtgcaggtcctgcaggtgatgctgaagtctcaggagaagctgactgcaaaaccaggtgcaatgtgctacatgtctgggaacatgcagatggacaacaattacttgcctgaaaatgatggaggcgtgtggcagtggatttttgggaaacgtgtaagcagcaccattttctttaattctggatctgatgatggatatgtcgggattgctgcaccatttcc

SEQ ID NO: 5425 - DNA, 371 bp, Zea mays
  Clone ID: LIB3279-049-P1-K1-E9
cccacgcgtccggtccacccgtcgtcctcctagctcctctactcgccagtcgccatgggcaagattaagatggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtccacggccactggaagcacagcgacatcacactcaaggactccaagacccttctcttcggtgacaagccggtcaccgtctttggcatcaggaaccctgaggaaatcccgtggggtgaggctggcgctgagtatgtcgtggagtccaccggcgtcttcactgac

SEQ ID NO: 5426 - DNA, 146 bp, Zea mays
  Clone ID: LIB3279-049-P1-K1-F1
gactggtacaagatcctgggctccgagtacgccggtagcaggtgggcggagcggggacaaccgtgcggactactacacgcaaccttctgtggagcaggtggccgttgatgtgtctctaggcacaatttgctgaacgggccttagtc

SEQ ID NO: 5427 - DNA, 366 bp, Zea mays
  Clone ID: LIB3279-049-P1-K1-F10
cgggaggagagcgtgtacatggccaagcttgcggagcaggcggagcggtacgaggagatggtcgagttatggagcgcgtcgcgcgctacgccgggggcgccggcggcggggaggagctctcggtggaggagcgcaacctgctgtccgtcgcctacaagaacgtcatcggcgcccgcagggcctcgtggcggatcatctcctccatcgagcagaaggaggaaggccgcgggaacgaggcgcacgccgcatccatccgcgcctaccgctccaagatcgaggccgagctcgcccgcatctgcgacggcatcctcgcgctcctcgactcccacctcgtcccatccgccggcggcgccgaattcaaggtct

SEQ ID NO: 5428 - DNA, 369 bp, Zea mays
  Clone ID: LIB3279-049-P1-K1-F11
cccacgcgtccggcgcgctggagccccacgcgccgcgttcccgtcgagcagcgcgttcagcgccctcacatcgggccccaccgtcatcttcaatccaacagcagcatcctgcagcccttgtcgcagcacatgatgtcgtgtgccggagcatcgctgttcgccatcgtttcgccatgagcgcagcattcctccagtcatcctcttcatctccaatgagcattttctcttctcttttctttctcagtttttcgttactgtgcatccttcggccttggcaagcgcccatgccccttgcggtcagcccacaacatggctccgtccaacccctagcagccccgtcgcaccctcgctgtcgtgcgattcgacact

SEQ ID NO: 5429 - DNA, 367 bp, Zea mays
  Clone ID: LIB3279-049-P1-K1-F12
gtttcatcagtatatatatactgaaactaatgctatatatatatatgttatctgcagtacgtattctcccaacaccggcccccttcaatctgcaggtggaggttgctcaagagaggctgaagagatggtacatggaagagaacagaagactccaggggtccagacgaaacccttaggccggccctcagctccactgtgtatctctagttttccactcaccacgagaacaaaacgagggagacgactgctccacgtacaggccgatcgaggctgaaggatcatctctgggctgtatggtattgtagacacaaataatcatctgggctgggctgggcatgcaggtaatagtggtgtgcactagttctga

SEQ ID NO: 5430 - DNA, 380 bp, Zea mays
  Clone ID: LIB3279-049-P1-K1-F2
ccgtgttccgtgtccgcgtccagtgtgtccgctactccgctccccctcagtcctcagttcctcacctagcggtagcgtcgcgcgggagacgtagatggcggcttcggaggcggcagcggcggcggcaacaccggtgacgccgacagaggggacggtgatcgcgatccacagcctggaggagtggagcatccagatcgaggaggccaacagcgccaagaagctggtggtgattgacttcactgcaacatggtgtcctccgtgccgcgccatggctccaatttttgctgatatggccaagaagtccccaaatgttgttttcctgaaagttgatgtcgatgaaatgaagaccattgctgagcaattcagcgtagaggccatgc

SEQ ID NO: 5431 - DNA, 377 bp, Zea mays
  Clone ID: LIB3279-049-P1-K1-F3
tttaggaatcgtcagaacttgatatttcacacctctaactcatgaaaagaaattgcgaactaaggttttaagccttgtaatcaacaatgcgggcttgtgctgttttgacaaagtgggatgagagtgacagtgaaagttttgaagggtttcatattggcaatggatttaaatgggatacaacaagacacatgtttgaacaatttggggatatattcattgctgcaatgtttgatccaatgggtattggttttgtatctttttatgctttcgtgtgtcaaagtgtaaaatacaaaatgcaaagaagatcacattatcattaaaaaagcgtcagcacaaaaaattccttctatctaactggaataaaaatcataagtaat

SEQ ID NO: 5432 - DNA, 358 bp, Zea mays
  Clone ID: LIB3279-049-P1-K1-F4
ctgtggttcgcgccgcccgagtggaaggagtgccggctggggatccagctgctgcccgtgctgcccatcagcgagcgctgttcccggacgtggcgttcgtcaaggacctggaggcgtggacgctgccggcgctagcgagggacggcgtgggcgaagggtggaaggggttcgtgtacgcgctggaggggatctacgacagggaggcagcgctgaccaagacccgcgccctcaaggggcatgatgatggcaactcgctgaccaacctgctgtggtggctccacagccgaggcagcgtcgtctgtgacggcgactctgggttcggccgctgctgctggtaccgccagtactgccactgacg

SEQ ID NO: 5433 - DNA, 375 bp, Zea mays
  Clone ID: LIB3279-049-P1-K1-F5
caacaaggcaaccttcccgctctttgatgctttgggagagctttatgatggacacttggctgaagggacttggaatgcacttctcttgaggcactgcaagaggaagaactgaatgagcaacttcaggatgcagaagatggaccacaaggctttgatctgaatgttgttcatgatgtagatgatgaagttgatgatgcactcgctgaaaggaatgaagatatgcttcaaggaagggctaatactctgtcacgagatgaagaaagtggacagcgaagacctgctgcgtcaagaaacaagcaagaaaaggaaccaaagaagcctagaaagactgacagcatagaaaatatgatgaacaaatacctagaaatgaggagc

SEQ ID NO: 5434 - DNA, 242 bp, Zea mays
  Clone ID: LIB3279-049-P1-K1-F6
ccctagcttctgtttggctgttgccttgcgggtggcggatgctttggtgcgctgtgcagtgcgctccagtcgtagtggactcggaatggccgcacttagccaatagatcagtgtattactaagtcgctcgtgtataatataacgcacacgggtccgatacctaggttgtttatcatgaagagcgcgcaagtcgatgatgcactcgcattaaaggaatgaagatatgcttcaaggaagggata

SEQ ID NO: 5435 - DNA, 373 bp, Zea mays
  Clone ID: LIB3279-049-P1-K1-F7
gcaccaggcgatgcaaaccagtcggttcacattgttgctgatgagggtttggaggcgtatctacctttggcgatatggttgacgtgtctgaagaggttaagcggctctccaagcgcctctccaagatgcagtcggagtatgatgctcttgttgcccgactcaattccccaagttttgttgaaaaggcccctgaagatattgttcgcggagttcgtgaaaaagcgtctgaggcagacgagaagatctctctaactaaaaatcgtctcacttttctgcaatcaaccattaccacttaaatacagtaattcacggggactctaccaggatgcctttttgatcgatgacgcaggagaaaactgattgttaatagttt

SEQ ID NO: 5436 - DNA, 217 bp, Zea mays
  Clone ID: LIB3279-049-P1-K1-F8
cccacgcgtccgaaaaagccctagccagatcagcgatggcaacgcacccggcgtccccgaccgccggcgctgtggcgacaggtcgccgtccggcccgccgccggtgcgcctgtctgcggcacaggcggtggcggcgatccagcctacctcaccgcggtacttattctgctcgcttgccgcttcctgtgccggggggatatccgtgcagcgacgcatg

SEQ ID NO: 5437 - DNA, 370 bp, Zea mays
  Clone ID: LIB3279-049-P1-K1-F9
atttacagctaaagcaaaatgctctatcaagttccttagaataaacaagccaatccctgtcacaactttctcatttgatagaattctattatagaatagtgaagaaaatcttctagaaaacctgtccttaggccccttctgaattgatagatctcttttaggtccgttttgtgctaaaatgtcaacttgtttaatattaagtgaatcccaatatcttggatcaaatatatcaggctgaaaagaatcaccagcatccgaagaaggattcaagtcttcgctgttattgcctatctgagtatttgtgttgtcagggagagcttcctcaacttcgacattattttctagaggatctatacgatcaatgtcaata

SEQ ID NO: 5438 - DNA, 111 bp, Zea mays
  Clone ID: LIB3279-049-P1-K1-G1
cccacgcggacgcccacgcggacgaaaaaggacccagggaccacaagggagaggagaagcgagacgagaagcacacaacaaacggagcacaacacaggaagcaggaagaca

SEQ ID NO: 5439 - DNA, 359 bp, Zea mays
  Clone ID: LIB3279-049-P1-K1-G10
aactcgccgtctgccttctgcgcctccatttcggcctctgtcccttgcaagttcaatctcacctccaacatgggtaaagagaagtcccacatcaacattgtggttattggccacgttgactctggcaagtcgaccaccacaggacacctgatctacaagcttggaggcattgacaagcgtgtgatcgagaggtttgagaaggaggctgctgaaatgaacaagcggtccttcaagtacgcatgggtgctcgacaagctcaaggctgagcgtgagagaggtatcaccattgatatcgctctgtggaagtttgagaccaccaagtactactgcacggtcattgatgcccctggcaccgtgac

SEQ ID NO: 5440 - DNA, 303 bp, Zea mays
  Clone ID: LIB3279-049-P1-K1-G11
cacccactctactactcgaagttactaccagcagcttgcgggaacagtagaagagagcgagccgaggatgcgtcaccgaagccctcgtcggcggccctgctcctcctggcggcggcggccgcgctggcgctggcgcgcgcggacctgacgcacgacaactgtgtgaagaacaagaaggtgacggtgcagaacctgtgcagccacgacgtgtcgctgacgctggagcctttgtgccaacagcccgtcgcttttcgtggtcaccgacgggttgtacccatgcattcacgccgatttccctttgtg

SEQ ID NO: 5441 - DNA, 247 bp, Zea mays
  Clone ID: LIB3279-049-P1-K1-G2
gtaggcacatattatctcacgcacgttgactccaagtaccgaaggttctatgacgtgaaaggtgacggtgtcaccactctgcaatgtccaacggccactgatctgtcttctgcccggagcttcaacaagttaaataacagaggcaggtgttcctaatcattttgacttcttttagattatctattaagaggggacgcttgagcttagattaatctctgccaagttataatggttttaaagttatttt

SEQ ID NO: 5442 - DNA, 378 bp, Zea mays
  unsure (1)..(378): unsure at all n locations; Clone ID: LIB3279-049-P1-K1-G3
cggacgcgtgggggcggactgggcggctgacggagccgcggagggaaccgagtggccccggcgacgcgaggccgagggagctaatctgacggcggcagtgacgactccaacgaccaggcgcggaggctgcactgctccagcgaaggcaccatgtcattcatgtctccattcccggggatggatctaagtaaaatggatcccgggactctgaccctccttggggcagctggttgtgtaatgctgactatgcatttcactgtgcaattggtgtcacaacatctcttctattggaaaaaccccaaggagcagaaagccatacttattattgtgctgatggctncactatacgctatctcttccttcgtgggtcttcttgat

SEQ ID NO: 5443 - DNA, 346 bp, Zea mays
  Clone ID: LIB3279-049-P1-K1-G4
cggacgcgtgggggcggactgggctgttgacggagccgctgagggaaccgaggggcccttgctacgcgaggccttgcgagctaatctgactgctgctgtgacgactgcaacgaccaggcgcggaggctgcactgttccagcgaaggcaccatgtcattcatgtctccattcccggggatggatctaagttaaatggatcctgggactctgacccttcttggtgcatatggttgtgtaatgctgactatgcattttactgtgcaattggtgtcacagcatcttttttattgtaaatacctctaggtgctgatagcaatacttttttttgtacttttggcttcatttt

SEQ ID NO: 5444 - DNA, 115 bp, Zea mays
  Clone ID: LIB3279-049-P1-K1-G5
gaaacgcttactttcttgtttgttttgatctaccttttttttccggggcggtggcaatgctaaattcaccttccattggggtaaagagaagtcccacatcaacattgtggttatt

SEQ ID NO: 5445 - DNA, 327 bp, Zea mays
  Clone ID: LIB3279-049-P1-K1-G6
cccacgcgtccgcggacgcgtgggctggatctggacatgccggctctggcttacatgatgaaggaataccctggaccgaagaagagaagatgcgagctgctgttggcaggtttggcctatcaggaaaggcgcaggtgatgccaatgaggaatctttctgatgggcaaaggagccgtgtcatctttgcatggttggcatataggcagccgcaactgctactgctcgatgagccgacaaatcatttggacattgagaccattgactccctggcggaggcactgaatgagtgggatggtggtttggtcttggtgagccatgatttcaggc

SEQ ID NO: 5446 - DNA, 366 bp, Zea mays
  Clone ID: LIB3279-049-P1-K1-G7
gatgaaacatctgtgcaaaagattcaggcactaacacctaatattggagttgtctatagtgggatgggtccgatttccgtgttctggtgagaaaaagtcgaaagcaggcacaacaatattatcggttgtacaaggaacatatacctgtaacacagcttgtacgagagactgctgctgtcatgcaggagttcacacagtcaggtggtgtgagaccatttggagtatcactgttgattgctgggtatgatgacaatggcccgcagttgtatcaggttgatccctcaggatcatacttctcctggaaggcatcagccatgggaaaaaatgtgtccaatgcaaagacgttttttgaaaagagatacacag

SEQ ID NO: 5447 - DNA, 367 bp, Zea mays
  Clone ID: LIB3279-049-P1-K1-G8
cctttgtgctataaaatggtctaccaccatgacacatgatatgtggtaaatataatataagtcacctgtaaactgtggcagatagaaatagaaaagagaggggaggaggaagtgtgtgcatatgtgtgcgcgcgcaaacagaccatcacagagagtattgtttctttcattaggactatgaggtctcgagaatcgaaggggccacaatgtatcaagcaaatgttataaggtgtatgcttgggctggtacgattggtgtagcaacctcattgatacaaccgtatgttgctagttatatgaaaggtgtaccaggggaggtgatcgaaagaaaatcctatgtgatagtgtggcacccagctttcatgcga

SEQ ID NO: 5448 - DNA, 346 bp, Zea mays
  Clone ID: LIB3279-049-P1-K1-G9
atactgatctactctaattgtataatgcttgcatgcgctcgctcactatatcgtacacttctcataatctgtcaaatgaagtgcgcctggcaattcctttccatggcttaaggacggcatggacatcaccaggaaatgtgtatgggttttgattgattactaattcagactttcgtttgggttcttatacacaacacagaatattgctctgtgatgtggcgcacattgtattaaggctatttttgggttcaaactcatctagaggcccttttgtgtttgcacagtatatttctgggggcaaccatgaacaaaatgtttatgctgacctacgtctatgcctcatttt

SEQ ID NO: 5449 - DNA, 376 bp, Zea mays
  Clone ID: LIB3279-049-P1-K1-H1
gtcctgataacatcaacatgagtgtcctaatactgatctgctataattgaataatccttggatggtattactcattagataatacaattctcataatctttcaaatgaagtgtgcctggcaatttctttccatggcttaaggtcggcatggacatcaccaggaaatgtgtatgggttttgattgattactaattcagactttcgtttgggttcttatacgaacaggaattgtcctgtgtgatgtcgggcattgtattaaggctatttttgggttcaaactcatctagaggtccttttgtgtttgtacagtatattactgtaggcaaccatgaaaaccaaaggtttaggctgacctacgtttaggcctcatttctga

SEQ ID NO: 5450 - DNA, 349 bp, Zea mays
  Clone ID: LIB3279-049-P1-K1-H10
gttcaaatctcacaatcttcttgtagcacaccactgtcttcgtccaactcggcggcgatgtctgggcgggcaagggcggcaaggggctgggcaagggcggcgcgaaacgccaccgtaaggttctccgcgacaacatccagggtatcacgaagccggcaatccggaggctggcgaggaggggcggcgtgaagcgtatctccgggcttatctacgaggaaacccgcggcgtgctcaagatcttcctcgagaatgtcatccgcgacgcggtcacctacaccgagcacgctcgccggaagaccgtcaccgccatggatgttgtgtccgccctcaagcgccagggccgcactct

SEQ ID NO: 5451 - DNA, 363 bp, Zea mays
  Clone ID: LIB3279-049-P1-K1-H11
tgccggaccgacccacgcgtgcggtccgcgacccagtcgagaacacgaccgcgccggcggtcgccctccatctcctcgccgctgcctgtctttcttttttcaacaatcaagatgagccgtggtggcagtgccggtggtggtcaaagttctctgggttatctctttggaagcggtgagccccccaaaccagcagtggcaccagctgcaagtgctccacctgttgagaaaccatctgctgcaaagactgatgcggccaagcaggttgctgctggggttaccagccaaaccaataactaccacagggctgatggtcagaacactggcaacttccttacggaccgtacatgaaccaaggtccacgct

SEQ ID NO: 5452 - DNA, 368 bp, Zea mays
  Clone ID: LIB3279-049-P1-K1-H12
gctgcccgtcgcccccaagcctaggttccgccggcgcgcgaggggattcgagctgggtcttgggtagcctctcaccgtctcacgatgccgccagcacccaagtccggcgacgccctcttcgccagcgtggatcgcgtcaatgcggagctgttcacgctcacgtacggcgccatcgtgcggcagttgctcacggatctggaggaggtcgaggaggtcaacaagcagctcgatcagatgggttacaacaattggaacacgattggttgatgagttcttagcaaagtcaaatgtatcaaggtgtgttgacttcaaggagactgccgatgttattgcgaagcttggcttcaaaatgttcttgggcgtgactg

SEQ ID NO: 5453 - DNA, 372 bp, Zea mays
  Clone ID: LIB3279-049-P1-K1-H2
cccacgcgtacgtccacgcgtgcgggaagaacctggtgaagaagtgcatagagctgctctttgagattgctgaaaacaggaggactacaacaagttctatgaggccttatcgaagaacctgaagcttggcatacacgaggactccacgaacaggaacaagattgcggagctgctgaggtatcactccaccaagagcggacatgagctgacaagcctcaaggactatgtgactaggatgaaggagggccagaatgacatctactacatcactggcgagagcaagaaggccggggagaactcccccttccttgagaagctgaagaagaagggctatgaagccctgtacatggtggacgccatcgacgagtatgc

SEQ ID NO: 5454 - DNA, 267 bp, Zea mays
  Clone ID: LIB3279-049-P1-K1-H3
atcatgctatcatcaacacgagcgttcaaattctgatctgctattacatgaatggggctcttattgtattgactctccagataatacaacttctcatatttctttcaattgaagcgtgcctggcaatttctttccttggcttgaacgccgccatctacatcaccaggaaatggctatgggtgtatattgacaactaaatctagacttttgctttcaatgcttatacgaccaggctactgattctgtgtgatgtcccgcttttcgcat

SEQ ID NO: 5455 - DNA, 307 bp, Zea mays
  Clone ID: LIB3279-049-P1-K1-H4
cccacgcgtccgatctcagcatcttacttttcatcttttagaaaaaaataaactccagccgcaaaggtacaataattcaaacatcactgccttatggagcgtaagaaattaggcactggccagagtgagcaaatgaactcactgtatcgcttctggtcatactatctgagagataattttaatgaagatatatacaaggattttaagaaactcgcactggaggatgctgcagcgagctacagatatggtctcgagtgtctattcagattttatagttatgggtttgaagaaaaatttccacccaatg

SEQ ID NO: 5456 - DNA, 297 bp, Zea mays
  Clone ID: LIB3279-049-P1-K1-H5
ccggcggcggcggcgacccagtcgagaacacgaaggcgatggcgacagcgctgaaccgcgggctccgctccgggctccgcctcctcgccgccggcgccgaggcgtccaagccagcttctcgtggattccatgccaccggcgtgaagagaatgggagggcatggccatgatgagccatactacatccatgccaagcacatgtataacttgcacaggatgaagcatcagggtttgaaggtgacactctccgtgctgggagcggttggcatcggtgttggagtccctgtgtatgcagtca

SEQ ID NO: 5457 - DNA, 319 bp, Zea mays
  Clone ID: LIB3279-049-P1-K1-H6
cccacgcgtgcgggcgctgcagatcatggagaagctggagatcgtgcgcaagatggtgtcgagcgcttgcggcggacccctcttgacagaggcacggtgttcgccaggaaggtggacctcaccggtgtcgacggtcaggcgctcgccggccacgggctcgggagcaacttatcagtggtgatcttcgtgctgctccacaacgtcttcagcaacgtcaagtcggacatcgatggcatggtctctgcttccactccttattagccatcgtcacctagctaccctacgtgtctacagatttgcagtcactagccctaaagtc

SEQ ID NO: 5458 - DNA, 364 bp, Zea mays
  Clone ID: LIB3279-049-P1-K1-H7
ccgaaatcccggaggacctgtacttcctcatcaagaaggcggtggcgataaggaagcaccttgagaggaacggaaggacaaagactctaaattcaggctcattcttgtcgagagcaggatccaccgccttgcccgctactacaagcgcacaaagaagcttccacccacgtggaagtacgagtcaaccactgcaagcactctggtggcctaagcgaggagctcagcgtcgggcgcttgaagccgagggcattgttggaaatcatttttatgtaccgttttaagagtttggagtgaactagagatggtgaatgtccctcctctggaggatgccatggaccctttttgtttacatagaactgccctg

SEQ ID NO: 5459 - DNA, 342 bp, Zea mays
  Clone ID: LIB3279-049-P1-K1-H8
ccgaaatcccggaggacctgtacttcctcatcaagaaggcggtggcgataaggaagcaccttgagaggaaaggaaggacaaagactctaaattcaggctcattcttgtcgagagcaggatccaccgccttgcccgctactacaagcgcacaaagaagcttccacccacgtggaagtacgagtcaaccactgcaagcactctggtggcctaagcgaggagctcagcgtcgggcgcttgaagccgagggcattgttggaaatcatttttatgtaccgttttaagagtttggagtgaactagagatggtgaatgtccctcctctggaggatgccatggacccttt

SEQ ID NO: 5460 - DNA, 373 bp, Zea mays
  Clone ID: LIB3279-049-P1-K1-H9
cgacgcgcctctgaaagttcggagccgccggcccgtccgcctccctctccgcctcccgtccccaaggccaaagttttcaagtggcaatggcggaccaggctaaccaacccactgtccttcataagctcggtggccagttccacctgcgctcgatcatctctgaaggtgtacgggcccgtaacatatgcccatctgtctcatcttatgaaaggagatttgccacaaggaactacatgacccagagcctttggggcccttcaatgtctgttagcggtggcatcaatgtcccagtgatgcagaccccgctctgtgctaatgctcctgctgagaaaggaggcaagaacttcatgattgatttcatgatgggcggtgt

SEQ ID NO: 5461 - DNA, 385 bp, Zea mays
  Clone ID: LIB3279-050-P1-K1-A10
gttctaaggatctgaagcgtgggaggagctacttgaggtctgcatctcctcaccatgggaagggccgagggagaagtactcaaggtctctatctccttaccttggaaggggccgagggagaagctactcgaggtctccatctcattatcatcgcaggggcagaagctggagttacagtcggtcgcactcgccaaggaacaactctaaggcttatggtgaagaattgccatcaactagatctggttatagccgcggccccaggaggagctccccaccgatggagcgagctgaatgcaatggtggtagccccatgagaggtgaagctcgggggaagtgacagcgacctataaaatcactctgggattgtaaagtgtcaaacatttgg

SEQ ID NO: 5462 - DNA, 380 bp, Zea mays
  Clone ID: LIB3279-050-P1-K1-A11
gccaaattatgccaagcttatctctatttttgatggtttgattgaagcacctgcgtcgagaccagtcagaattgatgggccctcaaggttggacagaaacgtggaagattgcatgcaaatctagaagatgaacaacctaaaaagaaggttagattagggagcccagcggctcaatggatttcagtttataatgctaggcgacccatgaagcagaggtaccattacaatgtggctgactcaaggctaagtcaacatatagaaaagggtaatgatgacgggctttacgttagttgtgtggcttcctcggcaaacctttgggcactcatcatggacgctggaactggtttctgttctcaagtttacgagctctcaacagtttt

SEQ ID NO: 5463 - DNA, 195 bp, Zea mays
  Clone ID: LIB3279-050-P1-K1-A12
ggttcgtgaggttctccggggttcggtttcgtgggtgagcggatcgagatggcggcgtcggatgttgagtaccgctcttcctcggcggcctcgcctgggccacggacgaccactcccttcacaacgccttcagcacctacggcgagggcctcgagttccaagatcatcctctatcgggagacgcataggttccgc

SEQ ID NO: 5464 - DNA, 386 bp, Zea mays
  Clone ID: LIB3279-050-P1-K1-A3
gtgttataccatatgaatatatatcatacaagactagaattttgatactcataggagtatggaactgagcagggtcagctgtgggaacaacggaggtggtggagcaaaaccttgtgcggcgccatggctctgcatgtaatggaacatctctgccatcctctgctgatttgccaagcgatccaaccgctccgcctcccgctccgccatcatcctcgcctccatctcctgctgttccctcatctcttcttctagctgggcatgtaacatttcatcccaatgctataataactcagagaaggtatataactcaaggaatgacaagttcagggccggtcgtgacatttgggggccctaagcgaaaatctatatggaggccctatacgaac

SEQ ID NO: 5465 - DNA, 253 bp, Zea mays
  Clone ID: LIB3279-050-P1-K1-A4
cccacgcgtccgcaggaacagagcgaggcgacgccgcggcacctcttctccggcgaagggaaatggcaaccgttccaggggtctgatctggcaggttgtgaggaagaacaactccttccttgtgaagcagttcggcaacggcaatgccaaggtgcagttcaccaaggagccgaacaacctctacaacatccactccttcaaacactcgggtttggcgaacaagaagactgtgacgatccaaccagctgcaaaa

SEQ ID NO: 5466 - DNA, 96 bp, Zea mays
  Clone ID: LIB3279-050-P1-K1-A5
ctgagcaatcgtaagtttgaaaggccttgctgaaaacaccacctttagtggggcggataataaacggtctccttctggaaaggttgaggggggggt

SEQ ID NO: 5467 - DNA, 289 bp, Zea mays
  Clone ID: LIB3279-050-P1-K1-A6
gacgatgacgacgacttggacaacgttcctctcgcactttccagggccaagaggggaaacgagaagcagaaaggcaacaatgcaatatgaaggcttcttcaaaagtcaagaaagaagtcagttctgatgatgattttgtcatgccaacggcgcaaaaaaaaagtgcaggtgctgctggaagtattgccaagacatccaaggttaaaaaaattaaagatgaaaatttggaagatctcaaggaggccaggaaaaggaagaaacgagtgggtgtcaaagaaaaggcaaagtt

SEQ ID NO: 5468 - DNA, 363 bp, Zea mays
  Clone ID: LIB3279-050-P1-K1-A7
ttggcctgcgggagacctacttcaactgcaagaggggccaggttgacatgcgggcccgaatacgcgggaacaagggtactagtgatgtgcctgcaatatccacaatcagttttggtttctagccatgcttctgtgacattgaggtgtaatgataacatggtttagtttgcccgtgttctgtttttgataggtgaggggaactcacaacacacgtggcttcaattgatgaggggagtgcattcctgtctacattctatacatttgatattccctctgttttaaatgtttgacgttttgttactatgatctgtgcgtgtagcaaaagttaatctatggcccgtttggtttagccgtagattcctg

SEQ ID NO: 5469 - DNA, 271 bp, Zea mays
  Clone ID: LIB3279-050-P1-K1-A8
ttagctttagaacgagggtacccgagactgcctatgatgcgggcattaatgacgactctagtccaacagaacagggttgcttgtgatgtgagtgaaatataaaacattagattgggtttatagcgatgccactgtgtcattgacgtatgatgatgacatcaattaacttggcagggttcaggttttaataggtgaggggaactcacaacacacgtggattcaattgttgaggagggttacttaatgtctacattctatacatttattattg

SEQ ID NO: 5470 - DNA, 229 bp, Zea mays
  Clone ID: LIB3279-050-P1-K1-A9
ggcggcgccgtcctgctcaccgcctaaggttcagtgctcgttcgcctgctggttttgaaatctatatctgaactgaagtgttttcctgtctcatcattttgagttaagaaaacctgttgttctaaaatctgtggttcctgcctgttgtgcagtgctaattctgttgtcgatgccggctcatatcaattatttcacatcaattacatctatcctcgctatcagttgtgct

SEQ ID NO: 5471 - DNA, 381 bp, Zea mays
  Clone ID: LIB3279-050-P1-K1-B1
cccacgcgtccgaagaacaccactgcctatgagaattacaagaggatctttgtacctgagggccagccgctggaaagcgagcaaatgagccactgcgagtgaatgtgctcttcaagcacgtccagaagatgttgactggtgatagtgcggtgattgctgagactggtgactcctggttcaactgccagaagcttaagctgccagaaggctgtgggtatgaattccaaatgcagtatggttcgattggatggtcagtgggtgcattgctcggatatgctcagggtgcgaaccacaagcgtgtgattgccttcattggtgatgggagcttccaggttacagcacaggatgtgtcaactatgctgcgatgtgagcagaacagca

SEQ ID NO: 5472 - DNA, 321 bp, Zea mays
  Clone ID: LIB3279-050-P1-K1-B10
cccacgcgtccgcccacgcgtccgtcgggaaccgccgccgacgccgcaggaggagacgcatcgaggagagcaagcgtgaagcgaccatgagggccaagtggaagaagaagcgcatgaggaggctcaagaggaagcgcagaaagatgaggcagagatccaagtaggcagatcgagatggattgtggacctgatgacatgcgtgggtacatacatttcttcggatgcgttggtgtgcctgtggagagatgtcaacctgccatggtgtcaacggtccgccatcagttgaacgtcttgcctgcacttcagtaggccatttttcat

SEQ ID NO: 5473 - DNA, 379 bp, Zea mays
  Clone ID: LIB3279-050-P1-K1-B11
ataaaaccctaaacccaggacccaggtttatcggtgaggcgagccgcgagtggaactgtggaagcgtcgagctttttcttctttgtcttgctgcgcaagaagaagggaaacgagaggagggcggcgatggcgaagaggctgctcccgtcgctgaaccgggtgctggtggagaagctggtgcagcccaagaagaccgccggcggcatcctcctcccggaaacatccaagcagctgaatgctgctaaagtggtggctgttggccctggtgagcgcgacaaggcaggcaatctgatcccagttgctctgaaggaaggcgacactgttcttctgcccgagtatggtggatctgaagtcaagcttgcggctgataaagagtacc

SEQ ID NO: 5474 - DNA, 349 bp, Zea mays
  Clone ID: LIB3279-050-P1-K1-B12
ggacaccagatgcaaatgctacatctatggttgctggaccagaacttgatgtattaagtgccatagagaataaccagggacgttatgttgaaagcgtcaaattgtactgccttttgattttttggaacgagttcggatgcgagagtttttataaagtttcgagtgtaaccagagctgattcactatcggtggagttactgaggtacttgtattgacataaaatttcaggcctatcgtgtttgctatggtttgttcttggacaagcgcaggttcatcaaggtttaaatgattatgccaaatttttttaagtttgccatatttatcatttgtgtgcgtagtatattaggtc

SEQ ID NO: 5475 - DNA, 381 bp, Zea mays
  Clone ID: LIB3279-050-P1-K1-B2
cccacgcgtccgcgcagcccaacccgttcccaccaaaccagcggcaccacccatggcttcggcggcggcgagatccggtctcggtcgctggcggtgcgcgccgccccgttgaggcgccgcatgtcctcctccgtccacgacgacgcctatgagacggccaagtgggagaagatcacctacgccgggatcgtgacctgcaccctcctggcggcgtacaacctgtccaagggccacccccacttcgatgagccgccggcgtacccctatcttcacatccgcaacaaggagttcccatggggccctgatggcttgtttgagacgaaagaccaccactgagccctgattagcacaccttcaggagctggtgcacgcttaaaagag

SEQ ID NO: 5476 - DNA, 384 bp, Zea mays
  Clone ID: LIB3279-050-P1-K1-B3
gtttcttcttcccttctttttaggggtcgcttttgacaagggttatattatatatatatgatggtcctccttgatattttcccatttgctcaacctccccccctgctcccgacatggaaagctacctggagcagcaggcgtgaagcgttgctgattggtcgctcggtctctctattagtcgtctgatctgagtgttgcgtgttgttccctctgcctacaagcaagtggtgtatgttgagggcagggggtgcgtgcgtgcgtgttgtgtgtgatacttactcacttggttgttgtgttgagaaaaaaaagggtcagattgttagtagcggtagtactacatgttacgcctggacagactgggatggaatggttgtacaagacgtg

SEQ ID NO: 5477 - DNA, 364 bp, Zea mays
  Clone ID: LIB3279-050-P1-K1-B5
cggacgcgtggggcttgctccatacaagattccaacaagactatacttgtgggattctcttcctcggaatgccatgggaaagttaacaagaaggagctgaagaaattgttaggagcttagccatgtgtatagatgtatttatctcttcatttccttcttaaagtttagcaagtcgggctcattatattgattagcgaataagtgctttcgttaccatggaccaataatcttcgaaacggcctgagttagactgcaaaaaaaaaaaatattaataatataaaatataatatatttttttatataataaaatattatttttaataaattaaaaaaagggccgggctctcgaaacccttagtgcgtg

SEQ ID NO: 5478 - DNA, 353 bp, Zea mays
  Clone ID: LIB3279-050-P1-K1-B6
gccgtcgcacaagaccttccggatcaagaagaagctggcgaagaagatgcgccagaaccgccccatcccctactggatccgctgcgcactgacaataccatcaggtacaacgccaagcgcaggcactggcgccgcaccaagctcggcttctgagcgtcgggattggccggctgctgcgtcggaaggctagggtctaagagctatcttctgttttatcattgtctctgtttctgtaagctagcaagtgatgctgtgatgcttttattaagattctgatgagtggtgacgttaagagaaaattggcagtactgtgttgtaccccaagattccttgcagcattgctatgctaaaaa

SEQ ID NO: 5479 - DNA, 353 bp, Zea mays
  Clone ID: LIB3279-050-P1-K1-B7
aagctcgaccaccaacccagctcgctcgtcccagctgatcaggtcgagcacctagtagcgacctgctcgatcatcatgtagagtgtcggtaggtgtctgtctctcttggtggctggttgcaacggtcatggcgacgtcgtctcgtcgggtgcccttgctgctgctgtgcctgggcgtgctggtgtcctgctccttcgcggcgggcagcttggaccaggagctggacatcacgtggggcgacgggcggggcaaggtccttgacaacgggcggctgctgacgctgtcgctggaccgcacgttcggctccgggttccagtcccggcacgagtacctgttcggcaagatcgacatgc

SEQ ID NO: 5480 - DNA, 276 bp, Zea mays
  Clone ID: LIB3279-050-P1-K1-B8
cgtttcgcgtacgactcagcccgcctcaaggagaggtaagttcaggagacattttcgagaagctagaatggctcctaagctgttcctgccaagaagggtgatgccaagacccatgcctttaaggttgccaaggctgttaagtctggggcagccaataagaagaccaataatatccgcacgtatgtgacatttcactcgccccacgaccctttagaaggctagggtcctcaagtacccacgatttcatcactaccgaagggaacattgctttgatca

SEQ ID NO: 5481 - DNA, 147 bp, Zea mays
  Clone ID: LIB3279-050-P1-K1-B9
cggacgcgtgggcgacacgctgcgagagggggaaagaacttagaagggcaggcaggagaagcgacacaggaaactgcgtcgccttcggcggcctgctacttaaataaatcccctcgcctcgccttcggctggcttttcccttttttc

SEQ ID NO: 5482 - DNA, 165 bp, Zea mays
  Clone ID: LIB3279-050-P1-K1-C1
cccacgcgtccggagaagaataggaagttcactgagactgtggaacttcagattggtctgaagaattatgatccacagaaggcaagcgtttcagtggctctgttaagttgccccatatccctcgtcccaagatgaaggtgtgcatgcttggtgatgcccagcatg

SEQ ID NO: 5483 - DNA, 383 bp, Zea mays
  Clone ID: LIB3279-050-P1-K1-C10
caacatcagcgacggcctccagacggggctcaaggtcctcgccgaccgcaagctcagctccggtcgcgtcgttggctcatgctcatgtccgacggccagcagaaccggggcgagccagccgccaacgtcaagatcggcaacgtgccggtgtacaccttcgggttcggcgcggactacgaccccacggtgctgaacgcggtggccaggaacagcatgggagggaccttctccgtcgtcaacgacgtgaacttgctgagcatggccttctcccagtgcctcgccggcctgctcaccgtggttgtgcaggacctcaccgtcacggtggcgcgcatcgaggatgagtccaccatacagaaggtggccgccgggaactacccgcagac

SEQ ID NO: 5484 - DNA, 345 bp, Zea mays
  unsure (1)..(345): unsure at all n locations; Clone ID: LIB3279-050-P1-K1-C12
atgatgttcagtctctgcattctctcaactcatttgactatccttttacagttgaccctgaagatattccattgggaaggttcaagttaaatcctcaggacatgttctgccatatgttggcgttgcttgtttgggggctattctgtttggttaccatcttggtgtggtcaatggcgcacttgaatatctcgcgaaggatcttgggattgctgaaaatgctgtcttgcaggggtgggtggttagcacatccttggctggtgcaacactaggttcttttactgggggttctttggcagataaatttgggcggacaagaacattcatcctggatgcagncccacttgc

SEQ ID NO: 5485 - DNA, 365 bp, Zea mays
  Clone ID: LIB3279-050-P1-K1-C2
cccacgcgtccggccgagttcaagaagatgtttgacctcatcgagcagtacaacctgaacgggcacatccgctggatctccgccagatgaaccgcgtccgcaacggcgagctgtaccgctacatctgcgacaccaagggcgccttcgtgcagcctgctttctacgaggctttcgggctgacggtggttgaggacatgacctgcggcctgcccacgtttgccacaacctacggcggtccggccgagatcatggtgcacggcgtgtctggctaccacattgacccttaccagggcgacaaggcgtctgccctgctcgtggactttttcgacaagtgccaggcggacccgagccactggagcaagatc

SEQ ID NO: 5486 - DNA, 383 bp, Zea mays
  Clone ID: LIB3279-050-P1-K1-C3
gggttttgctgctctccgaccccgagctccgaaggccgcagcatcaggcgaggcccccctcgcgtgtgaccgagatggcgctccgaatcaggggaccgttgattaccccagcttcaagctcgtcatcgtcggcgatggtggaactggtaaaactacatttgtgaagaggcatctcactggagagtttgagaagaaatatgaaccaaccattggtgtggaagttcatccgttggatttcaccactaactgtggtaagatcaggttctactgctgggataccgcagggcaagagaagtttggtggcctcagggatggatactatatccatggccagtgtgcgatcatcatgtttgatgtaacctcaaggcttacttacaagaatg

SEQ ID NO: 5487 - DNA, 375 bp, Zea mays
  Clone ID: LIB3279-050-P1-K1-C4
cccacgcgttcgaaaggcctctagaagcaatcaggccagcggcggctgcggcgcgatgggagagcaggtcctgactgagcgttccagcggaagctggaggaggccaacgctaccgtacaacagcaccttgccggcatgcaggaccacgtcaacttcaccatgcagcaagcatacttaaagtgcgcatatgattgctttgatcggcgcccatctcaggaagcgatcaacaattgtgtggagaattgtggtatgcctgtccttgctgtcaacaatgtttttgagagtgagatggccaagtttcaggaacggatgaaccggtcattgatggtgtgccaagataagtttgaagctgccaagctccagaagatgaaaaca

SEQ ID NO: 5488 - DNA, 149 bp, Zea mays
  Clone ID: LIB3279-050-P1-K1-C5
tgcactcgatgcaactcccgttcgctttctaatcggcccatacatgagaatgggacccctcattcgtccatggacttgacctcacaagaacaggttcaaagaggaaaaaaggagccagcttatcaacgggaaggaggccatagaagaaa

SEQ ID NO: 5489 - DNA, 338 bp, Zea mays
  Clone ID: LIB3279-050-P1-K1-C6
cccacgcgtccgcggacgcgtgggcggtgatgagctgagcctggagtgtgctggctcttatgctttgaaaggggatctagtggatatggaaggcagacattgcctggactaattaaagatggaatgagtgctctttcaagatattatttgaataattttcatgacggagtgcggcaagatgctcttgaccttattagcggttattatacagtcagccaaggcagctcttctccttttaataatggtggtgattcttcttcgtatctgccggtggcttcagcaatcatagttggtgggattaccgcgacaactttcactctcagtcaagtgggacggaa

SEQ ID NO: 5490 - DNA, 343 bp, Zea mays
  Clone ID: LIB3279-050-P1-K1-C7
atgatgttcagtctctgcattctctcaactcatttgactatcctttgacagttgaccctgaagatattccattggaaaggttcaagttaaatcctcaggacatgttctgccatatgttggcgttgcttgtttgggggctattctgtttggttaccatcttggtgtggtcaatggcgcacttgaatatctcgcgaaggatcttgggattgctgaaaatgctgtcttgcaggggtgggtggttagcacatccttggctggtgcaacactaggttcttttactgggggttctttggcagataaatttgggcggacatgaacattcatcctggatgctgtcccactt

SEQ ID NO: 5491 - DNA, 356 bp, Zea mays
  Clone ID: LIB3279-050-P1-K1-C8
cccacgcgtccgcagtggtccaggacccagaacttgtacaggtcattcagctccagggtgatcagaggaagaacgttcgaatttccttgtccaggccggcattgtgaagaaggagcacatcacgattcatggtttgtgagcaaccgccgggtccatagcaaaccaaccctgcatgcagggccagcttattatatataatatctgaggtggagcatatctatctgtctgtgtactgcaagcaggcctagtacgccggctgcgcgttcctgctattacacatataggcccctccctgcgtgtatgcttgttaccgtcgtgttgaaccttgtactacgaggctccatcgaacattgatg

SEQ ID NO: 5492 - DNA, 282 bp, Zea mays
  Clone ID: LIB3279-050-P1-K1-D1
tctgggaccatcaagacgctgtcttgtgctgctctttcaaggaaaagcctgtgggtactttcggcaaccagatgggagttgcatgttagaaacgactttagtcgctctgcaagatctcacccttgacaagatctttgacgagcctggtagaaaggcactacatgcggaggtttcgaaactgatggaacagggctatgcatacctgccggctggggtgtgcctgtctgggatgggccgccatgtcttctacgagcaagctgttgcttggaaagttctcggtga

SEQ ID NO: 5493 - DNA, 388 bp, Zea mays
  Clone ID: LIB3279-050-P1-K1-D10
tcggcgaccacaccgtttcttcgagcccaagagcatccccgcgccaggaggaagtttgttcttttaacaatatgtcgagggggagaatgtttacatggccaagttggctgagcaggctgaaaggtatgaggagatggttgagtatatggagaaggtggctaagactgtagatgtggaagagctcactgttgaggagcgtaaccttctgtctgttgcatacaagaatgtgattggggctcgccgcgcttcatggcgcattgtttcttccattgaacaaaaggaggagtcccgtaagaacgaagagcatgtgaaccttatcaaggaatatcgtggcaagatcgaggctgaactgagcaatatctgtgatggcatcttgaagctgcttgac

SEQ ID NO: 5494 - DNA, 261 bp, Zea mays
  Clone ID: LIB3279-050-P1-K1-D11
tgcacatcccgcaccgggcgcccgacctccccgccaaattcaagtccatgctcgtgcccggcaagatccaacacatatctgcactggcaatctctgcatcaaggaagtccatgactacctgaaaagcctttgccctgatctccatattaccagaggtgaacatgatgaggatgctcgatacccagagactaagacacttacaattggtcagtttaagcttgggctgtgccatggccatcaggtggttccatggggcgacct

SEQ ID NO: 5495 - DNA, 412 bp, Zea mays
  unsure (1)..(412): unsure at all n locations; Clone ID: LIB3279-050-P1-K1-D12
tgccgtccgcagaaaaaagggnttgtctccacttacccacctgtgtanntcctccttngtttttcagcgaggctgtctggagtctgtctgnnctttttccgcatcgggccaatatgcctctgtccgccgtgaaggtttccgtgtcccgcgacccgcatgtctggagtcagtcctgagcaaaggtgtgttatgcagagcgtgattatgacgctgttttgcactgaagtctaaagagtaagtaagataggtgtcagataggaaggctgctgaatggactctaaattgtacactataaaatttatatggtgtttggtttgtttcattcaaatttaggtggtcatcatgagttcatttcttaaatatggtgtgatgactcaattctttatattagtactaactggtgtgatgactc

SEQ ID NO: 5496 - DNA, 389 bp, Zea mays
  Clone ID: LIB3279-050-P1-K1-D2
tcccgccgcgccgtctcaccgccgccggagaagatgggtcgcgtgatccgcgcgcagcgtaagggtgcggggtccgtgttcagtcccacacccaccaccgcaagggccccgcccgcttccgctccctcgacttcggcgagcgcaacgggtacctcaagggcgtcgtcaccgacgtcatccacgaccccggccgtggcgcgccgctcgccaaggtcactttccgccacccattcaggtacaagcaccagaaggagctctttgtcgcagccgagggcatgtacacgggccagttcgtctactgcggtcgccgcgccaccctatgcatcggcaacgtgctgtccctgcgcgggatccctgagggtgccgtcgtctgcaacgtcgagcaccac

SEQ ID NO: 5497 - DNA, 239 bp, Zea mays
  Clone ID: LIB3279-050-P1-K1-D3
tccttccgctccttcttaacgccgagctataataggcgtcgcttaaggcgagggcagcttatgggtgcaccgtacaatttctgtctattatcgaccacgctaagtgccccacccttaagcctgttatttgactttatgggcgcaacgggtacactacgggtgtgaagagggatctcattgacgaccgtgagcagtgatctcagccaaccattgtcgctttaatccacccgttgatgttc

SEQ ID NO: 5498 - DNA, 369 bp, Zea mays
  Clone ID: LIB3279-050-P1-K1-D4
caacaagtacgcaggcagcgcagcctcgagccgtcgccatggcgagcaagcacctcgtcctcgccgcatgcctcctcctcctgccaccgcctcggtcgccaccgacgtcgactactgcagtaagaaggactacccggtgaaggtgagcggggtgcatatcgtgcccgatccggtcgaacccggcaagcccgccacttttaaagaatctccgttctactgataaaaccaatcgagaaaggggaagctggttatcgacgtcaagttttttttcttttacgtgcactcggagacccgcgacatttggggggagacttcctgcccagcgaccggggatttttggctgtccaaccagcagacgctgccaggctt

SEQ ID NO: 5499 - DNA, 389 bp, Zea mays
  Clone ID: LIB3279-050-P1-K1-D5
cggagagccgcgacgtcggccacggcttccgctgcgtccgcatggtcaacaacatctacctcaacttcgacgccttccacgggacaaggaccacggcggcgtgcgcgacggcaccaacatcgtgctctggaagtggtgcgagggcgacaaccagcgctggaagatcgtcccctggtaaatgtgctgttctgtggctgcactggtcatcaccatgatctggagctttgaaggcatagccacctgtggtcagcagctgctgccgtgttgttagaataaagttggtggcgatcgatcgatctgtggtgatgagtgtccctatctgtgtgtttgtgtttagttccagtcgtctgtgaggaagtcagttatgtttgagtgagaggggtacttcg

SEQ ID NO: 5500 - DNA, 102 bp, Zea mays
  unsure (1)..(102): unsure at all n locations; Clone ID: LIB3279-050-P1-K1-D6
gtgaacgtaagcgagccatattctttggtatgcagtctgaactatatgttaacgtttgggatttttgttaacatgaagtatctgcttggttgccttgnaaaa

SEQ ID NO: 5501 - DNA, 372 bp, Zea mays
  Clone ID: LIB3279-050-P1-K1-D7
cggacgcgtgggcgagcacaagagccccgagcacctcgtccgcaacccgtttggtcaggttccagctctgcaggatgtgacttgtacctcttcgaatcacgagcaatctgcaagtacgctgctcgcaaaaacaagccagagctgttgagggaaggaaacctcgaggaggcagcaatggtggatgtttggatcgaggtggaggctaaccagtacaccgctgcactgaatcccatcctcttccaggtcctcatcagtcctatgcttgggggaaccaccgaccagaaagttgtggatgagaaccttgagaagctgaagaaggtgctagaggtgtacgaggcacgcctgaccaagtgcaagtaccttgctggagac

SEQ ID NO: 5502 - DNA, 278 bp, Zea mays
  unsure (1)..(278): unsure at all n locations; Clone ID: LIB3279-050-P1-K1-D8
agcagctagctctggttccgctctgcgcggcgtaccggccgacgacgacacgatgcctttataggaagctcattcctcctcctgctcctgcatgccctgcaatgcctaacccttgttctaggagacatgacgagcacgacacctgccgccgatgaccggggcgtggtggacgtgaacacgacggcattcaccatgcatgactctgctgcgtgggcgtctcccgatggtgccgaaaaccttgaaatgtactactgcttnctctggacggaacgacaccc

SEQ ID NO: 5503 - DNA, 383 bp, Zea mays
  Clone ID: LIB3279-050-P1-K1-D9
aaactaaactgtatgcaaactggcaatggttcaaatttctgcatcatagctaagctgctgacaacagcgacagagaatatctggtacttgttgaccatgcaaaggtgaactgtcgctagagaacctgccaacctgttgaagtccaatactgaccactggtgggtagttctccacttccataacccagcatcagtcatggagaagtatgttggacaggaacaggcaacttcatcccgcagacaagatagggtacaaggtttccaggctgcagaacattggtgtttcgaattgcctcattcctagtgcccctggagtgaaatgttgtgatatcattttatctgtccggagaatgtagcttcattgcattcatgttatgtcaaaac

SEQ ID NO: 5504 - DNA, 380 bp, Zea mays
  Clone ID: LIB3279-050-P1-K1-E1
gtcgcggcgtgagcgagcgagaggggaaaacccaaaaccctagcacccccgccccgtctccgacggccgccggagtagagagtggcggtggacgaggtgaactcggtctacgtcggcggccttccctacgaggccaacgaggagatgcttcgcgacgccttcgggtactacggcaccatcgtctccgtcaaggtgattaatgatcatgctgtcaaaggcaagtgttatggttttgttactttcactcaccccagagctgctgagcaagcaattgcgggcatggacggcaagaaattaggcaaccgtattgttcgagtaaatgaagtgcgtacaagaggcccccgcgattttggccgagatggtttcagacgagatccaag

SEQ ID NO: 5505 - DNA, 106 bp, Zea mays
  Clone ID: LIB3279-050-P1-K1-E10
gttgagccgagggttccacagcgattttgtacttcgactgtgttcttgattttcaagtttaatcaaaggaagggtcacggtccagcccacagggctatttggcttc

SEQ ID NO: 5506 - DNA, 386 bp, Zea mays
  Clone ID: LIB3279-050-P1-K1-E11
gcaacatctcattcagtgaagagcccgtagtgaagacagcaaagaaaatccacaaccagaagttccaggagctgacagtaacaacatcttcaaggaggacgtcccttcctcagccgagaagtctctgagctctgcgaagctgaaggagatgagtggcagtgacatcttcgccgatggaacgccagctccccgagaatacctcggcggcatccggaagccccctggtggcgagagcagcatcgcgctgatctgattgtcctggactgctttaattcggaccggctgtagctcccatcgccactaaagctcgcagagagtgcatttctcgacctctcgatcctccagtcgtgttgggatcataatttatgttgggtatcgttagtcta

SEQ ID NO: 5507 - DNA, 386 bp, Zea mays
  Clone ID: LIB3279-050-P1-K1-E12
gttcaatggaccagtacgccagaaatcgaagaagcaacctagtcaatcattggatgagaacacccaaaatgccagccaagcaataggaagagaaaaccagatgtctctattgttctttcaactgcaccagaggatgcccctactcactggcagcagacccttttgtacttgtttgaacctatagaactaaacaaagatcagatcatagaaggctctgttactatctcccagagccagcaacatgctcgcttccttaacatctgcctgaaatactttactggcgaccaatggtatgtcaaagaatctgtgatgcgataatctgggggaaactgaaacatagtaaccttctttctgaataggctcaaatctgttttgtatgaaggaca

SEQ ID NO: 5508 - DNA, 382 bp, Zea mays
  Clone ID: LIB3279-050-P1-K1-E2
cgatgctgatgactccgatgtggagcctaaaagcgatgacgagagcgatgaagatgatgatgacgacgacactgaagctctatggcagagcttgagaggattaagaaagaaagagccgaggagaagcttagaaaggagcggcaacaagcagaagaggaggccaagatgaaggaggctgaactgatgcggggaaacccgttgattaatatcaacaatgctggctccttcagtgttaagagaaggtgggacgacgacgtggtattcaagaatcaagcacgaggagagaccaagacaccgaaacggttcatcaacgacaccatcaggagtgatttccaccgtaaatttcttcaaaggtacatgaagtgacgcttccgtcgttcac

SEQ ID NO: 5509 - DNA, 343 bp, Zea mays
  Clone ID: LIB3279-050-P1-K1-E3
cataccaagaccacatcggcacatcgacgtgagctcgtgcgtgagtgccctggtcgacgacagctcgcgcgccatggactcacgacgacgacggcgccgctgctgcagccgtccgccgcctcgagcaaggaggggccggcgccggcgccggctcagcacggtgagggcagccgggagctggaggcgatcctggccgacgcgtccaagccgtgggcttggcgggcctgggaaggcgcccgcctggagctgccgctgctgctgcgggtggcgctgccggcggtggccgtctacatgatcaacttcgtcatgtccatggtcaagcatatcttctgagggcagcttg

SEQ ID NO: 5510 - DNA, 390 bp, Zea mays
  Clone ID: LIB3279-050-P1-K1-E4
cggacgcgtgggatcagagtccgagcctgctgctgttgctgctccagcgtctgaaaccaaatcagacgccgagcctgctgccgtgctgctccagcgcctgagaccaaatcagatgccgagcctgctgctgctgctgctccagtgcctggaaccaactcagatgctgctgctactgatccagcacctggaaccaaggccactgccgccgatccagcacctggagctccagcagagaactccaccgacaaagacggaagccaggagagccagcccgtgaacaatggacagctgccgcactcgacggtgaagtgcacctgaagccgcaacgccggaaaaacctgaaccccttccggcgccgtgtatctcatttaggaacaaacattcgcattc

SEQ ID NO: 5511 - DNA, 331 bp, Zea mays
  Clone ID: LIB3279-050-P1-K1-E5
gccaaaaccccaatcgcacaggagagaccgagagagaggttttccatccatggctcccggcgtcgcttccgtgctggtcccgatgagcccgtcctcctcaaggacatcctcgcctcaccgtccccctgcgggaacaccgctgtctccgcccgccacctcttcggcaacggagtcgcgccggcacgctccttggacgacggcatcaaggacgccgctgccgaccgccacggtgaccgcgacctctccatccccaagatcttcaccggagacgtgctggacctgctcgacgttgctgcaaggctggacctgatgctggcgctgtcggtggacg

SEQ ID NO: 5512 - DNA, 384 bp, Zea mays
  Clone ID: LIB3279-050-P1-K1-E7
cccacgcgtccgcccacgcgtccgcaaaggcaaccaaaccatctcgactcgtggggaagtttcgctctcgcgggggtgacttcctagggttcgaggaacgtccgtccgtccgtccggggaaggtgcaggagggaggcggagatgatcgaggtggtgctcaacgaccgcctggggaagaaggtgcgggtcaagtgcaacgaggacgacaccatcggcgacctcaagaagctggtggcggcgcagacggggacgcgccccgagaagatccgcatccagaagtggtacaacatctacaaggaccacatcaccctcaaggactacgaggtccacgacggcatgggcctcgagctctactacaactgagccgccggccctctctgcctg

SEQ ID NO: 5513 - DNA, 323 bp, Zea mays
  Clone ID: LIB3279-050-P1-K1-E8
tactcccgtgcgagagagggagtttgaggagcccggtcatctgaggcaaggaaggggcctgctgaaacgcacgaggaaaggaggtttgcacaggataagagtatctatctacatcaacaagaggtcacaggtgatactgaagctgaaatgcaaacacctttgaggcgcgctgtaaaagaacatcatgtgcgtggtttacggcgggcacagagagcttccgacgtaggtctggtaaaggcttcgtagaggagacatgctggttctgacttaacaccgtgcaaggtttcgcggaggtggagtgccgtgggcgacaccagcaaacg

SEQ ID NO: 5514 - DNA, 378 bp, Zea mays
  Clone ID: LIB3279-050-P1-K1-E9
gccgtggattttttggtggaagaggagtgacacagcaagtttcttctgaatctagtctgcaaaggcatccaagattacaacagaaagcttggagaagaacaagcagatttacctgaaaatagaagatttggccaagaagtaccagtgcagcccagctcagctagctctagcctgggttctgcatcaaggggatgatgtggttcctataccagggacaacaaaaacgaagaacctagatgccaacgttgactccttgaaggtgaagctcacagctgaggacctgaaggaaattggcagccagatacgtgcagaagatgtggctggtggaagacaatacaattcctatgcacatacctcctggaagtatgcagatacacc

SEQ ID NO: 5515 - DNA, 370 bp, Zea mays
  Clone ID: LIB3279-050-P1-K1-F1
aaaacactaaaatggcgatggcggcggcgaggagagcgctcctggcccacctacgcgtgccggtggtccaccctgcatcggcgcagcgaccatccccgcggcagggcggctcctgtcgtcgacgacggagagaaagggctcgttcctcgacaagggcgaggtcgctgaccgtgtcgtctccgtcgtcaagaacttccagaaggtcgaaccctcaaaggtgacacctagtgctcattttcagaaggaccttggacttgatagcttggacactgtggagatcgtgatggcgtttgaggaagaattttcctttgagattcctgacaacgaagcagagaagattgactccatcaagacagcggttgatttcatt

SEQ ID NO: 5516 - DNA, 388 bp, Zea mays
  Clone ID: LIB3279-050-P1-K1-F10
ggtgattctgacatcctggcagccactgttagaaggaagggcatctgtgaaaaggatggtctggaaagcacatatgcgtattcactgttgaagaaccgaagaaaaaaagtggagcttggatcaagacagggggcaagaacaaaaaacatcaccttttatctagcatagttggggaaataaaggttgcgcgtcgaaaatcaagatgccaccatacaaccgatgttcatgtacacagggaatttgtgttggttggttccaaatttataccatcgtctgaagaatcaggtgattcaaatgttagtggagagcttgcagcttttatcagcacacttcctcagcaagaagcagaaacttcgaagcaatcatcttcacagaataccaggcaaag

SEQ ID NO: 5517 - DNA, 291 bp, Zea mays
  Clone ID: LIB3279-050-P1-K1-F11
cccacgcgtccgcgtctgtgaatcatgaaaacaaaataaaaagcagttgaaacctgtatcgcaaagggtaacatctctgaactccagcattcggcctcgaaagatggcctcagctttcctgacctcttcctcctgtccctgatgacatagaggctgatgtttatgttcctgaagccgatatcctgtcagtcttagatgtgccttctgtgaaaatgggacgagttattggcagagaggggtcaactataactggcttcgaaagaatgttgcggggtggtaaatcatattggt

SEQ ID NO: 5518 - DNA, 387 bp, Zea mays
  Clone ID: LIB3279-050-P1-K1-F12
ctgaattcaatgttgttgtgcttcaatccaatggcgtcgaccagccaaaagagtcggttcatgtactaaatgtcgggggctgcggatgaggcttactaaagggaagtcggtagtcgccaaggaattctattcctcatcgatgcagttatgtggtgtgagaggcggaggcgaagcagcctcgcaggcgatgttttggcgacccagaaacgacctcagcttggtgctagccttcgagagcactcgagaacgcaacacagccatcatgctcgctcggcgtttcgctgtagattgcaacatcatccttgctgggccaggcgacaaaactccctggtgaacgaagatggcacctgtggtctgccggataccagataccaccacccaccactc

SEQ ID NO: 5519 - DNA, 120 bp, Zea mays
  Clone ID: LIB3279-050-P1-K1-F3
ggccgccgccgcgctgagtttgggccgggctctgttaatctgggcgactttgaggttctctgctcgcgctgcccctgccgttagagtgaaacgattctggagaaagaccgtataatccta

SEQ ID NO: 5520 - DNA, 390 bp, Zea mays
  Clone ID: LIB3279-050-P1-K1-F4
cccgtcgcctccctctccccttgacgtgcgggtgcggctcctcctcgccgacggcgccagcgccgcctccctcgccctctcggatagaccggcggcggtagctgcatcttcgagtccgcagtgaaaactagaagggaagaatagcctcctaatggataggaacaacgaactggaagaggtggtcccaaatgattcggaccctcttattgggagggagaacagggagtcagagtcatcagtagagctgtcaccgccacagccagcaactgtgaacctgctggagattgaggatgaagagaccgacggctcttctgctgcgtgttgccgcatttgccttgaggctgagtctgagataggtgatgagctaatatcaccttgcatgtgcaaggg

SEQ ID NO: 5521 - DNA, 389 bp, Zea mays
  Clone ID: LIB3279-050-P1-K1-F5
cggacgcgtgggttgatgtcagctaatgatgctccagagagggatccaatggactgtgttcttgaagggagcgcagacggagctccacctggaatatacttgatgctcggaattcagaaatgttcgagagccgtttcttgaggaaaacatttacagtggataagagatataaggcaaatgctttcaggtttaggtttctacgcgtaagagattctcattctaatccaaggtctcagataggatcaattgatctatatgggaaaaccatatgaactcccgccggagctgtgtttcacttttcagctttctgaactgctcggtctcacgagcctgtggcgtatcataaattcataataccggaatgcgagcatttactgtggacgcaacac

SEQ ID NO: 5522 - DNA, 326 bp, Zea mays
  Clone ID: LIB3279-050-P1-K1-F6
cccactcagaaaacccagccgccgccgcatcggcctcccaggtaagcagtagcgtccaccccagccgccgccatgaagcgcaaccccgcgtcacgagctcccgccggaagtgccgcaaggcgcacttcacggccccgtcctccgtccgccgcgtgctcatgtccgcggcgctatcgacggagctccgccacaagtacaatgtgcgttccatcccgatccgcaaggacgacgaggtgcatgtcgtgcgcggcacctacaagggccgtgagggcaaagtggtgcaggtgtaccgccgtcgctgggtcattcacggtgagcgggtcacc

SEQ ID NO: 5523 - DNA, 371 bp, Zea mays
  Clone ID: LIB3279-050-P1-K1-F7
ccgatccccccttcgcaaccaaaaccccaactcgccccgcatcgatggcgcccaaggccgagaagaaacccgcggcgagaagccggcggaggaggagcccgcggccgagaaggcgcccgccgggaagaagccgaaggcggagaagcgggtccccgctggcaagtccgctgccaaggaaggcggcgagggcaagaggggcaagaagaagggcaagaagagcgtggagacctacaagatctacatcttcaaggtgctgaagcaggtgcacccggacattggcatctccttcaaagccatgtccatcatgaactccttcattaacgatatcttcgagaagctcgctgctgaggccgccaagctcgcgcgctata

SEQ ID NO: 5524 - DNA, 384 bp, Zea mays
  Clone ID: LIB3279-050-P1-K1-F8
gtggaatatgatgctctgagggttattttcaacaagtcccaatctgtgatatcgattaagcccacaatggtaacaaactttcccccgaggttgcagaaaaagaatcagaagctggtgggaagatgggtgacctagattgttatgagattgaaggcggcgagacaaaatcagagattttgcagaatctagctgagttccagttttattgtgtcctgtacaatggtgccctagagaatgcatgcagtgagcttggagcccgtatgtctgccatggacagctctagcagaaatgctggcgatatgcttgatcgtctcactctcacttacaacaggacacgccaagcattcatcaccacagagcttactgagattatatctggtgcat

SEQ ID NO: 5525 - DNA, 383 bp, Zea mays
  Clone ID: LIB3279-050-P1-K1-F9
tttggatctctcaagtgggaattttgttgggcttgcgctgtcattatttatgtcatttttttagattagtccatagttaaatattgagcaaatggcatgaaaatagatgtggatgctgcaacaactgaggtgtgcttgataagcagccaaataatatatcgtgtaatagattaatatatatgcatgccttaatactattctttagcaaagcaaaatatgtgactttcaatatgcaccaatcacatgcaatttactttagtgggtagcattatttttttttccagccaaaggctttaattcttgactactgaagtgaagcttagcattattttctaatgatctgtaaacaccaacttggattgaaatcttgtaactatgtaatt

SEQ ID NO: 5526 - DNA, 291 bp, Zea mays
  Clone ID: LIB3279-050-P1-K1-G1
ccttctccaacctccgtttctaatccgcgctgctaatcccactcccagtcccagctcgtccgctgagatggacagtatcagctcaaatccgcgcagctcctggagctgatgcgccagcacctggccaccgacgccggcaaggagctcaccaagaaggttggcctcttctaccagctcaacatcgcccccaagaagatcggcgttgatgaggagatcttcgtggtcgaccccaagaagggcgaggccaccaaaaggccgtaccagggaaagccggatgccactttttccttt

SEQ ID NO: 5527 - DNA, 380 bp, Zea mays
  Clone ID: LIB3279-050-P1-K1-G10
ctgaaccacgacacggccaagctgacgcacctgatcctccacgccgtcgcgaccgtgctcggcgccttcggcatctactgcgcgttcaagtaccacaacgacagcggcatcgccaacctctacagcctgcactcctggctcgggatcgggaccatcgctctgtacgccattcagtgggtgttcgggttcgtgaccttcttcctccccggcgcggcgcccggcgtgaggcgcggcgcgctgccctggcacgcgctcttcggcctcttcgtctacgttctggcgctggcgaccgcggagctcgggttcctggagaagctgaccttcctggagagcggggggctcgacaagtacggcgccgaggcgttcctggtcaacttcac

SEQ ID NO: 5528 - DNA, 386 bp, Zea mays
  Clone ID: LIB3279-050-P1-K1-G11
gacagatctgacaaacctatggaccaaaaggttttacgacggcttgcccaaaatcgtgaggcagcaaggaaaagtcggtgaggaaaaaggcatatgtgcaacaactagagagcagcaagctaaaacttgcaagcctggagcaagaactccagaaagctcgacaacagggaatcttcatatccagttctggagatcaaactcatgctatgagtggaaatggagctatgaccttcgatttagaatattctcgatggcaagaggaagaaaataagcagataaatgagctgaggactgcagtaaatgctcatgcaagtgaaagtgacctccgtcttatcgtcgatgggataatggcacattatgatgagatattcaagctgaagggtatt

SEQ ID NO: 5529 - DNA, 390 bp, Zea mays
  Clone ID: LIB3279-050-P1-K1-G12
cggacgcgtgggcgagcactcgccgccactcaccagcaaattcccgagccgccccttccccatctctttcgcgacccattgatcgattcctgatggcgcccaaggccgagaagaagcccgcggagaagaagccggcggaggagaaggccgagaagaagccaagggcggagaagcgcgtgccgagcaaggagggcggcgagaagaagggaaagaagaaggcgaagaagagcgtcgagacgtacaagatctacatcttcaaggtgctcaagcaggtgcacccggacattggcatctcgtgcaaggccatgtccatcatgaactccttcatcaacgacatcttcgagaagctcgccgccgaggccgtcaagctcgcccgctacaacaagaagc

SEQ ID NO: 5530 - DNA, 272 bp, Zea mays
  Clone ID: LIB3279-050-P1-K1-G3
ctttgctcctctccccgcgtgctctccctctctctcgcgcgcggcgacgactcggctagtcggctaccgccgccgcccctacccagcttcccagctcttcgtctgatccctccacctcgacgagcacccactacatatcccggagcgtctccaccgcacgtagggagtgtatctattagggaaggcccaagagacagagacctggtggtggctgggggccttgcggccttcgtgctcggggtctactactacaccatgagagccttgggagg

SEQ ID NO: 5531 - DNA, 393 bp, Zea mays
  Clone ID: LIB3279-050-P1-K1-G4
ccaaagccaaaaccccaatcgcacaggagagaccgagagagaggttttccatccatggctcccggcgtcgcttccgtgctggtccgcaggagcccgtcctcctcaaggacatcctcgcctcaccgtccccctgcgggaacaccgttgtctccgcccgccacctcttcggcaacggagtcgcgccgccacgctcctcggacgacggcatcaaggacgccgctgccgaccgccacggtgaccgcgacctctccatccccaagatcttcaccggagacgtgctggacctgctcgacgatgctgcgaggctggacctgatgctggcgctgacgggggacggcggtgcggcgtccatggccggcttctccgcgcgcgggtggtgggtctcgaaggagg

SEQ ID NO: 5532 - DNA, 329 bp, Zea mays
  Clone ID: LIB3279-050-P1-K1-G5
attacaccttttgccgagggggccgtcccgagccctatagctcctatcgtgtcgggtgctgatgaaaaaccaccaccatgaagtcagcatggaaaacccgtgtacggactgccaaatgatgctggtgatcttggacgaccaagaactacctgccttatatgaccgaaggatctcccacgaggccagcggtgaggctctgggcgaggagtttaaaggttatgtctcaaggaaccgggaggatgggacaaacagggcgtaccaatgaagcatggaggattgacatctgtgtgtgctcagactctatcttaacagaggcgatgaatgattgc

SEQ ID NO: 5533 - DNA, 383 bp, Zea mays
  Clone ID: LIB3279-050-P1-K1-G6
gggaatttcagttctcatagcattatcatgaatctcagaacataacaggtgaaacacgaatcaagcagaggcgccatggggttacagatccacacctaaaccgctaaattaaactgcgagcgatacatgataaactaagaccaccactcagatcaccaccatcttattcagatccaaaggaacggacgcagggggagtcgacgatgacggagggagggcggccgaacagaccagatcagagagatctaggagagctgtccgcagtcagcgaccttgaccaccttggaggtggagccgttgcgggtgcccaccttctcgatggccttgacgacgtccatgccctcgacgacctggccgaagacgacgtgcttgccgtcgagcca

SEQ ID NO: 5534 - DNA, 235 bp, Zea mays
  Clone ID: LIB3279-050-P1-K1-G7
atcgctgggcacgcaggcgacggcgacggcgctcaggctcgtgctctcaggaacggcgtcagctgcttcctttctccctcttgccagtcgcctcgcgccctcgcctttggtcctccgcacggctgacatacgtagaccgatggcaacactgaaagatgcagcggcaaggaagtctatactggcaacaatccgtcttgttgtcccagccggtgcagcccgtcctgcacctccagtt

SEQ ID NO: 5535 - DNA, 379 bp, Zea mays
  Clone ID: LIB3279-050-P1-K1-G8
gcggctacagtcaggccttaacaaaggccagcgtcctagtactgatgattcatcaagctgcattatagacgaaccagaagtcagcacaaagcagaaaaagcagagattgaagaggatgcgagtacaaacctcgctggaagtgctgatgatctacctggtaatatccatgatgatgagcaaaagaacatccctgaacatggtgctgaaatgacttctccagaagccaaatctgttctgaggttgcggaagacttctgaggaaggcaacaaggatgtcaagcaggagagttgtctcgagccacacgtgagagcaccaatgcagaagggaggcttccaatcatacatcatctggctggttcttccggtggctctgctcctgc

SEQ ID NO: 5536 - DNA, 214 bp, Zea mays
  Clone ID: LIB3279-050-P1-K1-G9
ctcgattctccccatcccgccgtgcttcccgtcttcaccaaatccttcgccacgatggcgccgcctgctcatcccctccccttcgccgccgcctttgcctaatcgttccacctggccgtctcccgccttcctttggccggggtctccgccgggcgtggggagggtctttttggggaaaggttgttagaaggagtgccaaggccccccccaaggt

SEQ ID NO: 5537 - DNA, 177 bp, Zea mays
  Clone ID: LIB3279-050-P1-K1-H1
ggccgagcgaaagcatcctcgatctcgtcgtatcgtagctgccgccgctcagagcaatggagagagcggtgccagttcggagtcgcacaccaacacggccgaccttctctcctggtcggccacgggccctgacgcatctgcctcgccggccgcgtcctcccgccccagcctcaagcc

SEQ ID NO: 5538 - DNA, 262 bp, Zea mays
  Clone ID: LIB3279-050-P1-K1-H10
cccacgcgtccgaaaagttagatctatgttgatccaaacagtccgatgcgttgtcttgtgcagtgcttctaatcaatctctttcaatagcagctcccgaagacccgaactgagttccttcaccgacccataccgtagggcgcacgcacctcactgcccctttagcagcgtacggttcgggatttgagatgctggcgctgctcgcggacggcaggatggcgctgacaatggcgccagaggctatcgtgtcactgggcagtgct

SEQ ID NO: 5539 - DNA, 389 bp, Zea mays
  Clone ID: LIB3279-050-P1-K1-H11
attcgctggatccaaatggcaatatcactataaaatgggatatcatgcagtggactcctgatggatatgtcgctgttgcacaatgttcaattatcaacaatttcggcacatcggggcacctggatggcagcttgggtggacatgggcaaaaaaggaggttatatggtcaatggttggggctcagaccactgaacagggtgactgctcaaagttcaagggaaacaccccccattgctgcaagaaagatccaacaattgttgatttacttccaggcactccatacaacatgcaaattgccaattgctgcaaggcaggagttataaatacctttaaccaggacccagcaaatgctgcttcctctttccagatcagtgttggtcttgctggaa

SEQ ID NO: 5540 - DNA, 376 bp, Zea mays
  Clone ID: LIB3279-050-P1-K1-H12
ggggagtagtggtaaagaaacatgcgctgcatacgtgcacagagagtgtgctaaactgtcaacttctgacttatggacaatgccaatggcaatgtcatgctacatgttgggttttcgccggattctgttttggagctcgcttctgttacatgtgaaggtaatgcttctgcaagccatgatgttatgttgcatgaaaacccaaccgatgctggcgcattgaatgatggtgatccatctgctttatctacttctgactatgaaaaagaacatgcttcatcattgatgaacttggagcagcatgctagaagtactttgcacgaggacaccagaaaggaagagggtgtgccatctcatggcatagtagaaaatgatattg

SEQ ID NO: 5541 - DNA, 391 bp, Zea mays
  Clone ID: LIB3279-050-P1-K1-H4
cccacgcgtccgcaaatgactctcaggtcaaactagtatggtattataacaatgcattggggaggccaaacaagaagaaatttatgcacgatcaaaagcataccatggatctacattgatttcagcgagcctaactggtcttcctgccctacaccagaagtttgatctaccagcaccttttgttctgcacactgactgccctcactactggcgatatcatcttcctggcgagacagaagaagattttgcgactagacttgccaccaatttagagaatctcattctcaaagaaggaccagaaacagttgctgctttcattgctgaacctgtgatgggtgctggtggtgtcatccctcctccaaagacctattttgacaaggttcaagcaatc

SEQ ID NO: 5542 - DNA, 383 bp, Zea mays
  Clone ID: LIB3279-050-P1-K1-H6
accagatgcaattggacttgctccaagggcagctgataagtccaagaatcgcaactagaatggttgcttcttacagtccagagcagagggagatatccagtgactgtagggatctttgtggaagccggaaaacgtctaacagtttcaagaagaattctgccttatggtctgtaccacatgtttttgctgctacgcaagtaaagaactccacgtctgtcaatgttagttttacaacatcgtctacggacaaaaaaaaaaccccccgctatttgattgttgctaagccttcgtacgacgtgtaaatgggttggtacaatgagtgctgcgactacgattgagcacccctctacctagtttgcaaaaaaacagtgtcccatggactg

SEQ ID NO: 5543 - DNA, 379 bp, Zea mays
  Clone ID: LIB3279-050-P1-K1-H7
aggaacattgactgacacacctgccatccttgtgtttgttgctcgaaaggttcacaggaagtggctcagcgctactaatgtcttccaactgcccttgagggacctgggggtgtgtggtgtgatgttgatgttgttgaattttcttattatggtgcaccagccccaacaccaaaggaacaactttatgatgagcttgttgatggattgcgtggtagcgaccctattgtaggctcaggttcacaggtggctagtcttgagacctatgggactttgggtgccattgtgaagagtcaaactggcaataaacaagttgggttccttacaaacaggcatgttgcggttgatctggattatcccaaccagaagatgtttcatccgc

SEQ ID NO: 5544 - DNA, 237 bp, Zea mays
  Clone ID: LIB3279-050-P1-K1-H8
cgccgcggaactcgtcggccacgtcctggccgtcgcgcatgctgacgacgaggccgttgccctgccgggcacccttacgcggagctcgcgcgcgttctgcgagcgcacggcgcctctcatgtacgccttcacctcctcgtaggtgctgtcgttgtcggagacggagccgtagcgtgagtagcgcacctcgacgccgggctccgagatgttgatggtcacgtaggggtccacgacgtt

SEQ ID NO: 5545 - DNA, 276 bp, Zea mays
  Clone ID: LIB3279-050-P1-K1-H9
ctccaagacccttctctttggtgagaaggaggttgctgtgtttggctgcaggaaccctgaggagatcccatggggttcgttggcgctgaatatgttgttgagtctactggtgttttcactgaccaagagaaggctgcagctcacttgaagggtggtgccaagaaggttgtcatttctgctcctagcaaggatgcccccatgttcgttgttggtgtcaacgagaaggagtacaagtctgacatcaacattgtctctaatgctagctgcacaaccaac

SEQ ID NO: 5546 - DNA, 370 bp, Zea mays
  Clone ID: LIB3279-051-P1-K1-A10
ctctgaaaaccgcttcacaacctaaagctgacgagcttcgcagaatgcaagagctggatggcatcatactagtgagcaagctgaactagagaggctcacaaagtgttccagcaaacttaaagatcaggcttcggaacttcaacagaaagttgaaaatgctggagggaagaagctgaaggaccagaagacaaaagttggcaacatccaatctgaacttgacaaaacaagttcagaaatcaacagacacaaagtcaacgtaacttcaggtgagaagttggtgaaaaggttaaccaagggcattgaggagtccaagaaagatagagaaaaactttctgctgaaacagagaagatgatgtctatgttcaaagag

SEQ ID NO: 5547 - DNA, 363 bp, Zea mays
  Clone ID: LIB3279-051-P1-K1-A12
gcaggaccagctagctagctcctcccactgctatcacccgggccccggccagccatctcgctgaaaggaaaagcgcagccatgaagactactagctcgggcattgcagtcgtcctcctggtggcgatgctggcagtccagtccgcggtggccgacatctcgtgctccgacgtgctcaacgacctgtcgccgtgcctgcccttcctgcagggcaaggcagccaaacccagcgagagcaacaaccagtgctgcgacggcgtgaggaccctgtacgcggcggcggacaccaggcccgacaggcaggccacgtgccggtgcctcaaggcggcctacgttcaagtccacgctgtgctctccgcggcgc

SEQ ID NO: 5548 - DNA, 372 bp, Zea mays
  Clone ID: LIB3279-051-P1-K1-A2
ctttgctctcgcctcgcgcgctcccccccccccccccccgcgcgcatcgtgccgttcgccaccgcaccgaccgatggaggtcgccgccgtgcccagatccgacgcggcctgccgtgcggagcccctgctcccggccgttcgagccgctgcgtgccacctggccctgccccggcgcgcgttttccgcatccgtcgcggaggcaccggcgccgcgccgtctagccggttgtcgcgctgcggatggtgacagcgtggagactgcgccggaggcggtccccattgagaaaaggttccctcccttaccgagcgtcatggacatcaaccagatccgcgagattctcccccacaggttcccattccttttggttgatag

SEQ ID NO: 5549 - DNA, 367 bp, Zea mays
  Clone ID: LIB3279-051-P1-K1-A3
gccgcgctcctccccgacgacctcctcgacaccaacgacctcttctacgcgcccgacgtcgtccaccaccaccagcgacggcgctgctgcccgggtacgatgtcctcgacgtgctcgcggcgctgagcctcagctcccccagggccatccgccagcctcgctaggagaagcctgctcatggcgcctggcgggccaccacctccaccacggctgctgtgcctagtgtaaccccaagcaaggctagtctgtttctgtgtatacaatacgactgaaaaactaggagaggggggattcggccaaggcggccggtgctctctcctctcctcgtagctagtttttcctcctgttccagctcagttcttgttca

SEQ ID NO: 5550 - DNA, 324 bp, Zea mays
  Clone ID: LIB3279-051-P1-K1-A4
gttggcttctactccccctccggttcgggttcgggttcgtgaggttctacggggttcggtttcgtgggtgagggatcgagatggcggcgtaggatgttgagtaccgctgcttcgtcgagcggactaacctgggccacggacgaccactccctacacaacgccttcagcacctacggcgaggtcctagagtacaagatcatactcgatcggaagacgcataggtcccgcggcttcggcttcaataccttctccaccaacgatgctatacttaacgccatggagggcatgaactgcaaggagctggacatgtccaacatcacagag

SEQ ID NO: 5551 - DNA, 376 bp, Zea mays
  Clone ID: LIB3279-051-P1-K1-A5
caaaaaatgaatatattgagtactttgctccagattatacattgaaagttgcaaatttgaacatggacaattgaacagtaagacctatctcagttcaatcaaagtgcaagtgatggagagtttgcggtacatacagcatgctcctggtgttcaaatgcaagaggttcctcccgatttttatatcccggactttgatgaagatgaattggatcctgatgaacgtgttgaccagcacactcaagacaagcagattcaccgtgatgatgagtactatgaaggtgacaatgacaacgatcacgacgatggcacacgctaatctgcttcttctgaggccctggtgtaaatggaaacctgagattcttcactgttgtgtagt

SEQ ID NO: 5552 - DNA, 381 bp, Zea mays
  Clone ID: LIB3279-051-P1-K1-A6
cgagtcgcgagtcgcgacagagagagaggcggagttgcggagaagatgcagagcagcagcatgaagagggagtcagcgaggcccacgacaccattcgcttcggcatcaacgccggcgtcaaagccgacctcgccccgccgcacccgctccagtctaccatccaatcggagaccaagttctgggcggacaagaagaagttcgggacagatgccatatacggatccgccctcaacatccgcaaggatctcgatgcccaaatcctctccaggttccaaaggccccctggtgctttgccgtcatctctgcttggatacgaggcactgacaggttccttggatgattttggatttgaagattatcttaacatgcctcatgattctg

SEQ ID NO: 5553 - DNA, 405 bp, Zea mays
  Clone ID: LIB3279-051-P1-K1-A8
aaaggaacgacgccacgcgacccgctgccatgggtgtcctttttcaacaaattttaacggcgatggggaacaactcgggggcaatgaatggaagcaccacatgaatcacagtgcgcatgacctgacacagttggcccaccagcagcaacagcgtgatttaggaaaccaattgcttgcgggcctcatagctggaaacagcttcaattaccttcaatacgactggaaaccttctcaacagagtgagctgtagttataacgctcgcaccgaatatttatacagttatcctagataggtcgggacatcaatgacaacacggaattttcccctaaccacaacctgcccttccttataagcggagagttcttactgatggtgcatgctaaatgtttcttcgaatatatgaa

SEQ ID NO: 5554 - DNA, 305 bp, Zea mays
  Clone ID: LIB3279-051-P1-K1-A9
aataccaaccaagggcaaagagcttcacaatttgtctcaacagtgcctatcatactcaatcggatggacatactgaatgagtgaatcaatgtctcgagacttacatcgcaagttgaacaaatttggctgttgaacaaatcggaacaagacttggataacatctgcccacatcgcaaatcctagatcgtgagttccttcatgtgagtgctaacactcctgctaactaatggtggaggagagccttgacctgctgtgtgccgcacagctcgaaaggcagagcgttcccctggagctggaccgcgctc

SEQ ID NO: 5555 - DNA, 322 bp, Zea mays
  Clone ID: LIB3279-051-P1-K1-B1
acccacccgtaccggctagatctcctagctggatgacctattttttttttttattaatacctagggcaggcgcaaaggagctttacacaacaaccacagaaaggaggctattacaccgggaacgagggtgctctacatgcatgggggggctgaaccttacctaccccagggccatgcggaaacctagttaggagaagcctgttaatggggcctggcgggccaccacctccaccaacattgctgtgcttattgtaaccccaaccaaggctgggctgttcctgtgtttacaatacaactgaaaaactaggagaggggggatttg

SEQ ID NO: 5556 - DNA, 373 bp, Zea mays
  Clone ID: LIB3279-051-P1-K1-B10
agctgatattgtccctggtgttctgttcatcgatgaagttcacatgctagacattgagtgcttctcttcctcaaccgagcattggaaaatgacatggctccgatcctagtaatcgcaacaaacagagggatcacatccattcgtgggacaaactaccgctcgccacacgggatcccgccagacttccttgaccggttactgatcatcacgacgcagccctacacggaggacgagatcaggaagatcctggacatccggtgcgatgaggaggatgtggagatgtccgcggacgccaaggtcctgctcaccaaaatcggcgtggagacctcgctgcggtacgccatcaaccttatcacatctgccgcactagcct

SEQ ID NO: 5557 - DNA, 376 bp, Zea mays
  Clone ID: LIB3279-051-P1-K1-B11
gaaagccgagattagcggcggcggcgatggcactcccggcgtcgagctccggcctcttccgcttcgttccccccgcagccgcccccagtccaccgacatcgtggccgctgcctcctggggagtcttcgctggcaccgccggcctctacctcgtccagccatttgactggattaagaagactttcttccagaaacctgaaccaggggcatgagtctccaggcagaaaaatgctgcaaatctgcaactttggtacaccacttttgtccgggatgattcctgatgataactcagcaaataatatgagaccccctcgtctttccttgtttgattttattcagatgtaggcattcctcttgcatgtaatcttcacgagggg

SEQ ID NO: 5558 - DNA, 372 bp, Zea mays
  Clone ID: LIB3279-051-P1-K1-B12
cggacgcgtgggcgttgatgtccgcatagtcgatgatgaaataaatatcaaattcacagagaagaaagagccaactctttgctttgtgctgcaaaggttctagaggagtttcatcttgagctcatccatgttgttgggggaatcattggagatcaccatatattcatgttcaatacaaagatacctaagggctcttctgtgtacgcatgcgcggtggccaagaagctcctcgaagctgtggagataaagaagcaggcttataatatcttcaactagacataccaatcataatgtttatccagacaacttaccatgctggtctgctctttagcatctaataaggtgcttgcttatcacttatcagagactgac

SEQ ID NO: 5559 - DNA, 380 bp, Zea mays
  Clone ID: LIB3279-051-P1-K1-B2
cggacgcgtgggctagccgccatatctcacgatccactcgagcaccaagccgagggaaggtgaggagcgaggcgcgcggcgtggtgtcggcgaagggcggcgcggtcgcgggcaagaagaaggggtcggtttccttcacgatcgactgcaccaagccagtggaggacaagatcatggaggtcgcctcgctcgagaagttcctgcaggagcgcatcaaggtcgccggcggcaaggctggcaacctcggcgactccgtcaccatctctcgcgagaagaccaaggtcaccgtcacctctgacggacccttctccaagaggtacctgaagtacttgaccaagaagtacttgaagaagcacaacgtgcgggattggctacgcgtg

SEQ ID NO: 5560 - DNA, 383 bp, Zea mays
  Clone ID: LIB3279-051-P1-K1-B3
gcccgtcgcgccgtcgccttgctcgtcgccgtcgcgctcgcgaccgtgctcctgcatacggcggaggttgggcgggacagaagaagccggcgacggccgcgaggcgggaggacatcccctacatccggtgccaggtgtgcgagcggatcgcgcgcgagatctccgcgcaggtcgccaagaagcaccaggcgctcccgccctccaagaaggtaccggagatcgagatcatcgaggtcgcggagaatgtctgcaacctgaagaagcatgaggcggattggatgctccggatcgatatcgtcgagaaaggcgacaagctcgagcttgttgagcaagatgaggaatggcattgcaatgcaaaatgcaagaccatggagcgtgcatgt

SEQ ID NO: 5561 - DNA, 381 bp, Zea mays
  Clone ID: LIB3279-051-P1-K1-B4
cccacgcgtccggtcctcgcaccgcacgcaacaagtacgcaggcagcgcagcctcgagccgtcgccatggcggcaagcacctcgtcctcgccgcatgcctcctcctcctgcccaccgcctcggtcgccaccgacgtcgactactgcagtaagaaggactacccggtgaaggtgagcggggtgcagatcgtgcccgatccggtcgaacccggcaagcccgccactttcaagatctccgcttctactgataaaaccatcgagaaggggaagctggttatcgacgtcaagtatttcttcttctacgtgcactcggagacccgcgacatctgcggagagacttcctgcccagcgaccggcgacttcgtgctgtcccaccagcaga

SEQ ID NO: 5562 - DNA, 378 bp, Zea mays
  Clone ID: LIB3279-051-P1-K1-B5
ccacaccccccgagctcagcttacctccactccagctccaatcacagtcgtgaccagagcgagagctagctgagggccgtgaaaatgccgatcaataggatcgccctggggagccaccaggaggtgtaccacccgggcgccctcaaggcggcgttcgctgagttcatctccaccctcatcttcgtcttcgccggccagggctccggcatggccttcagcaagctgaccggcggcggcccgacgaccccggcgggcctgatcgcggcggcggtggcgcacgcgttcgcgctgttcgtggcggtgtcggtgggcgcgaacatctccggcgggcacgtgaacccggccgtgaccttcggcgccttcgtgggcggcaacatc

SEQ ID NO: 5563 - DNA, 296 bp, Zea mays
  Clone ID: LIB3279-051-P1-K1-B6
gcgagtgctgcggattcacggaggagtgcacggagccgtaacatagagggcgtgcgcgcgcggttcggaggaagaggatctgaaaatctgtgcggagacgcaatgggcgaggagctgggacgcgcggtgacacccggcatctctcaaggcgaggcgctgtaacgacatgtccacacttatattagtgtgttccagacaacgataccagagggccttgagtaagctgacaagaaggctactaatgaccaactttggcctgatcgcggagagcgtggtgcacgcgtaagtgctgttag

SEQ ID NO: 5564 - DNA, 388 bp, Zea mays
  Clone ID: LIB3279-051-P1-K1-B7
atcgaatccatgggcagctcctcgaataccaacacaagcggcggggccagcgacaaggaggagaagaaggaggaaaggtcaaaggcaaggactcgtcggggccatccttcaaggagaacgaaagggtcctcgcctaccacggccccctcctctacgaggccaaggttcaaaggatcgaaaaccatgaagatgaatggcgctactttgtccattatctcggttggaataagaactgggatgaatgggttgcaaatgaccgcttgttggaattgacggaggaaaacgtgcgcaaacaacatgagcttgataagaatcaggtagttgacaaaacaatgaagtctggacggtcaacacagcataaaccaaaagtcttcaatgcggatgcaaa

SEQ ID NO: 5565 - DNA, 372 bp, Zea mays
  Clone ID: LIB3279-051-P1-K1-B8
cggacgcgtgggctagccgccatatatcacgatccactcgagcaccaaggcgagggaaggtgaggagcgaggcgcgcggcgtggtgttggcgaagggcggcgcggtcgcgggcaaaaagaaggggtcggtttccttcacgatcgactgcaccaagccagtggaggacaagatcatggaggtcgcctcgctcgagaagtttctgcaggagcgcatcaaggtcgccggcggcaaggctggcaacctcggcgactccgtcaccatctctcgcgagaagaccaaggtcaccgtcacctctgacggacccttcttcaagaagtacctgaagtacttgaccaagaagtacttgaagaagcacaacgtgcgggattggc

SEQ ID NO: 5566 - DNA, 275 bp, Zea mays
  unsure (1)..(275): unsure at all n locations; Clone ID: LIB3279-051-P1-K1-B9
aaannggggggggaccaccccgtccgcgagtcgcggggttttcttgtttttttacaaaacactctcgaccccacgggtgggtaaggtggggggtgtgccccacaccataatttctccaaaggccggaggcgggaggacataaaatacatgcggtgccagctgtgcgagcggatcgcccacgccatctccgcgcacgtcctcgagaggcacctggcgctgcaaccctctacgaaagtacctgagatcgagatcatggaaggcgtggaaaatgtgtg

SEQ ID NO: 5567 - DNA, 331 bp, Zea mays
  Clone ID: LIB3279-051-P1-K1-C1
cagactcgcagcataatattcttacaagagccttgcactaatcaaggaaggttacaattgacagttcgatacatgataacagtgatgtgaagactactcaggatcttaccgggtgatcttctagatctgagcaacatataaacaactattgctgcccagacaaatgctatgtctggagggatggacaccaactactactgctgtacgatacagtaccgtatattgggattataaacgtctgagagattgtcttcaccctgtagaaccttgaggtagatagaattctgcggctcactattgtcgagaaaggacacaagctgctgcttgttga

SEQ ID NO: 5568 - DNA, 373 bp, Zea mays
  Clone ID: LIB3279-051-P1-K1-C10
ctcacacgtacgcggacgcgtggccggacgcgtgccactgccgtggggggaacctaacatgatccacgtcactcctcgactgccaggctgccatggcacgagacgtgccgcttcgactgattactcctagagctcgacgacaccgtgtaccgacaacgacaccggcatcgtcactggacctgaggcgcaacatagacaagttccttcaggccaaactcgaaggatctgccgacgaggcctgaaacacgcgcgccaagctattacgcgcgcacggcagttacctaggcggactcatagagctaggatacgacgtgcacccggacgaataccacagctacatgcacggtaggctaccgtacgacatgatcgcgcg

SEQ ID NO: 5569 - DNA, 372 bp, Zea mays
  Clone ID: LIB3279-051-P1-K1-C11
gccttttacataagcaacccccccgacctcttttccctaccctctctttcgttacctacaggctacagtcccgtctctccgccgcttgcttggaaaacgaagaaaccctcctccaccaacccaatccagctacatccgtctgggtgaactccagggccaggagcagttcgccgccttcgttcgcatcacctacgcggttcgatccaactggcaggaaggaacgtgatggccaagacgagctcgttcaagctggagcacccccttgagaagaggcagtctgaggctaatcggatcagagagaagtaccctgacagaattccagtgattgttgagaaggctgagaggagtgacattcctgacatcgacaagaaa

SEQ ID NO: 5570 - DNA, 368 bp, Zea mays
  unsure (1)..(368): unsure at all n locations; Clone ID: LIB3279-051-P1-K1-C12
accgggcaccggcctcctttcccgcaggcacgggtgcacggcacgcggtttccactcgcttcgtccccttcggatcgccctcagagtaacagtctagcagagcaagcatgtcgtcgtcggcggagaacgacctcacggtgacggtgaccgagcgcggaggcaaggacaagcacgaggacggcggcgacaaggagcagggcggcggcggcttcatcgacaaggtgaaggacttcatccacgacatcggcgagaagatcgaggaggtcgtcgggttcggcaagcccacggccgacgtgtgcggcatccacatcccgcacatcagcctncaccgcgccgacctngtcgtggacgtgctcatcaagaacccg

SEQ ID NO: 5571 - DNA, 385 bp, Zea mays
  Clone ID: LIB3279-051-P1-K1-C2
ctcgcattttccttgcaaccgattgcctatccccctcccaaccaaagaccgatggcgcccaaggccgagagaagcccgcggcgaagaagccggtggaggaggagcccgcggccgagaagacgaccgccgggaagaagcccaaggcggagaagcgggtccccgctggcaagtccgccggcaaggagggcggcgagggcaagcgtggcaagaagaagggcaagaagagcgtggagacgtacaagatctacatcttcaaggtgctgaagcaggtgcacccggacatcggcatctcctccaaggccatgtccatcatgaactccttcatcaacgacatcttcgagaagctggccggcgaggccgccaagctcgcgcgctacaacaagaa

SEQ ID NO: 5572 - DNA, 369 bp, Zea mays
  Clone ID: LIB3279-051-P1-K1-C3
cggacgcgtgggaagcaaactgcacaggcgcagcaggacgcgagaagagaacgtgaagggccccacgactagccgaacgcagcgcggtcgcacggacaaccgccaccgccacctacccacccgggccggcggggggcgttgcacgttccgctgcgcaggccacttttttttaaaaatattttattacattttcctcttcctttttatacgaacgaggaacgatcacacgcagacacgcttccgcggcgccaccaccttccgccctccgctgcccgctcgcctccgcgcccgaaaggcaaagcctcctcgctcctgccccgccccctcctcgcggcgtcggtcaaaccctagcacaccgtacgcgcaggc

SEQ ID NO: 5573 - DNA, 376 bp, Zea mays
  unsure (1)..(376): unsure at all n locations; Clone ID: LIB3279-051-P1-K1-C4
gggttggcttctcctccccctccggttcgggttcgggttcgtgaggttctccggggttcggtttcgtgggtggcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccantcccgcggcggccgtggaggcggcggcggcggcgggtac

SEQ ID NO: 5574 - DNA, 373 bp, Zea mays
  Clone ID: LIB3279-051-P1-K1-C5
gcctgctgagatggtgaattatggtgccactgaacctgttgtaattcttggttttggagagatgggacaggttcttgcatgatatttcttttcttgcgtcatttgagtgcataccataatttttcatgtttgtgcaggtgcttgctaaatttttatctgcaccattgtcatttggaattgagaaagacacagaaggatggccatatgttgcattcgatctgaatcctgttgttgtaaagtcagctagaaaatcaggatttcctgtgctattcggagatggttcacgccctgcagttctgcaatctgctggcataacgtttccaaaagctatcatggttatgtatactggaaaggaaaaaacaattgagtctgt

SEQ ID NO: 5575 - DNA, 360 bp, Zea mays
  Clone ID: LIB3279-051-P1-K1-C6
cggacgcgtgggcggacgcgtgggttttttccctcttgtcacagcacccgccaccgacacacacccaaggcccaactgcagtgcccatccggcagtcaggtcgatggcggcggaagcagcggcagcggggaaggagaagatgcggacgctagtcagcagcgacttcaagaagttcgatgtggaggagtctgtggcgagggaatcgctgattatcctgaacctgatggcggactgcgacgacagtgacatcccggtcttcaacgtcaacgccaagatcctcgacaaggtcatcgcgtactgcaggaagcacgcctcggcgccgcgcgccgattgtggtgatgcggagccaagtgccgttag

SEQ ID NO: 5576 - DNA, 319 bp, Zea mays
  Clone ID: LIB3279-051-P1-K1-C7
cagccatggacttgagctgagcaggcggtaaggagaagaagggcacggacgggcgcaaggccggctggccgacaaaaactcggtgtcgcggtcctgcagggccgggctgcagttccccgttagacgtgttgggcggtacttcataatggggcgattcgcgtaccgtgtaggcactggtgcctacgtatacctcgccggcgtactgtagtacctagaaggcgacgtacttgatctcgacggctacgctgtaattgacaacgagaatacgcgcatgatcccgcgccacgtgctcttctccatccgcaacgacgaggagatc

SEQ ID NO: 5577 - DNA, 411 bp, Zea mays
  unsure (1)..(411): unsure at all n locations; Clone ID: LIB3279-051-P1-K1-C8
cggaannacccgggacggacccacgccgtccggggtgtccaaatgtaaacctatccaattttgagaaggatgatgatacctaactttcacgtggatttaatagctgggctgcaaacatgcgcgcaaggaattacagcattcctgaggttgacaagttgaacgctaagttcatcgccggaaggatcatcccagccatcgcaactttaacagccatggccacaggtctagtgtgcctggagctgtacaaggtcattgctggggagcaccccatggaggactaccgcaacacattcgccaacctagctatacctctgctgtctatggcggacccggttggggccaatctgatgaagcatcaagatatgaggtggaccgtatgggaccggtggactatcaggggcaacctgactg

SEQ ID NO: 5578 - DNA, 365 bp, Zea mays
  Clone ID: LIB3279-051-P1-K1-C9
aagcagcacatgcgcactcggagcacgatcggcaacaatatgtttctgctattcacgatgacagaggcgaagatataatgaaacgcccctggtgaagaggcccaggatgggcacggctaatttcagggcagagttgcagccatttgagtctggaccacagcaacccactgtttcaacccaaggtgctctgtctgtttcgccacaaaacagtcgtggagtaactaggtccttgactgtagtgctgcaagatgctgggtgtgaatatactttagctgtcgatgattctttcatcgtgaaagaacccaaaccagaaccacaaattgatatagcagaaatcaacattggtgaccatttaactgaaccac

SEQ ID NO: 5579 - DNA, 372 bp, Zea mays
  Clone ID: LIB3279-051-P1-K1-D1
ctcacatcgacgcggttcggttccagtttcactcccactgccgtctcggcaacctcccctgttccacgctcgtcctcgcctgccaggctgccatggccgcgacgtcccccttcgactgcgtcctcctagacctcgacgacaccctgtacccgggcgacaccggcatcggcgcggccctgaggcgcaacatcgacgagttcctccaggccaagctcggcgtgtcggccgacgaggccgtcgccacgcgcgccgagctcttccgcgcgcacggcagctccctcgccgggctcatcgcgctcggctacgacgtgcacccggacgagtaccacagctacgtgcacggcaggctaccgtacgacaggatcgcgcgcg

SEQ ID NO: 5580 - DNA, 376 bp, Zea mays
  Clone ID: LIB3279-051-P1-K1-D10
ttaaaaacctctgctcgggcctagggtttcctcccagtcgtcatcggttggcgtccgcctcagcccgcgccaggagagccggctcggtcggttcgtcgaagatcccggatctgctctgtcacgaggtctttcggcgggtgttgtctcgcgaggtgtagcgagccaagttcaggagagtttcgagaagctgaaatggctcctaaagctgctcctgccaagaagggtgatgccaagacccaggccttgaaggttgccaaggctgtgaagtctgggtcagtaaaaaagaccaagaagatccgcacgtccgtgacatttcaccgacccaagaccctgaagaaggctagggaccccaagtacccaagaatcagcactaccg

SEQ ID NO: 5581 - DNA, 373 bp, Zea mays
  Clone ID: LIB3279-051-P1-K1-D11
gtgggctgcctgtgcgcgtgcttttctaccaacatggtgactggagtgattttccagaggatgttgtaatctagcacaacaggacttccagttgaagaagccaattacaactgctgtgttccagaacaagcacatcctgttggacttcattcacatgatttgcatagattatgagatgaccatagacaaaccactagcatgggttgatgataatggcaaacgcttctttccagatttatctgctgggctctacacatctaaaccatctcagcatgagaatggtgaagctgatgagtgtgatggaacgcctacaagtgtagctgaaagttctagttcggtatctgttggtgaagtagtttctcatggtaagagg

SEQ ID NO: 5582 - DNA, 363 bp, Zea mays
  Clone ID: LIB3279-051-P1-K1-D12
cgactcgtagcccgaaccctatccaccaagccggaggcgagagagcagccatggcgcggtgcctcgcctcgtcgccctcctcgtactcggcctcgccgccgccgcctccgcggccgacgcgcccttcgtcgtcgcgcacaagaagatttcgctctcccgccccaagccgggcgtcgagcgcgtcgccgtctccctcgacctctacaaccagggatccgcgactgcctatgatgtgtccattaatgacgactcttggccaacagaagtgtttgagcttgtcactggagagaaatcgaagacattggaaaggcttgaccctggtgccactgcttcgcacacatatgtgctggagaccaaaacaca

SEQ ID NO: 5583 - DNA, 380 bp, Zea mays
  Clone ID: LIB3279-051-P1-K1-D2
cccacgcgtccgcgaaggtcttccatccaaacatcaatagtaatggaagcatatgtctcgacattcttaagagcagtggagccctgctttgacaatctctaaggttttgctttctatctgctccctgcttactgatcccaacccagacgatcctcttgtccctgagattgctcacatgtacaagacggatcggcctaagtacgaggcaacagcccgcagctggacccagaaatatgccatgggatgaaaatgaaatgaagtcgaaactccatattcggcattactgcttaaatgcagacgattgtggtgttgccccatgaaactttttgtggggacgtatgttcttccattccttgtcgcccgtatgcattctgatccat

SEQ ID NO: 5584 - DNA, 372 bp, Zea mays
  Clone ID: LIB3279-051-P1-K1-D3
cgccgagcggaagcggcgccgagcaaccaacccctctcctcgtccgccggcgtctccccggaccatgtactggccgcctcctcccggctgctctgggcgtaccgcgccgccgcctacctcaggatctccaccttccccagggccttctccaccgtgctgaaggatctgaagtatgctgacactcatgaatgggtgaaagttgagggtgattcagcaaccgtggggattactgaccatgcccaggatcatttgggtgatgttgtttttgtggagctaccagaagttggcatcagtgtatcccagggaaagaactttggtgctgttgagagtgtgaacgcaaccagcgatatcaattcaccagtgtctggagag

SEQ ID NO: 5585 - DNA, 352 bp, Zea mays
  Clone ID: LIB3279-051-P1-K1-D4
ccaacatagacaagcttggtaggatatgcctcgacattttcaaggacaaatggggcccagcacttttgatttaacagatcttttgagtatacacgctctactgagggcgccaaatacagacgaccctctttttgataacattgtagaacactgttgagacactcaatgaaaaaatgtctgaacaaataaagagtgggctctcctgtatgtgagcggtgcatgagaacgcacagatgttttttttgtaataacccatcaacttcagtcctcatctattgtcatgtgcttgataaaaaataagctggagatatttgccatggaatgaagactctacatgactatcactctgaat

SEQ ID NO: 5586 - DNA, 376 bp, Zea mays
  Clone ID: LIB3279-051-P1-K1-D5
cccacgcgtacggtaacatacaaccatcagaactaattgcagatatggatgcccagatagcaaaagcaaaggagaagcattgattagaaaagatatccttgataaagtagaaagatggatgtatgcgtgtgaagaagagagctgtcttgaagattataaccgggatgacaacaggtataactctagccgaggtgcccacctgaatctgaagcgtgcagaaaaagctagcatgcttgttaacaagattgcaacacttgttgaaactataatggcaaagaccagggcatgggaggagaaccgtgggctgtattttatgtatgatggtgcacctcttctatgctatgttggatgagtatgttatgctcaagcaggaaag

SEQ ID NO: 5587 - DNA, 333 bp, Zea mays
  Clone ID: LIB3279-051-P1-K1-D6
ttgaaacacgaaaatcccttgaacatatatgagagaagattgttgcagcgtcataatacaaattccctcggcggtaagttataatcaaagcacggttatatgaggataaacaaactccacgaccaagagagtaaacgcagaccggtcttcaatttctttgtgcgcatggaggcgtgaacatggctacatcagttcttctcgtcttctgttttgtctgacgtgtcttccttcttctcttgctctccctggctgagcaacgatgccagcaaatctttaacagatggatcattgggatcaacaccaggaagcgaattaaggatagatgacacaaac

SEQ ID NO: 5588 - DNA, 384 bp, Zea mays
  Clone ID: LIB3279-051-P1-K1-D7
cattagtgagatccaggcccagctgaagaataagaatgtcacagtggatgtcagggcaaattcagaggctaattctcaactacagtcactgttgaggaacttggtgtactaggcttgaaaaagataatcaccattccttatccacatccagcatttgggaggcttgaaatacagtacttgcatgattatgctggtatcaacgccagttctaccatgaacagaaaaccttcggttaacctttctgctgtatttggcaacaaagctattgctgctggtgctgatgttgtgtatgatggtgctactggggatttcactaagtacaatgctgggttgagttacaccaatgcagatctcaatgctgctgtgaccttgaacaacaaaggg

SEQ ID NO: 5589 - DNA, 354 bp, Zea mays
  Clone ID: LIB3279-051-P1-K1-D8
gctgtgcctgttccaaagtctgagtgcaacaagactacccagttgggtattagcggggctggtggttacgttgcggagtcttatgcgctattgtttatcacccggctgacaaccttgtgtctttcctgaacaatgccaagggagctacagtgggagatgctgttaagaagcttggtctctgtggtctcttgactagaggacttcctattcgtatcgacatgattggtacccttactggtgctcagtggggaatctacgatgcattcaaagtgatggttggactcccaacaacgggaggtgttacacctgccccagcagcaaaagctggattgaaagccagtgcttgattttttt

SEQ ID NO: 5590 - DNA, 379 bp, Zea mays
  Clone ID: LIB3279-051-P1-K1-D9
cggacgcgtgggcggacgcgtgggcggacgcgtgggcggaacgcagcgcagcggcggcggcgatagggagagagagagagtctgcaggatccagcaggccgaggaaggagtcagcggcgggccggagaatatgagcggcaacggcgcgaagaaggtggtcgatgcggcggtgaaggccggcaggacgatcatcgactgggacggcatggccaagttgctcgtcaccgacgaggcgcgcaaggagttcgccgccctccgccgcgctttcgatgacgtcaaccaccagctccagaccaagttctcccaggaaccccagccgattgattgggagtactacagaaaaggaattggatcaaaagtggtggatatgtacaaagag

SEQ ID NO: 5591 - DNA, 375 bp, Zea mays
  Clone ID: LIB3279-051-P1-K1-E1
gcggcgacaagaacggtaagaagaaggcgaacaagtcggtggagacctacaagatctacatcttcaaggtctgaagcaggtccaccccgacatcggcatctcttccaaggccatgtacatcatgaactccttcatcaacgacatcttcgagaagctcgccggcgaggctgccaagcttgcgcgctacaacaagaagcccaccatcacctctcgggagattcaaacctctgtccgccttgtccttcccggcgagctcgccaagcacgcggtctccgagggcaccaaggccgtcactaagttcacatcatcttacatttgaggtagtagctattgggtggcgttggtagttgtgtctcaatttgtctgctactaata

SEQ ID NO: 5592 - DNA, 378 bp, Zea mays
  Clone ID: LIB3279-051-P1-K1-E10
gcgcccgtccagccgccggctgtctcggccgtcgccgccgccgccgccgccctatcccggtccttcaggtgaccaggttggccatggccttcaacaagatcaaggtcgccaaccccatcgtcgagatggacggcgatgagatgaccagggtgttctggaaatctatcaaggacaagcttatattccctttcgtagacctcgacatcaaatattttgacctcgggcttccacaccgtgatgctaccgacgacaaagtcacagtggaggctgcggaggccacactcaagtacaatgtggctatcaagtgtgccaccattacaccagatgaagcaagggtaaaggagtttggcttgaaggctatgtggaagagcccaaatg

SEQ ID NO: 5593 - DNA, 371 bp, Zea mays
  Clone ID: LIB3279-051-P1-K1-E11
ggagagcaagcttcgtctactacagtctctgcagcaagtgatgtgaaggctggggctgggccaacggatcagcgtctgcaaacgtgtcaaccgacaagaacaggaactacgctgtcctggcaggcacaattgctgatatgagtggcctgggttggtatctattgtcaaagcctaagaagtcggaggaggttgtggactgaagagggggttacgaatgcgagctgtggatggttggccttatatttcaccatggtttactttctgcgcacgccttctggaaataatcgttgaaacatacgctgcagtctgcattacttgttctgaggcctggtgcaacaccgaacattgaagtgtgtactcgagacgttccg

SEQ ID NO: 5594 - DNA, 373 bp, Zea mays
  Clone ID: LIB3279-051-P1-K1-E12
atatggtcctctgcatggcggcgcaaacgaggcagtacttaaaatgttaaatgagattggaagcatgaaaatattccagatttcattgtaggagtgaagaacaggaagaggaagatgtccggttttgggcaccgtgtgtataaaaactatgaccctcgtgctaaagtcataaggaaattggcagatgaggtgttctcaattgttggacgggatccacttattgaggtggccattgccctagaaaaggcagcgctgtcagacgaatattttatcaagaggaagctgtatccaaatgtggatttctactctgggctaatttatagggcaatgggattccctacagaattttttcctgtgctgtttgctattcctc

SEQ ID NO: 5595 - DNA, 378 bp, Zea mays
  Clone ID: LIB3279-051-P1-K1-E2
ctaccaaaaaaacagcgacctctaacgcttagctagctctttgtgtcagcgcctgagcatcgagctattgcatggcgcactccaccaccttggccctggtgattgtcgttgtgctggcgctcacctttggtgccacggtcagtgtctccgctcccgtgaacaagtcgtgcgtcagcggtagcgccggcgccagcgtgagcattggctacggcggggcaagagccagcgccggcgctggcgtgtcccttggcgccgacgcgtaccggagcacgtgcccccgtgccgaggagatcatccgtgcggccgttgagagggccgtcgctgccgacccacgcatggcagcgtctctcctgcgcctccatttccatgactgcttcg

SEQ ID NO: 5596 - DNA, 379 bp, Zea mays
  Clone ID: LIB3279-051-P1-K1-E3
gccatctagacgctcatggacatcgacgactcgccgctcagcgctgcgggggccgggttcctcgacgaggggacggggaaggcgagatgttcttcgccccgcaccgcgcggcccgcggcggcactggcgatgcccgcgggcccctccccttttccgggttcttcaacagcttcgacggcgccgattttgacgacgacgacctcgcctgagggaactcccacccggttcggtaacggatgttgttcgtggatcgcgaatcgtgttatgtcgataccgcgatggggtctgttaattagcgcatcgattcagactcgttcgggcaatctgaagatgtctagggatcaacattacctttgtgtacctttgtggcctatggttc

SEQ ID NO: 5597 - DNA, 375 bp, Zea mays
  Clone ID: LIB3279-051-P1-K1-E4
gggaacccgaccacggaggcattagagaagaagatgagcgcactggagaaagcagagtccaccgtgtttgtgggtcagggatgtatgcagctgtggctatgctcagcgcacttgtccctgctggtgggcacattgtgaccaccacggattgctaccgcaagacaaggatttacatggaaaatgagctccctaagaggggaatttcgatgactgtcattaggcctgctgacatggatgctctccaaaatgcgttggacaacaataatgtatctcttttcttcacggagactcctacaaatccatttctcagatgcattgatattgaacatgtatcaaatatgtgccatagcaagggagcgttgctttgtattgaca

SEQ ID NO: 5598 - DNA, 377 bp, Zea mays
  Clone ID: LIB3279-051-P1-K1-E5
ttttgttttctacttttttaatccagatttcaaatcacctggtgaacctaaatacttggaggcatttgatctagcccagaagaggctgaagatgttagctttaagcaggcatggcttatatacttctggagaagagccaaaactcatggtgttgaggaagatattgctgatgaccggcttcagctttggattggtcgcaacgcacaagctccaaattctcatgacgctatcgatgtggagagaggtctaacagagctgaggaaattgggcatagagcagcaactgtgggagggctcgcgagcagatatagatcaagcttctttggcgatggagaatcagtaagaattttccacggctgtctatgcttcgtgtatcat

SEQ ID NO: 5599 - DNA, 377 bp, Zea mays
  Clone ID: LIB3279-051-P1-K1-E6
tgttcattcaactctccatcttccttttgaccacaatatgtatggccagaaccttactgttcagaatttcttaattcatcagttcctgtttctgtgcaagcaaccttcccctacaagttcgttgtgagcaagttcttgcagcctggagcatatgatctggttggttacatagtgtatgagatcgaccagcacccttaccagaatgtattctacaatggcactatcgaggttgttgaggctggaggcttactcagtgttgagtctgtgttcctcatcacccttggatttgcacttcttggtctgtttggattgtgggcatatggccaggttcagcagctctcgaagaaaacaaagaaggcacccaaggtggagctcgg

SEQ ID NO: 5600 - DNA, 381 bp, Zea mays
  Clone ID: LIB3279-051-P1-K1-E7
ctctccgcctccgctcctcgcgccgccgacgcgtatcctcctgtacaggtaaggagaggaagagggcgaaatgggaagcacaacaacgtcatccccaacgggcacttcaagaagcactggcagaactatgtcaagacatggttcaaccagcccgcccgcaagcagaggcgccgcatcgctcgtcaaaagaaggctgagaagatattcccccgcccgactgctggtactctacgccccattgttcaatgccagactttaaagtacaacatgaagtcaagggctgggagaggctttacccttgaggagctgaaggctgctggcatcccaaagaagcttgctccaaccattggtatttctgttgatcaccgccgcaagaacaaa

SEQ ID NO: 5601 - DNA, 382 bp, Zea mays
  Clone ID: LIB3279-051-P1-K1-E8
gatttacggaaatttcctataaaaataatttatctttattaggcttctttggtggggctctcagttggcaagggacttctatattacgaaggttcacaagttctgttgagtagacaataactgtctatttgacatgacattggcaccataagactgtacatgcttaccttgtctggcttaggaaaccccctgtattttaagtagctttgtatgtggatgcaccgactggaggcacgaacttacgtttcatggtgtacccgcctaataagactaggcttgttgctgacaccgtatctttgtacaccgcactgttgctaggaccccttagttggctcagcaacctgtacattatcggcagcttgcacattgatgatgtttagct

SEQ ID NO: 5602 - DNA, 382 bp, Zea mays
  Clone ID: LIB3279-051-P1-K1-E9
cggacgcgtggggtcaactctcgtttccccccttgcgccgtcagctatcccggtccattatcggtacgaattcgggagatctccgaattcgggatagataaatttgttgtgctcgcgcaagggagtttggcaaatgagggccgtgcaaatctagaagccccagcctgggggcgggtggttggcctctgactctggggatgtcgcggacccaaagacggatttttgttctggtttcgatccccattgcccccccgcgaggcttcatttttcttcccctttgtcttgacggccttaagttaagcgggtgtgtttcagtgattattattagtatacatctgcactgacatggtacgtttcttgatccgcagttccttgtgaattg

SEQ ID NO: 5603 - DNA, 349 bp, Zea mays
  Clone ID: LIB3279-051-P1-K1-F1
caaacctaacgtaccctcttccgcgccgacatgtctgggaggaagaagacgcgggagcccaaggaggaaacgtgacgcttggccccgctgtcttcgagggagaacacgtgtttggcgttgcgcacatctttgcctccttcaacgatactcttatccatgtgacggatctgtctggaagggagacttttgaccacatcaatgctggcatgaaggactacgatgatcgtggtgagcccttgttttatgctgatatgcaagtctgatatgatgatacgcagaggtgctgtgttaattaacgcattgatttagacttgattgtgcgatctgaagatggttagggatcaacatt

SEQ ID NO: 5604 - DNA, 379 bp, Zea mays
  Clone ID: LIB3279-051-P1-K1-F10
catctccctctccgaaatcaaggtagcgtacaccgctgcagtttctagagccctctctgccactcgtgacccactagtcacaatgcctgccctcgccaagcccgcctcccgcaccgccaagcccgccgcggctccgaagccgaagcctgccgccgccaagccgaaggcggccaccgctggtgcctcccacccgccttacttcgagatgatcaaggaggctatcacggcgctcaaggagaggaccggctccagctcgcaagcgatcgccaagtatgtgggggacaagcacggcgcgtctgtgccggccaacttcaagaagatgctttccatccagctccgtgggtccgcagccaagggcaagctcgtgaaggtcaaggct

SEQ ID NO: 5605 - DNA, 378 bp, Zea mays
  Clone ID: LIB3279-051-P1-K1-F11
atcctcgtgacggctcctcgccagtcgcctcgtctctccctgccgcgtcgcctcgtctctccctgccgatcgcctccagttccgacgccagcgcgcctcccgcctccgccgcgcctgacgaacgcagtgtaggactgtgcaggtagagaggaggagggtccggcgagatggggatgcgagataagaagcggaaccagaagcgagtgctcgcgcgccgtaccgcggtaccgcgcccaggcgagggcaaggacttcctgccgctggaaggaggccccggtaagaagctccggaaggtgcagcagcctgaagagcccgaaaacacagccacagtcgtctacattgggcatatcccccatggtttctacgaggacgagatga

SEQ ID NO: 5606 - DNA, 366 bp, Zea mays
  Clone ID: LIB3279-051-P1-K1-F12
ggcgaccgcagaccgggtcgccgccaccttcctctcctctttccccactgaccatccccgccccttttctccgtttccctcgtgacaaaccctgtcctacccgtctcccttcgggccgctgtcacaggtggcccacggctcgcctcccgtctccgggtccaccgcgtcggcgccgccgtcgcccagcttcccaccacgaatccggaggtagcttctggggagaagaagatcagatggtcatcaagggctgcgcggtcttttgcgatggcagagctggaggcccggaagatgaggtaccctaccacaggcaccgaggggctcctcatgggcattcttgttgaaggaactagtggcgcagcaaaactt

SEQ ID NO: 5607 - DNA, 378 bp, Zea mays
  Clone ID: LIB3279-051-P1-K1-F3
cccacgcgtccgcccacgcgtccggatcgacgacgaggaatcaagcagccagcagcgaccgatcgagaccagccctgtggctgtgccgctgtgggttggatccggccgattcgacagcacgcggcacctacggatgccccacacccgtctcctgagagaactcgatcgattgcttcatggggagcggcaaggcgtcgtctccgccaggccccactgccggcgggcgcggctcgccgccaggtgccgccgtctgctgcatgtgcggcgaccgcggcctcctgcccgagctcttacgctgctccgcctgctccgtccgctcccagcacacatactgcacggatcggtacccgaaggtggagtcatacggcgtctgcaact

SEQ ID NO: 5608 - DNA, 371 bp, Zea mays
  Clone ID: LIB3279-051-P1-K1-F4
cccacgcgtccgcccacgcgtccgcgtgttcgttcggagcgcacacacacacaaccagatctcccccaaatcccccgtcggcacctccgcttcaagatgcagatctttgtgaaaaccctgaccggcaagactatcaccctcgaggtggagtcgtctgacaccattgacaacgttaaggccaagatccaggacaaggagggcattcccccagaccagcagcggctcatcttcgctggcaaacagcttgaggacgggcgcacgcttgctgactacaacatccagaaggagagcaccctccaccttgtgctccgcctcaggggaggcatgcagatctttgtgaaaaccctgaccggcaagactatcaccctcga

SEQ ID NO: 5609 - DNA, 376 bp, Zea mays
  Clone ID: LIB3279-051-P1-K1-F5
tctacaactacgatatggagaaggcagaatttgcaggcctctttgcgaagttcacgccaggatttggcgctgatggagctctgctcttctttctgggcatgaagaactccatcccgaagcggcagggcggcaagaagaaggcccccaaggcgaagacgaactagggctgattagatagctgcacgcctcaggtggggtgtatcaggagacaggtctatttcgaagcatgctcagcgcgatgcagggaatgccatcgagctgcgcttttacatgtttatcatcagattccattttgcggcccgaacaaaggtgtgaccggggtgggttaggcgactagattgcacgattatgtacttgagatttgtttgttgaactg

SEQ ID NO: 5610 - DNA, 380 bp, Zea mays
  Clone ID: LIB3279-051-P1-K1-F6
gttgcaagaaagaaaaaggtcacccctctaacaccacgccgccgccgtttgctgctcggcgcctctcctcacacccgtacgccaacgtctccaatctcgtatactttcgtgctcagcatcatggacggcttccccaagagcgtcggcggtggcggccctaacattccggcgggatcccaccccgcacgcgggagccaggcggcggcaggaggaggcgcgacgcaacggacgcagtatccgtatgtgactggtaattcagtcattgccttgaaatacaaggatggtgtgatcatggcatgtgacactggagcctcttatggatcaactttgagatacaagagtgtggaacgcattaaggcagttggcaagcatagcatcat

SEQ ID NO: 5611 - DNA, 314 bp, Zea mays
  Clone ID: LIB3279-051-P1-K1-F7
gtttagtttccgcccaacctgaaccagataggacgccgactggatcacttgaagggggtattaaacagctcagaacttactcaagaatctttttggtaccaaagattcatataaacaagaaaaatgcattcaatttcccaaggacctgaaccattcagaggcatttacaggcacttcataaacgtagaatgcctgccaagccattcatgaaccccataaacagcctctgttctcagccgcttattaccacctctgtcaactaaggtctcactgcattttcaaagacctgcaatagtttataatatggaccattt

SEQ ID NO: 5612 - DNA, 245 bp, Zea mays
  Clone ID: LIB3279-051-P1-K1-F8
gttttactaacaacaagtatggattaattacaatgatgttactgtaattgcatggggtctaaaagatgcgactttttaactaaacacagtgtttacgacgttctacgattaggtgctaaaaaaattttcggtagtcgtgatacacatcaagatttggcttcggtatatagttacacatatcgtgatgtttatattgttatagtctgttcaagccttactgatcgttttctggtttagacttctgc

SEQ ID NO: 5613 - DNA, 331 bp, Zea mays
  Clone ID: LIB3279-051-P1-K1-F9
cccacgcgaccgatatgctcccaatgcatgctggctccaaacccaaactccgaggggacccacatcgacggcgcactacccgcatggaacaactcacacgggtaaccattgggctgaaacttttgtatttgagctaaatgacacggatgctgaagcactactgaagacaagacaagttccttctggtcttcctaggcaaatggcaattcagcaatatttgcgctctaaaaatcgtctgctcatattgggtttcaattcgacattgactgagccagtcgaatcctttgggagaaggggtggtgaccaaatcaatgaaatggaactcaagttg

SEQ ID NO: 5614 - DNA, 377 bp, Zea mays
  Clone ID: LIB3279-051-P1-K1-G1
cccacgcgtccgctcaatacggcatgctttaacgatgccatccgatgagagagagaaacgacacagacaaactacgcacatgtcacaactgacacgggtcaagattgggctgaaacttttgtatttgagctaaatgacacggatgctgaagcactactgaggacaagacaagttccttctggtgttgctaggcaaatggcaattcagcaatatttgcgctctaaaaatcgtctgctcatattgggtttcaattcgacattgactgagccagtcgaatcctgtgggagaaggggtggtgaccaaatcaaggaaatggaactcaagttgcatactgacttaaagggtcctctgagagccctctgtgaggatgagcgcac

SEQ ID NO: 5615 - DNA, 328 bp, Zea mays
  Clone ID: LIB3279-051-P1-K1-G10
ctccgactcagatggccagccgcgggtccggcccgaggtgtacccgctgttcgcggcgacgggcgtggccgtcggcatctgcgggtttcagctcttccggaacatcactggcaacccggaagtcagggtaaacaaggcagggagggcagctggtgtgcttgagaaccatgaggaggggagacgttacgccatgcatggcctaagaagctttgtgcacgacaagactcctgagatcatgcctgcagttaacaagttcttcactgaccctaagtgaagcatgttgattggcatactactactactacttgctactggggattttacactt

SEQ ID NO: 5616 - DNA, 374 bp, Zea mays
  Clone ID: LIB3279-051-P1-K1-G11
cgaattttggtcgacatgaagaaacggggtctctctcttaaacaatgcatctcgaaggctaatcaattgatattgtctcttcaaaactgcaatcagaattgacaaatttggaatcgcgacatgattgtcctcacatgaatggcactcttagcctaggtctttcctcagcgagagcagcagttgttcttcctctcaaaatggacaaaggtggacctcggactgcactttttaggctatgcaagagtttacagtggccaattccagaatttgaatttatggaacaaaggtttaggactcctattgttctggatggggttacaactacaaacttcaatagcttcgtttcaactatcaccttgcacatacctgatgtg

SEQ ID NO: 5617 - DNA, 374 bp, Zea mays
  Clone ID: LIB3279-051-P1-K1-G12
cttactacagtcgacatgaacatgccggggctctctcttaaaccgcggatgcggatcgctaatcaagggatattgtctcttcaaaactgcaatcagaattgacaaattaggaatcgcgacatgattgtcctcacatgaatggcactcttagcctaggcctttcctcagcgagagcaacaattgttcttcctctcaaaatggacacaacgtggactctccgactgcactttttaggctatgcacgagttaacagtggccaatcccagaattcgcatttatggaacaaaggtttaggactcctattgttctggatggcgttacaactacaaactccaatagctttgggggaactatcacctcgcacatacctgatg

SEQ ID NO: 5618 - DNA, 381 bp, Zea mays
  unsure (1)..(381): unsure at all n locations; Clone ID: LIB3279-051-P1-K1-G2
cccacgcgtccggccaaccaagcagctctgcagtcgagacatgaagcgagccgtctccgctctctgggccgccgcgccgtccgccaagcctacctctacacccccaccgccgccaccgccacctcgtcgtcgcctgagtttggggcgtccacatcagaggcgtgggacgggcgtttccggctccacaagccgcgcgggcagcacctgctcaccaacccgcgcgtcctcgacgccatcgcgcgccacgccgccatcagtccaggcgacgccgtcctcgaggtcgggcccggcacgggcaacctcaccgcgcgcctcctcgcgtnccaagcggcgcgcgtcaccgccgtcgagatcgacccgcgcatggtcgaggccgtcacc

SEQ ID NO: 5619 - DNA, 339 bp, Zea mays
  Clone ID: LIB3279-051-P1-K1-G3
cccacgcgtccggccaaccaagcagctctgcagtcgagacatgaagcggggcgtctccgctctctgggccgccgcgccgtccgccaagcctacctctacacccccaccgccgccaccgtcacctcgtcgtcgcctgagtttggggcgtccacatcaaaggcgtgggacgggcgtttcctgctccacaagccgcgcgggcagcacctgctcaccaacccgcgcgtcctcgacgccatcgcgcgccacgccgacattattccaagcgacgccgtcctttaggtcgggcccggcacgggcaaccttaccgcgcgcctccttgcgttccaagcggagcgcgtc

SEQ ID NO: 5620 - DNA, 375 bp, Zea mays
  Clone ID: LIB3279-051-P1-K1-G4
cccacgcgtccgaccatctagggtttctagggttttcgaggaggaggaaatggcgtctgatagggtgctcggactgtgaagtggttcaacggaaccaagggcttcggtttcatcacccccgacgacggtagcgaggacctattcgtccaccagtcctccatcaagtccgacggctaccgcagtcttaacgacggcgatgccgtcgaatacaccgtcggcagcggcaacgacggccgcgccaaggccctcgatgtcaccgcgcccggcggcggcccgcttgccggcggggaacgtcccgacggcggcaacggcggtgggcgaggcggatacggcggcggcgaccgcggttacggcggcggcggtgaccgcggctac

SEQ ID NO: 5621 - DNA, 377 bp, Zea mays
  Clone ID: LIB3279-051-P1-K1-G5
attcgctaatactccaaagcttacttcgataattctttgttcattgtaagcttcagagattttgaaatggctgagagggaaagggtgatgaactcacccatgtggagtactatgatgctgcagagaaggccaaggttggaatgattactgaagagatcatggctagcttgtttgatgattctgatgacagcgaagaatttgattttgaagaggataatgccaatgtcgatgatcggtcatattgaggtactgagaaattctaattatatcagtgatatttctatcgtgaggcttggtggagaggaaattacacctattccttagaaggatgaagtagtggtagtgaagtgctttaaaaatttgatatctaccttcat

SEQ ID NO: 5622 - DNA, 378 bp, Zea mays
  Clone ID: LIB3279-051-P1-K1-G6
caagagcttgctgctgtcttcaagaaaatcggcgacaagcaaacatgtactattggcttctacgaactgtatggataactcagctctacccaaaggttgatatatttgctcagcttcagaatgctagtgaagcatttagaacctatatcagggatgggctagctcaggtggagaagaatgcagcagctggaagaacgccttctagtcttccactgtccacgccacccccaatagcagcaataccttctccaaaattggcaccgtccccagttcacacaaaatcaattggtagcaaaacagattataacgaagataatgccagtggtgagacacaacctttcagaggtcaaggtgacgccactgaccaacaaactgata

SEQ ID NO: 5623 - DNA, 221 bp, Zea mays
  unsure (1)..(221): unsure at all n locations; Clone ID: LIB3279-051-P1-K1-G7
aaaaaagggngggagggacgcgtccgcggacactacgcatcaaacaaataattatattttaaccttagacaaaaaacgtggcgggtggaaattttggggcgccacaccctaccacaaaccttcctttatatccacaccggcggcacacacaccttgtttttgactgagcttggggcgtccacatcatatgcgtgggacgggcgttttcggtttcataagcc

SEQ ID NO: 5624 - DNA, 260 bp, Zea mays
  Clone ID: LIB3279-051-P1-K1-G8
cgtcatcatgcactaagaagtgctgcttaaccttgatcctggaccagatgcctggtcaatgatgaatcaaacttcaaggctgcacgaatatagaacgacgctctccggtatgaaccggagaagaagtcctggacagaactcatggaaacagcttcagtctaagagactatttctgcactcctggatgtttagacccctatagtgaaggctccacaaatgcctgtcattaagattgacaagcctgccatggctgaaatctc

SEQ ID NO: 5625 - DNA, 247 bp, Zea mays
  Clone ID: LIB3279-051-P1-K1-G9
agtaaacatgcactaacaatctctgcttaaccttgacccgggaccacaagcctgggcgggaagaatgaaacgctaatcgaccacacatacagtacgacgctctccgatcggaaccgttgtataagtcctggacagcactcatgaaaaagtctcagtctcagagactacttctgcacaccttgatgtttagacccctatagtgtaaactccacaaaaccctgtcattgagatatacaagcctgccatg

SEQ ID NO: 5626 - DNA, 325 bp, Zea mays
  Clone ID: LIB3279-051-P1-K1-H1
ctccgactcagatggccagccgtgggtccggcccgaggtgtacccgctgttcgcggcgacgggcgtggccgtcggcatctgcgggtttcagctcttccggaacatcactggcaacccggaagtcagggtaaacaaggcagggagggcagctggtgtgcttgagaaccatgaggaggggagacgttacgccatgcatggcctaagaagctttgtgcacgacaagactcctgagatcatgcctgcagttaacaagttcttcactgaccctaagtgaagcatgttgattggcatactactactactacttgctactggggattttaca

SEQ ID NO: 5627 - DNA, 372 bp, Zea mays
  Clone ID: LIB3279-051-P1-K1-H10
gttcggcggcgtcggccagagcgggttcgggcagtaccatgggaagtactcgttcgagatgttcagcccaagaaggcggtcatgaagcggggctaccttgtggagctgacactcaggtacccgccgtgggacgagagcaaggtcaccctcatgcgctacctctaccgcttcaactacttcgccttcgtcctctctttcctcgggctcaggcgatgaacttcactccagcatcaacgcaagggtcgcacagggattgggcccaataaaccggcattgacagtggatggaggaacatgccaatatagacaatatgcagtagttgtgttgtttgtgaggaacaagtgtcatgccgcacttcaaaaacagtaatgt

SEQ ID NO: 5628 - DNA, 372 bp, Zea mays
  Clone ID: LIB3279-051-P1-K1-H11
ctttccgaagcttctcgaccccccatcccctccctgacatggccggcaacgcgaaggccggggcggccatgcaaggccggagtcaacccaggaggaggaggaggactggaacgaggccgcgggggacgtcaccagagtcgaccgcgccgccaccaatggcgccagcgaggggggcgcgcccacagacaggccgatccgggtctacgccgacggcatatacgacctcttccacttcggccacgccaagacactggagcaggccaagaaaccggtttcaaacacatatgttgttgcaggatgctgcaaagatgaggcgacacataaattcaaaggaagaactgttatgactgacgatgagcgatatgagtcact

SEQ ID NO: 5629 - DNA, 372 bp, Zea mays
  Clone ID: LIB3279-051-P1-K1-H12
atgacttgtcaagatgagataactcaggtcatgattcatgaactgatacatgcctatgatgactgtgtgccaaaaatctgaactggaagaattgtgctcaccatgcttgctctgagattcgagccaatcaccttagtggtgattgccattacaaacgtgaattgttgcgtggtttcatgaagataaagggtcatgagcctgaatgtgtcaaaaggcgggctctgatgtctgtgaaaaacaacccatactgctcagagggtgctgcaaaagatgcaattgatgctgtatgggatatatgctacaatgacacacgcccatttgatagagccccatgaaatcttttcagaacctgggatacattagctattttgg

SEQ ID NO: 5630 - DNA, 375 bp, Zea mays
  Clone ID: LIB3279-051-P1-K1-H4
cggacgcgtgggttctggagaggtctgggtcggtaatcctgctaagttcctaaggaagcttacagaagaggaattgcgttcatcgctcaatcagcaaccaactatatcaacctagcccaggtccatgcagccgagaacgccaagagcttcgacgagattgagctcgagaagatgctgaggaagaagtacgcgcacaaagacgaggagtacgactcgatgcttggggtggtccgcgagatcccgccccagctcatccttcccgacaacatcctcccacacaatgctcagaaggcggttgcccgctgaaccttttctcaacccatgcttggcgttgttgcctgttgtcttggagcattttgacacgcgttcgttctc

SEQ ID NO: 5631 - DNA, 275 bp, Zea mays
  Clone ID: LIB3279-051-P1-K1-H5
acgcgtgggttctggagaggtctcggatgctaatcctgctaagtcccggaaggggcttacagaagaagaatatgaatgcatcgcttaatcagcaacccactatattaacctaacccaggtacatgcagccgggaacgacaaaagctaccaccagacggctcctcgtaacgattctaataattaaacttccgcctctattttctcgggctcacgcgatgaactttacttcaccataaacccaagggtcgctcatggtttgggcccacaaaatccca

SEQ ID NO: 5632 - DNA, 375 bp, Zea mays
  Clone ID: LIB3279-051-P1-K1-H6
ccgccaccgtcgccaccatctataccttcacagggagcatcggcggcactggaacgcgatttcgagcaggcgcgcgagctgtttctgacgcacaacgaaaaactacctgaagcgtcaacatcagtatcggcgccaccgctagcgcagtcgccggctcgccgcttccggtggacaacgagatactaccgtaggcgccttcatcgcagttgacacgcgtgatgaagcttggataggacagtgttaacacgtcctgtggggcggtctggaactggatcagttcttcgagaggttcttcaaagatactttcgtcatttctttttctgcatccttatcgaaggtatagtgcctcgaactgatcgaccttagctgcgttct

SEQ ID NO: 5633 - DNA, 377 bp, Zea mays
  Clone ID: LIB3279-051-P1-K1-H7
cccacgcgtccgaatcggtctaagtgagaagatcagtgttggcacttcagttgtaaacgataaagtgaagaaatggatcagaaataccaagtctctgagaagacaaagtcagcactggcagctgctgaacatagtgtctcgactgctggatctgctatcatgaagaacaggtatgtgctaaccggagctgcatgggtaactggtgctttcagcaaggtcaccagtgcagccaacgaggccggtgcaaaggctaaggaaaaaatagcagtcgagcaggagcacaagaatgctgagggtgggcctgcacaagcgaacatctcagagacccatgaagcgcacaggggtttggacggcggattctcaaggctacatgactc

SEQ ID NO: 5634 - DNA, 358 bp, Zea mays
  Clone ID: LIB3279-051-P1-K1-H8
cccacgcgtccgaatcggtctaagtgagaagatcagtgttggcacttcagttgtaaacgataaagtgaagaaatggatcagaaataccaagtctctgagaagacaaagtcagcactggcagctgctgaacatagtgtctcgactgctggatctgctatcatgaagaacaggtatgtgctaaccggagctgcatgggtaactggtgctttcagcaaggtcaccagtgcagccaacgaggccggtgcaaaggctaaagaaaaaatagcagtcgggcaggagcacaagaatgctgagggtgggcctgcacaagcgaacatttcaaagacccatgaagcgcacaagggtttggacggcggat

SEQ ID NO: 5635 - DNA, 376 bp, Zea mays
  Clone ID: LIB3279-051-P1-K1-H9
ctcaaccggataggtagcaccggagcaggtagaacgctgcacaatccccttcgccgccgccaagatgggaacgttcctaagaccaagaagacgtactgcaagaacaaagagtgcaagaagcacacactccacaaggtgactcagtataagaagggcaaggatagcctgtctgcccagggaaagcgccgttatgaccgcaagcagtcaggatatggtggtcagaccaagcctgtcttccacaagaaggccaagaccaccaagaagattgttctgaagctgcagtgccagagctgcaagcactactcacagcacgccatcaagagatgcaagcattttgagattggtggagacaagaaaggcaagggcacatctcttt

SEQ ID NO: 5636 - DNA, 396 bp, Zea mays
  Clone ID: LIB3279-052-P1-K1-A1
cctagcctgaagaacagtagaactcatactcgagcgctccaaagcgagccaccggcgatctgctcctccctcttgaccctcctcctgcgctgcgcaggcatgaggcgcctcctcgtcggcgccctcgtcctttgtatcgccgcggtggtggagtccaagccgcctctcgactctctgggcatacccccgcaagatgaggcgtactacataggctgcgtgatcaaatgcagggaccgatcgggcaggttttccagggaccagctcaacgacgacttatgcgactgccccgacagcaccaactagcccggcacatctgcatgccctgaggcgaaaaactactcgaggaatgcaagccacactccagtcacgatcttgtcgtcacgagtgaatgacggc

SEQ ID NO: 5637 - DNA, 393 bp, Zea mays
  Clone ID: LIB3279-052-P1-K1-A10
agcggcggctatgctaccttggagacagagcaacctgggagcctaacgcccatgcttggggacaaaaaggtcgagcatttttgggcatcaaacgaagtgccaagcctggaagcttacctcctccagtcccaaagaaaccgaagaactgaacctggtgatagcactcagccaacgaagcaggctacaacgcatttactgtgaacagcaatcagcccacaagcttccacggctcaaccccacgccgccgcactggaaatgcaatatcctctgtatttcttctaagctgatcacactaacattctggcatgttcgatggggttttgtaattcagtgatatacgtgtgcatccttgatctgccttgaacatgtaagtgatggaactaaatattgttc

SEQ ID NO: 5638 - DNA, 393 bp, Zea mays
  Clone ID: LIB3279-052-P1-K1-A11
cttggccgacgcctgcataatctcagtgccactcggcgtgctcaaggcgaacgtaataaagttcgagcctgagctgccccatggaagagctccgccatcgccgacctcggcgtgggcaccgagaacaagatcgccatgcacttcgacagggtcttttggcccaacgtcgaggtgctgggaatggtcgggccgacgcccaaagcctgtgggtacttcctgaacctgcacaaagccaccggcaatccggtcctcgtgtacatggccgccggaaggttcgcccaggaggtggagaagctgtcggacaaggaagccgtcggcctggtcgtttctcacctgaagaagatgctcccggatgccactgaaccgacgcagtacctggtgtcgcgatggggc

SEQ ID NO: 5639 - DNA, 394 bp, Zea mays
  Clone ID: LIB3279-052-P1-K1-A12
gaaatcgtgaccgcatgcaaagcagcctcaacatttttgaccggcacatcgtcaagcgcctcttcaaatgcggaggatacggtggctcaacctcgacaggaaattccctcttcgagggggcatggatccgaagtattatcggtatgacaatgaagccgtcgaagagcctagtctgtgtagatagttcagatagcgacagctccgggagcgaatcagaatcagatggcgatcggcccaacagcgatgacaacgctgagcgacaagctaaaggcgtgaagcaggagcgaggcacgaaaaaaaagaataacggaccacattgccattcatgaagctcactcacaccaatactgcagagagaggaaagacctctacatgctgccgttttctgataaac

SEQ ID NO: 5640 - DNA, 308 bp, Zea mays
  Clone ID: LIB3279-052-P1-K1-A2
gggttgccttatcctaccccacctgttcgtgttcaggttctgtttcttgggccagggggaagacataatctcttccgactttgagtccgttgcttcgttggcggactctcctgggccaccgacgaccactctcttaacaacgccttcagcacctacggtgagttccttgagtcgaagatcatcctggatcgggagacgcataggttccgcgttttcggcttaatcaccttctccactgaggacacgattcgcatttccatcgagggcattaacttctaggatcttgacggccgtaacattacccttaa

SEQ ID NO: 5641 - DNA, 371 bp, Zea mays
  Clone ID: LIB3279-052-P1-K1-A3
ggatcacaggatcttggtagcaatatggacctctggaccttcgatgacatgcccatcgctggcgatttcttctgaggaatttgaagttggccataggactatgtacatagggactagggaataaagactgggagattgggaagcacctgcttggcaccttggggtagcatatgctcgtgtctagctcagatgcagaagtcgcattctgaaactctttggttatcgacctgttccctattttaactatctctgtatgagagccatttatgagactgaaccattttaccattttgttttcccccttctttcgttgttacagtatatggtttaacattatgatttatggatatgtggccaaacatgccttttat

SEQ ID NO: 5642 - DNA, 401 bp, Zea mays
  Clone ID: LIB3279-052-P1-K1-A4
cggacgcgtggggggatatgcattcatcaatatgacggatccacagcagatagttccattttacaagacattcaacggcaagaaatggagaagttcaatagtgagaaagtggcatcacttgcgtacgccagaatccagggaaggaacgctttgattgctcatttccagaattctagcctgatgaatgaagagaaatggtgccgttctatgcttttccacaaagatggcccgaacgcaggagaccaggaaccattccctgtgggtaacaatgttcgttctcggtccgggaggaacagaccacttagcagtggttcggagactaccaaagaggcaagtccatcaacctctcctaactgaagagaagccggctcccgatattccaactcaggacaggcaggcgg

SEQ ID NO: 5643 - DNA, 395 bp, Zea mays
  Clone ID: LIB3279-052-P1-K1-A5
ggaagaaaggggtgaccgtaaggttgcagggtttatattcatgtgcaatgcaaagactaagaaggagtgctaccagagtcgcttgttgggatgcctagtgggaagattgaaatggtcaagaagattaggccaggggtcaagctgttcctgtatgattttgacttgaagcttctgtatggcgtgtacaaggcagcatcacatggtgggctgaaccttgtccatgaagcatttaatgggaagttccctgcacaggttaaggttaagattgataaagattgccgtcctctccctgagagtagtctcaagcaagccatcaaggaaaactacaatgcaaagagcaaattttgatccagagctcaccacaaaacaagtccaaaggttactttttgctgttt

SEQ ID NO: 5644 - DNA, 402 bp, Zea mays
  Clone ID: LIB3279-052-P1-K1-A6
cggacgcgtgggcggacgcgtgggcggacgcgtgggcggacgcgtgggagcgcacctgacacccaccacctccctcccagatccaccccccagccatggccaccgcctttgactccccgacctcctcccccgccgccgcgcccttccacgacgaccctttcctccatttcgacggctcggcccccgccgccgccgacggcttcccggcctccccggacgcctacgcgccctcccccttcggcatgccccactccaacggcgacctccacgacgaccctttcgccgcatctgctgactccaacggtgggcccatccttccgccgcccaccgagatgggccgcgaggagggattcctgctccgcgagtggcgccgacaaaatgctattcaccttgaggaaaaag

SEQ ID NO: 5645 - DNA, 389 bp, Zea mays
  Clone ID: LIB3279-052-P1-K1-A7
gtcccaagttcccgccacacacctctccattcccctcccgaagtcccgatgcctgtcctcaaatcccattgctctatcttcctagcggcgagtcgaggcggggaagacgagctagcggcgaggatgttgcgggtagataagtaccggccgaaaaccctagacaaggtcaccgtgcacgaccaggttgctcagaacctcaggaagtttgtgtcggagcaggattgcccgcacctgttgttctatgggccgtcggggtccgggaagaaaaccctaatcctagcgctcatcaagcagatgttcggcgccggcgcggagaaggttaagctggagaacaagacatggaaaatcgatactggaacaaggacatttgagatagaattggcgatgtt

SEQ ID NO: 5646 - DNA, 366 bp, Zea mays
  Clone ID: LIB3279-052-P1-K1-A8
cccacgcgttcgcagtgacaggccatataatatcgtctactattgggggaaagaatggtgaaccaaagaggactatcttcatatggctgagcgagtggttggaactggatctttcggcgttgtttttcaggcaagatgcgttccgactggtgacactgtagaaggtaacagggctctaccggacagatgatacactaatggggagttacaaataatgcgatcgatcgaccatggcgatgtattttccgtgaggcatcggttattatataccacaagtagcgctgaacttgcacataacttacgcatgggcggtgatcgataagctctttatcacgacatggaacattgctactgcatcaaggacat

SEQ ID NO: 5647 - DNA, 395 bp, Zea mays
  Clone ID: LIB3279-052-P1-K1-A9
cgacacctataagcaccaaccctagctcaaaaccccgcttccacttcacagcctctccgcctccgctcctcgcgccgccgcgcgtcttctcctgtacaggtaaggagaggaagagggcgaaatggtgaagcacaacaacgtcatccccaacgggcacttcaagaagcactggcagaactatgtcaagacatggttcaaccagcccgcccgcaagcagaggcgccgcatcgctcgtcaaaagaaggctgtgaagatattcccccgcccgactgctggtcctctacgccccattgttcaatgccagactttaaagtacaacatgaagtcaagggctgggagaggctttacccttgaggagctgaaggctgctggcatcccaaagaagcttgctccaa

SEQ ID NO: 5648 - DNA, 395 bp, Zea mays
  Clone ID: LIB3279-052-P1-K1-B1
gatactcattagggtgctcactgttgtgcactcagcagtccacgcaggagcctgggctacattcctgactccgtcatcatcttcagatctggagccaaaaacgcggtactaaatgacgtggaggacggcaaaggcgacggcaaagaaagcgaaccacgacgcgagagctactcctacagctacttccacctcatcttcgaccttgtaagcatgtatgcaggcatgcttctgaccgtgtggacgagcgcttcatcaaacagctcataacagatcgatgtggtatggactaccggatggacgcgcatctgcacgcaaaggttcaccgacggggtgaacatctggacgcacatgggcacactgatcgtaccagaccgtgattcatactatgcacccac

SEQ ID NO: 5649 - DNA, 292 bp, Zea mays
  Clone ID: LIB3279-052-P1-K1-B10
cccacgcgtgcggaccaccccgttcacctgcattgttaaaagtatagatgcctatgacgaaggtgcttactcatgaatcttaaggccaacactttatgttgtccagtcaaaatgtattacatgacagtgccaactcggatagcttgtcgtctggacgcactaaatggctcaaacaagcgagagatgactgcattaagacttggcatgagcaagcggccaagccaagacactgaccgacgtgttgaggttgatttaattatggggtattgaagatgccattcatacttgaata

SEQ ID NO: 5650 - DNA, 394 bp, Zea mays
  Clone ID: LIB3279-052-P1-K1-B11
gtttctcaaaacagaatggagaacattctcggtcaagtctgagtaggatggtgtcatttagtggagcatctgccacagaaccgttgttccagggagtggcacatcggaaaattacgtggaagatcttacaggcgttagagatcgtcctgttgcaacactaaattctggggaagagctcaaaaaggtctgtgatttactttatgagtttaaggatgaaatgttgggggcctccgcagcgaagtgtacaaataagagcagcccgtcacttgaagccttgcttgctgaatcatctgattctgaagcgcaaatctctgatctggagggtactgacagtggtgctggcattggctcaagtcgactgtttagtacactctcattttcagatgacgatgat

SEQ ID NO: 5651 - DNA, 332 bp, Zea mays
  Clone ID: LIB3279-052-P1-K1-B12
ctcacgttagcctcacgttgttaccgctttgagctccatactggtgtgtggtgaagtcatgggcaaataaaagccactatgagaccctttgggaagttgttggcgccgatttggacgccaaaaatctagagaggaaccgcctgacggttcgcggtcctggacggtctgcgacctggacacagaagcgggtccttatctgcgtacatctggatggtaagtgatggggcacagggttgtcttcttggcagaagacctagatctcgccttttagagggaccttgtcgaggaggagagaacctagggtgtgtcttgcggttggcaggccacgcaaa

SEQ ID NO: 5652 - DNA, 399 bp, Zea mays
  Clone ID: LIB3279-052-P1-K1-B2
cctttccccgccccaagggtacacggtcgccgccacctgccctagccgcaggagggagcgttcgccgccccgccccgccctccgtccccgtcgcctcgccccccgcgctccgtctgccgcccctgtccggagaaatgtctgagcatctctttgaggacaccttcgtcgtcactagactcgaccctgatggcaaaaagtttgatagagtttctcgtgttgaagctcgcagtgagcagttagatatgtatatgcagctagatgttgccacagatgtttatcctatgcatgctgctgagaaatttaacatggttatagcgcctactctgaatttggatggcaccccagatactggctactatactcaggctggcagaaaaactctggcagacaattatgagt

SEQ ID NO: 5653 - DNA, 399 bp, Zea mays
  Clone ID: LIB3279-052-P1-K1-B3
cccacgcgtccgcgctccgatcgacctgctccctccccaccaccgagcccatggcggaccagctcaccgacgaccagatcgccgagtcaaggaggccttcagcctcttcgacaaggacggggatggttgcatcacgaccaaggagctgggcactgtcatgcgctcgctggggcaaaatcctacagaggctgagctccaggacatgatcaacgaggtcgatgctgatggcaacggcaccatcgatttcccagagtttctcaaccttatggctcgcaagatgaaggacaccgactctgaggaagagctcaaggaggccttccgtgtgtttgacaaggaccagaacggcttcatctcggccgccgagctccgccatgtcatgacaaatcttggtgagaagct

SEQ ID NO: 5654 - DNA, 399 bp, Zea mays
  Clone ID: LIB3279-052-P1-K1-B4
cctacgctgcatggcaaggaaggaaatgatccgtcgccatcaacgaaccggtggagcgccaggtgacccacgaccagattgccgagtcaaggaggccttcaacctattcgacacggacggggatggttgcatcacgaccaacgagctgggcactgtcatgcgctcgctggggcaaaatcctacagaggctgagctccaggacatgatcaacgaggtcgatgctgatggcaacggcaccatcgatttcccagagtttctcaaccttatggctcgcaagatgaaggacaccgactctgacgaagagctcaaggaggccttccgtgtgtttgacaaggaccagaacggcttcatctcggccgccgagctccgccatgtcatgacaaatcttggtgagaagct

SEQ ID NO: 5655 - DNA, 398 bp, Zea mays
  Clone ID: LIB3279-052-P1-K1-B5
gtccgactgagcccgccgtaaggagaggtaagttcaagagacatcttcgggaagctcaaatggctactaaagctgctcctgccaagagggtgatgccaagacccaagccttgaaggttgccaaggctgtgaagtctggggcacccaacaagaagaccaagaagatccgcacgtctgtgacattttaccgccccacgacccttaagaaggctagggaccccaagtacccacgaatcagcactaccggaaggaacaagcttgatcagtaccaaattctcaagtacccccttaccacagaatcagcgatgaagaagattgaagataacaacactctggtcttcattgttgacctcaaggcagacaagaagaagatcacggctgtcgccaagaagatgtatg

SEQ ID NO: 5656 - DNA, 384 bp, Zea mays
  Clone ID: LIB3279-052-P1-K1-B6
gattctcacttcagggcttgtttggttattcctatcccatgtccttaaagctattgattatgtgcatgaattgagtatgaggtgcctggccaaagcgagtgttctactgtacccaaaaactttaggtagttgtgttgtctttagtggttcagttcctctaagtaaatcattcgctcaaaaggtgtcatctgaagctagaaaggtgataacccaaagatatatgtgcttatgtttagaacttgatcttcttactcttatataacctaagtatgaactcttatttcagaccggtattatggtttactcttatataacctaagatcatatgtcctaccaaagcgaaaatagtttatgaagcataataattttgccaatactaaattc

SEQ ID NO: 5657 - DNA, 388 bp, Zea mays
  Clone ID: LIB3279-052-P1-K1-B7
ctcacacctgctgcccctcccaaattcccttctccctcacgtctgtttctctccccaagccgcctactccctgccgttcctggagcaccaggccagtgccgttccgatggtcattccaagccagtgtcgttctcctttggccgtccctgctccagccgtgagctcacccaggccacggcctcgtcgaaccgcacagcccctgcgctccttccccagccgcgcttggcccagccctccctgctcgatctccttcgagccgtaacagctccctggcgtgtgcggctccctgcccctctacatggcgtcgcccagctctagctcgccccccctctgatctgtgcgcaggggtttcttccatggcgagctcccctgcaaacttcatctagcc

SEQ ID NO: 5658 - DNA, 368 bp, Zea mays
  Clone ID: LIB3279-052-P1-K1-B9
cggacgcgtgggcgagcgtggattaataggaatgtatcatgactggtgtgaaggattttctacttatccaaggacatatacctcatacattctaatgatatcttcagcttgtaccaaaacaagtgccaatttgaagatatactcctggaaatggacagaatcttacgcccagagggtgcagtcataattcgtgacaaggttgatgttcttgtaaaagtggagaagatagccaatgccatgaggtggaagacaagattggctgatcatgagggtggccctcatgtacctgagaagatactcttcgcggtcaagcaatactggactgctgaaaaaacaagcagctaacgttgttcattttcaattttttc

SEQ ID NO: 5659 - DNA, 396 bp, Zea mays
  Clone ID: LIB3279-052-P1-K1-C1
cgcttctacgagaggatatagagaggaagaacagctcgtccgagaccatgaagagcagcccacacctggtgctgatcctgtgcctcaggccgctctggtcatgggcgtcttcgccgctttggctaaagaaaatgccctggttgagagcaaggccatcgacatcaacccggggcagctcaagtgctgcaccaactgcaacttctccttctcggggctctacacctgcgacgacgtcaaaaaggactgcgaccccgtctgcaagaagtgcgtcgtcgccgtgcacgcctcctactcgggcaacaacaagttcaggtgcaccgacaccttcctcggcatgtgcggccccaagtgctagatcagagaggaagaacgcgcgctgctgctagctgctatagc

SEQ ID NO: 5660 - DNA, 392 bp, Zea mays
  Clone ID: LIB3279-052-P1-K1-C10
cccacgcgtccgccgcagtccgcaggaccggtcactcggcacgcaggctagcagcacagcagcagccagagccatcccctccctcgctacgcttcgcttcctcggcgccgattcctcctcctgctcctccaccctcgtccgtccccttccggcgcacgagctcgcccgagatggcgaacgcgagatcgggtgtcgctgtgaacgatgagtgcatgctgaagtttggcgagctgcagtcgaagaggctgcaccgcttcataactttcaagatggacgacaagttcaaggagatagttgtggaccaggtcggggatcgcgctaccagctacgatgacttcacaaacagcctccctgagaatgactgccgatacgcgatctatgatttcgacttt

SEQ ID NO: 5661 - DNA, 392 bp, Zea mays
  Clone ID: LIB3279-052-P1-K1-C11
cccacgcgtccgggaaactgacaacccagagctagctgttaagcctgtttatgtcaaggacgacttctttgattccctctcagtggaacgtttggacgtggagggccaaatggaaggggaagaccttctgaacggcgcagagtagacacagagacgtttggtgaatttccgaggcacaggcagccctaccgtggtggcggacgaggctaccgtggcggtgggcgttcccgtggttcatattacggtggcagaggctatggaaacacggggaggggtggccctgggaattcttattctcactggggcaatgggagagattgattatagcagcagcagccatacttgcgggtgttgtagtcttttgccacatgcatgaagcgcatccattacta

SEQ ID NO: 5662 - DNA, 390 bp, Zea mays
  Clone ID: LIB3279-052-P1-K1-C12
cagaattatatgcataaacatgtagtaggctattattctcttttatgcaggatggtgctcaaattttgaaaaatagatgtagtgatccaattatattttactaccatggttcattgagcggcttgcttgtggacattccttttgtggtattttttctatatattactattgactcatgtcataaatcagttagttatattttactttgttgatgaggtgacaatataatgtttcatttgcaaatttaggtgaaagtgaaggttgtttgcccctcataatgttccatgaaaccgaacaacagtcaaactgttagttgtgagttatataggatctgtttattttcctattttcatttgtctaattttactacacatgtttttccccacccat

SEQ ID NO: 5663 - DNA, 399 bp, Zea mays
  Clone ID: LIB3279-052-P1-K1-C2
cgcaaaaccctccctgctcagactcgtctgctgcagctcctcctccgccgccgtgtgaaacgcactctcctccgccgccgtccgagcaagatggttcttcagaacgacatcgaccttctcaacccgccggcagagctcgagaagctcaagcacaagaagaagcgcctcgtccagtcccccaactccttcttcatggatgtcaagtgccagggatgcttcagcataaccacggttttcagccactcccagactgttgttgtgtgcccaggctgtcaaactgttctctgccagcccacgggaggaaaggcgaggctcacggagggatgctctttccgtcggaagggagactagagctgagtctgttattagtactggatcggttgtcaatctccagtatgt

SEQ ID NO: 5664 - DNA, 306 bp, Zea mays
  Clone ID: LIB3279-052-P1-K1-C3
ggggaaccctacacgtctaatatatacagtcgacgtgttctaagtggggaatttgttgtggtcaacaagcatcttcttcatgatctactgaaatgggcatttggactcctaccttgaaaaaccagataatatacgatgacggttctgtccagaagatagcagaaatcccggacgatcttaaagcaatctacaaaactgtttgggagatcaagcagaaaactttagttgacatggcggttgaccgcggatgctacatcgaccaaagccagagcctcaatgtccacgtgcagcgggtcaactttgggg

SEQ ID NO: 5665 - DNA, 398 bp, Zea mays
  Clone ID: LIB3279-052-P1-K1-C4
agctgatctatgcggaaaggatgatgcatggtggggtgttaaaggttacatgagggacaatttcaaccatagcaatatggccatctctacaaagagcattttcagaacagcaggctcgtggaatctgtgttggatatgtattgggagcttcctcctgttgccggcccatccttaacacaccaaacaaggtatgacccagcacgtacagttgacccaatcatcgaagatggtcgctacggcttgttccgaaagaccggtctagcgaggttggacgccttggtgttcaatggttacactcagatggcatatgtgcagatatcaggttcaatgttgagcacggacgatgtttaaagatttttcgggggtgagcttgtttcgtttatggccaactgttgata

SEQ ID NO: 5666 - DNA, 315 bp, Zea mays
  Clone ID: LIB3279-052-P1-K1-C5
gctacgacttcctgcggaggaacagccggggtcccaactacgccgtctcgatcccgcacgcctccacgctggaggtgggtatgatgtctatatctgatctgatgactgaacccctgaaactgagggggagaaatataggagcaggagaggaaatggaacaaaaagttttcagctgtatatgcatatatggtatccgcgtctggcaaacttattttgaggcttgctaaatatgtaccttttgtctctgaagttgttaaataaagcaaattaacttccagacgacctatacgtgagagtaaacttaaagcgggccat

SEQ ID NO: 5667 - DNA, 400 bp, Zea mays
  Clone ID: LIB3279-052-P1-K1-C6
gtccttctccaccgacttgcgtgacgcctaaccaagccccgcaccgccccgcccccgcccccgcctcccttccgccgcaggggacgggtcggcacggggcgatgaggagcagcgaggccatggagctcctgggcttccatccctactccaggccctccccttccgaggtgaaggctgcgtatagaagaatggtgatggagtcccatcctgatcgtgtcccaacgcatctgaaatcgcaggctgagtcaaaattcaaggagatcgcagaagcatattcttgttcgaaggacggaagaagatcagggagtaggatggaagttcatgttatgcgttctggtgttccgactagccacggaagatcaaatagaacgttggttaaagccccgtttctcctcataac

SEQ ID NO: 5668 - DNA, 386 bp, Zea mays
  Clone ID: LIB3279-052-P1-K1-C7
cccaatcctctcttacgccgatttctaccagctcgcgggagttgtggccgtggaggtcaccggtgggcctgagattccctccaccccggtagggaggacaagcctcagcccccacctgagggccgccttcctgatgccactaagggttctgaccacctgaggcaagtttttggcaagcagatgggcttgagcgatcaggacattgttgccctctctggtggccacaccttgggaaggtgccacaaagagcggtctggtttcgagggggcctggactacaaaccctttggtctttgacaactcttacttcaaggaacttctgagtggtgataaggagggccttcttcagctcccaagtgacaaagccctgctgagtgaccctgtttt

SEQ ID NO: 5669 - DNA, 376 bp, Zea mays
  Clone ID: LIB3279-052-P1-K1-C8
accaaaccttgggaggggctcactatacaatttatgtttataatgaagggaagaagggttgacctaatttgaccatccgtatatggctcccctaaccgatggcactataacgacatcggcagcttatgttcttttttaccttcggactcaggagactggcttaaatacaatggcactcctagactctggtatcacaacctggggggtgcgatgatgcaatttatgagccctagtcccgcactgtgtatagattcattggtttatggtgacagatgtgcggctgtgccgtaacttaactgagaaataggaacaggtccagaagagctttatcggcttttttatcactacggagacgataatcagtcgcggctcctta

SEQ ID NO: 5670 - DNA, 374 bp, Zea mays
  Clone ID: LIB3279-052-P1-K1-C9
cccacgcgtccgcgtccccgtccgcgccggccgacgccgccttttcgtgcccgcgtcagcgtcgcggctccactgagcgtcgtgtcaccggcgggaggcaagggcaggcggtggtggcgatggcgtccgctgacgcgcgcttggcggggatcgcctcctccatccgcgtcatccccgacttccccaagccagggatcatgttccaggacatcacgacgttgctgctcgatcccaaggcgttccgtgacaccatcgacctctttgtcgagcggtacaaggaccaagggatcaccgtggttgctggtgttgaagctagaggggtcatttttggtcctcctatcgctttagccattggcgcaaaatttgtgcctttg

SEQ ID NO: 5671 - DNA, 358 bp, Zea mays
  Clone ID: LIB3279-052-P1-K1-D10
ctagtctcctcttggcacgagcgcaacaccatccacccaccagttcgaagcggaggcgaccggcaacctgcggcggagatgcaggcaggggcaagggcggcaaggggctcgggaagggcggcgcgaagcgtcaccggaaggtgctgcgcgacaacatccaggggatcacgaagccggcgatccggaggctggcgaggaggggtggcgtgaagcgcatctccgggctgatctacgaggagacccgcggcgtgctcaagatctttctcgagaatgtcatccgcgacgctgtgacctacacggagcacgcccgtcgcaaaaccgtcaccgctatggacgtcgtgtacgccctcaaacgcca

SEQ ID NO: 5672 - DNA, 391 bp, Zea mays
  Clone ID: LIB3279-052-P1-K1-D11
caccaagatataggatacttaacaagatgggtgaagggacatttggacaagttttggagtgctgggacttggaaaaccaagagcagtggctatcaagattgtgcgctcccttcagaaataccgagaggctgctatgatagaaattgatgtgctccagagacttgggaagcatgactttactggcagccgttgtgtgcaaatacggaactggtttgactatcgtaatcatatttgtatagtatttgagaagcttgggccaagcctatatgactttctgcgaaagaatagctaccgttcatttcctattgaccttgtccgagaatttgccagacaaatattagagtctgttgcatttatgcatgacttgcgacttattcacacggatctgaag

SEQ ID NO: 5673 - DNA, 397 bp, Zea mays
  Clone ID: LIB3279-052-P1-K1-D12
ctgatacatcggatgagattgtcccagttgtggttcggcctggtcacattcgctttgaaccagcaggtggagaacccgacaatcgccagcaaaggagttacagggcacgttccaatggagtgcaacaatgagcaaaaagaagggccagaagtggggaatgaatagctcaaacaagaaaaatgctgatatcggctatcatgcaggaatagctggatgcagcacagaagttaacaatcatgtcatggacattaaggttactgaaaatggcttttgtgctgtcaataatcgaaggaacaatgaaggcagtaacattgagatgtccagtgtgcaaaatattgctaatgaagaaaagtctagcgaacctttcaattttgagagcttgtaccccctaacacga

SEQ ID NO: 5674 - DNA, 190 bp, Zea mays
  Clone ID: LIB3279-052-P1-K1-D2
tgtttttacatgcgtatatagaaaggaagactacatcttctgtaaccatgaagaggaaaatacacttggttctgattatgtgctatgtaattggcatagctctatgttactaaaaactggtaaaaaataaatacttataattgaaatgaatttggtaatcaacaaaagacgtaaagtttattatgaaata

SEQ ID NO: 5675 - DNA, 400 bp, Zea mays
  Clone ID: LIB3279-052-P1-K1-D3
ggttgtccgtcaacgcgcagcccctctgttttccccgttggcgcagcagccccgacgcctccgcgctctgcgggctcgctgttttataagcgcggtgaacagcacgccgtcgatactcgccggttgtttgctgtttttgcgcagccccatcgtcgtcgtcgttcaccccggtgagaccgcgacgctccgtgttcgattccgcatcgacattattttcctatgattaattatgtatgtgtgctgctttgttttatttttgtggaggagagaaccccgtgttttgcgtggagaagaaggcaagccgctcgacgctcgtcgatgtgcggagcgatgcacaaaaccgaatcgccatcgtcctcacaaacaccgtttggttttgtttatggaccgagagatgctg

SEQ ID NO: 5676 - DNA, 100 bp, Zea mays
  Clone ID: LIB3279-052-P1-K1-D4
ccgtcccttaatgcaaaggaactatgtggtctctagctaccaaataaccgggagggggccagggtatgcgcgatcagaattttatgagcggggggtagag

SEQ ID NO: 5677 - DNA, 400 bp, Zea mays
  unsure (1)..(400): unsure at all n locations; Clone ID: LIB3279-052-P1-K1-D5
cggccatccaggagtccaacggcttcagcctctcccagctctgggtcctgtccggctccttcaacggctccgacctcaacagcatcgngcaggatggcaggtcagccctgagctgtacggggacagcaggccgaggctcttcacgtactggacaagcgacgcgtacgaggctactggttgctacaacgcgctgtgcccggggttcgtgcagacgagctcccgcatcgccatcggcgcgtccatctcgccggtgtcgtcggccggcggcgcgcagtacgacatgacgctgctggtgtggaaggacccgaagctgggcaactggtggctcagctacggggaccagctggtggggtactggccggcgcagctgttcacgcacctgtcggaccacgccaccatg

SEQ ID NO: 5678 - DNA, 403 bp, Zea mays
  Clone ID: LIB3279-052-P1-K1-D6
cccacgcgtccgccaccatcgatctgcaagtctcgctacgtagcagtgcaataaaaaaaagcagccgcaatggcgagcagcaccatggcctctcctccacggccttcgccggcaaggccgtgaacgtgccgtcgtcgtccgccttcggcgaggcccgcgtgacgatgcgcaagacggcggcgaaggccaagccggcggcggcgtccgggagcccgtggtacggccccgaccgcgtgctgtacctgggcccactgtccggcgagccgccgagctacctgacgggcgagttcccgggcgactacggctgggacaccgcggggctgtcggcggacccggagacgttcgccaagaaccgggagctggaggtgatccactcccgctgggccatgctgggcgcgctcgg

SEQ ID NO: 5679 - DNA, 388 bp, Zea mays
  Clone ID: LIB3279-052-P1-K1-D7
gacaagttgtaccacccggacatgactgttgaggaagcagtagatcttgttgacaagtgcatcaaggagattcggctgcgttggttgtcgcgcctcacaactttgttatcaagattgtcgacaaggacggggcgagggagtacgccaggcgtgaactcgtcggtgacaatgcacctgctgaagctgcaaccgcagttgttgctgcctgaggcatgaactcgtttgaggttgaaatgtgttagttgtttctcagcgatgctacttatgcgatcacaggatactggtggggggcccacaactgttttatcaattttagcacagtcgtgtaattctgtttctgcactattcatgtctgctgagtacaagtagtgtttcacgcttgaacaaa

SEQ ID NO: 5680 - DNA, 393 bp, Zea mays
  Clone ID: LIB3279-052-P1-K1-D8
gggacatggggcagagaaaatatgacatgaggatgagaagaagggagcggcaacgggcaccatgaaagtgaagactgtagagaaggtaataagggtgcatcagagcaattagaggcacagatatttgtgcagatgggagcggcctttggattgaaggataagttcgatgaggagctcttgagaaggctgtttgctgctaatggacggtagagggagcttgctaggattgcatgcgggcttggatttgttgaaagcctgggagatattgctgtggtactaataaaaggagggaatgctatctaggctatttatgttggccatgaggcgtgataacttgagaaatttccacctgtgcctcaattaaaattttatgtgtagaattccactgataag

SEQ ID NO: 5681 - DNA, 392 bp, Zea mays
  Clone ID: LIB3279-052-P1-K1-D9
caattatttttatggtgtcaaatctgaaattaaagagtcatcatgatcgtaactctgtaatttcagatttgacacaattattttatggtaccggagcacttcggtttgtgcaaattttcatacctatcgtagatatacacacaaaactcaatgagatttgagcagaccatggcccgtggaacaaatcaccaaaaacaaagcctaaatgaactatgaatattttattggccaactaacgtacaagccaccacgaagatctattttcagttgactccccgatccaggcattagaaggagcactttccttgttgaatattttggaggcatcgctgtagaccgctactacatttgatacaacagcaagaacaatcatgaagatcgccagaattttg

SEQ ID NO: 5682 - DNA, 363 bp, Zea mays
  unsure (1)..(363): unsure at all n locations; Clone ID: LIB3279-052-P1-K1-E1
cccacgcgtccgcccacgcgtncggttctggacatgtagcaagcagcttcggcactatcaagctttttgtcgcaatggaaccacatatctacccacacttttgtgctggtcttgtcagaggaacaaaaccgctatcttgcatacttggaagacatgtatgaagataagaagggacagaagaagatcaaagtgcgatggtttcatcaaaaccaggaaattgcttgcgctatacctcctccgcctcatccttgcgaagttttcatcactcctttcacacaagtaatcagtgtggaatgtgttgatgatattgcaactgttttaactcgtgatcattatgaaaaatgctcccatgcaatgtcaatt

SEQ ID NO: 5683 - DNA, 399 bp, Zea mays
  Clone ID: LIB3279-052-P1-K1-E10
cccactcgagcgagccaccgccgccaacgttcccgccttctatcccttaaccctagccgccgccgccgccgcttaaaccctgctgcggaaactacagcaacccccgccggcgatggtgaaggagaataagcggaagcagcctcctgccgacgcggcgccgcctccgggcgacgagggtgaggggaggagcgggcggaagggcaagaaggccaggaaggagaaggcggaggcgatactgccgtcgcagatcaagaacaaggacaagcgccgcgaggtgcacgccaagcttaagcgagagaagaaggcccagaagcgcgcgctcgcccgcgagcgcggccaggccgcccgccgcgccgaaaagctcggcgagcagccgccggagaggcaggtgccccgcac

SEQ ID NO: 5684 - DNA, 396 bp, Zea mays
  Clone ID: LIB3279-052-P1-K1-E11
aaaaaaaaaaaaatcttcagtcgtcgctgcaagccttcaacccgtgctaactgcgggggaaaaaaaacatgaagacgacctgggcagaacgtccccggtcgttgctgccgtcctggtggcgctcgccgtcgtcgccgcggccgtcggcccggcgccgaagcggagaggccaggagatccacctgttcgaggccacggtccgcttcccggacgacggcgtggacgagctcgactacaactaccgcctgctcgccaaagtgctcggcagcgtcgaagcagcgcggagagcaacgtacgacagtgagctcggggtattcagcgcgctcatcaccaacaaccaggcccgtcggctgtcaaaagtcccaggcgtgctgaaggtcacacgactcgaggaccc

SEQ ID NO: 5685 - DNA, 394 bp, Zea mays
  Clone ID: LIB3279-052-P1-K1-E12
cccacgcgtccgagatgaacctgtacagcatgaagagaagcgactagccacttggggaaccgacgtgcctcaggatcttgtcttaatgagaagaagctggaggaatctctaaagaaggagactgcaaggagaaaagaggagaaggatgaaagaaagaggaagtataacgtgaagtggaacgacgaggtgactgcagaagacatggaggcttaccgaatgaagaggattcaccatgacgatcctatgaaagattttctcaactgaaaagtgtggtagataactagatgttcatgccactgtatcacattggttgcaccgtgccttgcatcaatgttgtgatactgtggggtggctacacctgttctaaggatatggccagcagaccgtgcatgtg

SEQ ID NO: 5686 - DNA, 397 bp, Zea mays
  unsure (1)..(397): unsure at all n locations; Clone ID: LIB3279-052-P1-K1-E2
cccacgcgtccgaaacgataaaggcggcggcagcagcaagcatgacgaggtcgcgagctgtagtgacgttagtgctcctgctggcctcgccacggcgagctgcaggctgtcgctcgccgccgacgagaccatcgcggccatcttgggccgcgacctgcgggggttcatcgccagggccggcaacctcttcaggtcggacggcggcgcctggcgcgccgcgaacctcaccgacgtcgaggcgaagaacctgagggccgccaggaagtcgttctccggcggcagagcgggctgcgtgagcgccgcggcgtgcgggaagaggcggctgttctgcggcaagaggtgctctgacgtcgcctgctcgcgcgccgccagcctcagccacgtnccgtcgcgatgc

SEQ ID NO: 5687 - DNA, 399 bp, Zea mays
  Clone ID: LIB3279-052-P1-K1-E3
cccacgcgtccgtgccttcctactcactagtcgctcccccgcggctcgcgcaggcgggcgacacaacgaggctaaatccctatcgcaggaggcgtgtgaggccagcgtctttgcgatgacagcaccagcggacaaggggaagaaggccaagactgatgccgacggcggcgaggagaacgaacagatcgacggcgtcctcgtcctctccatcgagaagctccaggagatacaggacgagctcgagaaggtaaatgaggaagcaagtgacaaggttatggaggtggagcagaaatacagtgagatccgcagacctgtctatctcaagaggggtgacattatcaagaccatcccggacttttggctcacagcgtttatgagccatcctctattaagtgagct

SEQ ID NO: 5688 - DNA, 385 bp, Zea mays
  Clone ID: LIB3279-052-P1-K1-E4
gtcgctcggcctcgccggctgggtccgtaaccgccgcgacggcagtggggaggccctcctctccggagaccctgagaagatagaagaatgataacccgccgcctgccggtcggccaccacaagcgccaccgtaaacggcgaagaacgctacaactgctaccccgtggatccaggcaaacgaacagagagcaagtgtaccggttgattccatggacaacctgtacgagaaacaggacgagcttcagaaggcgtatgtggacgcacgatacatgcactactacgtggaatctgcgtacaaagagcacaggcgacatgtaatgtaccgaggtgtgacaacatgaaaagcattcctatctgttgtgtgagagaattcatgacacattgt

SEQ ID NO: 5689 - DNA, 402 bp, Zea mays
  Clone ID: LIB3279-052-P1-K1-E5
agaccaccaccagcggcgggctccagtcgcaactcgcaagacagacgccgccgcccaaagaaagacgtcaactccaggagacaagataggagaactgaagagaaggatgggcttcgagaagcagatcctgagatccggcaccggccccaagccgataaagggccagaaggtcaccgttcactgcaccggctacgggaaggatcgtgatctgtccaagaaattttggagcaccaaggaccctgggcagcagccattcagtttcagcattggtcagggttcagtgatcaaaggatgggacgagggagttatgaccatgcaagtgggtgaagttgctcgtatccagagcacgcctgattatgcttatggagccggcgggttcccagcctggggaattcaaccaaa

SEQ ID NO: 5690 - DNA, 312 bp, Zea mays
  Clone ID: LIB3279-052-P1-K1-E6
catgggccggctccttgatctgcacgttactggggtgttgaagtgtataggtggatcgtctatattctcctaatagcttacacgtttggttgaactggttattgcgttcgctcaaacaagtttgtcgtcatcttattagtatctgcgtcattctgtttggccggtggtgtgctgcactaaaaatttacatgatattggttataggaagagttggaaacacatgatggcgtgagcaaagggaaatataccattgggcttgggcaggaaagtatggcattttgcattgaagttgaggatgttatttttgatgag

SEQ ID NO: 5691 - DNA, 321 bp, Zea mays
  Clone ID: LIB3279-052-P1-K1-E7
ccaagctgctctcgtccctagaaataaagcagctcctccgcggggcggcgaactactacccatcgccaaaaccctagcccgatccggtcgaggagcactacttcttggcatggcgggcacccctagccaggcaagcctcctgctccaaaagcaggtcaaggatcttgcgaagaaccccgtggatgggttctccgcagggcttgtagacgatagcaacgtcttcgagtggcaggtcaccatcatcggcccgcccgacaccctatatgacggaggctacttcaatgcaataatgacctttccccaaaactatcccaacagccc

SEQ ID NO: 5692 - DNA, 342 bp, Zea mays
  Clone ID: LIB3279-052-P1-K1-E8
gcaagctgctctcatccctagaaataaagcagctccttcgtggggcggggaactactacccatagacaaaaccctagcccgatccgggggaggagcactactttttggcttggcgggcacccatagccaggcaagcctcctgcttcaaacgcagcttatggatcttgcgaagaaccccgaggatgggttctccgcagggctagtagacgatagcaacgtttattgagtggcaggacaccattataggcccgcccgacaccctatatcacggtggctacttcaatgcaataatgaccttcccccagaactatcccaacagcctgccattaataagatttactt

SEQ ID NO: 5693 - DNA, 387 bp, Zea mays
  Clone ID: LIB3279-052-P1-K1-E9
gaacaaaagatcgcgaagcgagagggaatgatggaggcataggcactagcacctcctcgcctccacctccgtcctcttcatcccgtccaatcccccgcgccccggcgcccctctccgccggcggctttgctgggtcccgcgctcctcctcctcctaggctgttctggttggggctgcggcggagggaactaggtaaggggaaggaaaggggaggtttgagggagagcgcagcggcagcggcagcagcgatgccatcgcacgcggatctggaccgccagatctcgcagctgcgggattgcaagttcctgcctgaggcggaggtcaaaacgctatgcgagcaggccaaggcgatcctcatggaggagtggaacgtgcagcccgtgcgct

SEQ ID NO: 5694 - DNA, 394 bp, Zea mays
  Clone ID: LIB3279-052-P1-K1-F1
ggccctgcccgccgctagcggcggtgaggatgacgcggcgtgggtgcgcgccatctccgccgccaccaagtccacctcggcgccaagaccctcaccctcgatggcaccgtcaagtcctccatgggcggcctcccctccgccgcgctcctcgagcgcttcgccacctccctagaggagctctccatcgcgggggtgcgcctctcctcgctcacgggcctgccacgcctcccggcgctccggtgcctctccctccctgacaaccgcctctcggggtccgccgccctcgccgccgtcgccgaggcatgcggtgccacgctgcgccacctcgacctagggaacaaccggttcgcagaggtccaggagctcgcgccgcttgccggggtccgggtcgagt

SEQ ID NO: 5695 - DNA, 367 bp, Zea mays
  Clone ID: LIB3279-052-P1-K1-F10
cggacgcgtgggcggacgcgtgggtttccgtcgccgggcgagccgggagccccatcattgcgatggcttcggccaaggaaggagcggtgcaccgaccaagaggactgcgcttcatgatctctacgagctccagggcctgtccccgtggtacgacaacctatgccgccctgtcacagacttgctgcccattatcgccagcggcgtccgtggagtcaccagcaacccaacgattttgcaaaaggcgcatttatcgtccagccgcatatgatgatcagttcaagcagctcatttcggcaggaaaggatgctgagagcgcttactgggaactcgttataaaggatatgcaagatgcgtgcaaactttttga

SEQ ID NO: 5696 - DNA, 249 bp, Zea mays
  Clone ID: LIB3279-052-P1-K1-F11
aaaacacgttgacggacgacttcgttattcatcgactttacaggggggagctccatcatagacatggcttcttccaaagatggatctgtcctccgaccaagtggattgcgatttatgatatctactagctctagacactgtctgcgtgtcacgacaatatatgatgacctgtcacatacttccttcctaatatcagcatcgctatttggtgatttgactgtaaccgtttgatttaaataaacgtcattt

SEQ ID NO: 5697 - DNA, 392 bp, Zea mays
  Clone ID: LIB3279-052-P1-K1-F12
ctctcggtctgtccctttggagcgaaggcgaaccgcgtcgcgaacccaggatcccgtcgagggcaggcgggcagatcccggctccgacggcgatgggcgaggaggacgcgagcgccgggggagatccgcagcggctgaagcggatcgccgctgcggcgtacgactacgagaacgatgcgcggtgggccgggtactggtccaacgtcctcgtgccgccccacctcgcctcccgccccgacgtcgtcgaccacttcaagcgcaagttctaccagcgatacatcgatcctggtttggttgttgaaccgatgtcctccatgacttcaactcagtctagcagaccagcagcgaagtcttcagctacaccatctagtgagaatgtcagagctcgggac

SEQ ID NO: 5698 - DNA, 361 bp, Zea mays
  Clone ID: LIB3279-052-P1-K1-F2
tgcttttactagaggatgtagagaggaggaacacgtcgtccgagaccatgaaaaggagcccacacactggggctgattctgtgcctaaagccgctctggtcatgggcgtgttaagcgctttaggtaaagaaaatgctctggctgagagcaagggcatttacatcaatccgtagcagatcaagtgctgcaccaactgcaacttttctttctcagggctctacaactgctacgacggctaaaaggactgtgactccgtgtgaaagaagtgtgggagttgccgcgcactcgtcgtactcggcgaagaacaagttgacgcgctgcgacaccttcatctagatgtgcggcccctagtgctagatca

SEQ ID NO: 5699 - DNA, 368 bp, Zea mays
  Clone ID: LIB3279-052-P1-K1-F3
cccactcatacgcggatttaaagaggaatacccaatcttccacaacgcgggcgtggagcgcacacatgcttcgccggtttacccagtcagagagctcgccagcctggtttggtcgggttatgatggatcaaatagcacgttaccatgcatgaggagcacaaacatgtggaggtagactactagcatctgcgcattgagagttattattctaggtgctatagacatgcaacaggccctagaaggattgtgattgtgagcgagagtcgagcgatacaccacacaatgcgcagctactatgggaactacctggaatattgcgtcgacatcatatttagaccggacggcatattttatctgtcatagaattc

SEQ ID NO: 5700 - DNA, 400 bp, Zea mays
  Clone ID: LIB3279-052-P1-K1-F4
cacgcggacacggcgcgcgcgcggcgactccgggctggggtctccctcttcccttccctcagatccaactccgtttctccattccctcctagcccagccagggaaccagtctcagtgaatcccgcgcccggatcaatctcgcccaaggaagcagctcttcacgacttgcttccagatccatccatccatccatccatccatccgaggttgggccgtgggggtgtcggtgcggtgggaaatggggaaggggatcagcggcgacgcccgcctcgccgcggcgccttacgaccagtgggtgctgctgagccccgccgggggctcgccgcgcccgcccgcgcgctacaagcatgctgcccaagtggttcaagacaagctgtacgttgtcggagggagtcgcaac

SEQ ID NO: 5701 - DNA, 394 bp, Zea mays
  Clone ID: LIB3279-052-P1-K1-F5
gagacgtgctggacctgctcgacgatgctgcgaggctggacctgatgctggcgctgacgggggacggcggtgcggcgtccatggccggttctccgcgcgcgggtggtgggtctcgaaggaggatggcgacgcggtgcagctgaaggtgccgatgccggggctggggaaggagcacgtgaagatgcgggtggagaaggacgccctggtgatcaagggggaggccggcaaggacctcgagggcgacgacgacaagggcccggcgcggtacagctaccgcatcggcctctcctcccaggctttcaagatggaccagatcaaggctgacatgaagaacggcgtgctcagggtcaccgtcccgaagatcaaggacgaggagcgcaaggacgtcttcgag

SEQ ID NO: 5702 - DNA, 403 bp, Zea mays
  Clone ID: LIB3279-052-P1-K1-F6
gtttaggttccgcccaagctgaaccagagaggaagccaagtggatcagatgaagctagtaataaacagagcagcaacttactcaagaatcttctggtcgcaaagattcagataaacaagagaaatccatggaggttcccaagggcctgaaggatacagagggatttacagtcgtttcaaaacgtcgaaggcgggcccagccattcatgaaccccataaacggcctctgttctcagccgtctatttgcacctctgtcagttaaggtctcattgcattttcaaagacctgcaatagtttggaagatggacctttgcttttgcttaggggttggtagaagaattttgccgtatccaagcgagcagcgagcatgtaatcaaactgtacacaattttccaggataccc

SEQ ID NO: 5703 - DNA, 391 bp, Zea mays
  Clone ID: LIB3279-052-P1-K1-F7
ctaacatctatgtttctgtaatcgactaacagctctttagcatttaaatatatgtatagcttgctaaagcatttacacatcagtaatcaactctaacatctctgtttctgtataccaaagaacaattcaacatctctgtttgctcatatagttgttcttgactacttcatctactattttatttaaatgctttagcattgttcatatctaaaattaattttaaattgtttttttgaaatcctacttgtaccttatttcaagacctccattctgactggactcattttatatcattttagaagaaagaaaaatataaggatgctgaacctagtgcaatagatcttttcaagtagatgcattgcaacaagaagggaggttttagtgaaaatgt

SEQ ID NO: 5704 - DNA, 388 bp, Zea mays
  Clone ID: LIB3279-052-P1-K1-F8
gtcaccttcaaagaatgcaatatgttgcatttgcgtcgtttcttgggttggtttgctgcctcttctggaatgtcataccactactacagcttggatcaagggggaaggcgttaagatctggttgttggcaataatctacttcatatctggtgttcctggggcatatgttttgcggtatcgtcctctatataatgcaatgaggactgatagcgcattgaagtttggattgttcttcttgctttacgtgttccacattcttttctgcgtattttctggtgcggctcctactgttgtatttgaaggaaaatcattggcaggaattttgccagcaattgatcttattagcgtgaatgctttggttgggatattctactttgttggattagga

SEQ ID NO: 5705 - DNA, 384 bp, Zea mays
  Clone ID: LIB3279-052-P1-K1-F9
atcccatgctgccccacggtgcatgactacgcgataatccaggtgctaattgaagctgagacatgggcggttccagggggaattctcacctgcgattgaattgatggcgagcctgaccacggaattgagcagcacacggcggagacgacacggcagcgagcaattcccccggccccgatccctcctctgtttggcaatggcgacatggttatctgattgtttggggtagatctagattggttgggtctaactcctgcgctagccatgattatatagggcaaagtatttcagagtgttgaggggtattcgatcgaggagattgagtccgtcgtcccggacggaaaacccggcgcggataatgcaacggccaaggggcccaacggc

SEQ ID NO: 5706 - DNA, 394 bp, Zea mays
  Clone ID: LIB3279-052-P1-K1-G1
ctaatctattttttcagatggtgacttccatgtgttcgattgtttgaggtgagggatgacgtgaagctgccaagctataagggtaaaacatcaatgacaagatgttcgacgagaagaatcatatcttggacccataaaggatgctttaggagtacgcccaattcgctaccacgctcaacctactctgtgtcttctccactggtggctacaccgacattcagcgcgtcacgcagtggaaacttgatgtcaccgaacatagcaagcagggcgtcatgagaaataaaatcttccatgcactgagttgatttattctatatatttattgcctgaccacaacagccttaggatcttattgtctgaccacattttttcactatgaaagacgtggcgtact

SEQ ID NO: 5707 - DNA, 144 bp, Zea mays
  Clone ID: LIB3279-052-P1-K1-G10
cattgatatcttttacgaacataaacatgattttcccatccggggggagcaaggttcaaaatttacggtattttcttcaacatcgaggaacgatagtgtttaatcaaacagcgtttttcaaaaaagtacttacacttattttag

SEQ ID NO: 5708 - DNA, 281 bp, Zea mays
  Clone ID: LIB3279-052-P1-K1-G12
ggcttctcctccccctcttaccaagtcctcttcgggttagggggacttagggttttgtggaggggcgatggcggcggctgattggagtaccgttgcttcgtcggcgggcttgtctgggccaccagcaacgagtcgctggagaatgccttcgccttctacggcgagatcctcgactccaaggtcatcaccgaccgtgagacggggaggtctctcggcttcggtttatttacctttttcttcgagaactccatgctcgactcttatttcaaacatgaaacggt

SEQ ID NO: 5709 - DNA, 393 bp, Zea mays
  Clone ID: LIB3279-052-P1-K1-G2
cccacgcgtccgcagatttaaagctgaatacccagtttttcagaaggtgcgcgtaaacgggccagatgcggcgccggtttacaagttctgaaagctagcaagcctggtttgtttgggtcatcaaggatcaaatggaactttaccaagtttctggtggacaaagatgggaaggtcatcgagagatacggaacctcgacagctccaatggcaattgagaaggacatccagaaggcccttgaggaataatttttgtgagcttgtctcgtctcatccaccacacacttgcagcagaaataggcacttgctgaaatatttcgtcgtagtaacattcagaccggacgtctttgcttatctgtagtaaaaattctgtgtaatgttaccctccttttcgcc

SEQ ID NO: 5710 - DNA, 397 bp, Zea mays
  unsure (1)..(397): unsure at all n locations; Clone ID: LIB3279-052-P1-K1-G3
gccggcctttcgccaaaggaaggcacaagtgcgctacgcacgcagccaaagaaaaggcgcaaaaggccaagggatatgacaaggacggaggcaaggcgaccggtagctttcttcggcggcgaagtaggagctaggagggggtctgaagaataccaacaaaagcttcggtcacccttaggtttaatttggaagaacacgttctctatttctatgtccgaataaacacagcaaagagaagtgcacgcggcgtgtacagntgacacgcacacgcacacgcacacgcacggagagctgaggagctcccctcccccgtttggccgtttggcgccgctgctacaaaagtagtgggttcacttttgtcgggctgcatgcttcttttcttcgcttgtttgtttgc

SEQ ID NO: 5711 - DNA, 251 bp, Zea mays
  Clone ID: LIB3279-052-P1-K1-G4
gcgcatcctattgccctcgcgcgaccgtggacgccgccgtcgctgcagtgagccaccgacctgtcttcgtttgacgtagacaccaattaccgaggtggaccgtatgcacaggcacgggatgggtatctatttatcggcgctgtcgtacaagaggacttctcctatctggctgaagacagctaccaccgaggtggaggagatgattaccaacgcgtgtaatacggccagatgccatctagattcgtgtttgc

SEQ ID NO: 5712 - DNA, 134 bp, Zea mays
  Clone ID: LIB3279-052-P1-K1-G5
cggacgcgtgggcggacgcgtgggcggacgcgtgggcggacgcgtgggcggacgcgtggggttagcatattttggaaacatcctttttaagagttgctatttctcattgatgtatggaaaacaacatattttgg

SEQ ID NO: 5713 - DNA, 355 bp, Zea mays
  Clone ID: LIB3279-052-P1-K1-G6
cggacgcgtgggatcgaagagatggctatctgcagaccttgttgcatgcacttatcatttggatatgttctgttgcttgattctgccaggcctctgctgtgtgtacactttatatgcttaagcgccaacatttgaaggtcctgggatggagatcgctggaccctcctctcctcatcatggcttctcatccccatcaacagtgctccatgtgattaacaaaggttaaaatgtcctaatgcgatcctccacaacatgtcagaatcgtatagaaagcaaaatctcacagattttcatcttcgcctttatggaagccaatttggatttgccaattcaccattaaaaaaaaagtgggtta

SEQ ID NO: 5714 - DNA, 338 bp, Zea mays
  Clone ID: LIB3279-052-P1-K1-G7
cccacgcgtccgttcctcccttcctcctcctcgtctctttcatcggcgactccgatcttctctgccgtcgccgccgccgcaagagatcgacccgaccccgagcgcccgacccgaccccccaatccaaccaccaaccgccggcgcgcgcggaagattcagatttggcccctcgccggtaagggagaaagcgaggatgggtgcgtggatgtcgcgcgtgtggttcctcatgttcccagcgcgggagtacaagctcgtcgttgtggggctcgacaacgcggggaagaccaccacgctctacaagctccacctcggcgaggccgtcaccgccgcgcccacca

SEQ ID NO: 5715 - DNA, 313 bp, Zea mays
  Clone ID: LIB3279-052-P1-K1-G8
cccacgcgtgcggtcttacttctattctcccgttcactaccatcacatcagtaccttttgagccgtaatcctttcctcgcccaacgagcgaactactgatcagacaccgatcccaccctacaatagaactacaaaccgtcggttcgacgagcagaacaaaatatacccctgaatggtgaaggcaaaaggtaagatctgcgcaaaaagatggcatcagacgagtataatattcttaacgcacctggacaggctggtgcgaaagatgcacgacgacacgttcaagatcaagatcctgtacagagtgcaattgagc

SEQ ID NO: 5716 - DNA, 338 bp, Zea mays
  Clone ID: LIB3279-052-P1-K1-G9
cgctgttccccgcaacctatagacccaatctcgtccgacccggcgcgtcgtcccctccagatctgcgtcgtcctcttcagtagcagaaactgttctgcttcagtctgacaaagcggagggcttaggagtttctgcttcttttatgtctgaacaatctttgctttatttgggattgttgggagagtactctcgtgcatcgaggaaaaggcacaaggttccgtttcactgcatgcgtcaagagcctgtctggttttattcgtctgattcgtcatctgctggtgctcaaagccggcttggtttcctcgaaggatcagcatctacttttgattgtggacttt

SEQ ID NO: 5717 - DNA, 388 bp, Zea mays
  Clone ID: LIB3279-052-P1-K1-H10
cgcatttcttcccatccgatccccccttcgcaaccaaaaccccaactcgccccgcatcgatggcgcccaaggccgagaagaaaccgcggcgaagaagccggcggaggaggagcccgcggccgagaaggcgcccgccgggaagaagccgaaggcggagaagcgggtccccgctggcaagtccgctgccaaggaaggcggcgagggcaagaggggcaagaagaagggcaagaagagcgtggagacctacaagatctacatcttcaaggtgctgaagcaggtgcacccggacattggcatcttctccaaggccatgtccatcatgaactccttcattaacgatatcttcgagaagctcgctgctgaggccgccaagctcgcgcgctataac

SEQ ID NO: 5718 - DNA, 396 bp, Zea mays
  Clone ID: LIB3279-052-P1-K1-H11
gtgatgaacagcaccggcacgccgaagcaccccagggtggccgtgccgacctacatctacgagctgtacgacgaggacacccgcccggctccacgtcggagaagtactggggcctgttcgacatgaacggcgtcccggcctacaccctgcacctgacgggctccggcgtgctgctggccaacgacacgacgaaccagacatactgcgtggcgcgggagggcgcggaccccaagatgttgcaggcggcgctggactgggcgtgcgggcccgggaaggtggactgctccgtgctgatgcaaggccagccgtgctacgacccggacaccgtggaggcgcacgccacgtacgccttcaacgcctactaccacggcatgggaatgggctccgggacgtgct

SEQ ID NO: 5719 - DNA, 226 bp, Zea mays
  Clone ID: LIB3279-052-P1-K1-H12
gggtgagcaaaggacactttacatgggtgcgaagtggttcacttgatagcttgctgtgaaaggtctacacattggctggacagtttgttcatacacgttcggggctaagattcacactgatgtaaacatgctcgtttagtgtttatatcaaatggaaaatgtaaccgtggaggcgcgtctttactacaaccacatatatcttgtgcatacaaaggaacaaccgctg

SEQ ID NO: 5720 - DNA, 362 bp, Zea mays
  Clone ID: LIB3279-052-P1-K1-H2
ccagctcgctcgttccagctgatcaggtcgagcacctagtagcgacctgctcgatcatcagtgtagagtgtcggtaggcgtctgtcttcttggtggctggttgcaacggtcatggcgacgtcctcttgtccggtgcccttgctgctgctgtgcctgagcgtgctgatgttctgctccttcgcggcgggcagcttggaccaggagctggacatgacgtggggcgacggacgcggcaaggttcttgacaaccgacggttgttgacgctgtctgtggaccgcacgttctgctatggggtccagtcccggcacgagtacctgtttcgcaagatcgacatgcagctggggatggtgccgggcaactc

SEQ ID NO: 5721 - DNA, 397 bp, Zea mays
  Clone ID: LIB3279-052-P1-K1-H4
ctcgccttccgaggaaactcaccagcccaccacagacccgagcggaagaagccatgtccgggcgcggtaagggtggcaaggggctcggcagggcggcgcgaagcgtcaccggaaggtgctgcgcgacaacatccagggcatcaccaagccggcgatccggcggctggcgaggaggggcggcgtcaagcgcatctcggggctcatctacgaggagacccgcggcgtgctcaagatcttcctcgagaacgtcatccgcgacgccgtcacctacactgagcacgcccgccgcaagaccgtcaccgccatggacgtcgtctacgcgctcaagcgccagggccgcaccctttactgctttggcggctaggctgatgggctcctcgcgatgttctccccttct

SEQ ID NO: 5722 - DNA, 390 bp, Zea mays
  Clone ID: LIB3279-052-P1-K1-H5
cccacgcgtccggccacgcgtccggttacataatgatcaacatgtcgcgtgaggatatcttttatctttgaaagtataatgtgttacctaactacaagaactcaaatataggactgtgttgttggagatgctctaaggagatcgaggatgatcccatctacggtggcaagcagtactacaattaaataataatggagggcgtcctgtagttgacagcccaacagggacaggaataccctggcggatcgaacctcctcgtgttatggcgcagagtgcctagtggcgccataaaactttattacaataatactcttcgtgctctacgctatcttcatgacactatctatagttgtctatatttaaagagagaatattgatgaaggagttttc

SEQ ID NO: 5723 - DNA, 327 bp, Zea mays
  Clone ID: LIB3279-052-P1-K1-H6
gcgcgacgcacccaggccacgcgtgcgggggattatatcaaaacacagtgattaattatatcgaaactagtattaattagataacgactatgcaacagtatcatgacgcctatcaatatttgtcaccgtgtgtataataatacgtatattgtgatcacaaagattatgcaatgcaaaccaaatcggcgacgcgtttatatatacttagagatacatatacctgctactactttcttattggtcgggaaccacatactttttgctagtaggtgcttacattagtcttggcgtaaaggtgtcgtggtcacattgcactaatgcacagaa

SEQ ID NO: 5724 - DNA, 389 bp, Zea mays
  Clone ID: LIB3279-052-P1-K1-H7
gcctccactccacacagtacacacgacacgatgtctccagaactctcttgggtgatagcttccacagggcgacgacctcctgaaaaacggcgagtcttcattcccatcgtcgtctccgcgctcttggaccatacgaatctccggtcgaacctggtgtcgtccgcccgccctctctcccgctgctccccatcgctctttcgttgtgactcgctccctccctggctccccgcatcgctccccatcccatcttgtcctggacacctgggaagcctcctgttctttttagtttcattcttggccacagacttcacgtgcccacaaccccaaggaggagaaaccaggctatgaccaatagctatcagttccttcagtgttttacgcccctctct

SEQ ID NO: 5725 - DNA, 338 bp, Zea mays
  Clone ID: LIB3279-052-P1-K1-H8
acgcccgcaggcaccggaccggaagcccgggacgacccacgcggccggccaccaccacacacaccacaaactaaaggaacggcgcaaaagggaaggcaagaagaacaccgggaggaagaagaaccagaggagaagggaaaggagccagccgagtgggaggactcccaagcccaggccatcctggaggcggagaacgcgaaccagcaaccgaagagccacccaaaggacaggaacaacaacaatgcgaggcagacggaaagcaccgggagcaggaaggccggagtcaccaaacaaccataccggcggcgcaaggccggcaggaagaaccatgcaagacc

SEQ ID NO: 5726 - DNA, 391 bp, Zea mays
  Clone ID: LIB3279-052-P1-K1-H9
gtcaccaccatccccaccatcggtttcaatgttgaaactgttgagtacaagaacattagcttcactgtctgggatgtcggggtcaggacaagatcagacctctttggaggcattacttccagaacacccagggtcttatttttgttgtggacagcaatgaccgtgaccgtgttgttgaagccagagatgagctccacaggatgctgaacgaggatgagctacgtgatgctgtgctgcttgtttttgccaacaagcaagatcttcccaatgccatgaatgctgctgagattactgacaagcttggattacactccctgcgccagcgacactggtacatccagagcacttgtgccacaactggcgagggtctgtatgagggcctggactggct

SEQ ID NO: 5727 - DNA, 286 bp, Zea mays
  Clone ID: LIB3279-053-P1-K1-A1
cggacgcgtgggccggcgaggccgccaagctggcgcggatcaacaagaagcccaccatcacgtcccgcgagatccaaacctccgtgcgcctagtcctccccggagagctcgccaagcacgccgtctccgagggaaccaaggccgtcaccaagttcaccagcaactgagcgcgctgcgcgatccgcggatctgttagaagggttctttgctgtgtgctctccccagtcccccaccctacccgactagtagctagctagcctgctctataaataccgcgcgccggatt

SEQ ID NO: 5728 - DNA, 149 bp, Zea mays
  Clone ID: LIB3279-053-P1-K1-A10
gatgaatcgcgtctacgcacgccgcagcccatatttcctaggtagggggggggcgctgcagccactaatcttacctgcaatatccaaagcagatgtgcgggaccaagatctcgatatccatctatacaagcgaggcgggtgctgttcag

SEQ ID NO: 5729 - DNA, 385 bp, Zea mays
  Clone ID: LIB3279-053-P1-K1-A12
ctgtcctccaggctcggctccagctaaggtcgagcggcgaggcgacagccctagtgtagcgcggcgcggtaccatagatggggagacgaatggaggccccctcctcgccggcgtccctcgtcgtcgtcctcctcctcggctcgctgctcctgcaggcacgcgccgatgacccctacaggttctacacctggaacgtcacctttggcgacatctacccgctcggcgtcaagcaggaggggatactgatcaacggccagttcccggggccgcagatcgacgccgtcaccaacgacaacatcatcgtcaacgtcttcaacaacctgccggtccccttcctcctctcctggcagggaattcagcagcggaggagctcatggcaagacgg

SEQ ID NO: 5730 - DNA, 393 bp, Zea mays
  Clone ID: LIB3279-053-P1-K1-A2
gctagcttcacgtcccaggtcatcatcatgaaccaccctgggcagattggcaacggctatgccccagtgctggactgccacacctcgcacattgctgtcaagtttgcggagctcattaccaagattgataggcggtctggcaaagagcttgagaaggagcccaaattcctcaagaatggtgatgctggtatggtgaagatggttcccactaagcccatggtagtggagaccttttctgaatatcctcctcttggtcgctttgctgtccgtgacatgaggcaaacggtggctgtcggagtcatcaagagtgtggagaagaaggatccaactggagccaaggtgaccaaggctgccgcaaagaagaaatgatgtgtctggctggttctgtgtttg

SEQ ID NO: 5731 - DNA, 395 bp, Zea mays
  Clone ID: LIB3279-053-P1-K1-A3
ctctcggtctctaccaaaaaaacagcgacctctaacgcttagctagctctttgtgtcagcgcctgagcatcgagctattggcatggcgcactccaccaccttggccctggtgattgtcgttgtgctggcgctcacctttggtgccacggtcagtgtctccgctcccgtgaacaagtcgtgcgtcagcggtagcgccggcgccagcgtgagcattggctacggcggggcaagagccagcgccggcgctggcgtgtcccttggcgccgacgcgtaccggagcacgtgcccccgtgccgaggagatcatccgtgcggccgttgagagggccgtcgctgccgacccacgcatggcagcgtctctcctgcgcctccattttcatgactgcttcgtcaacg

SEQ ID NO: 5732 - DNA, 318 bp, Zea mays
  Clone ID: LIB3279-053-P1-K1-A4
cgcattcgttccaactcctgagcactttctcctcgtcccagacaagccaatcgaagccgagatacgaccatggactccaccggcaccggagcagggggtaaggggaagaagggagcggccgggcgcaaggtcggcgggccaaggaagaagtcggtgtcgaggtccgtgaaggccggtctccagttccccgtcggccgcatcgggcgctacttgaagaagggccgctacgcgcagcgtgtcggcaccggcgcccccgtctacctcgccgctgtcctcgaatacctcgccgctgaggttctggagctcgcccgtaatgct

SEQ ID NO: 5733 - DNA, 254 bp, Zea mays
  Clone ID: LIB3279-053-P1-K1-A5
aacgacccacacgagcaccaagccgaggggaggggcgatggcgagaggtgtggtgtcagcgaagggcggcacggccgcgggcaagaagaaggggtcggtcgccttcacgatcgactgcaccaagcccgtggaggacaagatcatggagatcgcctcgctcgagaagttcctgcaggagcgcatcaaggtcgccggcggcaaggccggcaacctcggcgactccgtcaccatctcccgcgagaagaccaaggtca

SEQ ID NO: 5734 - DNA, 94 bp, Zea mays
  Clone ID: LIB3279-053-P1-K1-A6
gtttaacaaatgccatcggcaatgtggtggaaacgtgatcttgggaaaggggtattccatgatctaagggggcagcacgatcaccagacagact

SEQ ID NO: 5735 - DNA, 395 bp, Zea mays
  Clone ID: LIB3279-053-P1-K1-A7
gtcgttcggagcgggcagcagcacacagccccatcccaatcctagtcgatcttcttcccctcctcaagccggttccttcgtccacacgaccgcgcgctcggaaaactccgcggagggcgaaggaggcgaaccaagggcgacgtatccgccggcggagaaggtagccctcgatccggcgtctcccacgattcgtttgtcttgcgacagctgggcgaccgtcgtcgccgccgcccttcttcaggtgcccaggtcttcgccggtccctttgccgccgacgagcaccagccaggaagaaaagaagctgaaccatggggaagagaaagtcagctgctaagccacctcctaagaagcggatggacaagcttgacactgtcttttcctgcccattctgcaac

SEQ ID NO: 5736 - DNA, 393 bp, Zea mays
  Clone ID: LIB3279-053-P1-K1-A8
cccacgcgtccgcagcatatgcagctccaagggctcttgtctctatatcagctggtctaaaagattttgcactacttgagtctaacagtctactgctaacagcatgcataatttgccacgccagattgatcattccttttattgaagactgtgttctgaattgaccataataggagagagaagcatggggagttagcatctcggcctcatccatttgcaacaagccaaaagcactaactgtaagtctggcacttttaagcaacaataacatgtgctaaaagcacagtagtataattgatcacaattcacttcataaaatacatggataagtcataagtgctcgtatgtgagtacaaagaagaggtgattgtatttacctagatctgcaaacgc

SEQ ID NO: 5737 - DNA, 390 bp, Zea mays
  Clone ID: LIB3279-053-P1-K1-A9
gggaaagtggatctaggagacctgtacggcgcggcggcggggtgggtagaggcgcggaccagctgcccgcacatcggcaccatgccacccgctggtgctgacgacctcgcgcgcgtgccttcgcccgactctccgtgctccagatgtaatcaccctgctgaaaactggttatgcttcatatgcaaagatgtgctttgcagccgttttatcaacaaacatatgttgtgccatcatcaagaaactggtcactgtcttgctttgagcttcagtgatctgtcagtttggtgtttctcatgtgattcatacctagatgttcaagccattttagaattgcgcccagtgtatgaagttgcacatttgttgaaggttggacaacgtccaccatttcga

SEQ ID NO: 5738 - DNA, 397 bp, Zea mays
  Clone ID: LIB3279-053-P1-K1-B1
tccccatccgcacctctctccatctccctgctcctccgcctccttcttgatccagccaagccagggatcgccatgtcggactcggaggagcaccacttcgaatcgaaggccgacgccggagcgtccaagacctacccgcagcaggctggcaccgtccgtaagaacggcttcatcgtcatcaagaaccgcccctgcaaggttgtggaggtttctacctcaaagactggtaagcatggccatgccaaatgccactttgttgccatagacatattcaacgggaaaaagctcgaagatattgttccttcgtcacacaactgtgatattccgcatgtgaaccgtactgagtaccagctgattgatatatcagaggatggatttgtgagccttcttacttcag

SEQ ID NO: 5739 - DNA, 211 bp, Zea mays
  Clone ID: LIB3279-053-P1-K1-B10
cccacgcgtccggaccaaggctaagcgataccttgaggatgttattgctcacaagcaggcaattcccttccggagatactgtgggggtgttggtcgcaccgcgcaagctaagtcgcgccactccaatgggcagggccgctggcccgttaaatcagccaggttcatcctggatttgctgaagaatgctgagagtaacgctgatgtgaaaggc

SEQ ID NO: 5740 - DNA, 368 bp, Zea mays
  Clone ID: LIB3279-053-P1-K1-B12
accgtattttgctcttgttcatctaggacaataattgccttcggtttcaaagtacaggagtcgggcacgtttgcattgcaccccgttattatcctacagactccacagattaaacacacacacacacagcatgaacagaaggatcatggcactctagtctggatggaacatacaggggggtctagaggctcgctgaatcgacgccgcagcagctcctctacggcgaggacgcgggcgccgccgactaccagggcctcacttcacaggccagcaggcagcagtagcactcgccagcgcccagcggccggcctagcctatctgcctatgtgaggtggacggtgcactggctcttccgcggcccgccccat

SEQ ID NO: 5741 - DNA, 307 bp, Zea mays
  Clone ID: LIB3279-053-P1-K1-B2
gacgaagttaaattctggatttggaatcaatgacattcttctgctgcgaaaaagtacaagattatttgataatggaattgagtgtaggcagactttggatactgttattgatagatgttcacctttgcaaaatattcggaagctgttttgactaccagggtatttatcaccacttgtgggctaagtagggggtggttaaatcggccctattttgggggaccaaaatatggctttttgataccttgagggaaattgatggtttgggacaagacaacaagatctatttaaaggaggtgcacagcgcaga

SEQ ID NO: 5742 - DNA, 395 bp, Zea mays
  Clone ID: LIB3279-053-P1-K1-B3
catcttttcgcgtttagaacctctaaaatttcccccactcgccagtcgcagcagcacctgtagccatggacgccagcggagccggtagcaaggggaagaagggtgcggccgggcgcaaggcaggcggccccaggaagaagtcggtgacgcggtccgtcaaggccgggctgcagttccccgtcggccggatcgggcgctacctgaagaagggccggtacgcgcagcgcgtgggcactggcgcccccgtctacctcgccgccgtcctggagtacctcgccgccgaggttctggagttggcagggaacgcggcgaaagacaacaagaagacgcgcatcatcccgcgccacgtgctcctggcgatccgcaacgacgaggagctcgggaagctgctggca

SEQ ID NO: 5743 - DNA, 312 bp, Zea mays
  unsure (1)..(312): unsure at all n locations; Clone ID: LIB3279-053-P1-K1-B4
cccacgcgtccggccaaccaagcagctctgcagtcgagacatgaagcgagccgtctccgctctctgggcgcgccgcgccgtccgccaagcctacctntacacccccaccgccgccaccggcacctcgtcgtagcctgagtttggggcgtccacatcagaggcgtgggacgggcgtttccggctccacaagccgcgcgggcagcacctgctcaccaacccgcgcgttctcgacgccatcgcgcgccacgccgccatcagtccaggcgacgccgtcctcgaggtcgggcccggcacgggcaacctcaccgcgcg

SEQ ID NO: 5744 - DNA, 390 bp, Zea mays
  Clone ID: LIB3279-053-P1-K1-B5
agaacacatttgtggaagttgggacaagagatgtggatgtggaacatgcaggctcaggtgatgaatcttctggtggtttcgatgaactggattgtcagtacacaccaacagagagggaggactacgctctatcagatagggtggttcaagtgcaacaacagtaccctgataaccaggcagaagtgcttagctttgatcgggttttacaagggcgcatcacttttcctggtcagcagtggcattctgatttttatgccaatactacccaaactgaggataacgatgcatatagctgcgagtatgcccaagaggtcaaatatgcaattctggatggcagctctaatttgccagaaaccttagattctgaagttgataaactgtccctggggc

SEQ ID NO: 5745 - DNA, 342 bp, Zea mays
  Clone ID: LIB3279-053-P1-K1-B6
cggacgcgtgggcggacgcgtgggcgcgctctcgtttcgtcgctacgctagcttccagtcccgggcttagcaactgtgctgctgttgcactgcacccggcgcacgcagagatgcgccgtgtcgggacgggtgtgaggatgctttgcggcgcggcgctgtcggtgcttctgcttctcgcgggcggcgcggcggcgtatcactctcgctcgtcgtgccccgtcacgcctgcggacgcggggaacacgctgcaggtgtcgcacgcgttcgggccgtgctcgccgctgggccccgggacggcggcgccgtcgtgggcggagtttctggcggaccaagcgtcgcgtg

SEQ ID NO: 5746 - DNA, 388 bp, Zea mays
  Clone ID: LIB3279-053-P1-K1-B7
cgcgtcggaggccggcggcctgcgcgcggcgcggcagggcccccacggccggtcgctgacggcgcgcacggcgcacagcatgtccacgacggcgctgcgcaccaagtccaagtcggccgcgtcgctgcttcgcagggtgcccttcgcgccgctccgccccgtcctcgtcaacctgcaggaggtgttcctcggcaccaagctcgccgtgctattccccgccgtgccgctcgccatcgccgcccagtgcgcgcacttcggccaggtgtgggtgttttagctcagcctactcggtctcatccccctcgccgagcgtgtcagctttctgagcgagcagatcgcgatatacaccggccccaccgtgggcgggctacttaacgcgacgtgcggc

SEQ ID NO: 5747 - DNA, 385 bp, Zea mays
  Clone ID: LIB3279-053-P1-K1-B8
cggacgcgtgggcggacgcgtgggccaggctccaccggagccgccgccgtttctgggtctctcgacggcgagcagcgactcgtccggtcgtccctcagcactgggcttggcggacgcaggagaagacacaggatgagggctgtggtgcaccgcgtcctctcggccagtgtccaggtcgaggggcgaatagtgtctgcgatcggccctggactcctcgttctcgttggcgtgcacgaggcggacacagactccgacgccgactacatttgtcggaaggtcctgaacatgaggctgttttcaaatgacacgactggaaaagcatgggatcaaagtgttctgcagcgtaactttcaagcgctattgggtagtcagttcaccttatacg

SEQ ID NO: 5748 - DNA, 382 bp, Zea mays
  unsure (1)..(382): unsure at all n locations; Clone ID: LIB3279-053-P1-K1-B9
cggacgcgtgggcgacgagcgccggcgcgagctgcaggcgttcgacgacacgaagctgggggtgaaaggcctggtggactccggcgtcaagtccatcccgtccatcttccaccacccgccggaagccctgagcgacataatttctccggcgccgcctctgccgtcgtcgtcgccctccggcgccgccatcccggtggtggacctgtcggtgacgcggcgcgaggacctagtcgagcaggtgaggcacgcggccgggacggtgggcttcttctggctggtgaaccacggcgtggcggaagagctgatgggcggaatgctccgcggggtgcgccagttcaacgagggccccgtggaggcgaancacgcgctctactcgagggac

SEQ ID NO: 5749 - DNA, 301 bp, Zea mays
  Clone ID: LIB3279-053-P1-K1-C10
cacgacatcatgcatatttgtcgtgataaggttggtttctaatcttataaaccatttaagatcttaccatgtaagaataaagttccaaagtaactataagcacaggaagaatggtaaacaaagattcaggtgggcaaaacctgagaacagatatttataataaaaccaatgccaacggcattagaactacaaatgtctgacacccacatatttaagaaatactccattgtgatcctgaatcctgacttaccagagaatatagcgaacaaaggaatgaaaattgtgaatcaaattaaaacta

SEQ ID NO: 5750 - DNA, 205 bp, Zea mays
  Clone ID: LIB3279-053-P1-K1-C11
caccaacccgatccagctacattcgttgaggcccgtgcgtttcttgcctgttctcccatcaatcgacctagccttacgccgaccaggggcttcctctaatcgatctggtgtctgttctgtggtattggtctgggtgcactccagggccaggagcagctagccgtctttgttcgatccgttcgtaccctttaacgcggttcgattt

SEQ ID NO: 5751 - DNA, 342 bp, Zea mays
  Clone ID: LIB3279-053-P1-K1-C12
aacgccgtcccggccatgtccctcctcgcctacggcttcttcaaccggggcctcgtgccgggcctctgcttcggcgcggggctggggatcacgctgttcgggatggcctacatgttcgtgcacgacggcctcgtccaccgccgcttccccgtcgggcccatcgagaacgtgccctacttccgccgcgtcgccgccgcccatcagatacatcacatggacaagttccagggcgtgccctacggcctgttcctggggcccaaggagctgaaagaggtgggaggaactgaggagctggagaaggagatcaagaagaggatcaggaggagggaggccctagacgcc

SEQ ID NO: 5752 - DNA, 393 bp, Zea mays
  Clone ID: LIB3279-053-P1-K1-C2
gaaactatggttcaagaaatctgtcgcgacatcaaaaagttggattgtgctaagaggcacataacaactacaataaccgctcttcaccgtcttactatgcttgtttcggctgttgagcaacttcaggttatggcatcaaaacggcagtataaagaagcatctgcacagctggaggtaagaataatttaattagctgataaacctgcataggctctagagttgatttcaatggatggaacattttaacacttgttgtgatcatttttgcatgattttgcacatgatttccaaccaaatttataactttgttccaggcagtgaaccaactatgcagtcattttgaagcctatagagatgtgcccaagataacagaattgagagagaaattcaaga

SEQ ID NO: 5753 - DNA, 394 bp, Zea mays
  Clone ID: LIB3279-053-P1-K1-C3
cgcgagcgcggagggcacgcccaagaggctgacctacgacgagatccagagcaaaacgtacatggaggtgaagggcacgggcacggcgaaccagtgcccgaccatcgacggcggcgtggagtcgttcccgttcaaggccggcaagtaccagatgaagaagctgtgcctggagccgacgtccttcaccgtcaaggcggagggcatcgccaagaacgccccgcccgagttccagaagaccaagctcatgacccgcctcacgtacacgctggacgagatcgagggcccgctcgaggtcggctcctacggcacgctcaagttcgaggagaaggacggcatttactacgccgccgttaccgtgcagcttccggggggcgagcgcgtgccgtttcttttt

SEQ ID NO: 5754 - DNA, 391 bp, Zea mays
  Clone ID: LIB3279-053-P1-K1-C4
gccgctacgagggggaggggatcgaactcgaaggagaatttccattcgaccccatccacttctcacctcaatctcgcgagaagcgaagccggaggaggagggtgcgaggagatcgcgagcagccggagccggagccggagccggaggcctagtagatgaagacgttcgatccgtggccggtcttcttccgccgggagtggaagcgcaattggcccttcctcacggggttcgccatcaccggcttcatcatcactaagatgacggccaactttaccgaggaggaccttaagaactccaagttcctccaggagcacaagaagcgctgaccaaccaggtgttgtccgaatcgcctgtctggacagccagctatgttatgctgtttgaatgaaaa

SEQ ID NO: 5755 - DNA, 389 bp, Zea mays
  unsure (1)..(389): unsure at all n locations; Clone ID: LIB3279-053-P1-K1-C5
cgagaggtgtctgcctatcacttgcgaagaaatcgcgaggggaagcgtgacacctgacgagctgagcaggcaggcggtagtggccgagcgaaagcatcctcgatctcgtcgtatcgtagctgccgccgctcagagcaatggagagagcggtgccagttcggaagtcgcacaccaacacggccgaccttctctcctggtcggccacgggccctgacgcatctgcctcgccggccgggtcctcccgccccagcctcaagccggccgcggngattacgccggcgatgttcggcgcgccggtcaccgagcaggaggccgaggatctgagcaagagtgaaaggaaattttgctctggctcaaagttgaaagagatgggtgggagtgggattttt

SEQ ID NO: 5756 - DNA, 379 bp, Zea mays
  unsure (1)..(379): unsure at all n locations; Clone ID: LIB3279-053-P1-K1-C6
cagttgtctccagtttccatgcagagcagaaaagatcagctagcgagagaagcaatggcgtcggctcctgcgttctgcgtcgcgctgctgctgctgctggcttccgccgctgccgtccaagcggtgccgccccaggccggcacgtcgtccacctgcagcactgacctcctccgcctcctcccctgcctgcccttcatcgagggcaccgccaccgtgccggcggacacctgttgcgccaacctgggcagcatggtgcacgacgagccgcagtgcctctgccaggctctcagcaaccccagcacggcccccgtcgccgtcaacatgacgcgcgtgatggccatgcctcggntctgccgactngacctcccgcccgccaccg

SEQ ID NO: 5757 - DNA, 355 bp, Zea mays
  Clone ID: LIB3279-053-P1-K1-C7
caccgcctccccgatctcgtcgagaggaagcccaatcccgaaaccgtcgccgtattccaatggcgcccaaggccgagaagaagcccgccgccaagaagcctgcggaggaggagccggcggcggagaaggccacggcggggaagaagcccaaggccgagaagcggctccccgcgggcaagtccgcaggcaaggagggtggcgagaagaaggggaagaagaaggcaaagaagtcggtggagacgtacaagatctacatctttaaggtgctgaagcaggtgcacccggacattggcatctcgttcaaggccatgtccatcatgaactccttcatcaacgacatcttcgagaagctggc

SEQ ID NO: 5758 - DNA, 391 bp, Zea mays
  Clone ID: LIB3279-053-P1-K1-C9
cccacgcgtccgcccacgcgtccgcttcgccggctcatggtggccactggccaggctgtcatcctgttctataaagcgagccgaggggaagagccggaaccctagcccagcaccgcagaggcgcagagacaggcgtcttcgtactcgcctatctccgcgactcaaagcttcttccatttcctaccgccgccgctgcagctccaccccattccgtcgacaccatgagggagtgcatcttgatccacatcggccaagccggtatccaggtcggaaacgcgtgctgggagctttactgcctcgagcatggcattcaggctgagggtcagatgcccggtgacaagaccattgggggtggtgatgatgctttcaacaccttcttcagtgagactgg

SEQ ID NO: 5759 - DNA, 383 bp, Zea mays
  Clone ID: LIB3279-053-P1-K1-D10
aatcgacatatcttttcacaattcagaggttatgttgggatgaattatcctcaataattaagcacgttactgttagcttcaaagagggtcttggtaaaaaattcaagcaatcttcaggaacatgaattgccttttcagtgtttgaggaatcagacttattaaagcagggggacatggatgtatatccacttgcagttaaagctgaaacaacattgtatgttgatcacccaccagatgtgggtgaccaaaagatcaaaactcctaactcatagatcactcaggcagccaggtcgtgtttgaaaagaaagaaaatggggattatcaagtaagagttgtttgccagatcctttggtcgatggaactaggtataaactgcaagaaat

SEQ ID NO: 5760 - DNA, 391 bp, Zea mays
  Clone ID: LIB3279-053-P1-K1-D2
cccacgcgtccggaaggaatctgcagagagcacaatggtagcttataaggcagctcaggatattgcattggctgaactgccacctattcatcccataaggcttggacttgcacttaacttctcagttttctattacgagattcagaactctccagacaaagcttgcaatcttgccaaggaggtaggtgtacatttatctttctattgctgtactgggtttctgagttataactatcttcggtgttgttagtttgaatctgggctgaaagaaaaggtgcaaattgcatatggattgatctttgaaaactcaagcacagtgattttaccattttcaccgtagatattgtttgatccttctattgcttggtactcatatggactttactttcag

SEQ ID NO: 5761 - DNA, 391 bp, Zea mays
  Clone ID: LIB3279-053-P1-K1-D3
gagagatcggggggaacgactacaactacgccttcttcaagggcaagaccctggacgacgccaagacctacgtccccacggtcgccgccgcggtcaccgatgccaccgagaggctgatcaaggccggcgccacgcacctggtggtgccggggaacctgcccatgggctgctcgtcggcgtacctgaccctgcacccgggccgcaacggcagcgactacgacgccgccggctgcctcaggacgtacaacgactttgcgcagcaccacaacgcggtgcttcagcggaagctgcgggcgcttcgggcgaagtacccgcaggcgaggatcatgtacgccgactactacggcggccgtcatgttctttggcaagaaccccaagcggtttgggttca

SEQ ID NO: 5762 - DNA, 322 bp, Zea mays
  Clone ID: LIB3279-053-P1-K1-D4
gaaacaccgccgccgccgcgccttccattccagtactcgcggaggaaaggaacaccagccagcgccatggtcacgtcgacgaccgccgccgccgtgctgtccccgccgtccgtggccgggcttcgcctggcgccgtctccccgggcgcgcgtggcgttccgcgcggcgcgggcgcggcggtccgtggcggcgcgcgcggagctgagcccgtcgctggtgatcagcctgagcacgggcgtgtcgctcttcctgggccgcttcgtcttcttcaacttccagcgggagaacgtggcgaagcaggtgcccgagcaaaacggcaaga

SEQ ID NO: 5763 - DNA, 258 bp, Zea mays
  Clone ID: LIB3279-053-P1-K1-D5
gtaaggccttgatcagctttccagggtgttggaagaacccttggtggtggaccttccccagatgagagcgcaacagctggtcctgcatcagcggcccctgctgcttcgaggtccgctggcgttggcggggatgactcccaaccatttacgtccatacagctggagctggctgatggcactcgcatggtcgcccggttcaacatgcaccacaccgtgggagacatcaggttctttatagacgcagcttggcctggagct

SEQ ID NO: 5764 - DNA, 291 bp, Zea mays
  Clone ID: LIB3279-053-P1-K1-D6
gggaccgcaagccgccggagcgcttcaggcgcagggaggataggcctgctggtggacaaggaggcccccgccctggtcctggtgctgctgctacagctccatctccagcaccggttgctgctcgcccataggctttagcttttcgaccgtgttaagtcttctgcccactcagtttcggagttgccccttggccgggggtgaagctgctatattagagttactttttgtctaaagtctgaacattttcgaagaatttgaatatctgaccatttgaaggttggggctgagttt

SEQ ID NO: 5765 - DNA, 357 bp, Zea mays
  Clone ID: LIB3279-053-P1-K1-D7
ctctggaaagctaaaggtttccctagaccccaagcaattcttgggtgttgcttcagtcgtagatgcggtcgaatatcttcattctggcaagagtgttggcaaggtcgttgtgtgtattgatccatcatacggtcagatcgttgcaaaattataatccatggacatgatgcgcattgtcttccatggtcacgtaggttactgtcttatagttacacatatacctcaagaccgtattttcccagcgggtgacaaatgaataagggaacatgttggtgtatagtttagtttcatttttccaaagtgtaagatgcacaactatactgaagggcaagcatgggcatggaaatcgattaagtt

SEQ ID NO: 5766 - DNA, 344 bp, Zea mays
  Clone ID: LIB3279-053-P1-K1-D8
ggccaccaccattccttccccaactctgcaggctgctcgtcgccctgcctgcacgccggacgcgccccgatccagatccaggggcgtaacatggcatcaaaacgtatcctcaaggaattaaaggacctgcaaaaggaccctccaacgtcatgcagtgctggtcctgctggtgaggatatgttccactggcaggcaaccatcatgggtcctcctgatagtccatatgctggaggtgttttcttagtgaacattcattttcccccggactaccctttcaagccttcaaaggtattttttaagacgaaggtcttccatccaaacatcaatagtaatggaagcatatg

SEQ ID NO: 5767 - DNA, 299 bp, Zea mays
  Clone ID: LIB3279-053-P1-K1-D9
cttgtctatcttctcaatgaagcagctgtcttggaagcaaagataaagatgggactaggaaatcttgaggcaaccttcgagaccttggttgatgcgtttgtcttcttggataagaataaagatgggtatgtgagcaaggatgagatgatccaagcaataaacgagaccacgacaggagagcgctcttctgggcctatagccatgaaaagatttgaggaaatggactgggacaagaacggaatggtgacattcaaggagttcctgtttggcttcactcgctgggtaggaattgatgaaaa

SEQ ID NO: 5768 - DNA, 308 bp, Zea mays
  unsure (1)..(308): unsure at all n locations; Clone ID: LIB3279-053-P1-K1-E1
gnggtgctgtcatcccaatcccggcttggacagaaggtctggaatgagacacacaaaggaatccggtgcttgttgaacattgatcgacctggtttatttttatatactggacttttttttttgagggagatgtttgtttctatagaattgtaggccataacaaaaaatgggtacccagcgggctgcgcctgacattagcagccgggaaccggccacgttccacgatacaaggaactgtttcgttgtaattgctctcccagagtgtgaaattctccaaaggtatcgtatcaccttctttattccaaann

SEQ ID NO: 5769 - DNA, 242 bp, Zea mays
  Clone ID: LIB3279-053-P1-K1-E10
ctcaaggtgctcgtgcccttgaacgccgacttgcaggacaggcgccgctacccggggcccttcgcggaggcgacgcggcgcgagctcgagggcgcctcgatggagctcggcctcgccgtcgccagcatgggcagcggtccgccacctgtctctccggggcggtggaattttaatctgatcatgagctgattgatttggatttttatcttaaggaggttgaaacactttattttgttctattg

SEQ ID NO: 5770 - DNA, 352 bp, Zea mays
  Clone ID: LIB3279-053-P1-K1-E12
cagagtcacgcgtcagttcgttccctcctctgtgtaccggccagtaaaatccgaacccacagcgagaaatggcggcggcagcgctccgtccggcgatcctccgccgcatccgcctctccccctccccttcgctcgccctcgccgccgctgggacaggtgcatcccacccgcacgcgctggggcggtggctcgcgcggcccatgtcctcccacgacgcgcacctcacccgcgacgaagtcatcgaccggatcctcgacgtcatcaagagccaccccaagatcgacccctccaaggtgaccccggaggcgcacttcgagaaggatcttgggctcgacagcctggacaccgtcga

SEQ ID NO: 5771 - DNA, 383 bp, Zea mays
  Clone ID: LIB3279-053-P1-K1-E2
ctagaagcgcccctctccctctctctctctctcttcgccggccgaagctccgcaccccaatctaatcgacacctcgccgagatgggccgcaagttcttcgtcggtggcaactggaaatgcaatggaaccacagatcaggtcgagaagattgtcaaaaccctgaatgaaggacaggttcccccttcagatgttgtggaggtcgttgtcagccctccttatgtcttccttcctgtggtcaagagccagctgcgccaagagttccatgttgcggctcagaactgctgggttaagaagggaggtgctttcaccggtgaagtcagtgctgagatgctcgtcaaccttggtgttccctgggtcattcttggacactctgaaaggagagc

SEQ ID NO: 5772 - DNA, 130 bp, Zea mays
  Clone ID: LIB3279-053-P1-K1-E3
aaaaataccagaatgaagaaattttagatagagttaacttatgatatacatcatacgaacaccacaggtactggtacttatgacctccatacataggttcagagaatacaccaccagtagatccaacata

SEQ ID NO: 5773 - DNA, 290 bp, Zea mays
  Clone ID: LIB3279-053-P1-K1-E4
caggcatctgtccccttctccgaggaggagcttgagtacattgcaagacttgatcctgtaaaagatgcagaaatgctacgcatggagctacccatgatacgagacgcatgtctcagggtgctggtgctatcaacagtatttctcaaggaagctgcagcgtctggcctctgcctctcggagattggagacatgatgagcaggcagttcactgcgaaggaggaggaaccgagtcagcttgagctgctctgcatggaggcaaggaagtgggttgaggaaagagagtccttttt

SEQ ID NO: 5774 - DNA, 391 bp, Zea mays
  Clone ID: LIB3279-053-P1-K1-E5
acgggtgaaatacttgaaactaatgcccatgttttgggtcaaatttcgtcaaaccttagcaacatgcagatacaggacaatatctctctgctctgccaaactcgcgataatatactcagggtcttgaaagagataaacgatgctccagatatcatgaagcagatgccccctctacctgtgaagataaacgaggagctcgtcaacttgttgctccctagaccaactgtacctatgcagtagtgatagcaaaatgagcttttaagataggcagctgaaataaaaaaaaaaggggcagccctggtacttttttgttcgtttagtagctccatcctctcgccttctgtattgtattgttcgtctggatgcttatgttttgttccaaccttttgca

SEQ ID NO: 5775 - DNA, 389 bp, Zea mays
  Clone ID: LIB3279-053-P1-K1-E6
tgctgaatgcacgctctctcatgtggcatcatcatcttcatttggtggagtatctgggacatgatcatcatctatcatctttattaggtggagtttcaggggcatgatcatcatctggctgacattgcatggtcaccaaaacatgctggggttacttttttttacattatctttgtagcttgtgaaggccatcctagtcttctagatgtgcatttggcgtttgtcatggacattacactttgaagaattcgaattatgtatttccctttgtgcagatgcaacgttgtgttttcattataataggtgatgtggtttcgctggtttactaacaattctgaaatcttggatgattcattccatcatgtcatggcattttgacgaggaaattt

SEQ ID NO: 5776 - DNA, 376 bp, Zea mays
  Clone ID: LIB3279-053-P1-K1-E7
cttccctccctccctctccccgcgggccgccagaggcaatttcgccctcgattcgaccccgattcgtccgcccgcgaccgggattccctccgccaagcgcggatctgaacgctgcgctccgtgtcgtcgctcgaatccgccatgaagggggccaaatccaagggcgccgccaaggccgatgccaagctggcggtgaagagcaagggggcggagaagcccgccaagggcaggaaggggaaggccggcaaggaccccaacaagcctaagagggctcccagcgctttcttcgtgttcatggaggaatttcgcaaggagttcaaggagaagaaccctaagaacaagtctgtcgctgcggtgggaaaagctgctggcgaca

SEQ ID NO: 5777 - DNA, 380 bp, Zea mays
  Clone ID: LIB3279-053-P1-K1-E8
gcggcgaagagagaactcgaactcggcaggacttgtgcggaataggaggggagcggccgagcgggggtcagagagggagatagagttcatcaggtttgccatgtcctccagggctggcggcggcaagccgttgtggtctgcctccaccatcgtcgccaaagtcgcgagtgggtaccacatcctcaggatcgatggctactccaggaccatggagacccccacaggagagttcatcgcgtccctcccgttctcggtgggcggccgttgctggcgcattcgctactaccccaacggcgacaagttggagaataaagaatacatctcgctttatcttaatctccacgacagaagcgtcgaggcagagaatgcgcaattaatgt

SEQ ID NO: 5778 - DNA, 384 bp, Zea mays
  Clone ID: LIB3279-053-P1-K1-E9
cccacgcgtccgtatatgcaacgctcgtgtcatttgttccaatacttgaagaagcagcacgctacgagttgagatatgggcacacaaatagagctacaagaggaggtggatattatggcatattacacgttgagtggtgaactcaagtatcagtttgggtctggaaggtgaagctgatcagttgctgctggatgaggcttttcaacgacggcttctcgacaaacatcattatgcccgagtgccaggtggcagagcctgcacttaatcagaaggaggaagttatgatagaatatcgaccaccagcacctgcagttgattctaggcctgcaccccaatggatatgcccagtgtcttttatagagctcagtaaaactaccttccctt

SEQ ID NO: 5779 - DNA, 262 bp, Zea mays
  Clone ID: LIB3279-053-P1-K1-F1
cggacgcgtgggcggacgcgtgggtgagacggaaccgggacagcaaaggaagatacggcgcgatattttagactacaggagaccggcgccgaaagctccgtggcctcgtctccttccccacttcggcctcggcagttccgcgtgccggcccgagccttggttcggttcgcatttcgcactttgggcctttggcggtgggatttcttaagaggttcttgaccggttcaaccaaccctgggccggggagaatggagctaaagcc

SEQ ID NO: 5780 - DNA, 390 bp, Zea mays
  unsure (1)..(390): unsure at all n locations; Clone ID: LIB3279-053-P1-K1-F10
ctcggcacgcaggctagcagcacagcagcagccagagccatcccctctcctcgctacgcttcgcttcctcggcgccgattcctcctcctcctcctccaccctcgtccgtncccttccggcgcacgagctcgcccgagatggcgaacgcgagatcgggtggtggttgtgaacgatgagggcatgctgaagttggccgggctgcagtcgaagaggctgcaccgcttcataactttcaagatggacgacaggttcaaggagatagttgtggaccaggtcggggatcgcgctaccagctacgatgacttcacaaacagcctccctgagaatgactgccgatacgcgatctatgatttcgactttgttactgcagaggatgtccagaagagcagg

SEQ ID NO: 5781 - DNA, 362 bp, Zea mays
  Clone ID: LIB3279-053-P1-K1-F11
ctcgcgcggcgaccacccgattcgaagcgtgcggagagaccgaagaagcgggagagatggctcgtaccaagcagactgctcgcaagtccacgggagggaaggctcccaggaagcagcttgccaccaaggctgcccgtaagtctgcccccaccactggtggagtgaagaagcctcaccgctaccgccctggaactgttgccctccgtgagatccgcaagtatcagaagagcactgagctgctgatcaggaagctgcccttccagaggctcgtcagggaaattgcacaggacttcaaaactgatttgcgttttcagagccatgcggggcttgccctccaggaggctgctgaagcataccttgtt

SEQ ID NO: 5782 - DNA, 319 bp, Zea mays
  Clone ID: LIB3279-053-P1-K1-F12
cgcgccgcttcccagaaggcgcagcagcagaagaaggagatcgccaagcgcctcggccggcccctcgtctccaccacgccctatgaggacgtgattgcgtgcgacgtcatcaaccccgacagcatcgacgtcgaattcgactccatcggcggcctggaccagatcaagcaggcgctctacgagctcgtcatcctgcccctgcgccgccccgagctcttcaccttcggcaagctcctcagcccccagaagggcgtcctcctctatggccccgccggcacaggcaagaacatgctcgccaaggccatcgcaggagtccgcg

SEQ ID NO: 5783 - DNA, 381 bp, Zea mays
  Clone ID: LIB3279-053-P1-K1-F2
aacggattcatcaccgccaggcgtcaggtcaggtgcgtgcgcatacatccgtcagccacccttcacccgctcttcttctaccggcggttccctccacccgctcttctgccggtggttgtgagagtgtgttaagaaaagatggtggcgaatggcgacgcacctgctagagggagtgcgactgtagctgcaagcctgcgcaggcgtaggaccacaagcgttgctgctgctggcagaggtggtgccagctcgatgctccagttctacaccgatgaggctgcgggccgcaaaatgtcaccaaacacttttttgatcatgagcattgggttcatagctgttgtcgctatgctccatgtttttgggaaactgtaccgcaccttcaac

SEQ ID NO: 5784 - DNA, 388 bp, Zea mays
  Clone ID: LIB3279-053-P1-K1-F3
caggaattcaacgcaaaactttcagattttggcttggcaaaagctggtccaactggggataaaacccatgtatccacacaagtcatgggtactcatggatatgcagctccagagtacattgcaacaggttagatatttttccctcgcgtactgatgaaatattggggtagtgttgtgcattactctggtttgtggcttcagcttttaaagggagatgtcaataatacttcctagtactgcaacaactaaggatacctgatcatttcattttctacctaaagcatatttggtgatacagggtataacaaagggctatttgtttaagctaaaagaaatcattgtggggccctgccatcaaataactgtatttatatttgttttggagtca

SEQ ID NO: 5785 - DNA, 293 bp, Zea mays
  Clone ID: LIB3279-053-P1-K1-F6
gataagcgctatcgctgaaaaactgcatttgttcactgcacaagagacgtgggatccgcttgcacaagaacacaaggtctctcatgcacgtggtgagttgtatattatagagaactcgcatcactgcacgatgatcgaaaaccatgctatgatataataagtacatgtcatacatcggctggcaaaacatctcgagcccttgtgtgtcgtctaacaagtacgcggttctatgcatcattgctaatttcagactttgtagcatagaactttgctacttctctaacgcataccac

SEQ ID NO: 5786 - DNA, 377 bp, Zea mays
  Clone ID: LIB3279-053-P1-K1-F7
gagatccggagcagccgcagtcccaccgaccccgccgccggtcgccctccatctcctcgccgctgcctctcgtttctcttttcaataatcaagatgagccgtggtggtagtgccggtggtggtcaaagttctctgggttatctctttggaagcggtgagccccccaaaccagcagtggcaccagctgcaagtgctccacctgttgagaaaccatctgctgcaaagactgatgcggccaaacaggttgctgctggggttaccagccaaaccaataactaccacagggctgatggtcagaacactggcaacttccttacggaccgtcctttaaccaaagtccacgctgctcctggcggtggctctttcctgggctacct

SEQ ID NO: 5787 - DNA, 378 bp, Zea mays
  Clone ID: LIB3279-053-P1-K1-F8
cccacgcgtccgggaccaggccaggctcggtaagccagtctccctcaacaaggcatgcacctacacacactagcttggctaggctacatacatacgcctgctgccgtgggtcgtctcgtcgccaccatggtcgtcgtcgtcgtgaactttgcccttcttcttgaacaacacacactctctctctctctcccttcgcttttctgcgtgcgtgcgtttgttggtcgcttgtcttgtacatagaaatttttagtttctggtgtacgtaggagagttttgagtgagatggaataagaatcaggcatttccctcatacggcgtttccgattgcgtgacatgccgtggagggcattgtaaatgtcggggaaattcaatgcgcct

SEQ ID NO: 5788 - DNA, 384 bp, Zea mays
  Clone ID: LIB3279-053-P1-K1-F9
aacggcttcatcgtcatcaagaaccgtccctgcaaggttgtggaggtttctacctccaagactggtaagcatggccacgccaaatgccactttgtcgccatagacatattcaatgggaaaaagcttgaagatattgttccttcatcacacaactgtgacattccgcatgtgaaccgtactgagtatcagctgattgatatttctgaggatggatttgtgagccttcttacttcagatggcaacactaaggatgatcttagactcccaactgatgagactcttgtggcccagattaaggaagggttcgaaagcgggaaggatcttgttgtgactgtccagtctgcgatgggggaggagcagatctgcgcgttgaaggatgttggc

SEQ ID NO: 5789 - DNA, 280 bp, Zea mays
  Clone ID: LIB3279-053-P1-K1-G1
ggcggcgaccgtcggcgccgtccccgagaccaaggcaagaagagcgacggggggagtaaacccaccgtgttgtccgcgagcaaacccgccgtgttcttcatgatcaccgacgaggcggtcaccgacgattacgaccgttactgcaccaccggacactccttcgtggctgtggtgggacagtgctgcatatcaactgattgatatttctgaggatggatttgtgagccttcttacttgagatggcaacactaaggatgacattgttattttcattactgag

SEQ ID NO: 5790 - DNA, 301 bp, Zea mays
  Clone ID: LIB3279-053-P1-K1-G10
gggggatgcgaggtcgtgcgtagccatatttcacacaacggggcatcgaggatcgagctaccatctcgagatattaagatagagccaagcaagtggcgggtcaacgttagacacgttgatcgttgttgtgggaattaaaatacattgctcgaggatggcattgcctatcacgagagccgcttgtagaggaacagctaaccttgggaaggtggagaggccattgaacgtgtgaggtctagtcaaggcggaagaccccagaagcacattggccattcctgcagtgcgagctatgatgctggta

SEQ ID NO: 5791 - DNA, 202 bp, Zea mays
  Clone ID: LIB3279-053-P1-K1-G12
ttttgagatgctgtagactagtagtgcctgctctgagttagtaattgaaagtgttgtccctgaagtgatgctgtttagttggtagtgtgttcgcttcttcggcacttatacttacccccaagcatcaacgctgcctgttttaaatctcaataggtgctgttttaaatctcagatctcaatatatgactactgatcgctgaat

SEQ ID NO: 5792 - DNA, 383 bp, Zea mays
  Clone ID: LIB3279-053-P1-K1-G2
cgcctcgctctctcttgtctcgcccgctagctcccatcccagcctcccaccgcgcccgcctgccccaacatcccccctccccgctccgctccacgcacggctccagatctgctacggcggcggccggtggacgccgcgccgcgcgtgccggaggcggtgacgtgagcggcggatcctgcccggccgtgccatcctggcgacgatgacagcgtaagcgggcggcggacgaccgcacccccccggcccctacttccgaggtcattggcgtgtgctccttggcagaaaatggcgatgatgggggatccctccaatggcatggcaagtcaaggaaagcattactatactattgtgcagacactgtttgagatcgacaccaagtacgt

SEQ ID NO: 5793 - DNA, 377 bp, Zea mays
  Clone ID: LIB3279-053-P1-K1-G5
ctttgcttttcgtgggctgctcctagacacctcaaggcattatcttccagttgatgttattaagcaagtgatcgactctatgtcatttgctaagttgtagaacgtttttcattggcatatcatcgatgagcaatcctttccattggaggtgccaacatatccaaacctttggaaaggttcatactccaaatgggagcgctacaccgcggaagatgcacatgatattgtcaaaaattgacgtgcctggtcatgcagaatcatggggaaatggatacccaaagctttggccttcttccaattgtacagagccattagatgtctctagtgatctcacatttgaggtatttttggaatcttgtccgatatgaggaaaatct

SEQ ID NO: 5794 - DNA, 359 bp, Zea mays
  Clone ID: LIB3279-053-P1-K1-G7
cggacgcgtgggcggacgcgtgggcttccgtgctcaccttcgagagatcaagttgctgctgcggtagtcccccaaccatcatcatgcagaacgaggagggtaagacggtggacctctacgtccccaggaagtgctcggccacgaacaggatcatcactgccaaggatcatgcctctgtccagatcaacattggccacttggatgcgaatggcctgtacgatggtcacttcaccacgtttgctctctctgggtttgtccgtgctcagggtgatgctgacagctcgttggacaggctgtggcaaaagaagaaggctgagatcaaacagtagattttgcacgtagttccaccagtaatgcac

SEQ ID NO: 5795 - DNA, 374 bp, Zea mays
  Clone ID: LIB3279-053-P1-K1-G8
ccgtgttccagatcgacgtcgcccgctccaagtggctggacctggccgtgctcttcagcatgatcgtcatctaccgcctgctcttcttcctcatgatcaaggccagcgaggacgtcaccccctggctgcgccgctacgtcgcgcggcgccgggtgcggaaccgtcgccaccgcaagccggacctgcccgcccggacgccgtcgctccgcgggtacgtcgtcgacgcggccagcctgccggacgaccacccgtgacgaaagagcgcgagagaaaacgtacgggcagggatgtcatttcatatcatatcacacagaggctaaaccggatcgagctgataataacacactcactcactagtactgcaataatatgat

SEQ ID NO: 5796 - DNA, 380 bp, Zea mays
  Clone ID: LIB3279-053-P1-K1-G9
accggataattagccttgtggaaaaatggaaccactcagaaggaaccccgcaggtcgcttacaccttcgatgctgggccaaacgctgttctaatcgcccaaaaccgtaaaactgcagcacatttcctccagaagctcctatactatttccctccacaggataatgatttgagcagctatctggttggcgataaatcaattctaggtgacgccggattgcattccatgaaagacgtcgaggctcttccagcacctccagatacgaagataccggatcagaaattcaagggcgatgttagctactttatctgcagcaggcttggggcaggtccaaaggttgttgttgacgaaggtcaagcactgatcgattcagtcaccgga

SEQ ID NO: 5797 - DNA, 344 bp, Zea mays
  Clone ID: LIB3279-053-P1-K1-H10
cccacgcgtccgagccgccgtcatgtcgaagcgaggtaggggaggttcggctgggaacaagttccgcatgtcactgggtctaccggtggcggccacggtgaactgcgcggacaacacgggcgccaagaacctctacatcatctccgtcaagggcatcaagggccgcctcaaccgcctcccgtccgcctgtgtcggcgacatggtcatggccaccgtaaagaagggaaagcccgacctcaggaagaaagtgatgcccgccgtcatcgtccgccagcgcaagccgtggcgtcgcaaggacggtgtctacatgtacttcgaagataatgctggagtgattgtgaatc

SEQ ID NO: 5798 - DNA, 67 bp, Zea mays
  Clone ID: LIB3279-053-P1-K1-H11
ccggcgcctagggcgagaggtggtttggactagcaacggacttgttcgggggtgggcacaacttccc

SEQ ID NO: 5799 - DNA, 310 bp, Zea mays
  Clone ID: LIB3279-053-P1-K1-H2
attgatctagctagctaccttgaatcttgatccgtccatacacttgttctttttcatggcgaattaattaaagaacttcggcacaaacatattctcatctccatgaatattcattggcaattctctggctttcttttccttctcttttgatatataacatctaacatgcttgtgtgcatatgtgtagcagcagcaaggtcagcagccgagggcgaatgggggagctgatgcaccgttgctgcccctgggtccggcggcagctacatcggcggctccggagcaaggtgggttgcctagaagctcatcaatg

SEQ ID NO: 5800 - DNA, 227 bp, Zea mays
  Clone ID: LIB3279-053-P1-K1-H3
ccaccgggctgttagagcccatgacgccctactcgttcgcctcaggcgccgacttcccgctcttatcgccgacgggcttggacgggcagctgagaagcatccacggggccggcatcggcgtggagttggagaccctgttctaggagctgttgccggacacctgaacatacatgtatggttgcgtggagggcatacatagtttattgcatctaaaaaattgggggggt

SEQ ID NO: 5801 - DNA, 355 bp, Zea mays
  unsure (1)..(355): unsure at all n locations; Clone ID: LIB3279-053-P1-K1-H4
cccacgcgtccgcccacgcgtncgttcgcatgccagttccgacatggttgacatccatgcgtcgatcctctttcaggccctgcactgcgagaagaagtaccttcgcatccaggatgatactttgactgggaacgcatcgtccgtggacatcgccaccaaggagaacatggagtctctgatatcgatcggccaggagctgctcaagaagccagtggcgagagtgaacatcgacacagggctgtacgagtcctgcgacggtgagggcacaaatgcacagtcgctagctgacttcgccaagcaactctttgacgagcgcaagctacgcaagagcaatcttaactccaactaataaata

SEQ ID NO: 5802 - DNA, 104 bp, Zea mays
  Clone ID: LIB3279-053-P1-K1-H5
gttacaaggatcacgcctaggtctgtctgctatgaccagaatacagagttcgtggcggtcttgataatatcgatcgacggctgcagtcccggcctaaaattgaa

SEQ ID NO: 5803 - DNA, 166 bp, Zea mays
  Clone ID: LIB3279-053-P1-K1-H7
cccacgcgtccgatcccactgcgcctggtactccttttctccggtgctctggtgtcttctatgccgcacgcctgggagcagtccgtgccttttctttatacttggtcgtccagccatcctctgctcccttcgttctcctgtgatcggcctcctttcagctgcgacg

SEQ ID NO: 5804 - DNA, 215 bp, Zea mays
  Clone ID: LIB3279-053-P1-K1-H8
ctggcgcgtatgagaaaaaaagggcgaatacgaggccaccaactgaccgccgggtcggaagcagtgccaaccaaccaatcgccgtcctgggccagcggcgtatgctcgccccatgtcgatggcctggctctgcgtgctgggctggggaggccgtgccgacggatacctaaagatctccacccttgaccggggctgtctgaccctgctgcaggatc

SEQ ID NO: 5805 - DNA, 148 bp, Zea mays
  Clone ID: LIB3279-053-P1-K1-H9
cccacgcgtagtgacccctcgcggagttaacgaggctgacttaatttattgcgtgggataacatggatctcatcactcatgaagtcatggctggcttaacaaatgtctatactataggcgctgggagggcagctgcactaaccaacga

SEQ ID NO: 5806 - DNA, 282 bp, Zea mays
  Clone ID: LIB3279-054-P1-K1-A1
atgcgtgcacgcttgcaaggctatgatcaaaccctaagcatagagtggctttatcacgggggaaacagaagcgaatcgcaaccatagacaataaaagagggcatataccagagtggtgccaatgccactgacaagcattggaggacctcttatacagcccaactacacacgatggctacatactcatcagccccagaaagagaacaaattcaatgcttcttaatagtgagactatctactggattggaactttaaaaggtcataaaggagctagtcgcagct

SEQ ID NO: 5807 - DNA, 367 bp, Zea mays
  Clone ID: LIB3279-054-P1-K1-A10
ctttgttcctcgcgaagcctcaccgcgctgcagagcgcatcgccgagcccccgcctcacctcgaattcttctcgccgtagttcgttgccctcctccttccccttctctcctcgacaagtacacggcggcttggatctatacgaattcggcatctgtattttacctcatcggggatggaggtgcaggtgtttgatttgtcttccgactccgagggcgaggtgacggcgcactcgcccgatcacaagcgcccttctcgacagccgggtgcagaccctaatcgcgggggtggcgagacaggttccagcgccctggacagcctcttcgagcaagcgggcgcggcgaagccacagcgtcaccccagtgacgc

SEQ ID NO: 5808 - DNA, 365 bp, Zea mays
  Clone ID: LIB3279-054-P1-K1-A11
attccatttgatctaaatgagcttcctttagatgagctcgatgaagacttccaggagccggatgatgctaatgagctcggcctcaacgatgtgctgttggaaaatggcaacgattttgatttgaacttacctctagatgagtttggcgcggttgtagagaaccaccgacgaaaagagatgacaaaagatatgaggaaacaagtgtaccaagcgttgttggctagaagcaataacgggagactccacaagaaagatacccaaattgttgccaaccaatttgatctccaccttcggtcagtgcagcgcgtatggaacagaggttaaatacaacttgcaaactcggtgccagttgtggttgctagtct

SEQ ID NO: 5809 - DNA, 263 bp, Zea mays
  Clone ID: LIB3279-054-P1-K1-A12
atttcatttgatctaaacgagctcgctttagatgagctagatgaagggggccagctgccggatgatgctaatgagctcggcctcaacgatgtgctcgttggaaaatggcaacgacatggactcgaacttacctatatatgcgtttggcgcggggtgagagtaccaccatcgaaatgagatgacaaatgatatgaggagacttgtgtatcaaagggcgatggctcgaagcaataacgcgagacttcacaagaaagttacccgag

SEQ ID NO: 5810 - DNA, 405 bp, Zea mays
  Clone ID: LIB3279-054-P1-K1-A2
cgccagcagggaccggtcctgactgggtggacccacgcatgcgtccacgcttccaggcaccccacgcacacgtcagcatcgggtgctgcgtgacccgtctacgtttatcgagaaggttctagaccccacaagcaggaggcgactctgctccttggtgcttcgtactcctcccacgtgtgtgcgctctgatgacccaatctgacaggccgttaatcttctgaacacaggagtcatgggctgccaccgctaggatcatgtgtgaccaatcgactgttgagatgagcgaaccttcgtatcatgatataggaactaatttgaacctttgccttgagcggaatgctttgagggctgcacatgctgttgccgacattccagcttaagcatcataaacactcactggggatg

SEQ ID NO: 5811 - DNA, 385 bp, Zea mays
  Clone ID: LIB3279-054-P1-K1-A3
cccacgcgtccgcccacgcgtccgcggacgcgtgggaaagtttataaacgcactcctccccttcccctgttccctctaccaccaccaccggcaccgcgggacagtctgctctcgtcccgccgcagcccgtccccgacccggaaccctagcgactgccattgcccacgcgccgctcgcccgatgaatggcgggggctctgggctggcgcccaacgccgcgcacaccgtggacgaggtcttccgcgactacaaaggccgccgcgccggcatgatcaaggccctcaccactgatgtggagaggttcttcaaactctgtgaccccgaaaaggagaacttgtgcctttatggctatcccgatgagacgtgggaggtgaccttgccagctg

SEQ ID NO: 5812 - DNA, 389 bp, Zea mays
  Clone ID: LIB3279-054-P1-K1-A4
attcccccagaccagcagcgtctgatctttgctggcaagcagctggaggatggtcgcaccctcgcggactacaacatccagaaggagagtacccttcaccttgttctccgcctcaggggtggtatgcagatctttgtgaagaccctgactggaaaaaccataaccctggaggttgagagctcggacaccatcgacaatgtgaaggcgaagatccaggacaaggagggcatccccccggaccagcagcgtctgatcttcgccggcaaacagctggaggatggccgcaccttagcagactacaacatccaaaaggagagcaccctccaccttgtgctccgtctccgtggtggtcagtaagtcatgggtcgtttaagctgccgatgtgcctg

SEQ ID NO: 5813 - DNA, 391 bp, Zea mays
  unsure (1)..(391): unsure at all n locations; Clone ID: LIB3279-054-P1-K1-A5
gncaancccccacctaagctaagctncttaggggggcngacccncaagggaaggaacgagatgccagatatctttccgtattccacaatgcttaaaaaactggacttgcagttcactttcctcaccactgaagaccactgtcagcttattgctaaatgccccaacctaagtgttctcgaggtgaggaatgtgattggggatagaggactagaagttgtcgctgctacatgcaagaagctacgaaggctcagaattgagcgtggcgactattatcctggccaagaagagcaaggaggagtttctcagataggtttgacaagccctaaccgttggctgccgcgaactagagtacatagctgcctatgtatctgatatcacaaatggggcgctg

SEQ ID NO: 5814 - DNA, 376 bp, Zea mays
  Clone ID: LIB3279-054-P1-K1-A6
ccctagcgcgcgccgccacacctgccgttgctaccgccccgtacctcgcttgctttcccgtcgccgaaatgacgaagcgcaccaagaaggctggaattgttggcaaatatggaaccaggtatggcgctagcttgcgtaagcaaatcaagaagatggaggtatctcagcactccaagtacttctgcgagttttgtgggaagtttgctgtgaagaggaaagcagttggaatttggggatgcaaggactgtgggaaggtcaaggctggcggtgcttacaccatgaacactgctagtgcagtcactgtcaggagcacgattcgtcgcttgagagagcagactgaagcatgatttagcttgctacatcagggttctcctag

SEQ ID NO: 5815 - DNA, 383 bp, Zea mays
  Clone ID: LIB3279-054-P1-K1-A7
gcattccagggtaatcattggttcgacgggctagggtgctttctcacccggggaacggaagcgaatccagacgatggagaagaagaaggtggcgataccgctggtgtgccacggccactcgcggccggtggtggacctcttctacagccccgtcacacccgatggctacttcctcatcagcgccagcaaggatacaaatccaatgcttcgtaatggtgagactggcgactggattgggacttttcaaggtcataaaggagctgtttggagctgttgccttgacaggaatgctctgagggctgcatctgcttctgctgacttttcagctaaagtatgggatgcacttactggggatgagctacattcatttgaacacaagcata

SEQ ID NO: 5816 - DNA, 385 bp, Zea mays
  Clone ID: LIB3279-054-P1-K1-A8
ctctcgcagacgcgtctaggtctagctagggtctggtctcgctgccccgccgcgcgcgcattcacaggcttctagacgttccgaggaggaggggaggtacccgccgccgcagccatggcgtcgaccaaggtccagcgtattatgacccagcccatcaacctcatcttccggttcctacagagcaaagcgcgcatccagatctggctattcgagcagaaggacctccggattgagggtcgcattatcggattcgatgagtacatgaacttggtcctcgaagacgctgaggaaatcaacgtcaagaaaaacactaggaaatcactgggccggatactcctcaaaggtgacaatataactttgatgatgaacagtggcaagtgaagat

SEQ ID NO: 5817 - DNA, 394 bp, Zea mays
  Clone ID: LIB3279-054-P1-K1-A9
cccacgcgtccgcccacgcgttcgcggacgcgtgggaaagtgtataaacgggactccagccctgaccctgttccctctaccaccaccaccggcaccgggggacattctactctcgtccctgcgcatgccgtccccgacccggaaccgtagggactgccatagcccaagcgccgctcgccctatgaatggcgggggctctgggctggcgcccaacgccgcgcacaccgcggacgaggtcttccgcgactacaaaagccgccgcgccggcatgatcaaggccctcaccactgatgtggagaggttcttcaaactctgtgaccccgaaaaggagaacttgtgcctttatggctatcccgatgagacgtgggaggtgaccttgccagctgaggaagtt

SEQ ID NO: 5818 - DNA, 231 bp, Zea mays
  Clone ID: LIB3279-054-P1-K1-B1
ccaactcattaggtctaccattgacagctactgtgctctgcgctataggcactggagccaagatcctctacattattatgtgtcgacggaatcaagggctccttaacagagccgtgattctgacagggatgatgaccaagaagaatgggaagcctaaccttaggaaaacagtgatgcctgctgctcctacgaggtagcccaggccatggtgctgaacggatgacgtctaca

SEQ ID NO: 5819 - DNA, 382 bp, Zea mays
  Clone ID: LIB3279-054-P1-K1-B10
catccacgagactagcagctagctctgtttccgctctgcgcggcgtcccggccgacgacgacacgatgcctctctcggcagcttcttccatcctcctcctcctccatgccctggtctccctcacccttctcctcggcgacatgacgagcacgacacctgccgccgctgtcccggccgcggtggacgtgaacacgacggcgttcaccatgcatgactctgctgcgtcggcgtctccccatggtgccgaaaaccttgagatgtactactgcttcctctgcacggagcgccacccgctgctgattcactactgccccatctactgggacgagtgccacctcaactgttgggatggtgacacgccgacctccatggacacggtgca

SEQ ID NO: 5820 - DNA, 387 bp, Zea mays
  Clone ID: LIB3279-054-P1-K1-B11
aatacatagcacttattctaaagtttgtcaaggatcatatgggagctctgctttttggtggaggaagaacttatgaaagttgaggaacaatcagtggagctggagatggattagaaggagagatgctgttgaaacaacagtcatttcttgatctcaatcattccatccaccttgccatccacctgttcgaaagggaatccatggtctaacctagggtcgcggatgagctcaccgagcagcaggcctggcagctcaacttcgaccttgattcggcctacaatgccttcttggctgcgctgcccgctgctggtctgtaaccgggcaaggatctaccagcttgatttttatttggttggttcagtctattatgcttttgacactggagca

SEQ ID NO: 5821 - DNA, 379 bp, Zea mays
  Clone ID: LIB3279-054-P1-K1-B12
ctcccttcgtgtgtggtggtctgctgatatgaagaatttggtttccctggctcactagaacactatcctttcagagaaacaggaacagttaagcttaaaatgcaaggtgcctgcagcggctgtccaagttcgtcagtcacattgaagtctgggatagaaaacatgcttatgcactatgtgcctgaggtgaaaggagtagaacaggagttcgatggtgatgaggaagctgaagtggctggatagatcgagagagtttttacaggttttgagggtcaacacagcctgatgttatagcaacttcgcacgtacggtattgccgatcctgatgtatgcaagaggcatgcttagatagcagaggcgtcaatagtctgaaataaca

SEQ ID NO: 5822 - DNA, 391 bp, Zea mays
  Clone ID: LIB3279-054-P1-K1-B2
cccacgcgtccgcttctcgcgcgataagcatcagctcatcacctgaagagagagcggcccggaggagggggagcaagcagcagccgtcggtggaagatgtcgtacctgctgccgcatctgcactcggggtgggcggtggaccaggccatcctcgccgaggaggagcgcctcgtcatcatccgcttcggccatgactgggacgagacctgcatgcagatggatgaagtgctagcagcagtagctgagaccataaagaactttgcggtcatctaccttgttgacatcacagaggtccctgatttcaacaccatgtatgagctgtacgacccttcgacagtgatgttcttcttccggaacaagcacattatgattgatctcgggactagaaaca

SEQ ID NO: 5823 - DNA, 387 bp, Zea mays
  Clone ID: LIB3279-054-P1-K1-B3
gcagacacaataatcaaaagtcatggctacaatgaatggcccaacacacgtgtatttgcaacgtgcaagggtgacaagaatatgagcactctaatgcaccacccttttggtaactgggctgatacagtgagtcgctatttcgcaagatcgtcgtggccctattgggaacggagatgctcttaatgaagtaggaggaccgaccaatccaactagcagcagcaggcggggagtggatgcgcctgctagaagagtgctagctccgcgcatacgctcgctcgacaaatgtgtgttgttaactattgtgtatagtgttataattactgtcctttattcctgatgtttgttttgtagttgaaactcacattgttttttcatttccatctcgat

SEQ ID NO: 5824 - DNA, 385 bp, Zea mays
  Clone ID: LIB3279-054-P1-K1-B4
gcaaacacaataatcaaaagtcatgggtccaatgaaaggcccaacacacggggatttgcaacgtgcaagggtgacatgaatatgagcactctaatgcaccacccttttggtaactgggctgatacagagagtcgctatttcaaacgatcgtcctggccttattgagaacggagatgctcttaatgaagtaggaggaccgaccaatccaactagcaccagcaggcggggagtggatgctgcctgctagaagagtgctagctccgcgcatacgctcgctcgacaaatgtgtgttgttaactattgtgtatagtgttataattacagtcctttattcctgatgtttgttgtgtagttgaaactaacattgatttttcatttccatctc

SEQ ID NO: 5825 - DNA, 392 bp, Zea mays
  Clone ID: LIB3279-054-P1-K1-B5
cttggtgtcaagggcaaaagaggagtgctgccgaattcaatcactaaattgcacctgcctaaggtgcacaaatctggtggagctgccattgatatgtggattaaggcaaaagagttagatacaaacacagattactacctcgaactcttgtctaaaggagttggtaaaccaaaggaagagcttgctgaatttcttaggggcccgaggtacttccgagcacaagaggctcttgattatggacttgccgatacgatcttacactcgctggatggttctttcaaaccaaaggacctgaccgcgcagctagccaaggcacaggcgatgcgccagtcaggcaagcgtgcagctgctggagctgggagatggtcaactccaaccgcacccaggtagag

SEQ ID NO: 5826 - DNA, 366 bp, Zea mays
  Clone ID: LIB3279-054-P1-K1-B6
gggacagggtcagtctgttctgcctccttcgcacccagatcagttgttgtgctcacatgctcctcctcctggtcatgcttcttcagatgatcaggacttcgccacagccttcaccgagtagttctttgcatcgcctccggggggtgatccctatagtgggtcgtgagatgttacttttccctttttagtgcttggtgtcaagaagggggagatgttcgcggagagctggagttgtttcacttggcgttcgttagttatctttatctttatctttttttttgttacgaacattgggcttgcaataagtatggcatgaactatatgtgatgcaatggatctttctgttatggttacagctagagatgt

SEQ ID NO: 5827 - DNA, 386 bp, Zea mays
  Clone ID: LIB3279-054-P1-K1-B7
caactctccggacatggatgcgtactttgatgctattgttcatatggatatgagcttgcattcaatggaagtagtaaatcggctcactactgcagtagttttaccaccaggatttgttcatgactatatctcaaactgtattcgatcatgtgaagacattaaggacaagtatatgcaaaatagactagtgagactagtatgtgtttttctacagagcctcattcggaacaggataatagatgtgcaagatctcttcgtggaggtgcaagcattttgcatcgccttctcgcgaataagggaggcagtggggttgttcaggctcctgaaatctctagaatgaagagcgctgcaccatcagttgggcgctggattctcagaacagaaat

SEQ ID NO: 5828 - DNA, 388 bp, Zea mays
  Clone ID: LIB3279-054-P1-K1-B8
cgcggacaagtcgcggctgcacgagacggtggacggggagtccggcatcgaggggagccgcaagctggagcactcggagcagctggcgtgcctcgacagggctgccgtggtgacggccgaggacggcgcggaggcgagcccgtggcgcctgtgctcggtgacgcaggtggaggagctcaagagcgtgatccggctgctgcccatctgggccagcgggatcgtgttcgcggcggtgtactcgcagatgagcaccatgttcgtgctgcagggtaacacgctggaccagagcatggggccccggttcaagatcccctcggcgacgctgtccatggtggacaccatcagcgtcatcgtctgggtccccgtgtacgaccgcgccatcgtgccc

SEQ ID NO: 5829 - DNA, 384 bp, Zea mays
  Clone ID: LIB3279-054-P1-K1-B9
ccatttcagagagctcgagctacgcagaggagagggctgccagggagaagcctcctaaggatgactctaatgtaatcaaccccacttccttggtagaggaaccgatagtgctccatacccctgatcagattgaacatggaaattctgtgccgtcaggaactaattcatcacagatggtgggtgcagcatcgcacccgccgccaccgtcagctccgccttcaaaatcattgttggggaatactgggttgtggagaatgggacctggaagttccaacagtgtgcggattggatctccaagaagaccggtagcttggccaccagtggcagctcggacatctgcttcaggttctcggccttcttcgcctaggtcactcgttgatggtg

SEQ ID NO: 5830 - DNA, 379 bp, Zea mays
  Clone ID: LIB3279-054-P1-K1-C1
cccaagtcatcgtctggtcgtcgcccgcagaggcgcagacgcccaaagccggaaggggcgccatggccgcgtcggatctggagagcaaggccaaggaggccttcgtcgacgacgacttcgagctggccaccgagctctacagccaggccatcgacgccgggcccgccaccgccgacctctatgccgaccgcgcccaggcgcacatcaagctcggcaactacactgaggctgtggcggatgctaacaaagcaattgagcttgatcctatgatgcataaagcttactaccggaaaggtgctgcatgcattaagcttgaagaataccaaactgcaaaggctgctcttgagttgggttcttcttatgcatcaggcgattcaag

SEQ ID NO: 5831 - DNA, 380 bp, Zea mays
  Clone ID: LIB3279-054-P1-K1-C10
cttgatgccaaagggggagaaaatcaaggccaaagcgataaatggatcagctaccacttgacagattttgaaaatagtagaatagagtttttgttttgtcaaaagcttttattgtctcttattgcctctattatcaaacgttgacttcttgtggggagaagtgttagcttatgggaactagggcgagcttttgaaatcttcgatcaatctctctgaaatgactctcgttatgctacaacatccgtgtttgaatatctagatcgagacttgagtctgcttagcactaacatacccactggtgccccaagatgatccatatatgcgccaattgcatctaactcagactcacttgttatttaccgagatattgcactgggtct

SEQ ID NO: 5832 - DNA, 386 bp, Zea mays
  Clone ID: LIB3279-054-P1-K1-C11
aaaaaccgtatcgtctggcctgttcagtttccttgtcttcccgcagccgggtttgccgaccaggttccaccgttccagagtagccaagcgaatcccgtgtctggttcgcgcgatggcggaagagcagtccaacccccagcaccagcatgcggaggagagggaggttatggtggagcagcagcagccgaggagggccctgaagctgaggtacctggacttcgtgcaggtggcggctgcccaggccgcggtgtgcctcgctgggctctacggcctcgccaaggaccacgccggcccgctccgccccagcgttgacgccgtcgagtctgacgtcaagggcgttggtagccccgtctacgaccgcttgagcggtctgtcgttcgacggtc

SEQ ID NO: 5833 - DNA, 346 bp, Zea mays
  Clone ID: LIB3279-054-P1-K1-C12
cggacgcgtgggttcgggagcagattgacacaaaggttgcagagtggagagaggaaggaaaagctgatattgtccctggtgttctgttcatcgatgaagtccacatgctagacatcgagtgcttctccttcctcaaccgcgcattggaaaacgacatggcgccgatcttagtaatcgcaacaaaccgagggatcacgtctatccgtgggacaaactaccgctcgccgcatgggatcccgccagacttccttgaccggctactgattatcacgacgcatccctacacggaggatgagatccggaagatcctggatatccggtgcgaccaggaaaacgtggagatgtc

SEQ ID NO: 5834 - DNA, 390 bp, Zea mays
  Clone ID: LIB3279-054-P1-K1-C2
cttctcctcccccaccggttcgtgttcaggttctggttcgtgggcgagagggaagagatggcggcgtcggacgttgagtaccgttgcttcgttggcggcctcgcctgggccaccgacgaccactccctcaacaacgccttcagcacctacggcgaggtcctcgagtcgaagatcatcctggatcgggagacgcagaggtcccgcggcttcggcttcgtcaccttctccacggaggacgcgatgcgcagcgccatcgagggcatgaacggcaaggagctcgacggccgcaacatcaccgttaacgaggcctcatcccgcggcggccgtggaggcggcggtggcggatacagtggcgggcgccgtgatggaggcggctactgcggtggcggt

SEQ ID NO: 5835 - DNA, 390 bp, Zea mays
  Clone ID: LIB3279-054-P1-K1-C3
gctttgatgatcatgaccttccattcggactgaaagaagtcatactatctgacgtcagactgttgacgctacttgagtatggccttccatcgtgggttatatttcttcagtcatatccggtgttttgcaagatatatcggccatggatgtgccctcttgccagagcattgtatgtcttgatgtcattaatcactgttcttataggattttatgacctctacaagaacgtgcccatgctgaaggcaactgcctcaagattgtttggccctttatttgattggatagaaacatgggaaatgatatcaagacttaagtatcttggaactatgcttttcctgcataattttcagcaggcttttacatggtcccttaagattgtgggtgctgcta

SEQ ID NO: 5836 - DNA, 342 bp, Zea mays
  unsure (1)..(342): unsure at all n locations; Clone ID: LIB3279-054-P1-K1-C7
cccacgcgtccgatcgtgccgcgtcacatccagctcgccgtgcgcaacgacgaggagctgaccaagctgcttggtggtgccaccatcgcgagcggcggcgttatgcccaacatccaccagcacctcctccccaagaaggctggctcgtccaaggcttccaccgtcgatgacgatgacaactgaagctgcccactggagaagaggcattcgctaccgtcttgtttcctaggtttagcacgcagttagtcagcatgtctttgagagctcgatgtgtttgggaatgacaatagctcctttcttggttccctaagatcgttgattcagatgtgaataaaanaaaaa

SEQ ID NO: 5837 - DNA, 384 bp, Zea mays
  Clone ID: LIB3279-054-P1-K1-C8
cccacgcgtccgaaccagcattttatttcacgtttcagtaacattttcatccaaaatattgcggaattgtcgaaggagttaaacctcccgttggataattcaccatttccaccaccaccaccaacaaatccagctgcagaaaatattgctggtataccaaaacctgtacaaaacaatcttcctgggatcttgggtgatgcaaagctgactgcatgggaattgtggcataagcaggagtactcattcctgaaaattgcttatttccgcagagcagtgccaataaaagagcaaacagttattgcgtacattcttgatgctgctcgagaaggatgtgagatggactggagtaggttttgcagggaagtagggctgacacctgatata

SEQ ID NO: 5838 - DNA, 365 bp, Zea mays
  Clone ID: LIB3279-054-P1-K1-C9
ctcatttgtcaccaccgccgtcgttacccacgttcgacaacactatgagggcgggcatttggagctacatcggccgggccaatcttcaggtcggatactcgagctgggagtctgcctgcatcaacaagagcaattaggcaaagttgtgctggcttgccaaaacatggactgaatagggttcctgaaatattgggtgatataaagctgactgcacggtaatggaccttccgctgctagtacgcatttgtgaaaagagtgtatgtccgtatagttgagcggatagaagcacaggcagtgattgcataccttatttatgcttgtacaaaaggatgtgtgaatgactgttataaggcttgtacataagt

SEQ ID NO: 5839 - DNA, 388 bp, Zea mays
  Clone ID: LIB3279-054-P1-K1-D10
gctagttatacttgttctcattcatgtgcattatgcatatcattcaggtgcgttaattgatcacgtgatgcggaggacaagagccgagttgatctcaaaatgatgctggtgaacgaacctaaggctagatgatctgattgagtgccagaatgggagatgctcaccaagtggtcgtcatctaacaacactaacttagtgttattccaggcaagccccggtgcatttgccacccccttgttgttataaaacttttatcacttatatgttgcattaggtgataggagttgtgtgaataaacagttgatgcattaccattccttggaatttgaatactattccttgattactgtttataaaaagagaactaaagatgcttagtcctgcttaa

SEQ ID NO: 5840 - DNA, 387 bp, Zea mays
  Clone ID: LIB3279-054-P1-K1-D11
cccacgcgtccgccagcattgagcccaaatgaagaagacattcctcatggttttatttttgctacattcatgctgtcatccatgttgggtagctccgttgcgtcacgtctattagcccgaaagctcaaggttgaaggttacatgcagattgtattctcgatatcggctgtcacccttgtcctccctgttgtcaccaacatcctagtgcccacatcttctgtgaaaggaggcagcatatcgattggaggttctcttcagcttcttggtttctgcaccttcgaggcctgtgttggcatattctggccatcaatcatgaagatgaggtctcagtacattcctgaggaagcaagaagcacaatcatgaatttcttccgcatccctctcaac

SEQ ID NO: 5841 - DNA, 318 bp, Zea mays
  Clone ID: LIB3279-054-P1-K1-D12
ccaccacgtactgccacgtcgaggtttaattaagagcgagaggaagcagggaccatggctacctgtctagctgctgctcctgccgtggcctggtgtggtaataactgtctctatctctctctctctctctgtccacggctggcgctactactgcagtagtgcagtgatgcgggatgtaaaggaggggtaaaaaaaattcctttcgttctaaccccttgtgttttttgcatcttcttcttcaccttagcatatactactattattctctgtcgactgttgttcaaaggaagcttccaattgtcaatatacattgtggat

SEQ ID NO: 5842 - DNA, 389 bp, Zea mays
  Clone ID: LIB3279-054-P1-K1-D2
ctacccctacgggtccagtggccactgcctcttgccgcaggcagccctcttctctctcttccgccgtctcgcctcctcacgccattaaaccccacccgcgcgcgcggcggccggcggcgagccctcacccatccgagcaagccgaggaggaagcgagcgcgcgaaagtatcaggaggaggcatgggtaccctggggcgcgcgatcttcacggtgggcaagtggatccggggcacggggcaggccatggaccgcctcggatccaccatccagggcggcctccgcgtcgaggaacaggtttcaaggcatcgtacaatcatgaatatttttgagaaagagccaaggatccatagagatgtgtttgttgctcccagtgcagcagtcattgggg

SEQ ID NO: 5843 - DNA, 391 bp, Zea mays
  Clone ID: LIB3279-054-P1-K1-D3
gtcaccaacgcacccagcacagacagaagaccctcgccggacgctcgctgtcgccggggacaactcaatcacgaggccaggatggcccgctacgatcgcgcgatcaccgtgttctcacccgacggccacctcttccaggtcgagtacgccctcgaggccgtccgcaagggcaacgccgctgtcggcgtccgcggcgtcgacaccgtcgtcctcggcgtcgagaagaagtccacccccaagctccaggactccaggtccgtgcgcaagatcgcgagcctggacacccacatcgcgctggcgtgcgcggggctcaaggccgacacgcgcgtgctcatcaaccgcgctcgcgtggagtgccagagccaccgcctcacagtcgaggaccccgtca

SEQ ID NO: 5844 - DNA, 246 bp, Zea mays
  Clone ID: LIB3279-054-P1-K1-D5
tcgcccacgcgttcgcggacgcgtgggtggtggctcagcatggcgttttctgcgtgggggttctttgtgtaagtcaatgttgtcttaagatcctattttgtttgaattgctgactgtcgtattttttttgctatctttgaacgccttaaccgttccactaagagcatgtttggatgagttaggttttagttactagttgagctaaggctatctccaggacattttctatttcaaacttttctctgc

SEQ ID NO: 5845 - DNA, 387 bp, Zea mays
  Clone ID: LIB3279-054-P1-K1-D6
cgagcacttgcgggcactcatgagtggatgcccgagccgcccttttctgatctctttcgtgaccgattggatcgattcctgataggcacccaaggccgagaagaatcccgcgtgagaagaagccttctgaggagaaggccgagaagaagccaagggcggagaagcgcgtgccgagcaaggagggctgcgtgactaagggaacgaagactgctatgaagagcgtctagtcttacaagatctacattttcaaggagctcaagcaagtgcacccggtcattggcatctaagccaaggccatgttcattatgaactccttgatcaacgacatcttcgagaagctcgccttcgaggccgcgaagctcgcccgctacaacaaggagcccacca

SEQ ID NO: 5846 - DNA, 385 bp, Zea mays
  Clone ID: LIB3279-054-P1-K1-D7
tgtagttgcaccaattacaatttctgaatattctctactcttgtaggtcactaatgatattgctaatgctctaatggagaataggaactgtatcacattagatgtttgcgcttctctcttacgtcttaccaccagtcttcttgaaagcacatatgacaggtcatttctcatatttcctattaatttatcaatattgaaattgtgagatcatttaaatttgaccttgctattgaacattggctgattattttgattaaaagctgacttaatgctcttttggagagttggaactcgcaatgggaattgaatctgattataatgcccctttcttcaaaaagagatggaattctgaatacgcagatatgaaatattgttcatggtccag

SEQ ID NO: 5847 - DNA, 387 bp, Zea mays
  Clone ID: LIB3279-054-P1-K1-E1
cccacgcgtccggttcgaggcgttcccctcctccacgcaaccttctcccctccagatccaggattgccgggctccctgactcgttaccttgcgcgccctcggtgagctactttgtttcgatttagcgacaaatcagtttgcttcatgttgcgcaggcttagatctgaatgccggattcttcgtcttacggcttgaatcgagctgggaggccgtggatctgagcacgggagatacaacaaatccgcgtgtatgacgagttggatcggcaccggttagtctctgaccgcaagattttgttgttgagttgggctgatctgccgcgttgttttgcttcaggttctagagctagcgaaatcgcaaggctattagggttccgttcggagcgcg

SEQ ID NO: 5848 - DNA, 382 bp, Zea mays
  Clone ID: LIB3279-054-P1-K1-E10
gttatgtactccttccaacggttgtcctctaaccaataatattttttcacctaatgaatattgagcttttattttctttaccccaaaacaaaattatgctagttctgagattttagagtaaactaaaattgagtgttgcgattagactatgtccataggcatgagaattacaaaatatatatgtccttacttattgttggttatttctttgtgctaatgactacactgttgaagttattgttctcgtgaggaattatttgtgaaagtctccaattttctgtacaacgttgatatgattcatgtcggcgttgtggagcatgctcatatgcgtgaaagagaagatcatgtactcatgcttcgacgcgaacgcgaggcatgaaac

SEQ ID NO: 5849 - DNA, 385 bp, Zea mays
  Clone ID: LIB3279-054-P1-K1-E11
tcaatttcgaatctccccttcccctcagtctctcacacgcacgctcctgccctacgcagcaaaaccctaaccctagctgcggacgccgtcgccgcctccgcgcccaaccgatgtctgattctgaggcgtccccaccgtccactccggccgtcgcaacgcccgcagcgctggtggagacctccccgtcctcggcgaggaaggaagaactgctgcctgaggaggaaaagatctcggaattaagtgaatcacaatcagagcttctagggaggctccgtgggcttaaggaggatttgctgagttggaggagtaatttagactcccaagtgacgaaatacaaagtggaactctctgacatcaagagtgcactcaataatgaaatagagca

SEQ ID NO: 5850 - DNA, 369 bp, Zea mays
  Clone ID: LIB3279-054-P1-K1-E12
cccacgcgtccgcccacgcgtccggggcaaggccaacgcctccaagaaggatgagggcaggctccgggccggcggcggcggcgccggaaagcgcaagaaggccgccgcgagcggcaagcccaagcgccctccctccgccttcttcgtcttcatgtctgaattcaggcaggagtaccaggcgcagcaccctagcaacaagagcgttgcggccgtgagcaaggcaacaagggaaaagtggcgctctatgtcagagcaagagaagcaaccctatgtggaccaagctgggcagaagaagcatgactatgagaagactaaggcaaatattgagaaggagagcacaagctcaaagaaggctaagactgatgacta

SEQ ID NO: 5851 - DNA, 384 bp, Zea mays
  Clone ID: LIB3279-054-P1-K1-E2
gaggtattttgcacatctttttgagtttgaggagccaagtagctattttgaagttgaggctccatttaacaagcttcttctggagataaggtggcttgagaccttggattatcttgttaggagcctatccctgcatggaaaataaggtggaatccttttcgaataaagaggaaagttatctttccacctcatccatgtgtcctaccctcaattttttttgcttttgtttgctttttcaaataaatctggtgccagcaatcactaatcagttccctctatgtgctaaacttgatagtctttagttatgcactcataagtgttaatgacacacaaatcatgtgaattttgtaatcaaaccaagtgctagttagcaagccatacagt

SEQ ID NO: 5852 - DNA, 387 bp, Zea mays
  Clone ID: LIB3279-054-P1-K1-E3
cccacgcgtccgaagacatttcatggcaactcactcccactcccacacaagcacaacataaacataacgatcgctcggtcgtttattcaatcgttcgtctaactattcatattttgttcgttcattcgtctgatcgttcatccaattcaaattttggaatattctaggaatattcattttttcttttctttttctaattcctatgattgtaaaatccaaaactccttcgtccagactctgattttgacagttctgattttaaaattcttatcaaattaccctctgtctaaccataccatcccgtaagcatgattcataacccagaaaactctagaaatactcttatcccatatttttgaaagggaaatgtgcccttggaccatttgt

SEQ ID NO: 5853 - DNA, 355 bp, Zea mays
  Clone ID: LIB3279-054-P1-K1-E4
gctaccgccgggcgcagcacacacggtgcctgcgccgcagaccctctctcggacgcatgagaactcgcacggcgctgctcaccatgactgcgctcacgagggcgcacatgtctagtactactgaccgactagggcatctgattcagcatagagcacaactctaggcacttcgtaaggataaacactgtgtcatgttcacgttggaaagacaacgatggctaaatgcaaaaaagaatgccacagacaaggttcaagactgcaggtgcttgcacaaaatcatgagcatgacaactcacataaccctaccatgcgcggagcttaaggcctacccgagcgtactcaagaaatgctctta

SEQ ID NO: 5854 - DNA, 392 bp, Zea mays
  Clone ID: LIB3279-054-P1-K1-E6
cccatgcgtccgcccacgcgtccgataaaaaatttgcatttgggtggagcccaagtcttccacagcctcttccacggttcaaaagtaatcgaacccaagaaaaaagccttataacatgatttagaagagaactgtccagaggaagaatgaattctgagttgcatgtggcccttttcctgagctctgtaaagaactacaacatcaacaagagctggcagaactaagatgactgttcccgtcgctccttcatttgtgtgtgctaaccgtgctgacaagaggaaggaggtgtatatagttttcttgcattatttctagatggttgcttaattcattctgattattcacaactagcaagcagccaagcacttttgttccaaaaagggtctggtagt

SEQ ID NO: 5855 - DNA, 376 bp, Zea mays
  Clone ID: LIB3279-054-P1-K1-E7
cccacgcgtccgtgacatgagcccttttctatagataaataaatgttagctgccttttttattttctttttttaatatctccctcttacattttctccatataggtaatgtatgatgcatcaggaattagatggcacacaggccgccaagctgcgttgttaaatcaaatagtctgtgaattcccagcagaacatccaatcatttcaacctttaggccactacgggaacctcttggacacagcccacttcaggtttttgcaggagcacttgttggctgtgcagtcgcttatttcatgggaaagtctgtatgaggaatgagctaggatttgcattgtacacgaatcctattgaccttaatatataaatcttcttgtgt

SEQ ID NO: 5856 - DNA, 384 bp, Zea mays
  Clone ID: LIB3279-054-P1-K1-E8
gcctgacaattttctcatgggtctcgggaaaagagcaaaccaggtttatgttatcgattttggacttgcaaagaagtacagagatacatcaacacaccagcacattccatacagagagaacaagaacttgactggaacagcaagatatgcaagtgtaaatacccaccttggaattgaacaaagccggagggatgacatggaatctcttggatatgtactgatgtacttcttgcgaggaagccttccatggcagggcctgaaagctgggaacaaaaaacaaaagtatgaaaagatcagcgaaaggaaaattgctacttcaactgaggctctctgccgtggatatcctaccgaatttgcttcttacttccattactgtcgctcact

SEQ ID NO: 5857 - DNA, 356 bp, Zea mays
  Clone ID: LIB3279-054-P1-K1-E9
gcctgacaattttctcatgggtctcgggaaaagagcaaaccagggggaggttatcgattttggacttgcaaagaagtacagagatacatcaacacaccagcacattccatacagagagaacaagaacttgactggaacagcaagatatgcaagtgtaaatacccaccttggaattgaacaaagccggagggatgacatggaatctcttggatatgtactgatgtacttcttgcgaggaagccttccatggcagggcctgaaagctgggaacaaaaaacagaagtttgaaaagatcagcgaaaggaaaattgctacttcaactgaggctctttgccggggatatcctaccgaatttg

SEQ ID NO: 5858 - DNA, 388 bp, Zea mays
  Clone ID: LIB3279-054-P1-K1-F1
ggcgtctggcagggagcgcggtgccgagccaagaaaatagataggggagagagaaggaggtgccgccatcgctgggctctggggaggggcatcgtgggagattatcggacttcatgtggtatgggcgcatcgtttgtaggcgattgggagcaccagggggattggaattcgtcgtcggggcctcttcatccctgcagaaccaccatgcgccagcgaggctgggcgacgggagctggaagatgaatggtggccctcgatcctgatttggacggatacagctgcgacacgcttaccttgtgccacaaccataagtcttgatccctcggtcccgtcatcatatcggttcgcggtctaatctggactcttgattcttcatcggacgtccggg

SEQ ID NO: 5859 - DNA, 343 bp, Zea mays
  Clone ID: LIB3279-054-P1-K1-F10
gacctggagaaggaaaagacggtggtatctctgagaactttgatcgatcgctctgcggtggagagcttcggtggaggcggcagggtgtgcatcatggcccgggtctatccggcggcgctcgtcgacgacggcggcactcgcatgtacgcgttcaacaatggcactagcaccgtcagagtgccccggctagaagcgtggagcatgaggagggcacaggttaacaagggatgaggaggaacacaaggccatttgatagctagaggagaggaacagagcatgggcacatgaattaaacacacactgctggtttaatttgctggaattaatcaatcaatcaatcaac

SEQ ID NO: 5860 - DNA, 386 bp, Zea mays
  Clone ID: LIB3279-054-P1-K1-F11
cccacgcgtacggattaatcgatggagaattccttgacaaggttgacagggttggacttagccaggcatattttaaaacaaaggtgttgcttaatgaaaactgtctaaagagaagcacacacattgtattttatactatagattgcaaggattcatgtggtgaaatatttgttgacttacagaagcatagctatgttcagaaaaagcctggacgagcaactgaacaacaggagttgacatattctactcttcatgaagctatctctgggccttggaatagtctaccgaagaagaccgtcactttatactttgctatgagagttctagaggattatgaattatctgaagggcgcacacctggcgaaacaacactttctgacatagat

SEQ ID NO: 5861 - DNA, 390 bp, Zea mays
  Clone ID: LIB3279-054-P1-K1-F12
ctttatctctggggctaagcttcaattcgacattcgcccattcttcagtattaatgtcgttgccgccgagtacaatagtgattccccggtgcatccacaccaaggatttcatcaccaccagccccatcaacgattacaatggtgaagagtttgtcttctactctacaaggaagtaccgtgccaaaaaaactcaataatagagtatcacagcaaccaaaatggctaattgttgccactagagagaatgtatagcctattatgtctggcacttagtgaatcgatagctttaagggcaagttatgcactcgagtgactacaatagggaagggaggccttccaaggcaagaaagtgctcgttgtcggttgagataacacctttccaaaaataat

SEQ ID NO: 5862 - DNA, 360 bp, Zea mays
  Clone ID: LIB3279-054-P1-K1-F2
agcgcttgaggagatcgacggagaggaagctaagctgaagaaggccagcgaaggatctgatatgacgatgagccattgattagatttattgcagattaaatctgcctccagcatgattctgttcctagttatgcgctgcggagagagctcatctcatcagggtatttatgagattctagcttcgtatattgtttttcttcttcttgattgaactgagatcaaataagacaaagctgctgtgccttgttgtgtgccatctgtgtatgaacttttcggttcagcctccagcagtctttaatctgaaagaaagacgaggtaggaattctctccctcagggtaaaaacatcaaaaaaaaactca

SEQ ID NO: 5863 - DNA, 383 bp, Zea mays
  Clone ID: LIB3279-054-P1-K1-F3
gcggggttaacaccttctcgccggaggggcggctgttccaggtcgagtacgccatcgaggccatcaagttgggatccactgcgatcgggttgaaaacaaaggatggtgttgtccttgctgttgagaaacgtgtgacctcgccactgctggaaccaagcagtgtggaaaaaatcatggaaattgatgagcacataggctgtgccatgagtgggcttattgctgatgctagaacactagtcgagcatgctcgtgttgaaactcacaatcataggttctcatacggggagccaatgaccgtataatcttcgacacaagctatctgtgacttagctctgcgctttggcgaaggtgacgaagagtcaatgtcacggccatttggagtc

SEQ ID NO: 5864 - DNA, 365 bp, Zea mays
  Clone ID: LIB3279-054-P1-K1-F4
gggagaacttcaatgagagagttctgccttcaatcattcatgaaacactcaaagctgtggttgctcaatacaatgccagccagctgatcacccagagagaggctgtgagcagggagattaggaagattctgactgagagggccaacaacttcaatattgctctggatgatgtgtccatcacaagcctcagctttggaaaagagtttactcatgccattgaagccaagcaggttgctgcacaagaagctgagcgtgccaagttcattgttgagaaggctgagcaggacaagcgcagtgcagttatcagggcacagggtgaggctaagagcgctgagttgattggccaagccattgccaacaacccc

SEQ ID NO: 5865 - DNA, 244 bp, Zea mays
  Clone ID: LIB3279-054-P1-K1-F5
aactggatgtcaaacatagtgtggtgtttaaactgactagtgagacagggcaggacattctagcttagctcagtgccctcctacaaatcacctacagaaaggctctgatccataggatcaagcactttctgactggtggggcccacaacttttatgttaagtctgatgaagcgttgattacatgccttacctttttaaaggagtttatgcacgccattgaatccaaatcagttggtgtacaaaa

SEQ ID NO: 5866 - DNA, 392 bp, Zea mays
  Clone ID: LIB3279-054-P1-K1-F6
cccacgcgtccgcccacgcgtccgcggacgcgtgggctcgggcggtggttgcggaaacacgactcaccggcgccttcttcctcccatcgcccccttcctccgcgcccgcttcttgtctgccccgactacctcttcaccgccttcttcgtcttcagctgcctgccacgaggaggatgcggaggacagagacctccccgagatctccaatggtgatgcaggtgcccggctcagcatctccgtcgaccgctccgggctctacaaccccacaggtgttgttgtgtcaaaatgcggcagagcactcgcacgagccgtcgtcggaatccgagctcgtcaagcacatcaagagcatcataaagtttcggagtgggccaatcagcatagctgaatacatg

SEQ ID NO: 5867 - DNA, 386 bp, Zea mays
  Clone ID: LIB3279-054-P1-K1-F7
cggacgcgtgggcggacgcgtgggcttgctcgagggtttagctagcttggaagccctccgcaaactcccatggcgtgcctcctcgtgctcgtcatcgctgccacagtactaacgggtccaccgggaaaactgacgcacgccgctcggacgtcgccggcggaggccttctggcatgcggccctccccggcgctcccatgcccgaggccatccgcgagctcgtgcgcccagctggtgctgccgggaccaacgctccagacgccgctaggtccaggcaccacgacgccgatccgccgccgatgaacttcaagtacgaagactacaggtcctcgcgtcggaacgaagccaccgtcaccttcgtcgaggccctggaccgcgctggcggcgc

SEQ ID NO: 5868 - DNA, 388 bp, Zea mays
  Clone ID: LIB3279-054-P1-K1-F8
gcaggcaaagtgctgaagaaaggaaaaaagaagcaggccaaggacgagctggaccgccagaagcaggcggagaacaagcggcgccgacttgagaaagcgctggccaactcggctgccataatctcggagctggaaaagaagaagcagcacaagaaggaagaacagcaaaggctggactaggaaggtgctgccatagcataagcaagcgctcttcatgtcctcataggcgaggactcccatgaaccctgccatttgatgctgaacaagcaccatataaggtgcaaccatagggccccctcggctgcttttgaattcaccgaggacgcacagcccgtcgaggtgtacccgtctgaggatggactggtttgcggcagccatgcgtatgctc

SEQ ID NO: 5869 - DNA, 387 bp, Zea mays
  Clone ID: LIB3279-054-P1-K1-F9
gctcctcgagcgttgtctctctctctctgtctctctctctctcgtgcccctctcgctctcagacgaccggtgggccgccgccgccgccctaagccaggtgctgaggctcttgttggtctcttcgccagcgaggagcacccagcaggacaaggcaacaggctgttggaatatggaccaacaaggcatgcatgaccatgaaggggtccacgttgttggatttgaagtcccgccttcaccggattccagctacgacaaccctgttcctgggaatgaaaacgaaggccgggagcccccactgatgccacctgatctgcagcacacgctgctgagcttcccaccaagccaagacgagtcgagcccgctgtcccagccccagaccgtggttct

SEQ ID NO: 5870 - DNA, 390 bp, Zea mays
  Clone ID: LIB3279-054-P1-K1-G1
caaatatgtacccctcttctgctttattaggacagaacaaggatgagtctattgctgctttaccagttgatgatctcattgagaaagccgatggttttgctggtgtattccctgaacataagtatgagatcgtgaaacgtctacaagcacggaagcatatctgtggaatgactggggatggagtaaatgatgctccagccctgaagaaagcggatatcggtattgctgttgccgatgcaactgatgcagccaggagtgcttcagatattgtcctcacagaacctggacttagtgtgatcattagtgctgtgcttactagtcgtgcaattttccagcgtatgaagaattacacgatctatgctgtctctatcaccattcgtattgtgcttg

SEQ ID NO: 5871 - DNA, 361 bp, Zea mays
  Clone ID: LIB3279-054-P1-K1-G10
gccacgcgtgcgaaacacctctgggaccgtgagaaccaccagggaggtgctgctgttgcgtgcatgccgagcaagcagcgcgcaaagagaagaaccatcgctctgggcggctgctgcgatgccggcatggcagtggcgtgtgtgcagctgcccctgtgcggtggaggggaatctgcatgagcactgtcagcccggagccgccagcatagcatctgggcgtatcggagctcttgctttctcgtcggaatcgggcagtacacgtgtcgcgcatggccgcagatatatagccctgcacggtgcaattggtggttagtagctccctatcgtacccgacatatgcttcgttttgtttgtgcatcgc

SEQ ID NO: 5872 - DNA, 245 bp, Zea mays
  Clone ID: LIB3279-054-P1-K1-G11
cgaacccgtagtcgccgccgtcaaaccacaccgcgcttctttttggcggggagcgggcaacgattttgatcggcggtcctcagacctcatcccaacccggcccggggtggaaaaaaccaaactggcggtggcggttccgcttcccctggggcaccgggagggttttggggcgcggccgtggcagtggctgaagaccgtcttcttcatcgtggcgatgctggcgtccctgttagtcgtgggccccc

SEQ ID NO: 5873 - DNA, 345 bp, Zea mays
  Clone ID: LIB3279-054-P1-K1-G2
cccacgcgtccgcaaaccctcgccgactcagatccagcttcctcgcaccgccgtggccatgccgttcactccaggcccctactctggcgtcagcaccctagcccttgtggcgagggcgtcggcctttggcgtcggtgtcgtctacgggagcatcaagctctcaatcctgaaggtaacaaaacctaaaaaggaggaagtgcatgatcatcactaatgatgacagggctgctacatgttaatttccatatatgcaaggatgttatcaaattggcagtgcaccccttctacatacgtgcaatgtcgtttatgatttgtggacctgtctgtaacatacctagttttttt

SEQ ID NO: 5874 - DNA, 175 bp, Zea mays
  Clone ID: LIB3279-054-P1-K1-G3
cgagtcgagactcgagaggcacctgatctttccttcccgtcttcctcccacacgtgcccatcaccattgctgcgactagagtgagcgggagagggtaggtggcgaggcggcagtgatggggcgggggccggtgcagttgcgccggatcgagaacaagatcaacctgcaggtgacc

SEQ ID NO: 5875 - DNA, 380 bp, Zea mays
  Clone ID: LIB3279-054-P1-K1-G4
cccacgcgtccgcagcaatccctagcagaagccttccatcctcactcgctcgatggcccgcacgaagcagacggcgaggaagtccaccggcggcaaggcgccgaggaagcagttggcgactaaggcggcccgcaagtctgcccctgcgaccggcggagttaagaagccccaccgcttccgccccggtaccgtcgcgctccgggagatccgcaagtaccagaagagcacggagctgctgatccgcaagctgccgttccagcgcctggtgcgggagatcgcgcaggacttcaagaccgacctacgcttccagagctccgctgtctccgcgctgcaagaggcggctgaggcctaccttgtcggtctcttcgaggacaccaacc

SEQ ID NO: 5876 - DNA, 299 bp, Zea mays
  Clone ID: LIB3279-054-P1-K1-G5
cgcacgcgtaggcaacacctttaaaacacagcgaactcctatgtagggggtagcggtcagtgaatttgatgggaggtgctcagacctcatacaaccctggctctggatggataatacaaagctggcgttgcagttaccgctacccctggtgcactgagagggtgtggggactctgcctgagcagtggctgacgaccgccttcttcatccaggcgaggctgccgacctttttttttgtgggcgcaaccgcgctgttcaagtttctcttatacccgcagatatagaccccggtacttttca

SEQ ID NO: 5877 - DNA, 386 bp, Zea mays
  Clone ID: LIB3279-054-P1-K1-G6
ttgaactttgcgtttaaggactacttcaagaggctgttcaacttcaagaaggacagggatggttactggaagtggtttgctggcaacctggcctctggtggtgctgctggagcttcctctttgttttttgagtactccctggattatgcgaggacaaggttggccaatgatgccaaggctgccaagggaggaggcgatagacaattcaatggtcttgtggatgtctaccgcaagacactcaaatctgatggtattgctgggctttaccgtggatttaacatatcttgtgttggaattattgattatcgaggcctgtatttcggactttacgattctatcaagccagttgttctcactggcagcctccaggacaacttctttgccag

SEQ ID NO: 5878 - DNA, 104 bp, Zea mays
  Clone ID: LIB3279-054-P1-K1-G7
cctacgcgtacgctgccgcttgttgagcactatgaacttccaaaggccgttttttttattgatctgccagctccacagtcatagccatggacgggagcggatca

SEQ ID NO: 5879 - DNA, 381 bp, Zea mays
  Clone ID: LIB3279-054-P1-K1-G8
gtgtatcagaggatccttaccagtgccggtgtgacaatgattgaaggggcaggcagtctagttgatgctcatactgttgaagttagccagcccgatggttcaaagcaaaggtataccgcgaagcacattttgatcgcgactggtagccgtgctcaacgtgtcaacatacctggaaaggatctggctattacttctgatgaggccttgagcttggaggagcttccaaagcgcgctgtaatcctgggtggcggatatattgctgttgaatttgcttctatctggagggggatgggtgctgaagtagatttgttttatcgaaaagatcttcctttaagaggttttgatgatgagatgagagctattgttgcaagcaaccttgag

SEQ ID NO: 5880 - DNA, 387 bp, Zea mays
  Clone ID: LIB3279-054-P1-K1-G9
gccctgcctgtagctgagacgaaggcagatgctcctccggcagatgcagaaaagggggctgaaaattcaggccagccgaataccggccctcaagaaccgaaagcagcaaactgcgacgaggggcagattcaacctggtgcctctgctgtgaggtgcacataagggagcttgatctcagatgggactctgttgcgttatgtctttaggacgatacctcgcatttgctttgataattgtaatcgtggttaacctgacagcgctgtgtagcactaggctgcccagcacgtagttatcctttcgtttttttataacggtggtgttgctgcatgggtaatgggccggcctgtgctgcctcggccaccactgcatacccagtgtaagtgtaac

SEQ ID NO: 5881 - DNA, 155 bp, Zea mays
  Clone ID: LIB3279-054-P1-K1-H1
gccattcgtcagggtcctcggtgcctacccaagaaaacatatatctgagagagagagacatgccagcatcgctgctctctggggaagcgcatgctccgaaaatatgctactttatgtctattgggcgcatcattagctggcaatatggagcacta

SEQ ID NO: 5882 - DNA, 389 bp, Zea mays
  Clone ID: LIB3279-054-P1-K1-H10
ctactacgtcatcaccgactgactttaaactagcccactagctaggccggccctgccttgctcttgctgaaagtcgcggcatgtgaatccatagtttgcgagtccaatcaggcgtgccccccaattatttaagagatgagacagggggggaggggactgactgatggacagcgagcgctagctacctagccttgtgtctggagagctgcatccggcgtccattagcctacctgaagggtcttcagaaaaggcagaactcaaaacagcaaagatccctgacgacgattcagctgctatgactgatgaagttggctcatgtgctggtaactaaagagtttgcctcagggccgttcgtcagtcgtcacggcttcgactttagccttggtatt

SEQ ID NO: 5883 - DNA, 241 bp, Zea mays
  Clone ID: LIB3279-054-P1-K1-H11
tagaagatccaggctacggagtacatacacacttaactgtgagcaccgccgcatggtgacgaatgcgctccacatctctctcgcagctgtagatctcacagagaccggtatcacactgacctggacggacattgacaagagacctaccatgccttcagatagatgaacaggacccatcttgccatcactcccatgagtgattttcacaaatatgatatcgcaaacggtgactacttgatga

SEQ ID NO: 5884 - DNA, 382 bp, Zea mays
  Clone ID: LIB3279-054-P1-K1-H12
ctttggatgaggaaagcattaaggttaccatggatgattttgtgaatgcactttatgaaattacccctgcatttggtgctttcaccgatgatctcgaaagatgcagattgcgcggtattgttgattgtggcaaggcacataaacacatttatcaaagagctatgctcctcgtagagcaagttaaagttagcaaaggtagcccactcgtgacttgcctattggaaggtcctgctggaagtgggaaaacggctatggcagcaagtgttggcattgacagtgattttgcatatgtgaaaattatatcagcagaaactatgattggtttcagtgaaagcagcaaatgcgcacagatttgcaaggtttttgaggacgcatacaagtc

SEQ ID NO: 5885 - DNA, 390 bp, Zea mays
  Clone ID: LIB3279-054-P1-K1-H2
gacgacgacacgatgcctctctcggcagcttcttccatcctcctcctcctccatgccctggtctccctcacccttctcctcggcgacatgacgagcacgacacctgccgccgctgtcccggccgcggtggacgtgaacacgacggcgttcaccatgcatgactctgctgcgtcggcgtctccccatggtgccgaaaaccttgagatgtactactgcttcctctgcacggagcgccacccgctgctgattcactactgccccatctactgggacgagtgccacctcaactgttgggatggtgacacgccgacctccatggacacggtgcagggcaaggagtgctacgtcatgaagctgtacatgtccggtcgctacgtcatcgtccaacgc

SEQ ID NO: 5886 - DNA, 389 bp, Zea mays
  Clone ID: LIB3279-054-P1-K1-H3
ttttaggctgcttaagaagttgggttctggtgatataggaagtgtgtatctctctgaactgagtggtacacggagttactttgcaatgaaggtaatggataagacttctttggcgagtcggaagaagctgcttcgagctcagaccgagcgggagatcctacagtccctggaccatccatttctaccaaccctgtacactcattttgagacagacaagttttcatgcttagttatggaattctgccctggaggtgaccttcatactcttcgtcaaaggcaacctggaaaatatttctcagagcaagcagcaaagttctatgtagcagaggtactccttgcattggaatacctgcatatgcttgggattatataccgtgatcttaaaccag

SEQ ID NO: 5887 - DNA, 391 bp, Zea mays
  Clone ID: LIB3279-054-P1-K1-H4
tcccgccgcgccgcctcaccgtcgtcggagaagatgggtcgcgtgatccgcgcgcagcgtaagggtgcggggtccgtgttcaagtcccacacccaccaccgcaagggccccgcccgcttccgctccctcgacttcggcgagcgcaacgggtacctcaagggcgtcgtcaccgacgtcatccacgaccccggccgtggcgcgccgctcgccaaggtcactttccgccacccattcaggtacaagcaccagaaggagctctttgtcgcagccgagggcatgtacacgggccagttcgtctactgcggtcgccgcgccaccctcttcatcggcaacgtgctgcccctccgcgggatccctgagggtgccgttttctgcaacgtctagcaccacg

SEQ ID NO: 5888 - DNA, 322 bp, Zea mays
  Clone ID: LIB3279-054-P1-K1-H6
aattaactgcgaaattgggggcttccaccgatgatctcgaaagatgcagattgcgcggttttgttgattgtggcaaggcacataagcacatttatcaaagagctatgctcctcgtagagcaagttaaagttagcaaaggtagcccactcgtgacttgcctattggaaggtcctgctggaagtgggaaaacggctgtggccgcaagtgttggcattgacagtgattttgcatatgtgaaaattatatcatcagaaacaatgattgggttcagagaaagcaggaaatgcgcacagattagcaaggtttttgaggacacatacaa

SEQ ID NO: 5889 - DNA, 377 bp, Zea mays
  Clone ID: LIB3279-054-P1-K1-H7
ccgcgacgctctctctctttcgccgagctcctcgaaaccctaggagcgtgcttgaccggcggcggcgaggtgatggcgatggaccctgacgcggtagcgaaggccttcgtggagcattactaccgaacgttcgacaccaaccgcgcggcgctggttgggctgtaccaggagacctccatgctcaccttcgagggccagaagttccagggcccgtccgccattgccggcaagctcggatctctccctttccaggcctgcgagcatcagatcgtcaccgtcgactgccagccatcgggttccccagggaggcatgcttgtcttcgtcttcggttccatacgcaccggccccgaggagcaccccatcaagttttcccagc

SEQ ID NO: 5890 - DNA, 385 bp, Zea mays
  Clone ID: LIB3279-054-P1-K1-H8
ccaagaccgtcgccgtcctcctcgccgcggtgctcctcgcgctggtcgcgtccgcggcagccagcaggaagctggaggaggacgcacttctgggaagcctggccccagcccccgcgccggccgttggcggtgccgcggggctgcctggcggcaagccgggggcgtgggccgtcgccgctctggtctctctcgtcgccttcctcgtgatctgagggcgtggggatcgtgctgcgcatcgcgggagatggagggacgaatcctgcgatctggatcgcagagagagaggagagggggatatttatgttcgttctgtttgttctagggtgcctctcttttgcctgtataaaagaggatcatgattttttttatataataataccgttta

SEQ ID NO: 5891 - DNA, 382 bp, Zea mays
  Clone ID: LIB3279-054-P1-K1-H9
cccggctctccgccttcctcttccagtccccgcgcgcgagatcgccggcccgtgtgggccctagatcccgatggcctcgcgccgccgcaccctgctcaaggtcatcatcctcggcgatagtggggttgggaagacttccttgatgaaccagtatcctgcgattcggatcgattcttgacaagctgacttgatttcgtttcgtcgatttttttatttcttctggttggttggttggattgttttctttgagctgtgatgtaattcagatatgtgaacaagaagttcagcaatcagtacaaggctacgatcggcgcggatttcctcaccaaggaggtgcagttcgaggacaggctcttcactctgcaaatatgggacactgctg

SEQ ID NO: 5892 - DNA, 371 bp, Zea mays
  Clone ID: LIB3279-055-P1-K1-A1
attagattggtgacatgggctttgagaaatgttagctttctaatgataacggtcaaatgttctatctaattgcatccattttctccggttgctttttattttattttatttatttgaggggaaggataggcctgacacaatataccgagtaaaggccttgggttcgacgcagcttttctgcaaaaatgtagggatatggcgtgcctcggttattacttcatcggactccactcaagtgttcataagcaagatgtttgacttcgatggtgagctgaagagtccatgcaaaagttggttagttgtctacactgacaatgaaggcgatataatgctggttggtgatgacccctggaatgaattctgcgatatgg

SEQ ID NO: 5893 - DNA, 335 bp, Zea mays
  Clone ID: LIB3279-055-P1-K1-A10
gcaccatccgctaccctgacccgctcatcaaggccaacgacaccatcaagatcgatctggagaccaacaaattgtggacttcatcaagtttgatgttggcaacgttgtcatggtgactggcggaaggaacactggccgtgtgggtgttatcaagaacagggagaagcacaagggcagctttgagaccattcacgtggaggactccctgggccaccagttcgccacccgtatgggcaacgtgttcaccatcggcaagggtaataagccgtgggtgagcctgcccaagggcaagggaatcaagctgagcatcatagaagagcaaaggaagcgggatg

SEQ ID NO: 5894 - DNA, 244 bp, Zea mays
  Clone ID: LIB3279-055-P1-K1-A11
gcaagaccagctagctagctcctcccactgttatcacccgggccccggccatccatctagtttaaagaaaaatcgcagccatcaaaactactagctaagggcattgcattcttcctcctggcggcaatgctggcagcccattccgtgggggacaacatctaatgctaccacgcgctcatttacctgtcatcatccctgcggtatttgtatgggaagtaatccaaacccagcaagagcagcaaca

SEQ ID NO: 5895 - DNA, 359 bp, Zea mays
  Clone ID: LIB3279-055-P1-K1-A12
ggatgagatccgcaggttgaaggagatgaagaagagggggagaactggtctggatgattatgggtatgctatatcgctggtgagaacgatcaggatcctcctccagagaatgtatcggttcccttgcctgacatggtgcttcccccttcatttgattgtgacaatcccacataccggtaccgttttttggagtcaacctcgactgtcctagcaaggcctgttttggatgcgcatggatgggatcatgactgtggttatgatggagtgagcgttgaagagacactggctatccttagcaggttcccggcaaatgtagcagttcaggccaccaaggacaagaaggaattcagcatccattt

SEQ ID NO: 5896 - DNA, 338 bp, Zea mays
  unsure (1)..(338): unsure at all n locations; Clone ID: LIB3279-055-P1-K1-A2
gggggngaccgangcgtccacccacgcgtccggttggcttctcctccccctccggttcggactcggcttcgagaggatcttcgggggacggtttcgtggcgagcgcatcaagatggcagctttcgatgttgagtaccgctgcttcgtcggcggcctcgtctgggccacggacgaccactccctccacaacgccttcagcacctacggcgaggtcctcgagtccaagatcatcctcaatcgggagacgcagaggtcccgcggcttcagcttcgtcaccttctccacggaggaggcgatgcggaacgccatcaagggcatgaacggcaaggagctggacg

SEQ ID NO: 5897 - DNA, 369 bp, Zea mays
  Clone ID: LIB3279-055-P1-K1-A3
cttaaatggggtgttcctgtcccccatgagaagtataaagacaaggtgttctatgtttggtttgatgcacctatcggcacgtgtctattacggcatcctatacacctgagtgggagaagtggtggaagaatcctgataatgtagaattgtttcagtttatgggcaaagataatgtgccgtttcacacgatcatgttcccttcaacgctactcggaactggggaaaagtggacaatgatgaaaacgataagtgttactgaatatttgaattatgaagcaggcaaattttccaagagtaaaggtattggagtctttggtaatgatgcaaaggatacaaatattcctcctgaagtatggcgatactatttgc

SEQ ID NO: 5898 - DNA, 311 bp, Zea mays
  Clone ID: LIB3279-055-P1-K1-A5
gcgacaacaaagatttgtccgtgaagtgacaatacagtacaatctctgcaacgagccatggttaaaatataatatagcattggggccgacaaggggattgaaaaaagtacttttttcctttgctagactggaaaaaggggaagttatttatttggagacacattttaataggtaccagctgtgcttcaatggaaagaaaccttggggtattggatcgagctctaatgcattttatgccaaacctgagaaacaccaaagccgttgtcaccattcgcaaaaccgctctgtggagcatgaacttcgggatgtgt

SEQ ID NO: 5899 - DNA, 366 bp, Zea mays
  Clone ID: LIB3279-055-P1-K1-A6
cacaaagggaagcaaagtcaaatacgagcttgacaagaaaactggactgattaaggttgatcgagtcctttactcatagttgtataccctcacaattatggtttcattccaaggactctttgtgaagacaatgacccaatggatgtgttggtcctgatgcaggagcctgttgttcctggttcgttcctgagagctagagcaattggccttatgcccatgattgaccagggtgaaaaggatgacaagataatagcagtatgtgctgatgatcctgaataccgtcactacaacgacatcagcgagctgtctcctcaccgcctgcaagagatcaagcgcttctttgaagattacaagaaaaacgagaac

SEQ ID NO: 5900 - DNA, 284 bp, Zea mays
  Clone ID: LIB3279-055-P1-K1-A7
cccacgcgtacgtcaaactattgttagctcggtactgatacattcatgacattatcttgagacattggaggcaccaaaacttaagaaaggcaggcatgcacaagagctgatatcaacatattgggtgaattcttgatctttcgacgagagggtgtgtcgtatgaggctgtggctagcatgggttgcacactacaagtgccaactaatgacactgacgaacatgaactggatatagagagcgaggatagtaaggtcagagatggtaatgctgcaaaacaatcaca

SEQ ID NO: 5901 - DNA, 330 bp, Zea mays
  Clone ID: LIB3279-055-P1-K1-A8
gaagaaggaaaatgctgagcgtgatgagcgtgccaagaaggtgggaagcatcaacgagttgctgaaacctgcgaaggagaaaggtactacggcggccgtggccgtggaagggggggccgtggggatcgtggtgtttttagaggcggatacggagggggatacaatggtggcccagctactgctgctccatccattgaagatcaagctcactttccaagccttggtgggaagttaagggcgcccagctgctgctgtcaccgagcgttgtgttgtctgctgttttcatatttaaattttgttcgacgtttcatttctgtgccacggtttaaa

SEQ ID NO: 5902 - DNA, 332 bp, Zea mays
  Clone ID: LIB3279-055-P1-K1-A9
ccacgcgtccgggtgggggcatgggagatctacaaccacagaacgccggagcagttaccggcacacacaacttagacgggcaggctgcgaggcatcatgcccctgtacgagaagtacggggagaacttgggacatgctgacggggtgtcgcgttgtgctctacgacacccgtacaggacctacgtggcgggcgcgacgccatcggcgttaacccgtctacatgggctggggcaggacggttccgtctggatcgcggcgaaagaacgcgctgacgaggactggtgcgctttgagatttcccgacggccacctctactccaccccggcgggggg

SEQ ID NO: 5903 - DNA, 370 bp, Zea mays
  Clone ID: LIB3279-055-P1-K1-B1
ggaggtcagtggtgatgctctgggtgaggagtttaagggttatgtcttcaagatgcatgggtggatgtgacaaacaaggttcccaatgaagcaaggagttctgacttctggtcgtgtccgccttctgctccacagaggcactccctgcttccgcggttatggcaggcgtaatggtgagcgcaggaggaagtctgtccgtggttgtattgtgagccaagacctatctgttatcaacttggtaattgttaagaagggtgagaacgatctgcctggtttaactgacactgagaagccaaggatgaggggtcccaaaagggcctccaagatcaggaagctgttcaatcttgcaaaggatgacgacgtgcgcaag

SEQ ID NO: 5904 - DNA, 360 bp, Zea mays
  Clone ID: LIB3279-055-P1-K1-B10
atggagggggaaaatgatcgagactacttacactgcaaacatgaaagcaatgatgcagaatcggtaccgtcagcattctggacaatgaggaaagatgcatctcggtcaaaagcttgtaagcctcgttgaagtgaagatcatccatggcggacgatcaatttgtgccatcattattcactgttgtattcaaactccacacaggccgtgccagactaagttagatagatatatcagatgagctgcctgattcacagaatataattggcttaacataggaaaggaggtgctgagccacgctagctagctcatccttttcttctatattacagatattcaaactgtgctatggactctgtaaga

SEQ ID NO: 5905 - DNA, 345 bp, Zea mays
  Clone ID: LIB3279-055-P1-K1-B11
accatgcgtgcgaagatcatgtagtctgggatctttgcatcctgcataccgtcgagcgttgataatgtccgcgactgaggaaagaacatggatgagtttacgatgaaagctgtatacatgggtacctctgggaagggtatgccttcatttgatcatggcactggacccactggcactcgcgtttaaagaatcaatgaagagaacgtttgggacaaccgttcaccaatctaacagctactatgccgatgctgtggcgctcatcattccatcaacagtgggatcctgatccatgctacaaatgcttatagaacctggggggggtagcgttgttactaatgacggaaa

SEQ ID NO: 5906 - DNA, 366 bp, Zea mays
  Clone ID: LIB3279-055-P1-K1-B12
tctccctctccgaaatcaaggtagcgtacaccgctgcagtttctagagccctctctgccactcgtgatccactagtcacaatgcctgccctcgccaagcccgcctcccgcaccgtcaagcccgccgcggctccgaagccgaagcctgccgccgccaagccgaaggcggccaccgctggtgcctcccacccgccttacttcgagatgatcaaggaggctatcacggcgctcaaggagaggaccggctccagctcgcaagcgatcgccaagtatgtgggggacaagcacggcgcgtctctgccggccaacttcaagaagatgctttccatccagctccgtgggtccgcagccaagggcaagctcgtga

SEQ ID NO: 5907 - DNA, 370 bp, Zea mays
  Clone ID: LIB3279-055-P1-K1-B2
gttattcctcgttgcgtgccctcgccgcagacctctgccatggcggaccagctcaccgacgagcagatcgcggagttaaggaggccttcagcctcttcgataaggatggcgacggctgcatcactaccaaggagcttggaacggtgatgcgctcccttggccagaaccctaccgaggcagagctgcaggacatgatcaacgaggtcgatgcggatggcaatgggaccatcgacttcccggagttcctgaacctgatggcgaggaagatgaaggacacggactcagaggaggagctcaaggaggccttccgcgtcttcgacaaggaccagaacggtttcatctcggctgccgagctccgccatgtcatgac

SEQ ID NO: 5908 - DNA, 373 bp, Zea mays
  unsure (1)..(373): unsure at all n locations; Clone ID: LIB3279-055-P1-K1-B3
gcctgaaacgcacccgccccacgcacgcagggcaaccgaaaacccctcgatccggctctcctcgcgctgtagcttttaaacgccgtagacgacaacgaaagagaacggaaagaaataaaacccaccacacctaccgtcgtccgtagaggaaggaaggactcgagatggacaccgtcagcgtccccgtggtggccgttgcgaatgggatcggggaggtggagcgcaaggtgcanaagagctactgggaggagcactccaagtgcctcactgtcgagtccatgatgctcgactcccgtgccgccgacctcgacaaggaagagcgacccgagatcctgtctttgcttccctcttacaaagggaaatcagttctaga

SEQ ID NO: 5909 - DNA, 369 bp, Zea mays
  Clone ID: LIB3279-055-P1-K1-B4
cggacgcgtgggcgttcccaagccagccattggttggtagcaagccaagctaatcaagttagctttagatacccgccccgctcttcttccctccgacgaaggcagctgacgacacagcaggctagcttcggagttcggagcactcagccatggccattgccggcgctctcctcctcctgctcggactcctcgcgcgggaggccgctgccggcgggtggcagagcgcgcacgccacgttctacggcggcggggacgcgtgcggcacaatgggcggcgcttgcgggtacggcaacctgtacagcacggggtacggcacgagcacggcggcgctgagcacggcgctgttcaacgacggcgcggcgtgcgggt

SEQ ID NO: 5910 - DNA, 369 bp, Zea mays
  Clone ID: LIB3279-055-P1-K1-B5
ggccctagtagttctggctttagtggcaccgcctatggtggggcatatgatcctacgctaggtggttatggatctgtagcacacctgacatgaataggggaagcttcactggaggatatggacgatatcacccatatggataacaagaagagcccttgaaggcttaacacttgcatgcacgtttgctgcccgtcattggagaacacccaccatttctggacaatatccagctgcctgaagcttcaagaacaacttaatgtcatgtgtacatgttttctcgttcccgtgagctttaacttatatatcctatagcatgtagtgtgatccagagtagacgttgtatcgaaggttattgtgtttggcataata

SEQ ID NO: 5911 - DNA, 372 bp, Zea mays
  Clone ID: LIB3279-055-P1-K1-B6
tcagaatgtaataggcactttacaatcctgtactgttgaagaacttccaaactttgatacattgatgtccagaagtgtgatcaaaatggtgaaacccccattccacataatctggggaatatgacaccagatgaagatcagttgccaccaccacctcctctccccccaatgcagtggaggatgacaagacaaacaacttcactagaagaggaaacttgcattacaactaaagatatggttagaaaaacttctagcctaccacatatacacacctctgcccaggaagaacactgtcctccaactgcaccattggatctacaagggcatgctggggaagtgggtgtccagaaaactggtggggtacgagaaatt

SEQ ID NO: 5912 - DNA, 367 bp, Zea mays
  Clone ID: LIB3279-055-P1-K1-B7
cctccccagtcgccgccagccgcgcgcacacccaccgagagctcgggctttctttctccgttcctccctcgccgctcagggtttcacgatggaggccgaggcggcggccaagagggcgcgggagggcggggaggacgccaccgcgccggtggcgggggccgaggcggcggtcgccggtgctggcgagcaggcggggatctccgccgtcatcccaggatggttctccgagatcagccccatgtggcccggtgaggcgcactccttgaaggtggagaaggtgctgttccagggcaagtcagactaccaaaatgtgatggtttttcagtcctccacgtacgggaaggtgcttgtcctcgacggagttatt

SEQ ID NO: 5913 - DNA, 362 bp, Zea mays
  Clone ID: LIB3279-055-P1-K1-B8
ctccatttatacggtattccattgcaaaatttctgcctatgatagtgcggggatacatgggctaagccatgggagacacagacaccatatatgaagttttctgcctatgatagtgcgcagatacatgggctaagccatgtggagacacaggcaccatatatgaagttggtctttttgctgccaaccaatcatgaacaccaaattcagagttaggaatgaactataactattcatagtcttgttattaccttaagctcttgattttgcaacggacctgttgatgcgcagttgatctaacacatgagatgtggtttcatagacaatacaagtgtattctagttgtctttttcatagtgggtcag

SEQ ID NO: 5914 - DNA, 365 bp, Zea mays
  Clone ID: LIB3279-055-P1-K1-B9
tctctctctctattcgttccccgcctcaccccgagccagccgtctcggtagggtttcgccgccgccgccgcgccgccgccgctatgcctcgccgcagctcaggaaggtctgccccacgcccagctccccgtgctgctccagtgaggaacccgccacagccagcacgccaggctcctcctccagctcctgttcgagatggtggtggctccatgtttggaggaattgggtccaccattgctcaaggtatggcgtttggcacgggtagtgccatggcacacagggctgttgatgctgtattaggtccccggaccattcagcatgagactgttgcctcagaagctgctgctgctgcccctgcccctcca

SEQ ID NO: 5915 - DNA, 368 bp, Zea mays
  Clone ID: LIB3279-055-P1-K1-C1
cggacttcttttgttctgtgcaccatgcaaggaattgtggattcatcttccgagggccgcagactccagtcaatccaattggttttatcttccagtaggatacaatgggcgagcatcatctatagttgtgtctggaaccaatgtcattaggcccaggggacaaggacatccaacaggaaactccgctccttattttggtccctcgcagaagcttgattttgagcttgagatggctgccattgttggtccagggaatgaattaggcaaacctattgatattaatgacgccgaacaacatatttgtggcctaactttgatgaatgattggagtgccagagatatccaggcttgggagactatacctcttg

SEQ ID NO: 5916 - DNA, 365 bp, Zea mays
  Clone ID: LIB3279-055-P1-K1-C10
aattcctccttcggatctcgcattcagcgcagcgcaggtgtgaaggaagggggacgcggaggaagatgggctcgcgttcgggaagctcttcagccggctcttcgccaagaaggagatgcggatcctcatggtcggcctcgacgccgccggtaaaaccaccatcctctacaagctcaagctcggcgagatcgtcaccaccatccccaccatcggtttcaatgttgaaactgttgagtacaagaacattagcttcactgtctgggatgtcgggggtcaggacaagatcagacctctttggaggcattacttccagaacacccagggtcttatttttgttgtggacagcaatgaccgtgaccgtgttg

SEQ ID NO: 5917 - DNA, 363 bp, Zea mays
  Clone ID: LIB3279-055-P1-K1-C11
ctcccggcaacctcgccgccggggccatggaccggtggaccggcgtgctctacgtcccactctccagaggcggcccctcttccgcgtcgctgcctcgctcctcctctcgccagccaaaacgctcgccactcgcctacggagcctgaactatcccgatggaagcaggttccacgagtcaacgcgatccttttcacgggggaccgcgtccgcggcacgggcgatccggtgatcgagcggctctctgacgccgcccacctggctggggtcctcgccgggaagctccctggggaggccaacgcgtgggtggtcgacgccgcgtgctttgctgggccgtttgcggtgtaccgagagctcgttccgacc

SEQ ID NO: 5918 - DNA, 307 bp, Zea mays
  Clone ID: LIB3279-055-P1-K1-C12
ggggcagacttgaaaatccatgcagagacccaaaaactggcacaagggtttaccatagtaccattcataccggaacacgtgcttttaaccattttattaattacaggcggggggtagataaaacaacaacaatactttaggtggtctttttagccttggaggctgtgggaagaacctgggctctgagcctttcagtccttttagacgcaataaaaccgaccttttggccagggggagcattgcgggggacagtaaaggcatgaccggtatgctggtggttaccttcttcggggggatgctccacggg

SEQ ID NO: 5919 - DNA, 370 bp, Zea mays
  Clone ID: LIB3279-055-P1-K1-C2
gggctatagggcggtgacattccagctgtttaactccagcgggcttcaagttgtttgtactttatctaatgccgctggcatatcacattaaacgaagatgttctccctttcgaggttagtgccatactgaaagtacaaagtaaaaatatagaccatgatgtgggctaacggcatcaactacatttagcatgagatgccttgcatgctacatgacaatagctgcacacattatttttaccttctgctgatcgaccaacacaaaaaaaatactcttgtatctaactgcactgctactgcatttattgcattggctttagtgcgctcctagatacagtctaatcgtggtgacatttaatcaatgaaacatgaa

SEQ ID NO: 5920 - DNA, 366 bp, Zea mays
  Clone ID: LIB3279-055-P1-K1-C3
tctttggatggacttgtggctgaatttcttggtcctaggacacggggatgacaaagtttgcaagaagttcatagtgaccagtctgtgctttggagttattggtttcttgtatcttcggtatgttgcagacccaaaggttctttggatgtggtatgagccctatttgagggatgatgaggagttctcccccggatctaatggccgcaagacaaccatgggtgtttatgtgcgtgatcttatacttggacagtactactttgatagtcttctaccaagaattcctctcccagtaactcgtcagattacagccaatcttgaaaagatgaaattgcccactaagctttctggggcaactggagactccag

SEQ ID NO: 5921 - DNA, 367 bp, Zea mays
  Clone ID: LIB3279-055-P1-K1-C4
cgccgatcgctcgctggtgggatgaagaaatgctccggcgtgctcttcatcctcacactcgccgtcgtgctcttcccctctcgccgtcgccctcccccactccaccccccaacaccgcacccaatggcccgatcaccgacctcctccccaccctccccggcctttcggacctctaccctcccgctcccaactccactgcacatctctcctggggcctcctccgcccgctcctctgccgctccgacgcgctcccgggaacctctgcaggcgtcctcgaggcagccgaagcctggcggaatctcaccctggctgtcaccgccgcggcaagcgaggaggaggcgcgtctccaaggactccgctgctcatc

SEQ ID NO: 5922 - DNA, 369 bp, Zea mays
  Clone ID: LIB3279-055-P1-K1-C5
gggaaacagagaagatggcgacgaagcgcgacaccgagtcggacggcgaaggctccaaccccgtcggtggtggcgcgctccgccgcccctagccgccgcccctgtcgtatgcctcctccgctccgccggggacttcggtggcggcgccttcgttggatccatcttcggatatggacaaggcttgatcaccaagaagggttttaagggctcattcagcaatgcaggggcctctgccaagacttttgcagttctctctggcgttcagagtttggttttgtgcttgttgcgaaggctacgtggcaaggatgacattgtcaatgctggtatagctggttgttgtactggcctcgctttgggctttccaggggc

SEQ ID NO: 5923 - DNA, 162 bp, Zea mays
  Clone ID: LIB3279-055-P1-K1-C6
gtttgaccccccggggcctggaggagctgaagccgggcattggggagaggaccaatgccgaggcggcggcagagggacaggcgcgggcaatggggtggttgaagaagaggaggaggaggactatgaggacgacgatgatttcatcaccaatgaggtgaagcg

SEQ ID NO: 5924 - DNA, 365 bp, Zea mays
  Clone ID: LIB3279-055-P1-K1-C7
caccgaattccctgcgattcctctcccctcgcctcctcgtctccccctaggggatcgtcggagaggaatcgaaagagggccgtctcatccgagttaaggaagccatggagcacaaggaggctgggtgccaggcccccgagggacccatcctctgcatcaataactgtggcttcttcggcagcgcggcgaccatgaacatgtgctctaagtgccacaaggagatgataacgaagcaggatcaggccaagctggctgcctcctctatcgacagcatcgtgaacggcagcgacgccgtcatggagccggttgttgctggcagcaacacggtagtagctgttgcccaagtcgagttgcaaacaatgaac

SEQ ID NO: 5925 - DNA, 365 bp, Zea mays
  Clone ID: LIB3279-055-P1-K1-C8
cggacgcgtgggcaaaacactaaatgggtaaaaacagtaaacaatgagagcgagagttggaaccgatgatggataccggaggaaaccaatctcacagaaaccaatatcttgggtgttttttactggacaatcatagttagttgtgctcatcgttgtgtacatgaaacactgagtagtaagtcagctatgttttacaaaacatatatcaaatcggaaccagtggtgagcgggtgtgtttcacaaagttaggtttggatacaagggtcatgtttgttttacatttaaatcatattttacgactgcactaccatgaaaataacaaaattccatcaaattttggcaaaggagagttgcaaacaatgaat

SEQ ID NO: 5926 - DNA, 365 bp, Zea mays
  Clone ID: LIB3279-055-P1-K1-C9
cccacgcgtccgcccacgcgtccgcccacgcgtccgtgatctttatgtgagattgcactaatctggtggtagagaagtatcataatgtggataaacataccagaaacctgatagtggtgcttctgtttctatgcctgaactggtaataggcttatagctgcctgaggatttcagttgaatgatactattacatcacactgtaaattgtgagccaagaatgtacatcttgcattcggtaagaccataagagaaaggttattgtgactcgttacttgtaaatacgtgcactggctgttcaaagaaactaagaaagacaaggcggaggtgctaccttcccaccacccacctaccctacgtctgatcat

SEQ ID NO: 5927 - DNA, 346 bp, Zea mays
  Clone ID: LIB3279-055-P1-K1-D1
cccacgcgtccggcaagaaatgaatccttcctctaatcctctccgatggcgcttctccgtccgtcctctagagcctgcttggccgcccacatgcatgcatgcatgcatgagtcaagcacaagcatcgtcttcccatgctactcgcgtgaatatgaatcgatgcttatctcgcatcaatcaatcgacgctcttccgtctcttctatcaatcaacgttctctagtgaaagaaccggcccttgagtggtatatgtattgttgcggcctgcgacgagttgagcagctaagttatgttgctatcttttgtttttatcttcggagatcttttattagctatgacaactggac

SEQ ID NO: 5928 - DNA, 361 bp, Zea mays
  Clone ID: LIB3279-055-P1-K1-D10
cattgttggacgcgttcccctcctgcacgcaacctcatctcgtcctccagatccaggatggccgtcctcctgagaccttgcctccccgagtgctctcggtgagctactttgtttcgatttatcaggaaatccgtttgcttcatgttgtgcaggctcatatctgattgctggattcggcaaacccgcgttggatcctgtatcggttagtccttgcctgcaaggttcttgttgttttgttttggtggtcgagcatcgcatgttctgcttctggatccagatctggagaaatcgcgaagtcgtcgtcgttcggttcggagcggatctgaggcgacgatagatggaggcggcgggatctctcggt

SEQ ID NO: 5929 - DNA, 362 bp, Zea mays
  Clone ID: LIB3279-055-P1-K1-D11
gcgccgcgacgtccctcgccttcgccgccgaatccgagactccgatctcgggttcaccgcagcgcacagagagccccgactcccggcccgatccgcgctctcctctccgtcgcttcagtcatggcaggaatggcacctgagggttctcagttcgatgctaagcactatgattctaagatgcaggagctgctgagcaccggtgagactgaggagttcttcacttcatatgatgaagtttttgagagttttgatgatatgggcctccaagagaatcttctgagaggcatttatgcttatggttttgagaagccatctgcaattcagcagagaggaattgttcccttctgcaagggtcttgatgt

SEQ ID NO: 5930 - DNA, 313 bp, Zea mays
  Clone ID: LIB3279-055-P1-K1-D12
cccacgcgttcgcccacgcgtccggtccttacctagtttctggtcctgcaggcatggatgatgaagacgacagtccgcgacgattgaccaggtcctaaacgacacgaagagagtcggctacttcaaaggatacctcaattcggttgcgcaggcgatcaaggacggggctgatgtccgtgggtacttcgcgtggtcattcctggacaactttgagtgggctatgggctacaccaagaggttcgacatagtctacgtcgattacaaggacgggctcttcaggcaccccaaggcatcggtccttttggttcttcgc

SEQ ID NO: 5931 - DNA, 368 bp, Zea mays
  Clone ID: LIB3279-055-P1-K1-D2
cccacgcgtccgcccacgcgtccgcggacgcgtgggtggtgcgggagatcgcgcaggacttcaagaccgacctccgttccagtcctccgccgtcgccgcgctgcaggaggccgccgaggcgtacctggtgggtctcttcgaggacaccaacctctgcgccatccatgccaagagggtcaccatcatgcctaaggacatccagctcgcgcgccgcatcaggggcgagagggcctgattgctgctctgtcttcctgtttctgtagtgtctgaactaggggatggaatctatcgcttcttgtcctgcaatcgtgtactgatgttctaggcaaatcagtttggctgttatgaatgtgattcagtgctttgat

SEQ ID NO: 5932 - DNA, 359 bp, Zea mays
  Clone ID: LIB3279-055-P1-K1-D3
cccacgcgtccgcccacgcgtccgcggttggtggttgcgtcgcgttgtgttgcgttgtgtcggaggttggagttgggcggctcgcgtgcgagaggatctgagcggagaaggccatggaggagagtaattagcggttgctgggtcgggaggaggtggtgtggttttgatcgtagtcgcgtttgccggggctcgatttcgatcagaaaactttttttaccggatattcttgggtgggtgtgtttttgggccgcaaattgttatcgccggtgttcggggctcgatttttaagaacccaatttattaggggggtaattttctgcttttgttttcgtggcaatggttttggactcccagacgct

SEQ ID NO: 5933 - DNA, 370 bp, Zea mays
  Clone ID: LIB3279-055-P1-K1-D4
agcactgcagctaagaaggctcctgccaaggaggaagaggaggaagacgaagaggagtctgacaagtccaagtcggagtcaatgacgaggatgacgaagagggtagcgaggaggatgaagatgatgacgagtgatggagagctcgctcgagacaatggacggtgcttcatccaacaatggagcggctacacaaggccccgtggcgatcaaaaaaaaggagcctatatccatgtactagaattattcagtttcactccacatcgtgatgttttatttttacttttgtcgtgctataacggatagcgctcctcgttggcgccactggcgggtggttctgcctctggtctggtgtgtttgtgtgtggtcacac

SEQ ID NO: 5934 - DNA, 366 bp, Zea mays
  Clone ID: LIB3279-055-P1-K1-D5
ccaacatcacaatctgaatgcacagctgagcaagcttacacatggagcaagggacaagcagtgtttgcgactgggagccatttgatcctgtggagtacaatggcaagatacatgttcccggacaggcaaacaatgcctatatcttcccagggtttggcctcggcgtggtgatgtctggagctatccgcgttcatgacgacatgcttctggcagcatcggaggctctggcccagcaggtcacagaagaaaattttgagaaggggctgatttatcctcccttctcaaacatcaggaagatctctgcccacattgcagccagcgttgcagcaaaggcatatgaacttggtttggcaagtaggcgccctc

SEQ ID NO: 5935 - DNA, 371 bp, Zea mays
  Clone ID: LIB3279-055-P1-K1-D6
cccacgcgtccgcttttcgcgtttagaacctctaaaatttcccccactcgccagtcgcagcagcacctgtagccatgacgccagcggagccggtagcaaggggaagaagggtgcggccgggcgcaaggcaggcggccccaggaagaagtcggtgacgcggtccgtcaaggccgggctgcagttccccgtcggccggatcgggcgctacctgaagaagggccggtacgcgcagcgcgtgggcactggcgcccccgtctacctcgccgccgtcctggagtacctcgccgccgaggttctggagttggcagggaacgcggcgaaagacaacaagaagacgcgcatcatcccgcgccacgtgctcctggcgatcc

SEQ ID NO: 5936 - DNA, 362 bp, Zea mays
  Clone ID: LIB3279-055-P1-K1-D7
ggcggcgccggcgtgcttgtgatctcaacccaagtcgtgcctccgctccggtcacccgtcgctccacgcaccatgtcgaggaggaagaccagggagcccaaggaggagaacgtcacccttggacccactgtccgtgaaggagagtatgtctttggtgtcgctcacatctttgcatccttcaatgacaccttcattcatatcactgatttgtctgggagggaaactctggttcggatcaccggtggcatgaaggtgaaggctgaccgtgatgagtcgtcaccttacgctgctatgcttgctgctcaagacgtcgcacagcgctgcaaggagcttggcattactgcactgcacattaagcttcg

SEQ ID NO: 5937 - DNA, 364 bp, Zea mays
  unsure (1)..(364): unsure at all n locations; Clone ID: LIB3279-055-P1-K1-D8
gccgccgacaacgctctctaccgtccgagaccccaagcaccagcgcggcggcgggggcgggggcggcggcaccatggctgtcggaaagaacaagaggatctccaagggaaagaagggtggcaagaaaaagaccgtcgaccctttctctaagaaggattggtatgacatcaaggcaccgtcggtgttcagtgtgcgcaacatcgggaagactctcgtatccaggacacagggtaccaggattgcttctgagggtctgaagcacagagtctttgaggtttgcctagctgatcttcagggcgacgaggatcaagcttacaggaaaatcangctccgtgctgaagatgtgcagggcaagaatgtgctc

SEQ ID NO: 5938 - DNA, 209 bp, Zea mays
  Clone ID: LIB3279-055-P1-K1-D9
cggacgcgtgggcggacgcgtgggcgcgcatcgcgccaccccatccgtcaccgtcgacccgcgagcaccctgtcgaagggaggaggtggaggctagctcctgactagattcatgatgactattactatcgtcaaattaaggttgggtctggtctctattaatgtgctgacagttttcttgaccttaatggtgcttcttccacacaccat

SEQ ID NO: 5939 - DNA, 368 bp, Zea mays
  Clone ID: LIB3279-055-P1-K1-E1
cgcagccccgctcgtcgccttcctccagaacccgcagctcgtgcaggagttcaggcccgacaaacagtacaacatcacatgctccaggagcgataccagatcggtcctgaccagattgaagctctgtatcagtatgccaaatttcagtttgagtgtggtaactactcaggggctgctgattacctttaccagtatcgtgctttgtgcacaaacagtgagcgaaatgtgagtgccctctggggaaagctggcagcagaaatcctaatgcagaactgggacgtagctttggaggaactcaaccgcttgaaggaaataattgattcaaagaacttctcatcacctctgaatcagctccagaacaggatatg

SEQ ID NO: 5940 - DNA, 266 bp, Zea mays
  Clone ID: LIB3279-055-P1-K1-E10
cacgcaccagcccagcagcagaagcgcccctcggccctcgctcccacaacaagctcaagccagccttctcttctctctgctccaatggcgcgcttccagctcgcagccgtggccatggccatgctcttcgccgcggcggcggcgcaggccccgaccgccaccccgacgccggctcccaaggcgttccccccgccggcgacgccgccgccgacccccgcgccggtgtcttcgcccgtgccgaccccgaccatgccttctacggcgcc

SEQ ID NO: 5941 - DNA, 318 bp, Zea mays
  unsure (1)..(318): unsure at all n locations; Clone ID: LIB3279-055-P1-K1-E11
ctcttcgccccctcgcgcttaccgctgccgcgcctcccgactcgccgcctccgcctagctccgggctctcaatggcctccatgctcgccatcctcaggccctcggcgccggccccgctcgcgggacgccgggccagggctgccgcgccggcgaccgcgagggtggcgctatctaccagatctaggtattcgtcagccagggtgtcgctcggctccgaggttgcagtgggcgccgacgcgctcttcgncgactataagcccaccaccgcttttcctctttccccggccaggggtgccccaaaccggttggaaatggggg

SEQ ID NO: 5942 - DNA, 367 bp, Zea mays
  Clone ID: LIB3279-055-P1-K1-E12
cccgctaggattccccccaaaccctcccccaaaaccccagagcggagaagagcgcaagatgttcggcttcggcaccacggccaccacggccagaacccgccggcgcacggcggcgtgcaccagcccaccttcaagatcttctgcaaggccgacgaggggtactgcctcaccgtccgcgacggcaacgtggtgctggcccccgccaacccgcgcgacgagcaccagcactggtacaaggacatgcgcttcagcacccaggtcaaggacgaggagggcaaccctgcgttcgccctggtcaacaaggccactgggctcgccatcaagcactccctcggccagtcccacccggtgaagctggtgccgttca

SEQ ID NO: 5943 - DNA, 288 bp, Zea mays
  Clone ID: LIB3279-055-P1-K1-E2
ctcgctctcgccttctcggcgcagcgcagtactacgagctagcagcaccaggaacgtcttcccacacttccgcgctctccctttgtctcgagactcgagaatgggtgtgtaggcgggcgcaagaaggagggaggcgagagggggagctagggtttttcgccgccgccttctgttatcctcaggctctgaaccccctcctgtccggtgcgcggcggattagactccgatggggaagtctccggcgaagtggatcaagtccgtgctcttcgggaagaagtcgtcgtccag

SEQ ID NO: 5944 - DNA, 368 bp, Zea mays
  Clone ID: LIB3279-055-P1-K1-E3
ctcccaccccctccctcagccatggcgggtgccgccgccactgcccactgctcactcagccgtccgcccagccctactcttgcacgcacctcatcttctccatcccctccccatcttcctctagcgccagccaccagggaggttcgagctcgccccctccgcgccctccctgctcgctgccctccagctcgccagtcgtgctcagctctgctccatcttcctacgccgcccaagtccagtcaggaacttccttgtgtcaatctgccactacccattgctaccagtgctgtttttattaccatgctggtcactgcttccatgtcttcacaggccttcttaagctcgtcgagttctgatctgagcatgcc

SEQ ID NO: 5945 - DNA, 373 bp, Zea mays
  Clone ID: LIB3279-055-P1-K1-E4
agaaagcaaagtgcagagcacgagcagcagcaccagtccaccaggccggcgccgcccaaaatctccgcgtccccccaccatggcctccttctttgcggacgacggcgccgacgacctcccgcgcgccacctcccaccccttcgactccgacgacttcggcgccgccgcagccgacgacgctagcgccggcgggtacgcctccttcgccgacggtggcgtcgaggaggtggacgaggagatcaccgtagagtcctacggcgtcccgatccgccacgtctccgggggatactcgccctcgccattctcccccgacctcgagcccaacggcagcgacggcccgaccctgccgccgcccaccgagatggggcgggag

SEQ ID NO: 5946 - DNA, 341 bp, Zea mays
  Clone ID: LIB3279-055-P1-K1-E6
gacctcctattcaccatgccgaccgaagagggttccgacggcggtggcggcgccggagccggagccggggagaagaaagctcgcaggcgcccgcaaagcctggagcgtgcggcgccgcaaagttcctcgcggggttgccgtcgcgcggcaacttctcttccggctccggcccctccaatctgggagggttcagggttgtcgtctgcgagcacagctcagatcccccagaaggacaagttataaagacggcttcaacgaatatattaatcaggcattgtgggttgaacaagcagaagacttgaggcaaaagatgtggattccagaactggcggcgtaaacaa

SEQ ID NO: 5947 - DNA, 351 bp, Zea mays
  Clone ID: LIB3279-055-P1-K1-E7
gaaaagaaaaggaacaatgaagcaaaccaaaacccaatcagaatcagggtgggtaggcggaggaaggaagggaaaggcgacgagctggtgacgacgaggagcaactagcgtcgcgaagccgccgagccccaggcgaagtcacaggccgccgcagcggtgccggcgcccacccgatccgccgccgccgccgacctcgtgctcgcgcctccggtcggaaggagggggtgtcaaacccatggagcagcctgccgctcccgatcggagcgattttcccgccggggagtgcgaatggcgggaggagctgcggcagcagcagtctcaggtggacgcgctgcgggagcggctcgtgga

SEQ ID NO: 5948 - DNA, 365 bp, Zea mays
  Clone ID: LIB3279-055-P1-K1-E8
aaaggtcacctcttaacaccaggccgccgccattgctgctccctttgtgtcgtttctcggcaccctcgatccgagcgtggttaatccacgcatcgaccggcgaacgccaccgtatcccatctcgaatacctccgcgctcagcgtcatggacggcttctccaaaacgatcggcggtggtggccctaacgttccggcgggatcccaccccgcgggcgggagccaggcggcggcagggggaggcgcgacgcagcggacgcagtatccgtatgtgactggtacttcagtcattgccttgaaatacaaggatggtgtgatcatggcatgtgacactggagcctcctacggatcaactttgagatacaaga

SEQ ID NO: 5949 - DNA, 363 bp, Zea mays
  Clone ID: LIB3279-055-P1-K1-E9
cccacgcgtccgcccacgcgtccgcggacgcgtgggttcgggttcgtgaggttctccggggttcggtttcggggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctccatcgggagacgcagaggtcccgcggcttcggcttcgtcaccttcttcacggaggaggcgatgcggaacgccatctaaggcatgaacggcaaggagctggacgggcgcaacatcaccgtcaacgaggcccagtcccgcggcggtcgtggaggc

SEQ ID NO: 5950 - DNA, 362 bp, Zea mays
  Clone ID: LIB3279-055-P1-K1-F1
gaagacccgaactgagtccctccaccgacccaaaccctagcgcgcacccacctgcctccccctttcccggcgtgcgtccggcgttggagatgcgggcgctgctcgcggacggcgggatggcgctggcgatggcgccggaggttaacgagtcgtcgggcggtgctgcgttgtcgcaggggctgttatggtgggcgtcggagtgccacggggtgttgtacagccttgcggtgatgctgccgtcgctggccttcgtgggattcctagcatggcaggcgcggcggagcttccgtaggatcagctacggccgctctcacgtcgtcgtcgtcgcgtactacgcgctcctctgggtcgtcgccgtactc

SEQ ID NO: 5951 - DNA, 367 bp, Zea mays
  Clone ID: LIB3279-055-P1-K1-F10
gcagttcctattgaagaaaaaaacttcaccggtggatttcggctgggtaatccccttccccctcctattttgtgtatctcatgaccaccgaacctcaaggatcacatcaacatggttctaaacgtgatttgcattcatgccgaaaaaatgtacccggcacatcattcgtctcagatttgagagatcacatccacgagttcatcaacgcctcttctgatgaacacatgacatgcttcacaaagactatcaagaagatgttcgggatgtcaaagactgtggcacataaatcgtcggaagcagagcaagctgggccctcatgattacatctcaccatttcatatttgactaggtagcagccagtaaacat

SEQ ID NO: 5952 - DNA, 367 bp, Zea mays
  Clone ID: LIB3279-055-P1-K1-F11
ctgcatgaggacccatatacagctggagaaatagagaaaattacaggagaaggcctgacatctgtcttccaggctctcagacgtcattggaagttataaaagcggcaaagcactacaagctatttcagcgtgcgacccatgtctactctgaagcaaggagagtttatgctttcagggatactgtctcttcaaaactcagtgaggaaggcaagcttaagaaacttggtgatcttatgaacgagagccattacagctgcagcgtgctatacgaatgcagttgccctgagctggaggagcttgtgaaggtctgcagagacaacggagcactgggagcacgtctgacaggagctgggtggggtggctgcgc

SEQ ID NO: 5953 - DNA, 368 bp, Zea mays
  Clone ID: LIB3279-055-P1-K1-F12
cagcgcaaaccctgccctgacaccggcggcgccatggtgctcgaggcaacgatgatctgcatagacaattcgaatggatgcggaacggcgactacgctccgtcgcggttccaggcgcaggccgatgccgtcaacctcatctgcggcgccaagacccagtcgaacccggagaacacggtaggcgtgatgacaatggccgggaagggtgttcgcgtgcttgtcactcccaccagcgacctcgggaagattctcgcctgtatgcacgggttagaagttggcgctgaggcaaacttggctgcggcaatccaggttgcccagcttgctctaaagcatcgccagaacaagaggcagcagcagaggattatagct

SEQ ID NO: 5954 - DNA, 331 bp, Zea mays
  Clone ID: LIB3279-055-P1-K1-F2
gattaagcaaaacaaggttactggacaaatatgcgtaactcaacattggaaatagaagcgcgcacagagagagagagagacgatggcagggcggtgtctgaaaactccacgcttacatgaactgcactcaaatgaaacccaagcagtacgtacgcgcgtactcaaattacacacaacgacacacagagatatatagagagagagatggatgggcatgattatgcgccggtgagctcctcctccttgtgcgtctcgatgacgacgtcagaggtggggtaggcgtggcaggtgagcacccagccgtcggcgatctggccgtcgtcgaggtagc

SEQ ID NO: 5955 - DNA, 362 bp, Zea mays
  Clone ID: LIB3279-055-P1-K1-F3
cggacgcgtgggtaggacaaagcttccctctggcattgaaatgagtgtccatgtgcttacaacaggctattggcctcatatccaccaatggacgtgaaactcccacacgaactgaatgtgtatcaggatatatttaaagagttctatttaagcaagtacagtggaaggcgtttaatgtggcagaattctttgggacactgtgtcttgaaagcagactttcccaaaggcaaaaaggaacttgcagtgtcattgttccagagtgtggttttgatgttgttcaatgacgcacaaaagttaagcttcattgacatcaaagattccactggtatcgaggataaagaattgagacgaacactgcaatc

SEQ ID NO: 5956 - DNA, 340 bp, Zea mays
  Clone ID: LIB3279-055-P1-K1-F4
cggacgcgtgggcggacgcgtggtcggacgcgtgattggagaagcaggggctgtggattcgtgatccaaaccgcataatgataatcacattccgcttacaccattgagtgagcgaaagcaagcaaaaatagaagcattggctcgaatgtaacaagggatcacaaaggggatatcatggtaccccacattcaagcgccgtttgtactcccttgagaagtgctctatcagaagagcttgcgcggacaatgggtgttaatcaatctgctaatgggtcgcaggtccggaagatgaaaagtggtattgtccgaatgcttagtcagagatcacttgttaaagcaac

SEQ ID NO: 5957 - DNA, 369 bp, Zea mays
  Clone ID: LIB3279-055-P1-K1-F5
gcttctgctgcagctagggtttagaggttttctgggcgcggagcggacggcggcggcggcggcggctatggctgcgcggaggaggagatcgcggtgaaggagccgctggatctgatacgcctcagcctcgacgagcgcatctacgtcaagctccgatccgaccgcgagctgcgcggcaagctccatgcgtatgatcaacatttaaacatgatacttggagatgttgaagaggtcgtgacaactgttgagatagatgatgaaacatatgaagaaattgtgcgcaccacgaaacgcactatccccttcctttttgtccgaggtgatggtgtcatattggtttctccaccccttcgtacggcatgaagtttg

SEQ ID NO: 5958 - DNA, 370 bp, Zea mays
  Clone ID: LIB3279-055-P1-K1-F6
atcagtttcagcctctgtgattacccccatgcttcatgtggagactcaagttctgttagcaattatattttttgagctccttgagttttgaattcactcgattgttctgagccgtgggtgctagttgtccaatggttgcaattacacatacctaacaaacaaatataaatatatttagatttactactaatatgaatgcttcacaaaagataccaaaaaaatacccagactgcagaactctgtttaacaatcctaaaagggattttcatttgcataaatagtgtgtatcacttattgcaaacatatagcattttgtaagtgtaaaaacatgtgggaggaggctggagctgaaaggatgtttctactggca

SEQ ID NO: 5959 - DNA, 356 bp, Zea mays
  Clone ID: LIB3279-055-P1-K1-F7
tttttgtcgaatctgtcgtgagatcctccccgacgagatggcggggaagggagccaaggccacggccgccagtcggcggacaaggacaaggggaagaaggccggcggccccgtctcgcgctcctcccgcgccgcacctcaggagaattcaactccgaagaaagatgtttatcaattgttcgctgagaaggttagggataacaaacagctggaatcaagatgggcaatcatgcaagaaacccgtgtggagtattttcgtggaaaagatttcaatgccttcatcaagaattatccagaagtcagggaaattttggggccagataaggatttagaagtggaagacattgttaacacttt

SEQ ID NO: 5960 - DNA, 365 bp, Zea mays
  Clone ID: LIB3279-055-P1-K1-F8
aacggaaatagctcgcggtcgcggtttcttgcgccactccggctcaggcgccgcccgccacccgccacagcgccgcagacgagatgggcatcaagggtttgacgaaactgctggcggacaatgcgcccaaggcgatgaaggagcagaagttcgagagctacttcggccgcaaaatcgccgtcgacgccagcatgagcatataccagttcctgattgtagttggaaggacaggcatggaaactctcacaaatgaagctggtgaagtcactagtcatttgcaaggaatgttcaaccggacaataagattactggaagcgggaatcaagcccagttatgtttttgatggcaagcctcctgatatgaag

SEQ ID NO: 5961 - DNA, 359 bp, Zea mays
  Clone ID: LIB3279-055-P1-K1-F9
ggcctctcgggattctagagtggcggccggctctccgcctgttcttgtcgtcgctgctcctttcccaggagtcggaacgttctgagagcgcaactgaaaagattatgagcagcatcatggataccattgctgacaaccttcctaagcagaagtctgggaaatttgatccaggttcagtctctgacaaagtgaagaataagctgtttggtcgtcagaagaccttgcatggagttctgggtggtggaaaacctgctgatgtgctgttatggaggaacaaaaagatatcatcgagtgttctggctcttgcaacagctatttgggttttctttgagtggctcgactaccacttactgacaatt

SEQ ID NO: 5962 - DNA, 358 bp, Zea mays
  unsure (1)..(358): unsure at all n locations; Clone ID: LIB3279-055-P1-K1-G1
ccgacgtcgattactgcagtaaaaaggagtacccggtgaaggtgagcggagtgcagatcgtgcccgatccggtcgacccggcaagcccgccactttcaagatctccgcttctactgataaaaccatcgagaaggggaagctggtgatcgacgtcaagtacttcttcttctacgtgcactcggagacgcgcgacatctgcggagagatctcctgtccggcgaccggcgacttcgtgctgtcccacgagcagacgttgccagggttcactccaccggggtcgtacacgatctacatgaagatggtcggngacgacgacgaggagctgagctgcatctcgttcggcttcagcattgggttc

SEQ ID NO: 5963 - DNA, 361 bp, Zea mays
  Clone ID: LIB3279-055-P1-K1-G11
agactctcaaaacttgttcggatgaggctggaaatgcaggcgccttatatatctaagtggcctcaagcactagtattcagtctcaaccagcaaacgtctcaacaagcttgaagcagcgagctatcctggtggatgagatatggcatgctgctggagattctgggtcagatattgattggtatgtgaaacgtacagtgcttggtggtatctactcaacctcagaggtgtatatgttgacagacaattctccagagttccgtgatacttggacgtttgtgaaccgcagaataaaggatgctcttgatctttagaaaaccttccaagaggccgcatacctcgctgaagccgtgggagcaggcat

SEQ ID NO: 5964 - DNA, 347 bp, Zea mays
  Clone ID: LIB3279-055-P1-K1-G12
gcggaaatccataggttggctacacacaacgtggttctatatcaaaaactggaagggggatactaccagctgcaccacatgtgctagataccttgtacacccttgtgggtgttgacattgcaatagcaattgcagctcctcgctcaaggaagagccttgaagaaggcatcaaaactgatgctctagaaggctacttagatgctataattgcattgtgatgacttgtgcctagggaaacctgatggtgagatttacgaagacgtatgcggagcaacttggactggagccagatgtctgtgtagcgtttgggaactcaaactcgccgacggactctgcacataactctg

SEQ ID NO: 5965 - DNA, 191 bp, Zea mays
  Clone ID: LIB3279-055-P1-K1-G2
gccacactatttactcaactatagaggagtacccgcccaacgtcaacggactggggctcttgccctataccatcttctcctccaatctcctcagtttcaacatcatccactaatactgataaatccatcgcgaagggtattcttttgatcgacttcaagcacattttataatacatgcacttggaaactct

SEQ ID NO: 5966 - DNA, 197 bp, Zea mays
  Clone ID: LIB3279-055-P1-K1-G3
gagctgaaggctgcctgccctgtgttgtgtctgttggctccatctagagagctactagtggtcggtctatggacgcggaagggacttctacaacggtggcgtctccggggcagtggccgcggcggcccaagaacggcggtggcgcggtggctgtgcccaccacgaggagagtagtgttttgagcaaccggggggggg

SEQ ID NO: 5967 - DNA, 308 bp, Zea mays
  Clone ID: LIB3279-055-P1-K1-G4
gccatgcgagcggtcagcgttccacgccacaggcgaagaggaccctcccgtggtggatgactcctactactcacaaatcaatgggggattacgggtggcacggtgtacgagtcggccaccacgttcgaggatctgaagctgtcatccgagctgcttaaggcgatgcacgacgagatggcgttcaaccgcccgagcaagagccaggcgatcacgctgcccatgatcctcacgccgccctacaaggaccttagattccaggcgcacaactccttttggaaagaccacctgtttcgaaactttgcatgctc

SEQ ID NO: 5968 - DNA, 371 bp, Zea mays
  Clone ID: LIB3279-055-P1-K1-G5
gcagcaggcgaagcatcgccagattggtatatcgatcgattgatcggtggcggaggaaggggaggacggggggcagaggcggcgtgccggggcttcttcgagtgcctgctcaggctgctcaacttcatcctcaccgtcgccggcctcgctatggttggctacgggatctacctgctcgtcgagtggatgaagatatccgaggacggcatcggcggggcatcgacggcggaggtgctcgtctccggccggccgttgttgggggctatcgttctcggtgacagcttcctcgacaatctacccaaagcatggtttatttatttgtttattggtattggcaccatcgtcttcttcgtgtctctgtttggctgcat

SEQ ID NO: 5969 - DNA, 372 bp, Zea mays
  Clone ID: LIB3279-055-P1-K1-G6
attgtagttgttattcaatctcactgttattgtgtcattctccttgaggtcaaagtatagtctgccatataactttctaacgtcggaagtgctgcggtccgcatccaaacaatgaggtcctcttgctcactcaacgggatctttgggttaagtgttgctccacctttaagtgcaccattctggaagttgctcggatagacatctttaccaaatttatgctccctatcactcttccaggagatgtctctcttgtccactgtcaagttctcattaccacgagtgaaattatatgtatcattaaacaagctccaagcaataaggccgcaaggaacaattgcgtgcccattagctgtggtcttctcaggttcacaa

SEQ ID NO: 5970 - DNA, 346 bp, Zea mays
  Clone ID: LIB3279-055-P1-K1-G7
taaaaacatcgagctcgagggaacgtttgaccagatcaagcacgctagcgcaatggtcacagagttgatttccgcatcagtggtaaggtgcctccacaagcaaagaacaacccaggcagggggcctggttctcatgctgggggtcctgcaagcaacttcaagaccaagttgtgcgagaacttcaacaaaggctcctgcacctttggagacaggtgccactttgcccatggcgaaagtgagttgcgcaaacctgctgctgcttgatagatgtgtttagtgtggcttgcggtgattactctgcctgtgtggctgaataacaccacagtcgcctatggtgagatgtact

SEQ ID NO: 5971 - DNA, 361 bp, Zea mays
  Clone ID: LIB3279-055-P1-K1-G8
gcgtccgcctcccctaccatctagggtttctagggttttcgaggaggaggaaatggcgtctgatagggtgtcgggactgtgaagtggttcaacggaaccaagggcttcggtttcatcacccccgacgacggtagcgaggacctattcgtccaccagtcctccatcaagtccgacggctaccgcagtcttaacgacggcgatgccgtcgaatacaccgtcggcagcggcaacgacggccgcgccaaggccctcgatgtcaccgcgcccggcggcggcccgcttgccggcggggaacgtcccgacggcggcaacggcggtgggcgaggcggatacggcggcggcgaccgcggttacggcggcg

SEQ ID NO: 5972 - DNA, 188 bp, Zea mays
  Clone ID: LIB3279-055-P1-K1-G9
aaaaaaaccaagaactgaacctggtgatagcactcagacaacgaagcaggctacaacgcatttactgtgaacagcagtcagcccacaagctttcacgggtgaacaccacgccgccgcactggaaaaagaacaaactctgtatttattctaagaagatcaaactaacattctggcatgtttgatggggg

SEQ ID NO: 5973 - DNA, 362 bp, Zea mays
  Clone ID: LIB3279-055-P1-K1-H1
cctgatccagatccaggggcttgtcatggcatccaaacctatgctaaaggagttaaaggacttgcaaaaggacccccaacatgatgcagtgcagggccctggtggtgaggatatgttctactgggaggcaaacatcatgggtcctgctgatagaccatatgctggaggtgtattcttggtgaacatgttatttgccgccagactaccccttgaagcctacaaaggtattttttaagacgaaggtcttacatccacacattaatagtgatggaagcatatgtcttgacattcttaaggagcagtggagccctgctttgacaatcattaaggtgttgctttctatctgctaactgcttactgat

SEQ ID NO: 5974 - DNA, 207 bp, Zea mays
  Clone ID: LIB3279-055-P1-K1-H10
ctcactcctcaccatttcccaaaccctacccaatcccccggcggccgccgccgcattgccgccaaagttgacccgtccaagggggggggggctttcttccggtgaccggccgggagggtcggcccggcttcttccttggcgccaaaaatcggcccgttcggcttttcccggaaaaaaatcgggaagaccatggccaaggaaacggcc

SEQ ID NO: 5975 - DNA, 331 bp, Zea mays
  Clone ID: LIB3279-055-P1-K1-H11
ctaatcccacatccagtctctgggcacaaaatttccggcggcgatggcggcggctgtggcgaggacatggttcggcgcatgttgtgcggctctgccttcgcgccggcgaaggcgcgcgccgtgcgccccaaggcctacccatcaagaaacctctgtttgtgctgttcaagcacgcgtaccacaagtgaatgactcagagaaccctcaagggcgggaggggactgtgtgcaacctctaattgtgaccgaccgaagcagcgggcaatgtaagggataggcctttggaaggtctgcttctactcaataggcacacagagccctagagggaccgg

SEQ ID NO: 5976 - DNA, 350 bp, Zea mays
  Clone ID: LIB3279-055-P1-K1-H12
tcgctcacgcgacagtgctgctattaatgaactcgccccgccctccatcagttagataatcggagcggattctgtgcgcgcaacgtctgaaagaactccgcgggaacataggcaaccgtgggcttttcggctgaactaacagtacttgattggattcctcgccgtactaactgttatgcttcaccctgaatccacgaggtcagatgtcttctgagcaggcttggtgccgcattgagtggataaggattctccttgtggcccgtcatacaaaatttgctgcatgattaacactccatccagattgatcataaaagcagatataaaccgtctgcattgtaaggtgtgacatg

SEQ ID NO: 5977 - DNA, 372 bp, Zea mays
  Clone ID: LIB3279-055-P1-K1-H2
tgcaagtaaaactcagcctgctaagagagctgcttcaaaaatgaaagatgaatcaagtgatgactcagacactgataggatgaagaacctcctcaaaagaagcagaaggaagcactttcagctgcaaaaaaagaaagcagcagtgaggatgaagatgacagtagtgaggaaagttcggatgatgagccaacaaaagttgaagaaaagaaggctccaaaagtatcagaaaacagtggatcggaggatgaatcttctgaagacgagagtgataaagacagtgaagagcctgctaatactccaaagaaggctgctgtgcacgcctctgaaaagaaaactgctaccaaagaacctaagacgcctactggctcccaa

SEQ ID NO: 5978 - DNA, 366 bp, Zea mays
  Clone ID: LIB3279-055-P1-K1-H3
cgctgatggggttgttgcgagcggaggaataatcaatatgatgggcacttatcagatagctcttgtggctcatacatggacaaacctgtttatgtggcagctgaaagctacaagtttgctcggctatatcccttggatcaaaaggacatgacgccagctcaccgaccaatagattttggagtcccaatacccattggtgtggaagtggagacatttggaagagactacacacctccccaatatatgacactcctcctgaccgaccttggtgttctgacgccgtctgttgttagtgatgagctcatccaactgtatctatgatctttgccgcaggcgccgatgtttcattggcatgtaacatctaca

SEQ ID NO: 5979 - DNA, 351 bp, Zea mays
  Clone ID: LIB3279-055-P1-K1-H4
tgaataactaccgtgtcggctgccttccccagttcccctcctctccatttctccccttctgaccacccatggcgctcgcacccagtgtctctgctcacccttggcgaccgaacaggtgaaccacccactcctttccgccgtcctctaagggccatccagttgcacctacgcgtgagctctcccttcaacactccagtgcccgagctccctcccctgtggcctccgctcggtgcgcccctctctgctcctctgccgtgtccctgctagcgcctgccgtcaaccacccgccgtccgagcagacaccgggcgccagcaaactacgtggaggctagctagaggtgccggggatcc

SEQ ID NO: 5980 - DNA, 313 bp, Zea mays
  Clone ID: LIB3279-055-P1-K1-H5
cgagtactggtactctaacagatcttggattccttgtgcttcacagaatcataccttgaatacccatgtgatattaagctacaattgaaagctccgtcacgaagctgctggagaaccatgtcattgaatcaaaagacgctaatattctagaacgcattaagctctcctctagcctgtacactgactgtggtaagcatgcactaactcctctcaagccgagatgactttatgatgtacatgtagctggtgctgatccttgctcagatcttcattgtcagaagctcaatgagatgatcattacgtactatatgag

SEQ ID NO: 5981 - DNA, 224 bp, Zea mays
  Clone ID: LIB3279-055-P1-K1-H6
tcgagactgcctaacattacaaagtttcaatgcctattatcgctcccacccctatcgttcagaaaatctgagcggattcgatgcgcccaagggctagaagaagccggcggcgaaaaaagtggcggaggaggagccctctgagaaggcggctccggcggagaaagcccccgcggggaagaagcccaaggcggagaagcggctacctgcgggcaagttcgccggca

SEQ ID NO: 5982 - DNA, 364 bp, Zea mays
  Clone ID: LIB3279-055-P1-K1-H7
cccacgcgtccgcccacgcgtccgcccacgcgtccgttggagttgagctggtgacagaccgtgagaagaaaccccagccaaagctgagatctcacgtgtcatgaaccatatgaaagatatgggagtgttggttggtaagggtggtttctacgggaacgtttttaggataacaccaccgttgtgcttcaccaaagaggattccgacttcttcattgaggtgatggacattgcgctctcgaagctgtgaggcaggcagggcgaagatgatgtgtaaaccctggtccgtggccatgggttttttgcccatgaataatattaagattagtgagacagcacctcgttgtctcttaatctaagacgatgc

SEQ ID NO: 5983 - DNA, 299 bp, Zea mays
  Clone ID: LIB3279-055-P1-K1-H8
cccacgcgtccgtccacacctttttagctgactgatcggagagttactcctaggcaactcttgtttctagtttgcaaatggtgtctgaaactatgcgtttgctgcggcataacgtgtacttaattgttcgtgataggtgtgaataacacatggatggtatcagtgttgtcacaaaagaccaccttaaatagagaaaattacggcttctaaatagaagaaaacaacattgcgctgttgaatctttttgacacgcaaggcggaaataatgggtaaaccctgtttttcttccatgaaagttt

SEQ ID NO: 5984 - DNA, 351 bp, Zea mays
  Clone ID: LIB3279-055-P1-K1-H9
atagtcccaaagaatataccaagagacatgaaccttcaagagaaactgataataataaggtatgacctgttgaatccttgttttatacatacatatgtgggttcctgggaagtttggaagcaccggaattcttgtttatttgaaggaactctgcctattatccatgcgctccttcagaccataggagatgagtgcagtttatggtgcatggctggagcatcaaagtttagtgaattactcgcaaggtcgttggtctagattgtctaatatatagagtagtttatttgatcagcagatcaggttctggtcatgtatagaaccactcaccccttcctttttcggttagggtgg

SEQ ID NO: 5985 - DNA, 220 bp, Zea mays
  Clone ID: LIB3279-057-P1-K1-A1
tcggaaaaattccaataagaaacttatagtaatagatcggactgcagtgtgtggtggcagtggctacaatgaaagaacacggtctttcaattgaaaataccatggcaaaagcttgaataatgtaaacccttaaaatgttaacgtaacattcaagtagctgagcttaaaatcatgagctagtccataaaccaccaaaagttgaaacaccgaaaggggttta

SEQ ID NO: 5986 - DNA, 350 bp, Zea mays
  Clone ID: LIB3279-057-P1-K1-A10
cccaactcgatctcgcacctagggtttcgtctcgccgctctcgtcctccgcgaagatgccgaagaacaagggtaagggaggcaagaaccggaagcgaggaaagaacgaggctgacgacgacaagcgcgagctcgtcttcaaggaagacgggcaggagtacgcgcaagtgacccggatgctcggcaacgggcggtgcgaggccatctgcgtcgatggcacgcgccagctctgccatatccggggtaagatgcacaaaaaggtctggatcgcggctggggacatcgttctcgtcggcctccgcgactaccaggacgacaaggccgacgttattctcaagtacatgaacgacg

SEQ ID NO: 5987 - DNA, 387 bp, Zea mays
  Clone ID: LIB3279-057-P1-K1-A11
cggacgcgtgggcggacgcgtggggaatcaattaggtgcattgttttggcaatagacatgatggcaaccggagaagatcggtgggactatgtatgttgttgtacaaatcgagactaccataatggataatggagtggacacactaataataatatagcagctcaactattcagcggaaggaactataccttgtctgatctctgtatacccggatctttctgtctatatcaaccattctttcattctcccaaccctagctgtttggcacctttagatattttttagtgtcgttactgtatatttggcctattatttctctcaactccacacatgctcatgtcaggggcgattagatcttggtcctattatattatgttggttcctatt

SEQ ID NO: 5988 - DNA, 402 bp, Zea mays
  Clone ID: LIB3279-057-P1-K1-A12
cggacgcgtgggcggacgcgtgggttttttccctcttgtcacagcaccgcccacccacacacacccaaggccccaactgcagtgcccatccggcagtcaggtcgatggcggtggaagcagcggcagcggggaaggagaagatgcggacgctagtcagcagcgacttcaagaagttcgatgtggaggagtctgtggcgagggaatcgctgattatcctgaacctgatggcggactgcgacgacagtgacatcctggtcttcaacgtcaacgccaagatcctcgacaaggtcatcgcgtactgcaggaagcacgcctcggtgccgcgcgccgatggcggtgatgcggagccaagtgctgtgagtaacaaggtctcagcggacgatctcaagtgctttgatgctg

SEQ ID NO: 5989 - DNA, 108 bp, Zea mays
  Clone ID: LIB3279-057-P1-K1-A2
tcggaaaaatttcaattagaaacttaaggaaatagcaccggactgctgttggagctgacagtacacacagatgaagaacacaatgctccattgaggaaaagaaggcca

SEQ ID NO: 5990 - DNA, 82 bp, Zea mays
  unsure (1)..(82): unsure at all n locations; Clone ID: LIB3279-057-P1-K1-A4
cccacgcgtncggatgtgatttcccccctacctgaagctcgacgtgatctgctctaccgacggcgcagaagcatgggttcag

SEQ ID NO: 5991 - DNA, 408 bp, Zea mays
  unsure (1)..(408): unsure at all n locations; Clone ID: LIB3279-057-P1-K1-A5
gtccgcctcagcccgccgccaggagagccggctcggtcggttcgtcgaagatcccggatctgctctgtcacgaggtctttcggcgggtgttgtctcgcgaggtgtagcgagccaagttcaggagagtttcgagaagctgaaatggctcctaaagctgctcctgccaagaagggtgatgccaagacccaggccttgaaggttgccaaggctgtgaagtctgggtcagtaaaaaagaccaagaagatccgcacgtccgtgacatttcaccgccccaagaccctgaagaaggctagggaccccaagtacccaagaatcagcactaccggaaggaacaagctngatcagtaccaaattctcaagtatcccctcaccacagaatcggcgatgaagaagattgaagataacaac

SEQ ID NO: 5992 - DNA, 411 bp, Zea mays
  Clone ID: LIB3279-057-P1-K1-A6
cacagcgccggcaaccgccgccatcgatcgatcgcccggaaactgacctctaccgatgtctggagccggcgaggaggataagaagcccgcggagggcggcgcccacatcaaccttaaggtcaagggacaggatggcaatgaggtgttctttcgcataaagaggtccacccagctgaagaagctgatgaacgcctattgcgaccgccagtctgtggacatgaatgccattgcattcctgtttgatggccgcaggcttcgcggcgagcagacccctgatgagctggagatggaggacggcgacgagatcgacgccatgcttcaccagaccggaggcagcgttcctagcaccacctaaaagcagcagctgcggagcctcgttttgctctccgccctgcgtagtactaaacaaaa

SEQ ID NO: 5993 - DNA, 265 bp, Zea mays
  Clone ID: LIB3279-057-P1-K1-A7
tcggaaaaattccaataagaaacttaaggaaatagatcggactgcagtgtctgctggcagtggtaacagtaaaagaacagtgtcatccattgaagattacagtgcagaaggctcaagcgatgtaaacgatcagaatgtgaacgaaacgtccaggaagcggagctcagatggtggacctggcgcagaaaccaccacaggtggaaacacggaatgtgttttagctcctaaccatacgctggggaatgctaccattttgccacaacac

SEQ ID NO: 5994 - DNA, 235 bp, Zea mays
  Clone ID: LIB3279-057-P1-K1-A8
gtctaaactcgagttttgggcacacagggctatgttgcaccagaatacgcatggactggacatttgactaccaaatcagatgtgtacagttacggtgttgtgcttttggaattacttactggcagagtaccagttgatatgaagaggccttctggagaaggtgttttagtaaactgggcattgcctatgcttactgaccgagaaaagtttgcggatcttggatccagcattggaa

SEQ ID NO: 5995 - DNA, 203 bp, Zea mays
  Clone ID: LIB3279-057-P1-K1-B1
cggacgcgtgggcggacgcgtgggatctgcttgaaacggttgccctgtcaatcggtgaatggaataagccaagtctgttctgggttgtttgcttgttcagtgatgtgtcttctatgacgaaagttgagtgcctatgtgtgagcatgcttgcttgtaacgagacattgaattgttcggaaatgagcattcctgtgctttttttg

SEQ ID NO: 5996 - DNA, 386 bp, Zea mays
  Clone ID: LIB3279-057-P1-K1-B10
gcaagatagtggatttgatccaacaggatgggaacttgctcttgttactacaagcagcaatgcgattccactgtctatggagagtaatttgggtggtggatttgacaagctcacattggacagcctatacgatgatggaacctacaggcagatgcagcaacaacagctatacggatcagcccctcccaatccattcatggcaagcgatcccttagccgtatcaaatcaagtggctcccccaccgtcagttcaaatggcggccatggctacacagccccagcatttgcccatgatgattgaaccaaatcccttcggaccaccacagcaacatcacgcgggcgtcgctcctgcagcaaaccccttactcgacgccgggttcggtgcgt

SEQ ID NO: 5997 - DNA, 363 bp, Zea mays
  Clone ID: LIB3279-057-P1-K1-B11
gatccagttggttgctacaaggagatatatcgtgtgttgaagcctggccagtgctttgccgtgtacgagtggtgcattacggatcactatgatcctaacaatgcaacccacaaaaggatcaaggatgaaattgagcttggcaatggcctgccagatatcagaagcactcggcaatgtctgcaggcagtaaaagacgccgggtttgaggttgtttgggataaggatcttgctgaagattctcccttgccttggtacttgcccttggatccaagccgattctccctgagtagcttccgtttgacctctgtgggacgcatgattacccgcacaatggtcaaggccctggagtacgttggtcttgct

SEQ ID NO: 5998 - DNA, 379 bp, Zea mays
  Clone ID: LIB3279-057-P1-K1-B12
aaaagtcgtgtgcgaatgcgtcttatagttgtgaaggaataagaggagacagatgggttgaagcgtgatacagttcttgctgcttgtcactctctgatctggtttcgttgtagataagatggttgttaatggtttgagtttgaggcacgatccgccttattttctaccgatctaaagccggggtgtaacaattttgaattattctggttttgggtttatgtttatgcgatgtattggctggtagcaattctgcattgactgcataacaaccttaatcagctggtaacaattcttggacgtttttatattattactagttgtgcgcccgtgcgttgcaacgggaacatataataccattgatggcttatgtacgttggga

SEQ ID NO: 5999 - DNA, 407 bp, Zea mays
  unsure (1)..(407): unsure at all n locations; Clone ID: LIB3279-057-P1-K1-B2
cggacgcgtgggcggctccaccgagctccccgatccctccgccccaaatcccacacacccggttggccaccgcctcgctatggatttggatctgtggatctccaaggtcaaggagggtcagcacctcgcggagcacgagcttcagtccctctgcgaatatgtgaaggagatcctcatcgaagagtcgaacgtgcaaccagtgaacagccccgtgacggtttgcggtgatatccatgggcagttccatgacctaatgaagctcttcgcgacggggggccacgtcccagagacgaactatattttcatgggtgattttgtggaccgtggcttcaatagtctagaggttntcaccatcctattgctactaaaagcgaggtatnctgcacacnatacccttctgcgtggaa

SEQ ID NO: 6000 - DNA, 305 bp, Zea mays
  Clone ID: LIB3279-057-P1-K1-B3
gtgaaggctgttgctgtgcttggtagcagcgatggtgtcaagggcaccatctttttcacccaagagggagatggccctaccgctgtcaccggaagtgtctctggcctcaagcctggcctccatgggttccatgtacatgcacttggtgacaccaccaatggatgcatgtcaactggaccacactacaatcctgcgagcaaggagcatggggcaccagaagatgagaaccgccatgctggtgatcttggaaacgtgacagctggagcaaatggtgttgctaatatcaatgtcaccgacagccagat

SEQ ID NO: 6001 - DNA, 412 bp, Zea mays
  Clone ID: LIB3279-057-P1-K1-B4
ctctcaaaccctagccgcctcctgcaagtttcagagctcaagaatctgcgccatggcgagtgagacggagaccttcgcatttcaggctgagatcaaccagctgctctcactcatcatcaacaccttctactccaacaaggagatcttcctccgcgagcttatctccaactcttccgatgcgctggacaagatcaggttcgagagtctcactgacaagagcaagctcgatgcgcagcctgagcttttcatccaccttgtcccagacaaggccacgaacacgctctccatcatcgacagcggcatcggcatgaccaagtccgaccttgtcaacaacctcggtaccatcgccaggtccgggacgaaggagttcatggaagcccttgctgccggcgctgatgtgtccatgattggc

SEQ ID NO: 6002 - DNA, 403 bp, Zea mays
  Clone ID: LIB3279-057-P1-K1-B5
gctgggcctcagatgctagctagctcttctccacgtttagcttccaatccgtccatctctctgcagactgcaggggtatttcttgtagttcagctcatgagtttcacaagacttcatcacacggttaaactacaaattgtgcgagacaaattagtagcgatactgttgaccagaattttggaaataaaccggctccaacacctacttgcaaagatatttggaaccggtgaccagctgcacgacgatgaatcctacaagacgaccatgtaatacacagtgtcgtcctcttcgttctactactcaacagagcagtcgccgaccaataacgaatggagtacctccgcgtgttcgtgatctctgtcactgccaacatcatatctatgggattgatgatattcttgat

SEQ ID NO: 6003 - DNA, 356 bp, Zea mays
  Clone ID: LIB3279-057-P1-K1-B6
gtggtcaccatggaccaaaccctacccatacccccggcggcggcgacggcaagcgggccaagctccacccgggggacgcggtggaggttttactacggctgacgggccgagagggaggaccagcatgagacctggcacgcaagagcggcccggtgcaactctatccgaagaagagcgtgcaagacatcggccaggagacgggcaaggactggaaggggctgcgcgtaacagtaaagctcacagttcagaaccgccaggccaaggactacgtcgtgcgctccgccgagcggctcgagatcaacgcgctcaaggagcccgagagggaccggaagaaggtcaagaacatcaagcacagc

SEQ ID NO: 6004 - DNA, 75 bp, Zea mays
  Clone ID: LIB3279-057-P1-K1-B7
ttttcccccacgtgcgccgccgcgaccttcctcgatcccatctcccaacgcccccgcctcgcctcgggatcccgc

SEQ ID NO: 6005 - DNA, 284 bp, Zea mays
  Clone ID: LIB3279-057-P1-K1-B8
cggacgcgtgggcaggaaacgtcatcattttcagttctgatgccaagggagaagtgactggtcattggtatggttatgttgttcctgatgatgtgcctgttttgctgcataaacatattggagaaggagaagttgtggaccatctatggaggggacagatgggtttatctgtggagcaacagaagcgagctctcgagcttcggaacatggtaaatggtggcgaagaatcccttgaagaaaccagaacagatggtgcttctttcaaccctgcagcagctggtgga

SEQ ID NO: 6006 - DNA, 311 bp, Zea mays
  Clone ID: LIB3279-057-P1-K1-B9
cggacgcgtgggcggacgcgtgggcgttcccaagccagccattggttggtagcaagccaagctaatcaagttagctttagatacccgctcccgctcttcttccctccgacgaaggcagctgacgacacagcaggctagcttcggagttcggagcactcagccatggccattgccggcgctctcctcctcctgctcggactcctccccagcgacgacggcggctggtgcaacccgccgcgcccgcacttcgacatggccgagccggcctttctccgtatcgcgcagtaccgcgccggcatcgggcccgtcgc

SEQ ID NO: 6007 - DNA, 417 bp, Zea mays
  Clone ID: LIB3279-057-P1-K1-C1
cctcccccggctctgtctgttgacttaccccgtcgagctttctagtcagctgctcccgttgccatggggaaggagaaggttcacatcaacattgtggtcattggccatgtcgactccggcaagtccacaaccaccggccacctcatctacaagcttggaggcattgacaagcgtgtcatcgagaggtttgagaaggaggctgccgagatgaacaagaggtccttcaagtacgcctgggtccttgacaagctcaaggccgagcgcgagaggggcatcaccattgacattgccctgcggaagtttgagacaaccaagtactactgcaccgtgattgatgcccctgggcaccgtgacttcatcaagaacatgatcaccggcacctcccaggctgattgtgcggtgctcatcattgactcc

SEQ ID NO: 6008 - DNA, 405 bp, Zea mays
  Clone ID: LIB3279-057-P1-K1-C10
gcagaagcaaaaaaagaaaggtcttgttgccgatggggagctcagggttctcgtggacgcttccggaccaccccaagctccccaaggggaaaccggtggctgtcgtcgtgctggacggatggggcgaggccaaccccgaccagtacaactgcatccatgtcgctcagactcctgtcatggactcgctaaagaatggcgctcctgagaaatggagactagtgaaggctcatggaacagctgtgggcctcccatctgatgatgacatgggcaacagtgaagttggtcacaatgcacttggtgctggtcgaattttcgcccaaggtgctaagcttgtcgatcaagctcttgcctccggaaagatttatgatggagatgggttcaactacatcaaagaatcttttgaaa

SEQ ID NO: 6009 - DNA, 406 bp, Zea mays
  Clone ID: LIB3279-057-P1-K1-C11
gaaaaatatgcagcgacttcagttaacctataatataggttggcgcgagggagtcaaggcgaacaagggaattaagggtctgtttggttcgtggctaactatgccacactttgcctaaggttagtcgttcgaattgaagaactaaccttaggcagaaaagttaggcaaagtgtggcaagtgaggctgcgatccaaacatgccctaaacctcctattccatctttccaaaccccaccgtctctattcctcttctatagttctatttataatcttgaacaagaaactaggacaaaactcctgcacttcatgtgcatgtcatatataataaagagctaaaaacatcttgaacaaaaaacttttaaaagagatagatttaagtgcatgatttttgcttagcttctgccct

SEQ ID NO: 6010 - DNA, 405 bp, Zea mays
  Clone ID: LIB3279-057-P1-K1-C12
tgcggactagctcacaagacaatactatttattctagaagaattcgacctctttgctcagggtaaacagaggttgctttacagcttacttgatgcaatgcaatctctaacatcccaagctgttgtcattggtgtgagttgccgcttggatgcagatcaactcctagagaaaagggttagatcccgattctctcataggaaacttttatttatttcgccttcgttggatgatatacaacggttggtggagcatttgcttatactggccaaagactcaggtttaccatcaaagtatatcgccgattataactcaagacttactagcatttttagtgataagaaattcaaaggttgtctcaactccctcatggatgctgatgcaacaacgagcaacattcaaagattt

SEQ ID NO: 6011 - DNA, 378 bp, Zea mays
  Clone ID: LIB3279-057-P1-K1-C2
agcacgactacaacatgatatgcaaggtcaaatccccagcggcaagcgaggagcctgcctcgttcgcctccagggtgtccagtttcttcctaggactcctctcgcagaaagggtaccgcggtgtgggcgccgagggcgtcaagaccgagctgtaggcgtcaagacctagcttagcacggtgccgtctcctctcaccgtctgcgagcacgatcaggaaccagactaacccatgcactaacccgcagtgtttttgtacggggcgagtcgaatgtgtaggacaccaccacaggaggcgccagttcggttgtctccagggccagacgcctctgatactgtagtagcaataacataaataataaatgtgtttcaattcggact

SEQ ID NO: 6012 - DNA, 418 bp, Zea mays
  Clone ID: LIB3279-057-P1-K1-C3
cccacgcgtccgcccggttccgcgtgcctttccccacctactctcgcggctctcgccagccagtctagggtttcggtcccggcgtgcttatccgcccccgccggccatgtcgaagcaaggagggaaggccaagccgctgaaggcgcccaaggccgacaagaaggagtacgacgagacggatcttgcatatctgcagaagaagaaagatgaggaaaaagcactgaaggagcttaaggccaaggcacagaagggcgcgattgggggctcgggtctgaagaaaagtggaaagaaatgagactggtcacccgtctccaatacctagaggatgataaggcagctgtctatctgtgttgcgcttcactaagtgtgattgtaacagtggtacctcttgtgttctgagttccgcgatgttgcagtt

SEQ ID NO: 6013 - DNA, 385 bp, Zea mays
  Clone ID: LIB3279-057-P1-K1-C4
tgcaagttgtgaaacttgccgcgaaaccggaaggtgctgctcctgctagtgaagatgctgctgatcctgcaactaaagctggtgtttttgttgtcaatgatgctgctattgagcagggagttaaatgtatagcttctctctcaagtggtgcctccaagatggaggttacagtggagaattctcttgcaaatggaccgaccactgaattaggagtttccaattctcttgcaaatggaccgaccactgaattaggagtttccaagggcacgtcccttgctaatgaatcggctgatctgccaggggttacatgcattatgccagaagttacagacaaacctgttactgatctaggggttataagcaccgtggtggaagttagtgatac

SEQ ID NO: 6014 - DNA, 409 bp, Zea mays
  Clone ID: LIB3279-057-P1-K1-C5
ctccttcccggtctcctccgcccgttagccttcgtcccctccatctccggctgcgacgccggcgagcccgacaccgcgaatcggatccgccgacaaggcgagagggaagagatggggctcacgttcaccaagctgttcagccggctgttcgccaagaaggagatgcggatcctgatggtgggactcgacgccgccggaaagaccaccatcctctacaagctgaagctcggcgagatcgtcaccaccatccccaccatcggattcaatgttgaaactgtggagtacaagaacatcagcttcactgtctgggatgtcgggggccaggacaagatcaggccactgtggaggcattacttccagaacacccagggtctcatctttgttgtggacagcaatgatagggaccgtg

SEQ ID NO: 6015 - DNA, 392 bp, Zea mays
  Clone ID: LIB3279-057-P1-K1-C6
gcaacaaccagtgctgcgacggcgtgaggaccctgtacgcggcggcggacaccaggcccgacaggcaggccacgtgccggtgcctcaaggcggcctacgttcaggtccacgctgtgctctccgcggcgcaagagctgcccggcgactgcggcctctcgctgtcctacaacatcacccccgacatcgactgcgacaagatcgaatgaagggatactgttcccttaccagaatccatacgacgggatggtgatgttcagtgccctgctagcagtaggctgcatctgcactgagtgactagaataaaggatttggtgatgtttgtgctgattggtgtgttcgcctgtaatcgtgtgatgccgtcgttggcttcttatatccgtgtctaatctcgc

SEQ ID NO: 6016 - DNA, 410 bp, Zea mays
  Clone ID: LIB3279-057-P1-K1-C7
gtctggtcagttccttcgcgcaccggcaccgcggcggcagttcagcatggtggcagcatccgtagccgagcgggcctatgaggcggcgacgcggtccgcgctggtggcgctggagcgcaacctcatcccggacgcggtgacccggcgcctgacgcggctcctgctagcgcagcgcctccgccagggctacctcccctccgcgccgctccagctgcagcagctcctccagttcgtccactctcttgaagagatgcccattgccattgaaacagacaaagctaaagcccaacactatgagttgccaactacatttttcaagctagtgctgggaaagaatctcaaatacagttcctgctatttccctggtgattcaagcaccctagaagatgctgaggttgcgatgatggatc

SEQ ID NO: 6017 - DNA, 407 bp, Zea mays
  Clone ID: LIB3279-057-P1-K1-C8
cgatcccagcatccgagagagctccacaggccaggtccccatcgccgcggcgcttagccccacctctcccccgcccggtagtagcctcgccgccgttgccgagatggggttcgtgtccttcgtcgggagggtgctcttcatcgccgttttcctcctctccgcctaccaggagtttaatgaattcggtgctgatggtggaccagcagctaaggcccttcggcccaaattcaacgtgtttgtcaaaaatgtatctgctcatctgggagtagctgtgccacacattgagttgaagcatgtgattgctgctacaattggtcttaagggtcttggaaagctgctttttattttgagcagctctctcggtgcttatctcctgctgctgtaccttgctttgatcactcctatca

SEQ ID NO: 6018 - DNA, 369 bp, Zea mays
  Clone ID: LIB3279-057-P1-K1-C9
cgccgccgaacccgccaccagccttctcccatcctcgaagcacggaaggctcccagaaggagctctcacctcgcagccatctctggcacgtccgtccttcttctccctcggtccctccccttctccacagctatcggattggcgttggagtggagatcgacccgggctcggaattcccttcgttggtaaggaaccctaatttggtcagatgggatttccaacttcgacaaagcccgcgaggtcgatcgatctcagttgacgcgagggattggaaaactaagttgcgggtgtagttaattttctaggaagattggggtttcagctcaaactcccatgctcgacgctgaggacgacccttgcgggagatga

SEQ ID NO: 6019 - DNA, 416 bp, Zea mays
  Clone ID: LIB3279-057-P1-K1-D1
cggacgcgtgggcggtacaacatgggtgcaggtgtaccgtcgtctctgggtcatggacatgcagcggatcaccccattataggtgaacggctccaccgtgaacgtgggcatccacccctccaaggtgatcgtcaccaagctgaagcttgacaaggaccgtaaggagctcattgctctgaatgtcggcaagcttgccgttaagttagttaaaggcaagtttactgccgatgacgtcgctgccgccgtcgctggtggctgcttcaccttagcgggagtcaatgtgtcaactatagtcttcacggtcatctgatggttgtcgtaccgccttttcctcatctcttgagtgtttgctgccaagtgagatgcttagatgtcttattttatttgaaaactgctctgtgcctggatgagagttt

SEQ ID NO: 6020 - DNA, 406 bp, Zea mays
  Clone ID: LIB3279-057-P1-K1-D10
agaagatatagtagtgggagtagtataggagaaacaaaacatcgcagcgtagttcctttttttttactttgtttgtttgtttgtttttttaccatgaaaccaaaggtcagcagatggcagcagcaagcaacagattatagcgcttgctctcctattacattacattacatgatgcatttagcactaattagtagtagttactattaccagcccatctaggtagctgctcctccatgaccatgatatgcacagcagtactaggggggaggaggggtgtgtgatgcacaagaagatgctgctgctacccacatgggactacactggatgcagacagacgtgacagaccagctggtccagcgtgaagatctcacaggattagaagaaacaaacgagtcccggtcccacc

SEQ ID NO: 6021 - DNA, 403 bp, Zea mays
  Clone ID: LIB3279-057-P1-K1-D11
ctacagttatcggataaagcatcttcatttctttcatcaggaaataaggctgaagcaggttctatctacaagataatcgaacaattagagagaaatctgtaccatgctttctcaactactttgctgcacacgtgcgaaacactattgaagatatatctggaattacaagattggtggactgcattgacatactgtagattgacaattcctgtttatgaaagagtttatccaccttttcatccgatgattggattacaattctatacttgtggaaagcttgaatggttgcttgagttcacagaggatgcactaaaatctttaaccagagcagcagatatacttaaagtaacacatggcgtaaaatcccagttcatgaaagagctctttggcaagttagaggaag

SEQ ID NO: 6022 - DNA, 379 bp, Zea mays
  Clone ID: LIB3279-057-P1-K1-D12
ctcaggacttcaagacggatctgcggttccagagccacgccgtcctggccctccaggaagccgccgaggcctacctcgtcggtctgttcgaggacaccaacctctgcgccatccacgccaagcgcgtcaccatcatgcccaaagacatccagctcgcccgccgcatccgcggcgagcgcgcgtaggcgtatctcgcgcccggccccagtggcggcggagggatggaggagtgcaatttgtaactttatgctgtttgttcgcttttagacggcgtggcgaagtagtgtaaaaacggctttacaagtctattttgtgtggtagttcgtgtaccgcttcgtcccgaagcgatcttggtaaaagactgatgattcgtgttgcc

SEQ ID NO: 6023 - DNA, 385 bp, Zea mays
  Clone ID: LIB3279-057-P1-K1-D2
cccacgcgtccggttgatggccacaaactcatccaaatcagaaatccatgggcaaatgaagttgaatggaatggaccatggtcagactcgtcaccagagtggacggaacggatgaagcataagctcatgcatgttccacagtcgaagaatggggtattctggatgtcttggcaagattttcagattcactttcggtcaatatatgtttgtcgtgtttatccacctgagatgcgttactctgtccatgggcaatggcgtggctacaatgcaggtggttgccaagattatgactcgtggcaccaaaatccacagtatcgacttagagtaacaggacgtgatgcactataccctgttcacgtttttattacccttactcagggtgttg

SEQ ID NO: 6024 - DNA, 415 bp, Zea mays
  Clone ID: LIB3279-057-P1-K1-D3
tctttttgctggaaatcacttgaagaaggacaacagactagctgattacaacatcatgacaaattcttgtgtccacctttatgtaactgatgggatacatatatgtcagtatccccatgtttgggatcccatagtgtttgctaatgtcaaggcggtgatcgaatagatagggggagttcttcttgatgaacaaatcttgatgcatggatgccaaaagcttgaggacaacaagttgctgagtcaatgtagtttgagcaatggccacacactgcatgttttggtctaccccactaaaaagatgcatatttagtacgtgaagcactgcaaccgctacaagaaccccattgtcctgtgctaggtccgcgagatgcttagctgctacgacctcgccaagttcgagctctgcacgctcgac

SEQ ID NO: 6025 - DNA, 414 bp, Zea mays
  unsure (1)..(414): unsure at all n locations; Clone ID: LIB3279-057-P1-K1-D4
gacattgagcaagtaaaagctgatgctgagggcctggcaaagaaactggaagcacttgaagcttacaaaagaaaacttttgggtgagaggttggaagaatgctcctttgaagaactgcacagtttggaagtgaaactcgaaaagagccttcattgcatcaggggaagaaagactcagctgctggaggagcaactccataagctgaaggagaaggagatgaatctgcgcaagagcaacgaagatttacgtgaaaagtgcaagaagcagccgccgccgccgccgcctatgctgatggctcctccgccgcctccagcgccggcagccatcgatcacacggagccgaaggatgtcgggatggacgtggagacggagctgtacatnaggatgcccggcagagattaccgctcaaacaac

SEQ ID NO: 6026 - DNA, 394 bp, Zea mays
  unsure (1)..(394): unsure at all n locations; Clone ID: LIB3279-057-P1-K1-D5
ctccgccgcccaccacctccatccccctcctctctttatacgccaccgcggcggggcttcccccatccctctgtccgttcgctgcattgctcccctaaccgttcggccaggagacagcggagagggcagagatggcggccgcgtccttcaccgccgccaagttcctggcgccggtggccgcgagatccggcggagagagggcgcccccgctccccgccggcgcctcgtcctcctccttcgccaggaccctgcgccgcggcgcggtgcaccacccgcgcctgcgcaccgagctcgccgtctcctccgacctgctcgctgggaacaaggccgcgcaggccagcgccgcgcatncggcggttacacgggaagaggcactggagctgtatgaggacat

SEQ ID NO: 6027 - DNA, 411 bp, Zea mays
  Clone ID: LIB3279-057-P1-K1-D6
cccacgcgtccgcccacgcgtccgagcagcgcatgactttgtatctgcaactcgtttcgactagcctgcacgccgggagccctcgtctcgcccttctccacctccgaagatcctgcgagttcaacccgcgagtgagcatgtcgtcctactccccgccgccgccgccgccgcgggaccagtccatggacaccgaggcacccaacgcgcccatcaccagggagcggaggctcaaccccgatctgcaggagcagctccccaagccatatctcgcgagagctctcgaggcggtggacccgagccacccgcaggggaccaaggggcgcgacccccgcggcatgagcgtgcttcagcagcacgccgccttcttcgaccgcaatggcgacggcgtcatctacccctgggagacgtttc

SEQ ID NO: 6028 - DNA, 394 bp, Zea mays
  Clone ID: LIB3279-057-P1-K1-D7
gttgtcgtttaacataatagtggctgatgctactactgccactggtggaaaggcttagcatcggtacattatctgcttgtaccaattgaacatgttgaggttctggtcgttggtgcaagctgcgtccgcaaaagctaagttctgttgaggtttcctagcacaatgctctgcattttgccaagtttggggttaagttgttttacacacagtatatgttagctggagtgaaacagtaagtagccttagactgctaaattttagtgggagtcaatctgtcaactattgggcatgttgaaagaactctgggcagccctggctgtggctactcctatgggtgataattgtggtggtaagatgcttatgcaatcaagcataaagcggttcagagggacta

SEQ ID NO: 6029 - DNA, 403 bp, Zea mays
  Clone ID: LIB3279-057-P1-K1-D8
gtggcttcctctcttcccctcctcccttggccccgtctcgtctgctccgcctcaccttcctctccaccttcctccctcccacccctccgcgcctcgccccaccgcgccaaccaaccaacacggcgtcccagcctgcctatataccgctccccccgcgcccccccacgcgcaaatccatatgctcagctcccgcctcctcccatccccggaccccggaccccggccatgggcgcctgcttctcctccggctccgccgcccccgccggcgccgccgtcgacgagcgccgtccttccaaggagggcgacggcaagaagaggcgccgggcggccggggcatcgcccgatggccgggcggccgtgcgcgtggagttcggctacgagagggacttcgaggcgcgctacg

SEQ ID NO: 6030 - DNA, 393 bp, Zea mays
  Clone ID: LIB3279-057-P1-K1-D9
gtctcctctccccatcttctctcctggaagccgcctcggtcggacccggacaagatggccgccttcttcggtgctgcaccgccgccggctctcgcttcgttccgccacgaggaggaggaggagcagcatcaggacgccgccgaggaggtgtaccacgtggacgatgtcgacgagggcagcggtgacggccgtggccacggcggcgccggccaggggaagctgtgcgccaggggccactggcgccccgccgaggacgccaagctcaaggagctcgtcgcgcagttcgggccccagaactggaacctcatcgccgagaggctggacggcagatcagggaagagctgccgcctgcggtggttcaaccagctggacccgcggatcaaccggcgcgcc

SEQ ID NO: 6031 - DNA, 360 bp, Zea mays
  Clone ID: LIB3279-057-P1-K1-E1
tgatcgaggccgctctcgcccagctagatgatgcctccgcgagcccgccgagcgtgatgagctactattagaatcggacaaccgtcacgctgacatgcacgagccggcctagctactgtggccgaccggtactgttccgtgcgcgtatataggaactaggaagaagtgggtgctttgtttgctatatatgaggcactaggtcaggggctttatgcaactttgatgtaatggaccgaaaacgacagattgagtgttggcggctagctcccatatgtttagagtctagggaaggaataaataatcgagacaagtcttatccctgtatttttgtagagaggtatttgaaacaagaagttcatc

SEQ ID NO: 6032 - DNA, 394 bp, Zea mays
  Clone ID: LIB3279-057-P1-K1-E10
ctttccccccaacaagtaaaccagatggtggagtggaccttcatgttaggatgatgcttgcacctttcaagtttcagaacattctgaatgagctcctcaattggtttctgggaagtcttgtaatagcttagcagcaagattagcgttgacaccaccgtagcagtagtcattgtcgtcaagtagttgtcctaaatgtctgtgctgggttatggatctcctgcaagcagttgcaggcttgcagctgttctgtttactctagtagtttattttggagtagtcgctctcaataaatctgtcctaggagtctattggtggattattagtcagtcagtttctgggattcctggtggtgaagcaaaacaatgttatggctatcggttaataataataagtt

SEQ ID NO: 6033 - DNA, 403 bp, Zea mays
  Clone ID: LIB3279-057-P1-K1-E11
ctcacctccggtccaccaacctctgccggccatggcggctggggcggcgcaaaagctcctcgaggcgagcacgaagatcatcggcgtcgggcgcaactacatcgcccacgccgaggagctcggcgacccgatccgcaaggagccgagtactactcctgaagccgaccttaacgttcctccacgctggcgtggccaccgccgccgctaaaatcccgaagccgctcgaatcgctacaccacgaggtcttgctcgccgtcgtcatcttcaggcgtgggcgagacattcctgaagcgtactccatggacttcggcggaggctatgcacttgctttgagcttttcgctgacaaaacggtggtaaagaagctggtgcccaacagacagaactgcctagccgaggagagc

SEQ ID NO: 6034 - DNA, 406 bp, Zea mays
  Clone ID: LIB3279-057-P1-K1-E12
cccacgcgtccgccggattccagagtccttcgctgacatgccttccctcagtgttcttcgtcttgcctataatcgcctcgaaggacggttccccatgaggatcttccagaacagaaacttgacggttgttgatgtcagttataattctaaagtatccggtctactgcccaacttctcatctgccagtattatgacggaactgctttgtagcaacactaacttctctggtcccattcctagttcaataagtaatctcaaagccctcaagaaattaggtattgcagcagctgacgacctacaccaggagcacctccccacttcgatcggtgagctcagatcgttgacatcattacaggtttctggggctggtgtggtaggagaaataccatcttgggtcgcaaattta

SEQ ID NO: 6035 - DNA, 400 bp, Zea mays
  Clone ID: LIB3279-057-P1-K1-E2
gttgcttaccatgtggtttggtgagagcgaagccaacgtccgtgaaatttttgacaaggctcgtcaatctgctccttgtgtcctcttctttgatgagcttgactcaattgctactcagagaggaagcagtgtgggtgatgctggaggtgcggctgatagagtgcttaatcagctactgacagaaatggatggcatgaatgccaagaaaactgtgtttattattggagctacaaacaggcctgacatcattgaccctgctctgctgaggccagggcgtcttgaccagctgatctacattccactgcctgatgagcagtctaggctccagatcttcaaggcctgccttaggaagtcccctgtggcgaaggatgtggacttgaatgctcttgctaagtacacg

SEQ ID NO: 6036 - DNA, 413 bp, Zea mays
  Clone ID: LIB3279-057-P1-K1-E3
gggctcttcgccttgatactggtaactactcatggggaagtgaagctgttacccgcaagacccgtatcctcgacgtggtctacaatgcatcaaacaatgagcttgtgaggacacaaacccttgtgaagagtgccattgtgcaagttgatgctgccccattcaagcagtggtacctcactcactatggagttgacattggtaggaagaagaaaacccctgctgcaaagaaggataatgctgagggacaagaggttgaggcagcagctgaggaaacgaaaaagagcaaccatgtcacgaggaagcttgagaagcgcaaggagggacgtacccttgacccacacattgaggagcaatttggcagtggacggttgctggcatgcatttcttcccgccctggacagtgtggccgagct

SEQ ID NO: 6037 - DNA, 363 bp, Zea mays
  Clone ID: LIB3279-057-P1-K1-E4
gcgagggcggcctggactacctcgggaacccgagcctaatccacgcgcagagcatccttgccatctgggcctgccaggttgtgctcatgggcagccgtagagggctaccgcatcgtcggcggcccgctcggggaggtcaccgacccgctctaccccggggggagcttcgacccggtcggcctcgccgacgaccccgaagccttcgccgagctcaaggtcaaggaactcaagaacggtcgcctcgccatgttctccatgttcggattcttcgtccaggccatcgtcaccgggaagggcccgctcgagaacctcgctgaccacattgccgaccccgtcaacaacaacggttgggcctacgccacc

SEQ ID NO: 6038 - DNA, 408 bp, Zea mays
  Clone ID: LIB3279-057-P1-K1-E5
cagaaacaccaaagccccaaacctcaccctctcccgaatcccgatggagttctttgacgaaaccctcgccttcggcaccggcaccggcggcgtcgagaagcccgcgctcaacggcgtcgttgcggaggaggagcaagtccccatcacccaccccgcaaagtcacacgccgcggtcgctgccgagaaccccactcctatcagcagcgtcgcgaacggtgagggtgagggggtccccggcgcccacactggcgccaagtcctacgctgccgtcgccaccctcgcggagatcgccgccctccgcgccgccaagctcgacctggaagcgaagctcgacgaggcccgccgtgagaacaagttcctcgccgaggagactcaccgcatcgaggggatcttcacgcaggttcggga

SEQ ID NO: 6039 - DNA, 411 bp, Zea mays
  Clone ID: LIB3279-057-P1-K1-E6
ggtggggaagaagaggggtgttatctccccgctggaccatctcgctgggctgctggaggtgcgcgtggtgaggggagtggacctcgccatccgcgacctccgatccagcgacccctacgtcgtccttcgcatcggcaaggcgcagaaagtgaagacgcgagtggtcaagaagagcatcaatccggaatggaacgaaaaactcaccctctctattgaagaccctgccgttcctattagactggaagtatttgacaaggacactttcgttgatgatgcaatgggtaacgcggagctggacatccgcccgttagtcgagattgtgaagatgaagctccagggtgtcgctgacaaaacggtggtaaagaagctggtgcccaacagacagaactgcctagccgaggagagctccat

SEQ ID NO: 6040 - DNA, 127 bp, Zea mays
  Clone ID: LIB3279-057-P1-K1-E7
ggtggagaagaagaggtgtgttattcccccgctctaccatcagagtgggctgttggaggtgcgctttcttaggtgattgtaccttacctttctctaccttcaatccatctacccttacgtgattctt

SEQ ID NO: 6041 - DNA, 411 bp, Zea mays
  Clone ID: LIB3279-057-P1-K1-E8
gtacaagttgatgctgctccattcaagcagtggtacctcactcactatggagtggacatcggtaggaagaagaaggtgcctgttgctaagaaggatgcgactgagggacaagagggtgaggctatagctgaggaaacaaagaagagtaaccatgtgcagaggaagattgagaagcgccagcaggaccgtgcactcgacactcatattgaagagcaatttggcagagggagattgttggcctagcatttctgcccgtcctgggcagtgtggccgagctggtggctacatccttgagggtaaagagctcgagttctacatgaagaagctccaaaggaagaagggcaagggtgttgcatcttagagcattcttttagctagaactgcaaaatatcttctacttagggggatttg

SEQ ID NO: 6042 - DNA, 406 bp, Zea mays
  Clone ID: LIB3279-057-P1-K1-F1
ctcacgcaacgaatccgagccggatcggggggtgcgcggagtcaccggcggcccggcgttgcctgggctgtgatacagttgcaatggcatctgtaactgatgagacagctaagattgagggtttgacatctgctgcagcctttgtggagggtggcattcaggacgcatgtgatgatgcatgcagcatttgccttgaggctttctgtgagagtgacccttctgcattgactggctgcaaacatgagttccatctccaatgcattcttgaatggtgccagagaagttcacagtgcccaatgtgttggcagcctattactatgaaggatcctaccagtcaagagctgcttgaggcagtagagcgtgagaggaatataagaactaatcaaactcggaacacaactatatt

SEQ ID NO: 6043 - DNA, 338 bp, Zea mays
  Clone ID: LIB3279-057-P1-K1-F10
cgctcatcacttcgctccaagccagtgctagcccggccccttgtgtacgtgagagacggcatcgtaccgtagagcagcacatccatggctcagggaagtggcagtgctcgtggcagcggcgccgccgccgcgcttgcgctggtcctcctctgcgtgctcctccacggcgagctggccgagtcggcggtgtacacggtcggcgaccgcggcgggtggagcttcaacagcgccaactggcccaagggcaagcggttccgcgccggcgacgtgctcgcgttcaggtacaacgccaaagcgcacaacgtggtgcccgtgagcgccgcggggtacaagtcgtg

SEQ ID NO: 6044 - DNA, 270 bp, Zea mays
  Clone ID: LIB3279-057-P1-K1-F11
cgctgctagtattccatgttttgtgttttcatattggaggacgtctgtagatgtaaaaaatcctcgggcgcttgtgctcggcttgaggaaatatccttgtacggttgtaccctggacccgctatagctggttggttcttcaaattgtgttcctatagaagccaaagttactacacgatcgatatgttctttttgcggaatcgaaaaaatccaagacccagactgaaaggaaccccggatgatcaagataactattttttaattccaatct

SEQ ID NO: 6045 - DNA, 398 bp, Zea mays
  Clone ID: LIB3279-057-P1-K1-F12
ctccttttgacaagaaatcatttgtgtcttacatcaaaaaatacatcaagaatctcactgctgtgttggagccagagaaagcggatgagttcaaaaagggtgtcgagggtgcaaccaagtttctccttagcaagctgaaggacctccaattttttgttggtgagtccatgaaggatgatgcgtctgtggtattcgcctattacaaggatggtgccactaatccgacattcctctatttctctcatggtcttaaggagatcaagtgctaggcgtgcggcgaaattagttacccatgttgggtactatctatgtactattattatatccaaaactatagttgtcctggctgaattgaactcaaaagggtttgtttgagaaaaaattgtcccaagattgga

SEQ ID NO: 6046 - DNA, 412 bp, Zea mays
  Clone ID: LIB3279-057-P1-K1-F2
cagaaatattagtatttctacaggttaacaaggtacatacaaagaaggcggctgctcccaagattgctaaacaagagtccagtgatgatgacactagcgacgagacctttgaatctgatgaggtatgttatcatttttgggttttaatgctgaaaaaaaccagcaaccaacaaattgaattgttaatgtagttttcagagtttttagatgccaattcatcttctcattaaggaacctacaaagaagcctgctgctaaacccttggctgcagttgcaaaaaatggttcgaagacggtcaagcaagagagcagcagcgatgaggacagttctgaagatgagtcggatgacgacagtgatgatgtgagttgaagtttcctcggcgtccctgcatcgcttccaccagccctcccca

SEQ ID NO: 6047 - DNA, 385 bp, Zea mays
  Clone ID: LIB3279-057-P1-K1-F3
cggcgttcaaggccaagcccgcgctcatctccctcatcggcgctgcctcggcagcctccggcggtggagccgcctccgccgccgtgccttgcctccgcgacgcgctcactgccgacgattgggccgccaggaaggctgccgccgaggcgctcgctttgttggccctcgagcacggagacgacctcgtctcacacaaatcttcctgcattaccgtcttcgaagccaagagatttgataaggtgaaaatagtgcgcgagtccatgaaccggttgatcgaagcatggaaggagatcccggatttggatgaggaggtctgctccttaccatcgtcccagtctagatcttctctcacagatactgcaagtgatggccgatacccagctga

SEQ ID NO: 6048 - DNA, 415 bp, Zea mays
  Clone ID: LIB3279-057-P1-K1-F4
gccgccgctcgcctgcacttctacgtgtgaaacgcgtccgcgcctatggcctgcccgtgcccagctgccccctctccacgcgagcctctctaggcgtcaagcgtgccattaagcaaccgtggcccccacccctcctcggctctctgcgtgagcacaagcacgtctctgtagcccatgttcaacagaagcgaaaggaaacaggtcacccatcacattcgtcatgtgcaattctctcatgccgtgcagcccattaattccactgaagaaaacatagaatgtgcatcataatgtcacagaaggcctaaaatgttatagtgtgcggccattgctcacgaggaggcagagtgctgtgttgccgagtgccgctggaccacatacgattgttgatggtaaagaagttgtgaactttgcatca

SEQ ID NO: 6049 - DNA, 409 bp, Zea mays
  Clone ID: LIB3279-057-P1-K1-F5
caatgaagcagaacctcttttttttgtgtgtgcacgtaatgtacctgggccttgtaaagtacggagcgtttgggattatgtcggtttacattttgttttgctctttacattacagaaccacggcaatcctacgagccataaaccagagctagtactgaacaatttcactacacgccttggtcatcgtgttggaaggatgatccagtctctcttccctcaagatcccaatttccgcgggcgccgtgttgtgaccttccacaaccagcgagactacatatttttccgccatcacaggtacatcttcgagacaaaagaaaagaaggttgcttcgaaggaaaagacatctggaagcaaaagcggatctgagaagcagcaagtgatttgtcggcttcaggaatgtgggcctcgc

SEQ ID NO: 6050 - DNA, 402 bp, Zea mays
  Clone ID: LIB3279-057-P1-K1-F6
cccacgcgtccgcagaggagagagatctagagcgagggagggagggaaatgggccacgaggctgcggcgccggggtcgtcggtgctcggccgcgcggtggaggaggtgcgctcggccctcaacgagcacgccgacgtggttgccgacctcttcggtcgcgtctcctccgaagtgcgcaccggcttcgcgcccgccgtcgactccttcgttggcttcttccacgccgtcgactggaaggagccttggctgatcagcatactatctttccatgccattctgctactggttaccatcatctcgaggaggaatatcaatttccagctcatcttgtcagctctaacattttctggtgtattccttgctgagagattaaatacgttcctggcgcaaaactggaagagc

SEQ ID NO: 6051 - DNA, 377 bp, Zea mays
  Clone ID: LIB3279-057-P1-K1-F7
cccacgcgtccgctgctcctccgcctccgcctgatccatccaagacagggatcgccatgtcggactcggaggagcaccacttcgaatcgaaggccgacgctggggcgtccaagacctacccgcagcaggctggcaccgtccgtaagaacggcttcatcgtcatcaagaaccgtccctgcaaggttgtggaggtttctacctccaagactggtaagcatggccacgccaaatgccactttgtcgccatagacatattcaatgggaaaaagcttgaagatattgttccttcatcacacaactgtgacattccgcatgtgaaccgtactgagtatcagctgattgatatttctgaggatggatttgtgagccttcttact

SEQ ID NO: 6052 - DNA, 283 bp, Zea mays
  Clone ID: LIB3279-057-P1-K1-F8
cccacgcgtccgctgacgcagttcaccccaatatgtggatacgatagtctctcccgaacggtcgaacgcctggaaccttttgttactgcatcttttatcttcttagcacacccttgctgcttgacagcagtacgggtcagaaactcgaaaataaccgtggttctcaagaaatttttccagattctaaaaaaaaaaaaaaaaaaaaaaaaaaaaaaaaaaaaaaaaaaaaaaaaaaaaaaaaaaaaaaaaaaaaaaaggaagacaaaaaaaaaaaaacaaaaat

SEQ ID NO: 6053 - DNA, 297 bp, Zea mays
  unsure (1)..(297): unsure at all n locations; Clone ID: LIB3279-057-P1-K1-F9
ggatcatcactgccaaggaccatgcctctgtccagatcaacattggccacttggatgcgaatggcctgtatgatggtcacttcacaacatttgctctctctgggtttgtccgtgctcagggcgatgcagacagctccttggacaggctgtggcagaagaagaaggctgatatcaagcagtagattttacatctagtttaccaagaattggacactgccttagctatgttttgaattcatgtcactatatgcaatgttgtgatttcagctggtaccttaaatctgaagatttagtnna

SEQ ID NO: 6054 - DNA, 394 bp, Zea mays
  Clone ID: LIB3279-057-P1-K1-G1
ctcgtagagagaaggaaaaatatccccaaaccctagctcccgatctcgatggcgaaccctcgcgtcttcttcgacatgaccgtcggcggcgccccggcgggccggatcgtgatggagctgtacgccaacgaggtgcccaagaccgcggagaacttccgcgcgctgtgcacgggcgagaagggcgtgggcaagtccgggaagccgctccactacaagggctccaccttccaccgcgtcatccccgagttcatgtgccagggcggcgacttcacccgcggcaacggcaccggcggcgagtccatctacggcgagaagttccccgacgagaagttcgtgcgcaagcacaccgcccccggtgtgctctccatggccaacgccgggcccaacaccaacg

SEQ ID NO: 6055 - DNA, 408 bp, Zea mays
  Clone ID: LIB3279-057-P1-K1-G10
cgcacatctatctgtcaagcgacgccgcggcctcgatcagagtcggaggcgaacacccccatggcggcggctggcggcggcgcaagagggaaggtatccttcaagatcatcctcacctccgaccccaagctccctttcaaagtgttcagcgtgcccgaggcggcgccctttaccgcggtgctcaagtacgccgcggaggagttcaaggtcccgccccagaccagcgccatcatcaccaacgatggaattggcatcaacccccagcaaagtgcaggcaacgtgtttctgaaacatggttcggagctgcgtctcatccctcgcgatagggttggagctgtaatcatgtcttccggttagaggatatatacagtccaatgcataatgagcaaaacttgagagaaataaagc

SEQ ID NO: 6056 - DNA, 268 bp, Zea mays
  Clone ID: LIB3279-057-P1-K1-G11
aagaagactactagtataggtgctaatgtgcctcgccctcgcgttgtcttcacaggtgtgagctagttaattctacggccggctttaggagtatgctgctgaggttatgctaacgttggtagagtcggttctgcggtctgtcattggatcagtattttcgttaactgttgcattcatgccctgtatctgtttctgacgaaacatcttaccatggacttgattgcctttgagcctgaattatccaggatcgatctttcgttgcctgctt

SEQ ID NO: 6057 - DNA, 407 bp, Zea mays
  Clone ID: LIB3279-057-P1-K1-G12
ctggatactcccatattggtacaacaaatgacattgtatctcaggatcacatggcccatggatctcatgggatgtttacacaagcgggatataatgatccctcacaagatgagtcgtctcagattcattatggaatggctgccgctggccctctacagtcgcagggcatgatgaaccccttgtactctcaatcctatgctcactacaacacccaaccacagtctattgaacctccggcccagtgataatgaaagcttgtgataggatgcagccaaattttcgaagtttggtgggttgcatcttttgggccacatgtgcacttcttcgttgtttcagactcgatggtgcatagacattagatgcaagcaatgaaggcgcactatgtattggctatatatcggggcagg

SEQ ID NO: 6058 - DNA, 412 bp, Zea mays
  Clone ID: LIB3279-057-P1-K1-G2
ttagcttttgtcgtcgtggagcctccaccagtgccgtgtagcattcaagaacaatggaaccaaaatacaggacattttcctacttcacgtctggatgccatccaattaatatcttctctgcgatattgcaatggaagggactggtcttatgtgttattggtgctattcttgtacagccaatgaaataggtcctactacacaaggtcaaaggatgggagaatgtttaatgcttcttcagatactatttcttggtctgtcaaatctgcttgacccaaatgcaagttttgctcaaatgtgggaaaaaatgattgtctcaccaattgttagcacgtttgcttccagcaaagttgtccagagaaggaaaagatgaaatggaactcaaattttagtggtcgcacaagtgtggagacag

SEQ ID NO: 6059 - DNA, 146 bp, Zea mays
  Clone ID: LIB3279-057-P1-K1-G4
cggacgcgtgggcaaggggcaggttgttgtgcttgcaagtatctgttgcagctggtagttcatgcctgatgttgatgcctcttttcatactgttgtgtttggatggtgtaccaccagtgttttacaacagtttggcccttggaatt

SEQ ID NO: 6060 - DNA, 414 bp, Zea mays
  Clone ID: LIB3279-057-P1-K1-G6
tcaactaccagcctcctagcgttgtgcctggtggcgacctggccaaggtgcagcgtgccgtgtgcatgatctccaactccaccagtgttgtggaggtgttctcccgcatcgaccacaagttcgacctcatgtacgccaagcgtgccttcgtgcactggtacgtcggtgagggtatggaggaaggtgagttctctgaggcccgtgaggacctggcggcgctcgagaaggactacgaggaggtcggtgctgagttcgatgagggcgaggatggcgacgagggtgacgagtactagagaagtttgctgatgacgcagcatcaggccagtgtgctgcccttatcccgtgatctgccgagagttgctcctgctatcgagttatgtgtgtctgttctgaagtattgtgtggtttacaaca

SEQ ID NO: 6061 - DNA, 404 bp, Zea mays
  Clone ID: LIB3279-057-P1-K1-G7
tgcacatttaggaagaaccgctagcaggagagatgatttggagtcacttgcctatacactagtattccttcaccggggcaggttgccatggcagggatatcagggtgataataaatcatttttggtgtgcaagagaaagatgagtacctcacctgaggccctctgcggcatatgtcctcaacctttcaaggagtttcttgaggccgttgtcaacatgaagtttgatgaagagccaaactattccaagttgatttcattgtttgacagtttaattggaccaatcccttccattagaccaatcaatactgatggagcccaaaaggtagggcagaagcgtgccaggttgcttaatgatgacgacgaccatgtaaaaaagaagattcggctgggtgctcctgcaacac

SEQ ID NO: 6062 - DNA, 374 bp, Zea mays
  Clone ID: LIB3279-057-P1-K1-G8
cccacgcgtccgcccacgcgtccgcttctcttctccgcgtcacctcctgttcgccgccgccgacgctccaccgggcagccagccatggatgaggagtacgacgtgatcgtgctaggcacggggctcaaggagtgcatcctcagcggtctcctctctgtggacggcctcaaggttttgcatatggacagaaatgactactatggaggagattccacctcgctcaaccttaatcagctctggaagaggtttagaggggaagacaaaccctcagcacatctaggtgcaagcagagactacaatgtggacatggtgccaaagtttatgatggcaaatgggacattggttcgaaccctcatccacacagacgtgacaaa

SEQ ID NO: 6063 - DNA, 361 bp, Zea mays
  Clone ID: LIB3279-057-P1-K1-G9
ctccgtcccatgctccgccgctgacacgttcgcccgacttaaccttacgatggccgccgccgcctccgccatcaccaccgtctcaggcgttgtgcttccccaaaccttcctatcccaccggtcgccgccgccgcaggtcctagccgtggcctcctcattccgccggctctccttgtgcgcttcccctcaccgggtcactcacataatcccccgcgctgatgcaagtgccgaagctggagaaccggagcctgccactgcttcagctgaatccgaagaggaggtggccgaggggtctgtcgctgtggcggaagcggaggaaccgacgccgccgagcaagccgaaggttaagttcggcgaaata

SEQ ID NO: 6064 - DNA, 410 bp, Zea mays
  Clone ID: LIB3279-057-P1-K1-H1
gcatcccacaccccccgagctcagcttacctccactccagctccaatcacagtcgtgaccagagcgagagctagctagagggccgtgaaaatgccgatcaataggatcgccctggggagccaccaggaggtgtaccacccgggcgccctcaaggcggcgttcgctgagttcatctccaccctcatcttcgtcttcgccggccagggctccggcatggccttcagcaagctgaccggcggcggcccgacgaccccggcgggcctgatcgcggcggcggtggcgcacgcgttcgcgctgttcgtggcggtgtcggtgggcgcgaacatctccggcgggcacgtgaacccggccgtgaccttcggcgccttcgtgggcggcaacatcaccctgttccggggctcctgtactgg

SEQ ID NO: 6065 - DNA, 128 bp, Zea mays
  Clone ID: LIB3279-057-P1-K1-H10
gtcagccagcgtccacgccttcgtttcccactcccagggccaccaccacggggctccccttccggggggagccaggcacaagtccggtgatggagccctcacggggaacatcacgacgactctaatca

SEQ ID NO: 6066 - DNA, 395 bp, Zea mays
  Clone ID: LIB3279-057-P1-K1-H12
gcagcgttcatctggtaggaggttttaggaggtagcctcccagggaggtggctttcgcagaggaggtggtagattctgatcctttggtggtaatcaaagagctgggctctccccatttatagcaagtggggctagaagaccggcagctgatttcttgacgcagatgataaagtatgctccaagcatatccccagacaggtttacgcattagctatagcatacacatgaggcgagttacttttatgttccactcttaaaccttgtttccgcacaggaactgttatataaacatgactcgagtataccctggactggatgagccctcacttcgctccatctattgatgacggaggggggcttccatttgggagccttattgctttatcttcttttac

SEQ ID NO: 6067 - DNA, 343 bp, Zea mays
  Clone ID: LIB3279-057-P1-K1-H2
agagtacaacaaggccatcgcagcctacaacaagggcgagagcactgcagctaagaaggctcctgccaaggaggaagaggaggaagacgaagaggagtctgacaagtccaagtcggaggtcaatgacgaggatgacgaagagggtagcgaggaggatgaagatgatgacgagtgatggagagctcgctcgagacaatggacggtgctttattcaacaatggagcggctacacaaggccccgtggcgatcaaaaaaaaggagcctatatccatgtactagaattattcagtttcactccacatcgggatgtttaatttttacttttgtcgtgctataacggata

SEQ ID NO: 6068 - DNA, 365 bp, Zea mays
  Clone ID: LIB3279-057-P1-K1-H3
gctcggcggcgcggggctctacgccgtcctcaacagcttctacaacgtcgagggcggacaccgcgccatcgtcttcaaccgcctcgaggggatcaaggacaaggtgtaccccgaaggaactcacctgatgatcccgtggatcgaaaggccgatcatctacgacgtccgcgcccgacccaacctcgtcgagagcacctccggaagccgcgacctccagatggtgagaattggtcttcgtgtccttactcgacccatgccagatcagctacctaaaatctacaggaacttgggggagaacttcaatgagagagttctgccttcaatcattcatgaaacacttaaaagctgtggttgctcaatacaat

SEQ ID NO: 6069 - DNA, 409 bp, Zea mays
  Clone ID: LIB3279-057-P1-K1-H4
cggacgcgtgggtgacttggggcgtcgtcgccgagctttctccggccgagggcggcgcgaccggacaaccagcgtgagcgcgaccggcgacatgactcgcggcaaccagcgtgaccgcgaccgtgagcgcgcggcggcgcggaagcccaacgccaagaactcccaggacgggctcaccccggagcagcgccgcgagagggacaagaaagctctggaggagaaggcggccaagaaggcgcagcaagcagcggccggcggcaccgggaccttcacggacaacaacaagaacaaggcaggtggcaagaagtaggaggcagtggcgcgccgccacctctgtacgattaatcgatgccttgagcttgtaacttgttcgcatccttgtaagtgcgatgcttgttgggtcataaac

SEQ ID NO: 6070 - DNA, 419 bp, Zea mays
  Clone ID: LIB3279-057-P1-K1-H6
acgccgtccgcggattgggttttggtttatgttatgacatccgtttccaggaattagcaatgttgtatgctgcaagaggtgctcatttgttatgctatcctggtgcattcaatatgactactggaccactgcattgggagttgctgcaaagggcaagggctacagacaaccagctgtttgttgcaacatgcggcccagctcgagataccagtgcaggttatgttgcttggggacactccactcttgttggaccttttggagaggtgattgcaacaactgagcatgaggagacaactataatagcagaaattgactactcactgattgagcagaggaggcaatttcttcctctgcaacaccaacgccgtggcgatctctatcaactggttgatgtccagaggctgggttctcattagcac

SEQ ID NO: 6071 - DNA, 382 bp, Zea mays
  Clone ID: LIB3279-057-P1-K1-H7
gtcacgttcaccacgttcgcccgctcattcaccggcggcgtcgcccagctcggcctcccgccgcccacggaggccaggtccccgggccgcccgctcggtccgccacagaggcaaggaattggttcttttagtacttgacagaaataaatatattccaggcatggtggcgtctttagacaatgtgaggggcttgactttagccatgtcatctagtgcattcattggttctagctttgtgatcaagaaagttggattgaagaaggctggggataatggggtgcgtgcagcttctggaggcttctcatatctatatgagcccgtatggtggttgggaatgataactatgattctaggcgaggtagccaattttgcagcatatgca

SEQ ID NO: 6072 - DNA, 371 bp, Zea mays
  Clone ID: LIB3279-057-P1-K1-H9
gtaccatcaggttgtgacggagatctgcatttctacagaagatgggcacttgctgttgaaaaatggtgatgagccctgagttcgctatgatatgccctgtgaaggtccaccaaggtcgaatcgtctctgatgcgtagaatagggtcattcggagtttgggatttggccggtgagaatgagtattgatcaggcagttcaagatagctacagcaaactgttctaggtggctttgtcagccatttttggctcagcagtttttgctgggtgctaattgagcggtgtttttcggttagtcgtctttatttgtgtccattgaatccttgctggtctagcttggcgtaattcagttagggatgttattttgtctttta

SEQ ID NO: 6073 - DNA, 118 bp, Zea mays
  unsure (1)..(118): unsure at all n locations; Clone ID: LIB3279-059-P1-K1-A1
atggaacccattgctagcaaaggaacccacaactcgtttgcagagttggctcaagcatgcttcatggaacgtgtggatctctcttgtcaagggtntatgctacacctaaattgggttg

SEQ ID NO: 6074 - DNA, 406 bp, Zea mays
  Clone ID: LIB3279-059-P1-K1-A10
catgagtttgatctcccagctgttgatatttatgctggggtagctgcatccctcgcagaaaggaaaaaagggggccagttgacagagttcttgaagaatataagggggactatagatgatgatgaatgggatcaggttattggtgctgctataaatgtttatgccaacaagcataaagaaagaccagatcgccttatcgacatgctaatcagcaatcacaggaaagtacttgcttgtgttgtctgtggacgtctaaaaagtgcattccaaatagccgcacgaagtggaagtgtcgctgatgttcaatatgttgctcatcaggcattacatgcaaatgcattgacagtgcttgatatgtgtaagcaatggctcgcgcagtacatgtgataccatagatacttgctga

SEQ ID NO: 6075 - DNA, 373 bp, Zea mays
  Clone ID: LIB3279-059-P1-K1-A11
caggctatgttcgctggcattgcttaatgtcactggaggtggctttcagtgcttcccaaaggtagatgggcagatgctttctcttgcattccgattcttaagggcaaaaacaccagaggaaagagcccttgtggacttggaaacgcattatacgaaggaataccttgaggagactgttgggtcgtgtaccacaagaacggtcctctatcaagaatatgtgaagggcatatcgtcgacagggatgcaatctaattgtggatgtgaagggcaaatcaatgcatgctggactcacaacatgactactaaggagctagatacaatacgatctgccggctttctagtttcagttattcatggaaggtacgatatcatt

SEQ ID NO: 6076 - DNA, 142 bp, Zea mays
  unsure (1)..(142): unsure at all n locations; Clone ID: LIB3279-059-P1-K1-A12
ggtccacttgcatctttcattgaatcgaccaaatatggcagtgactgtgtgcgggcgggctcaagaattgaaggccaatccntcatcgtatcaatgattgttgcgtgcctatctagctatcactaaaggcaaagatgcatta

SEQ ID NO: 6077 - DNA, 358 bp, Zea mays
  Clone ID: LIB3279-059-P1-K1-A2
gcaatggattgtgaaggcaattgcatccaagatattggattgcaaggttgaccagcttaaccagactgtcactgtcagtcggcacacagagaggatctttgggatggaacattggcatgctctgcgcacaaagctcggagcttggaggggaaacattgccagagctatcaacacaatacaagctaacaaagtcaccgaagagggggcacaagggatgcaaggcttggcgatccactgattcagggcagatcagcgggttcgtgaattgagattatagcgtgggagattagaagggcaacctttttttgtataagacaagctgtgacggtttattcacttagataccgtaaccatgcct

SEQ ID NO: 6078 - DNA, 350 bp, Zea mays
  Clone ID: LIB3279-059-P1-K1-A3
caaccttggccatcaatttctgagagtgctaaagacttggttagaaagatgttgacacgagatccaaagaaaagactgacttcagctcaagttcttcaacattcatggctcagagaaggtggaggtgcatctgataagcctatcgacagtgctgttctttctagaatgaagcagttcagagcaatgaataagctgaaaaagatggccctaaaggttattgcctcaaaccttaacgaggaagagatcaaggggctaaagcaaatgttcatgaacatggacacagacaatagtggcacaatcacgtatgaaagactcaaagcaggacttagccaaacttgatcaaagctgtc

SEQ ID NO: 6079 - DNA, 333 bp, Zea mays
  Clone ID: LIB3279-059-P1-K1-A4
ctctctgttgctcgcactcgcggagatcgaagagaagcgcaggaggccccagcactagcgccgccccgccgccgcatcagacatggcgctggccgctcgcctagtctagcgctcccgtcagctatattcggttcaagccactttggggaatggaggtgtcactcaagttcgctcctttgccaaggatgcagctccagctgaccgtcctcctgtcagtggggatgatctcctgaagggcatattctttgaggtaaagaagaagtttgagacagctcttggtgttcttaaaaaggaaaagatcactattgatccagatgacccaacggcaggttt

SEQ ID NO: 6080 - DNA, 389 bp, Zea mays
  Clone ID: LIB3279-059-P1-K1-A5
gagagcacgggggcttgatcgaagatggatgccggagcaaaggtggtgaagaaggccgcggcggggcgtcgcggcgggggcggccccaagaagaagccggtctctcgctccgtgaaggccggcctccagttccccgtaggccgtatcggccgctacctcaagcagggtcgctactcccagcgtgtcggcaccggcgcccccgtctacctcgctgccgtcctcgagtacctcgccgccgagctcctcgagttggcggggaacgcagcgcgggacaacaagaagaaccggatcatcccgcgacacgtactgctggcgatccgcaacgatgaggagctcgggaagctactggccggcgtcaccatcgcacacggcgggggttcttgccaaca

SEQ ID NO: 6081 - DNA, 400 bp, Zea mays
  unsure (1)..(400): unsure at all n locations; Clone ID: LIB3279-059-P1-K1-A6
agcatatgcacaagatcactttttcgatgtcatcacaaatgtaattggcctggttgctgcactacttgccaattacattgagggctggatcgatccgcttggtgcaatcgttctagcgatctacacgatcaggacatggtcgatgacggtgctggagaacgtgcactccctggtggggcagtcggcctcgccggagtacctncagaagctgacttacctgtgctggaaccaccacaaggccgtgcggcacatcgacacagtccgcgcctacacgttcggttcccactacttcgtggaggtggacatcgtgctgccgtcgaacatgcccctgcgggaggctcacgacatcggcgaggccctgcaggagaagctggagcgcctgccagagatcgagcgcgcg

SEQ ID NO: 6082 - DNA, 333 bp, Zea mays
  Clone ID: LIB3279-059-P1-K1-A7
ctttgctccaaaaaatgaccgcgccaccctgcttctcacctctatttggctacgcgctgcatgcttgcatgctgctctttttttgcatgcgcgctgcatgcttgcatgctctctgttttcttttctctagtttttttctttggttctagcaggtggccgccgggagctccatcagttcaaaaaaattgagcacggtgggcttcggccactcgaaagaaagggccccacagcgcctaccgccggcgagcgcatccccatggagcgggttaatcatagaacatgcatgtattaaatattcaacgttggtcaaataataactatgccatatccatg

SEQ ID NO: 6083 - DNA, 301 bp, Zea mays
  Clone ID: LIB3279-059-P1-K1-A8
cccacgcgtacgatctcgccttccgaggaaactcaccagcccaccacagacccgagcggaagaagccatgtccgggcgcggtaagggtggcaaggggctcggcaagggcggcgcgaagcgtcaccggaaggtgctgcgcgacaacatccagggcatcaccaagccggcgatccggcggctggcgaggaggggcggcgtcaagcgcatctcggggctcatctacgaggagacccgcggcgtgctcaagatctttctagagaacgttattcgagacgccgtcacctacactgagcacgcccgc

SEQ ID NO: 6084 - DNA, 261 bp, Zea mays
  unsure (1)..(261): unsure at all n locations; Clone ID: LIB3279-059-P1-K1-A9
gcagggacgcgggcccgggacggaatgtcccgggctcgaaacccacgcgtcccccgcccacgtcgtccgcgtgacgtcgttggnngcctcgatacccgcagtcnatgtgcgtcacgattgcatccgtggaatggggcatacgctttcaaggggtcccatngccactgnnttcctccnnngtcgccgattgacctggcgacccagggctgcgcccaaagctnattccaagggggtggnnggcacgaaccgaannngcgctca

SEQ ID NO: 6085 - DNA, 217 bp, Zea mays
  unsure (1)..(217): unsure at all n locations; Clone ID: LIB3279-059-P1-K1-B1
gtgccttgccgctgcactacatgctggcagcaggacgagtgggtgctgtgcagggtgttcaagaagagcatcgagccgccatccgngcccggcagcaagaggtcatcgtcggttgcgtgcatggggacggagggcacgggagtgggagtggggccgtcgtccatgttcacagaggacgacttcgccgcgtgcgccgtgttgccttcgatgttggact

SEQ ID NO: 6086 - DNA, 367 bp, Zea mays
  Clone ID: LIB3279-059-P1-K1-B10
gcagacacaagcactgggttgttgctgaaattctccgcagagctaaggtgtacgttccaccagctgcaacagcgtccagtgaacgtggtagcaaatctcaacaagctggtggtgctaccaaatgatccatctgaagttactcagaacaagatgcagtcacggcttgtttttctttcgctgtatgtttgtttccttgtggaatgtggttgccatgtttagcatgggagaaaaaatagcaagcagccagcatctttgcttaattactgttgttcttctgtggtgtccttcgtttaacggtactagccattaaggatgtagttaccagattcaacaagaccaatggattcatattgtattggttcacttc

SEQ ID NO: 6087 - DNA, 394 bp, Zea mays
  Clone ID: LIB3279-059-P1-K1-B11
tcaatttcgaatctccccttcccctcagtctctcacacgcacgctcctcccctacgcagcaaaaccctaaccctagctgcggacgccgtcgccgcctccgcgcccaaccgatgtctgattctgaggcgtccccaccgcccactccggccgccgcaacgcccgcagcgctggtggagacctccccgtcctcggcgaggaaggaagaactgctgcctgtggaggaaaagatctcggaattaagtgaatcacaatcagagcttctagggaggctccgtgggcttaaggaggatttgctgagttggaggagtaatttagactcccaagtgacgaaatacaaagtggaactctctgacatcaagagtgcactcaataatgaaatagagcagcttcgctc

SEQ ID NO: 6088 - DNA, 403 bp, Zea mays
  Clone ID: LIB3279-059-P1-K1-B12
ccgccctcgcgaagcacctcggacacggcgactgccgactgacccggtcagcttgattaggcaatatggttatccctccaccagctagggctcctgcaatcaccaagttcctcaagccgtatattttgaagatgcatttcacaaacagttttgtgagcgctcaggtcatccacacaccgacagccacggtcgcatgctctgcaagctctcaggagaaactcctgaggccaagcatggagtcgacacgggatgttgctgcggctgcaaagattgggaagttgcttggagagcgcttgctgttcaagggtatccctgcagtatctgtctccatgtcaagagaccagaagtaccatggcaaggtgaaggccgtgatagattctctaagaggtgttggtgtgaaatt

SEQ ID NO: 6089 - DNA, 409 bp, Zea mays
  Clone ID: LIB3279-059-P1-K1-B3
cggacgcgtggggttgtgggcccgtgtgggaattggttcatctcaggttcttcgagaggcgtccttacactgtgggataataggtttttagtacctgttaaatcgtggaattattcaacattaagcccaatagagaaactatgcttgcttatacctccaccaagttcgatatcctctgctggaaggccattagtttttgttgccgctggatgcaacgaagtttctctgtggaatgctgagaatggaaactgccatcagatgtttagaacagcaagcactgacaatgaagctgtgatgtcaaaggcgccatcgaggcctgttaacaagccagtcatcaaagatataaggcgagcaggcaattataagtacagaatcgatgaattgaatgacccacctgtacgccatcctg

SEQ ID NO: 6090 - DNA, 406 bp, Zea mays
  Clone ID: LIB3279-059-P1-K1-B4
cggacgcgtggggttgtgggcccgtgtgggaattggttcatctcaggttcttcgagaggcgtccttacactgtgggataataggtttttagtacctgttaaatcgtggaattattcaacattaagcccaatagagaaactatgcttgcttatacctccaccaagttcgatatcctctgctggaaggccattagtttttgttgccgctggatgcaacgaagtttctctgtggaatgctgagaatggaaactgccatcagatgtttagaacagcaagcactgacaatgaagctgtgatgtcaaaggcgccatcgaggcctgttaacaagccagtcatcaaagatataaggcgagcaggcaattataagtacagaatcgatgaattgaatgacccacctgtacgccatt

SEQ ID NO: 6091 - DNA, 298 bp, Zea mays
  Clone ID: LIB3279-059-P1-K1-B5
gagccagtcagccagccccggagccctggacagcagcagtgaactcgaggccgctccgccacctcgccactcgcctcttctcgctctcgccaccgggccagggaagggaccatccgatcggctccgtcatggctggagctgctgctctcaatgagggtatcctttcttccgtgtccgagaaaaatgttgctgctcacccatggcatgatttggagataggaccagaggctcctgaagtgttcaattgtgtggttgagattcctagaggcagcaaggttaagtatgaggtggacaagag

SEQ ID NO: 6092 - DNA, 406 bp, Zea mays
  Clone ID: LIB3279-059-P1-K1-B6
cacaccaggctatgaacaggaaaaggcacctgaaggatcatctatctctgagttaactcctctggcaagtgacagaccatcatccagcagagtggccaaaacaaatgctgatcgtattaccccttttgcaacacgagtaaataaatttacccaacagtatgttctcaatgctgataacgcagttggtgtgccaagtaaaagtgctgaaatcacagaagatgaaataattagaagagttcaacctagtcaaagatgttacttacaagttcagcgctcacagcctgaaccaggttgcagattcatgtatgacagaatggaagacagatttaattacttggaagatcggatacggaaatcggcgagcttgttttctgcatctggattttgtggacaacctgcagatgct

SEQ ID NO: 6093 - DNA, 407 bp, Zea mays
  Clone ID: LIB3279-059-P1-K1-B7
cttctccctagccgccgccttctctcctccctgtcttctccctcgcgcagcagtccttccacggcaagcagcgagcctcgtcggacgctatatgctctggtcgcgcctgggactcctatggccgagctagccacctgccaggacaagccgcagacccctctgctcctccatggccatgagctcgacgtccccttcttcctctcctcccccatttccctctatcggccattaggcccctgcacgtgcctctccatcgcacaagcgcaggagacctgtccgtgggttggggccagggttttccctgggtggcctcgctgagagtagcaggtcgagtttcccttgtccatggcgcgacatctccaatggcgtcttcccctctggataacatgctcggctacctactctag

SEQ ID NO: 6094 - DNA, 407 bp, Zea mays
  Clone ID: LIB3279-059-P1-K1-B8
cccacgcgtccgcccacgcgttcgaagaaggtgaaggagcggatcgacgcccgcaaccagctggagacgtacgtgtacaacatgaagaacacggtgggcgacaaggacaagctcgcggacaagctggaggcggaggagaaggagaaggtggaggaggccctcaaggaggcgctggagtggctggacgacaaccagtcggccgagaaggaggactacgaggagaagctcaaggaggtggaggccgtgtgcaaccccatcgtgtcggccgtgtaccagcggtcgggcggcgcccctggcggtgacgctgacggcggtgttgacgacgaccacgacgagctgtagatggttgtagatggacgatggtggtggtgacgtggagtgccgggagccgagccaaattttgtaac

SEQ ID NO: 6095 - DNA, 384 bp, Zea mays
  Clone ID: LIB3279-059-P1-K1-B9
gaaagttcggagccgccggcccgtccgcctccctctccgcctcccgtccccaaggccaatagttttcaagtggcaatggcggaccaggctaaccaacccactgtccttcataagctcggtggccagttccacctgcgctcgatcatctctgaaggtgtacgggcccgtaacatatgcccatctgtctcatcttatgaaaggagatttgccacaaggaactacatgacccagagcctttggggcccttcaatgtctgttagcggtggcatcaatgtcccagtgatgcagaccccgctctgtgctaatgctcctgctgagaaaggaggcaagaacttcatgattgatttcatgatgggcggcgtttcagctgctgttttaaagact

SEQ ID NO: 6096 - DNA, 407 bp, Zea mays
  Clone ID: LIB3279-059-P1-K1-C1
cctgaaatgaagctgaactatgtgtattgtgttcaggtttattaagttccttgcttggttcatggctataattcagagtctccttataattgcttctcgcaagcactactcggtcgatgttgttgttgcgtggtacactgtaaacttagtagtattctttgtcgacaacaagctgccagaaatgccggatcggacgagtggactacatttgcttccattaagctccaaagaaaaagagggcaggcagaaggaggagaaagacagtaaactgaaggacgagttccacaagttactgaatgggaaccatgcggatcctactgatcgggtaatgtagaatttatgctaacaactcttttacctggcaaccctattcatcctatctggatctgcatagccatctctgtcac

SEQ ID NO: 6097 - DNA, 405 bp, Zea mays
  Clone ID: LIB3279-059-P1-K1-C10
ggagtttgcattaaccccattagcaatgaactaccagggcagtgatcatgattctgtgcactcccctgggggcgtctcatcgcccgataaagtctccacaaactcgcgagctttagttccagttccagctgcagatcccaatgcaggagctatagttccagcgaataagtctaagaggtcaccagagcaggggcaacgcagaatcaggcgcccgttctctgttgctgaagtagaagcacttgtgctcgcagtcgaaaagcttggaaccggaaggtggcgagatgttaaacttcgcgcgtttgacaatgcgaagcaccgtacctatgttgatcttaaggacaaatggaagacgctggtgcacaccgcgagcatctcgccgcagcagcggcgtggcgagcccgtgcc

SEQ ID NO: 6098 - DNA, 393 bp, Zea mays
  Clone ID: LIB3279-059-P1-K1-C11
ggaatttcgtctcatgatgggtctatagcccttcctagattcccttgggcattttcttctcaaatttcagcccaggaactgtctaagccccctagtagactgccttctccattttcttctggattttcatctctggatgggcctaattcctcgtctaggtttccttctgcattttcttctggattttcatcacagaatggccctaacccttcatctggattccctttttcttctgggttttcatcacaggatgggtctaatcagtcgtatggctcaacaaacccagaaaatcttctccggaatactgttctgggtggcagtagtaatcattatcaatctcagtttggaaggcactcaagtgacatggagttcgatgatcctgctatattagct

SEQ ID NO: 6099 - DNA, 388 bp, Zea mays
  Clone ID: LIB3279-059-P1-K1-C12
cggacgcgtgggcggacgcgtgggcgagcacgaggcggacaaggtaagcagcaatcgcaggaaccctagcgccgacgcacccgcaggaatgggtatcgacctggttgccggtgggaggaataagaagaccaagcgcactgcgcccaagtctgacgatgtctacctcaagctcctcgtcaagctctaccgtttgttggtcaggaggaccaagagcaatttcaacgctgttattctcaagaggcttttcatgagtaaaaccaaccgaccaccaatctccatgcgccgccttgtcaagtttatggaaggaaaggagaagaacattgctgtcattgttggcacaatcacagatgacaaaagggtccacgaggtgccagcaatggatgctact

SEQ ID NO: 6100 - DNA, 413 bp, Zea mays
  Clone ID: LIB3279-059-P1-K1-C2
gcgagagagcccggagccgagagaccagccagccatggcgctgcgtgccctgtacaacgagatccggagcatgaaggtccgcgacgtgccggcttacctgaagccgcgcttgacctgggacaacgtcaagaagagcgccgaccaggccgtcgaccgctacatcgagaagtacatcgacacgagctcgccggaccctctctaccacgtctgcatcggagggatgatcttctcctacttcgtcaatctgccctgggagcgcgcccacctcgcccacctcgaggagatggagaggaccggtgggaagcactagatccgctgccccgtccctcgccggcagcgcgggaggacgggtgactttcatggggtccattcaagctgatggcttctggtttcttctgctggtgagctactgg

SEQ ID NO: 6101 - DNA, 412 bp, Zea mays
  Clone ID: LIB3279-059-P1-K1-C3
gcaaatccctggcaaagaggagctgcgacagaaaaaccttttcagtgtcagtgattgtaagatgtattggcaaaacagtggagaatatcttgctgttcaagttgatagatacacaaaaacaaaaaagagcacctacactgggtttgagctgtttagaattaaggagagggatatcccaattgaggtccttgaactcgagaacaagaacgacaagatcattgcatttgcatgggaacctaaaggacatcgctttgctatcatccatggtgatggccctaagcctgatgttagcttctacaccatgcgaacagccaataacactagccgtgtatccaagctcacaaccctcaaggccaagcaagctaatactctgtactggtctcctgctgggcgcttcatagttcttgctgga

SEQ ID NO: 6102 - DNA, 400 bp, Zea mays
  Clone ID: LIB3279-059-P1-K1-C4
catggcttctcccaagccgctcctcctgctcgccacctcgttcctgagctgcggcctcctggtggccgccgactacgccccaatgaccctgaccgtggtgaacaactgcccctacccggtgtggccgggcatccaggccaacttcgggcacgacgtgctggagggcggaggtttattacttcagccgatctggggcaacgcataatcaggcgccccccacccctggtccggccgcatatggtcgcgcacggactgcacaagcttggaaccggaaggtggcgagatgttaaacttctcgcgttagacaatgcgaagcaccgttcctatgttgatcttaaagacaaatggaagacgctggtgcacaccgggagcatctcgccgcagcagcggcgtggcgagc

SEQ ID NO: 6103 - DNA, 311 bp, Zea mays
  Clone ID: LIB3279-059-P1-K1-C5
gctacgacttcctgcggaggaacagccggggtcccaactacgccgtctccatcccgcacgcctccacgctggaggtgggtatgatgtactatatctgatctgatgactgaacccctgaaactgagggggagaaatataggagcaggagaggaaatggaacaaaaagttttcagctgtatatgcatatatggtatccgtgtctggcaaacttattttgaggcttgctaaatatgtaccttttgtctctgaagttgttaaataaagcaaattaacttccaaaaaaaaaaaagaaaaaaaaaaaatacgaaagg

SEQ ID NO: 6104 - DNA, 286 bp, Zea mays
  Clone ID: LIB3279-059-P1-K1-C6
gaacacaacagacttggattttatacaccggaaccatttagtagggggttactactacatttttactgggggctaaaagggggggccagagctggaagcaaatttggggttgttaataactactccccctaagcgtttttgtggagatcggacagcgagaaggaccttggggttttgaagctcccgaggccgccattcggccctttcttccgccgtattcaaaaaccgctgattttaaggggtggcagtgcccgcgcgtcccggacttttttttcgtggtgcgggg

SEQ ID NO: 6105 - DNA, 345 bp, Zea mays
  Clone ID: LIB3279-059-P1-K1-C7
cggacgcgtgggcggacgcgtgggcgcgtacgttcggttctcggccactgctcagctctcgctgcagcgatggccctgcaggccccgtcactcatgcgcgcgccggcgccgcagcggtccgcgccgccacggccctccttctccgacccgtggtcgctgcggatgccggcgccagcgcggcgccgggtggccacggccactccattcaccacgcgggaagcgcccaaaaaaggatacatctgcgcaggcggcggaagcacctacaccgacgggaggctgctcaaaatgctggctggcaactacatatgccctgctgcttcgctcacgaatagtatggtcggaccg

SEQ ID NO: 6106 - DNA, 410 bp, Zea mays
  Clone ID: LIB3279-059-P1-K1-C8
cacgacacaaccccactcaaccggcagggaggccctcttcgtcggcggaggccatggtttccctcaagccgcagaagaggctcgccgcgggagtcctaaaatgtggcaaggggaaggtgtggctcgaccccaacgaggtctacgagatctcgatggccaactcgcgtcagaacattcgtaagctggtgaaggatggattcataattaagaagccacagaaaatccactcaaggtcccgggcaaggagggcccatgaggccaagcagaaggggaggcactcgggttacggtaagcgcaagggtaccagggaggctaggctccccaccaaaatcctttggatgcgcaggatgcgtgtcctcaggcgtctgctgcgcatgtaccgtgaagcaaagaaaatcgacacgcacatg

SEQ ID NO: 6107 - DNA, 277 bp, Zea mays
  unsure (1)..(277): unsure at all n locations; Clone ID: LIB3279-059-P1-K1-C9
cccacgcgtccgcggacgcgtgggcggacgcgtggttgccgtgcctgttgaaaatttcaaactgcttcgatccggagatgggnnctgtcgctcaacatatacagaatatataatatcaataaatcctggtgattcatctatgcgtacaagttacatcacatacattgtgaaattaaggtcaaattccctcggcacaaaatttgtaatattcattacttatccgccatacaatggaactagctaaacaggggtatcgaaaacaagttaaagattcaac

SEQ ID NO: 6108 - DNA, 405 bp, Zea mays
  Clone ID: LIB3279-059-P1-K1-D1
ctggcgcgtgggctggtgtctgatggccagctcggccgggacagataggacggtgacctactccaccatgaaacgtctgactacgaacaggtataccgatgaggcgagagatcgagctgtactcacgctaagtcacaagcgctgagcgcttacgcatggcatgtatacttgcgtttggcggagcagttgaacctcttgattgacaccggttcgttcattaccatgggcgtgtactgtgacctagccgcagcggggtacgcgcacaggcagatgatcaacaacagcgcgttcagacttagctgcatgcaacaggacatcgactatcgcgggggctcagaggaaacacgatgggtggcgcctcgctaggttcctaaattaaaaagtatatgtggctaattatttttg

SEQ ID NO: 6109 - DNA, 407 bp, Zea mays
  Clone ID: LIB3279-059-P1-K1-D10
ctcccgcatcgtactccgcgacctggattccatcgactctccggcctccatggcgtcctcgaagaaggttgtgacccgtgacgagtgggagctgaagctccgcgacgtcaagatccgcaaggaggacatgaaccgcctcgtcatgaacttcctcgtcaccgagggcttcgtcgacgccgccgacaagtttcgcatcgagtccggcacccagccggagattgacctagcgaccatcactgatcgaatggaggttaagagagcagtacagtcgggtaatgttcaggaggcgatcgagaaaatcaacgaccttaaccccacgattttggacacgaatccccaactatactttcatctccagcaacagaaactaatagagttgattcgcgtgggaaaaataaatgaagctt

SEQ ID NO: 6110 - DNA, 410 bp, Zea mays
  unsure (1)..(410): unsure at all n locations; Clone ID: LIB3279-059-P1-K1-D11
gccgaaggtggggaggagaagaaggatgatggcaaggaggaaaagaaagatgaagacaagaaagaagcggataaacagaaggatgatggcaatgctggtgatgaagggaaagacaaagaccctggcgccgttgctaacatgtatatgcactacccgaggtccaatcatctgagcgaatacggatatgcctaccagtacccacctcagctcttcagcgacgagaacccgaatgcctgttctctgatgtgagaaagccagaaccaagtgaccttaagcgcgaaaataagaggggattgagttatcccctgattttggaggttcaggaagtttagaacttttcttttctatttctaaggttgaactttctgtctggtacaaagtgaactctgngctgggttgtggacatcata

SEQ ID NO: 6111 - DNA, 400 bp, Zea mays
  Clone ID: LIB3279-059-P1-K1-D12
ctcaggtcgtccacaccccaacagcaactgttgcatgttctgcaagctcgcaggagaagctgttgagaccaaacatggagtcgacccgcgacgtcgcagcagctgcaaagattggaaagttgctcggcgagcgcctgctcctcaagggaatacctgcagtgtccatccacatgaagagagaacaaaagtaccatgggaaagtgaaggccgttatagattcagtcagagaagctggagtcaaactgttgtgattgcgatgttgaaaacattggacttagcatttgtgcaatggctgagctgtaatttttaagtgtttatcaatgcaaaatggctggacgttgctgttctgaaattctgggccaattgttactcaagtcaataaaggactttgtttggactt

SEQ ID NO: 6112 - DNA, 406 bp, Zea mays
  Clone ID: LIB3279-059-P1-K1-D3
cggacgcgtgggaccagccatggacgggccgcgttggacggaagaggtggacgacctggtcgacgccggcgacgtcgacggcgccatcgccctccttgagtccgtcgtctccgatttgtcaacctccgctgctccccctgccactgaccttcgcctcgccacggcgctcggcgacctcgcgggcctgcacgcctcccggggagacaccctccgagccgacgagctccgcgcccgcgccatcgcccttcggtcccgcgccacggtccctgggactgggaccctaggggatcaggagctgtcagagaaatgtccatcacaagagtgtgcaacgggttcaaaagactcagaagtctcagctaatactaataaaagcaatgaagatgaggaggatgattgggaggctatt

SEQ ID NO: 6113 - DNA, 410 bp, Zea mays
  Clone ID: LIB3279-059-P1-K1-D4
cggacgcgtggggttgaaactgagcctccggaagaaaagaagccttcatgtgagaggaacgcaaatggggaaaaagggaaaagtccacatagtctcttcacctatccttcaagggctgatgcaccagatataatctcagtaagctctgtggtgatggatgcttggcgtgtcctgttgtaagtaagcgtgagacgatcaagcatatcgccagcatttctgctagagctgtccatggcagacatacgggctccaagctcactgcatgcattctctagggcaccattgtacatgacacaagaaaactggaactcagctaggttttgcaatatctctgcttttgtctcaccgccttcaatctcataagaatctaggtcacccatcttcccaccagcttctgcttctttttctgc

SEQ ID NO: 6114 - DNA, 260 bp, Zea mays
  Clone ID: LIB3279-059-P1-K1-D5
cccacgcgtccgtccacagcgattcgtctcctctgctcttatctccgctgtgcctgtgcctgacttttcctcctcttcgtcccctcccacccgcaaccgcacagagaaaggggaggaggctctctacccagcgcagcccgagcaccctctttatggatgcttagaattttctgacgtaagtgatcttgccaccatcaaccatctcaactttttttctgctagaaccccccaggccggtctttcgtgctagaaagctcact

SEQ ID NO: 6115 - DNA, 401 bp, Zea mays
  unsure (1)..(401): unsure at all n locations; Clone ID: LIB3279-059-P1-K1-D6
cccacgcgtccgcccacgcgtccgatcccttcaatcttacgctactgctagatatctcgttttttcgcagattgacgatgcatcggagatccgatcggctaaccgaaagcgttgtgacgaagctcttgccgaaccggtcacaacgatgttctgggttgccctagaagatgaacggatggtgagaaattcctcgccggagttgtcgctagagtttgggtggtaatcgaacttcgacgagatagtcatgtgtaacaccctaaatccatcatctaaaagcaaaccagtttaagttattggtttccaatagaacaaaaaaatatttgtgttttcaaataatgtaatggtgacataactaaatcaagcaatntcttgaatagataaaatcttaccaagattgatgc

SEQ ID NO: 6116 - DNA, 387 bp, Zea mays
  Clone ID: LIB3279-059-P1-K1-D7
cggacgcgtggggtgatgttccatggggacctcccttactcctcaaaagacatcctcaagaagctagagactatagatgaagaaaatatcattggagcaggaggcttcggaactgtttataaacttgcaatggatgatggcaatgtctttgctttgaaaaggatagtgaaaacaaatgaagggctagatcggttctttgatagagaacttgagatattgggaagtgttaaacatcgctatttggtcaatctccgtggttattgcaactccccttcatcaaaacttttgatatatgattatcttcaaggtggaagtctggatgaagtgcttcatgaaaaatctgaacagttggattgggatgcacgtattaacattatacttggagct

SEQ ID NO: 6117 - DNA, 357 bp, Zea mays
  Clone ID: LIB3279-059-P1-K1-D8
gatgattatatgataaaacagccttagtgagttgttaaggtccatttaaacatacaaatgagtgaatgaccatcattttagtttagctagctctttagggtgcctgaagccctgaaccatgtagctgcctttttacaagaccacaacagcctttatttaaaacatgctataatctattcaaagcatactcggatagtaaaacagtggcaggtgtttccccttcatctgttgatccatgtagcttgttcttgtgcttttgaagcttttagttgtttctaataataaaactatagatagtatgcggcaacatataacatatttactttctccaaaacaagagtgaggctttcctatttt

SEQ ID NO: 6118 - DNA, 54 bp, Zea mays
  Clone ID: LIB3279-059-P1-K1-D9
cgcagacggcagaccttgttgtattgtatctttgcttcacatctcatgctggct

SEQ ID NO: 6119 - DNA, 409 bp, Zea mays
  Clone ID: LIB3279-059-P1-K1-E1
ccacaacacgctcctcacctcgcggcgactcttgccaagcattcctccgcgaaaaacgcatccgctccaaggggagttgatcgagaagcgttggtggacatgggtcagatccagtactccgagaagtacttcgacgacacctacgagtacaggcacgtcgtcctcccgccagaggtcgccaagctcctccccaagaaccgcctcctctccgagaacgagtggcgcgcgatcggagtgcagcagagccgcgggtgggtgcactacgcgatccaccgcccggagccgcacatcatgctgttccgccgcccgatcaactaccagcagcagcaggaggcggctgccgcgcagatgctggccaagtgagcccctggtggccagggcggcgaccaggaacgtttaaaaccctaac

SEQ ID NO: 6120 - DNA, 411 bp, Zea mays
  unsure (1)..(411): unsure at all n locations; Clone ID: LIB3279-059-P1-K1-E10
ctttaactcgggctaactatcttgcttcaccacctcttgttgttgcttatgcacttgctggaactgttgatattgattttgagaaagagcccattggatttggaaaggatggcaatgaagtctacttcagggatatatggccctcgacagaagaaattgcgcaggttgtccaatccagtgtgctgcctgacatgttcaagggcacctatgaggctatcacaaaaggcaacccaatgtggaaccagctaactgtcccagaagcgtcactctactcatgggattccaaatccacttacattcatgagcccccttactttaaggacatgaccatgtccccacctggcccctctacagtgaaagatgcctactgcttgctgaacttcggngacaagcatactacagatcacattt

SEQ ID NO: 6121 - DNA, 354 bp, Zea mays
  Clone ID: LIB3279-059-P1-K1-E11
cctaactgaacccatggtgctctccgccgctcgccggctctccaccaccgcgtcctcctcctccgtcgccgacgcgccgccaaagctttcttcgctgttccagaacccgaagcctcgaccgctgcctgtccgcggcgtcgaggagccgcggcggggggccaggcccaggccgaggcagccctgggaggaggaggcgggggcgctgctgctgcggctccacaaggggaggtacctcccgggccccgacctctcgtcggcgccgcacgctgtctcacccgacgccgtcaagaccgtcgccgagtggttcgggcatgaccaccagcccgtcgccaaatggctgtcagggaatgattt

SEQ ID NO: 6122 - DNA, 397 bp, Zea mays
  Clone ID: LIB3279-059-P1-K1-E12
cccacgcgtccgcccacgcgtccgaggtaatctggtggtccgatgcgcggaagttttgttctgttgttttggctataataaaattagccttcatttattggaagtgcctttactttctgaagttttcaaaggggagggaaggaaaattgatgggcggcgggtccgtgtaaacatggttaatgagagacctgctgggaaccgtggtggtggtggctatggcggcggcggttatggaggtggtggctacggaggtggcggcggctacggaggttttggctatggtgggggcagccaaagctatgatgcttgaggggggcaggatcctattaggcgcattatcaaccaagatttttgaaataatgaactttaggacttggtttgaacttttatgtaaagc

SEQ ID NO: 6123 - DNA, 410 bp, Zea mays
  Clone ID: LIB3279-059-P1-K1-E2
ctccactcatcttttcgcgtttagaacctctaaaatttcccccactcgccagtcgcagcagcacctgtagccatggacgccagcggagccggtagcaaggggaagaagggtgcggccgggcgcaaggcaggcggccccaggaagaagtcggtgacgcggtccgtcaaggccgggctgcagttccccgtcggccggatcgggcgctacctgaagaagggccggtacgcgcagcgcgtgggcactggcgcccccgtctacctcgccgccgtcctggagtacctcgccgccgaggttctggagttggcagggaacgcggcgaaagacaacaagaagacgcgcatcatcccgcgccacgtgctcctggcgatccgcaacgacgaggagctcgtgaagctgctggcaggcgtcac

SEQ ID NO: 6124 - DNA, 403 bp, Zea mays
  Clone ID: LIB3279-059-P1-K1-E3
tgagcttgttagcacccacgggtactcccagaaccagataattgtttggagatatccaacaatgtcgaagcttgccactttgacagggcacacgtaccgagtattgtatttagctatttcccctgacggccagaccatagttactggtgccggtgacgaaacactccgtttttggaacgtgttcccctctccaaagtcccagagctctgatagtctaagttgcatcgggggtacatcgtttgttagaagctacatccggtgacccgcagaaacgtagtttgaactgagctcataaggtaattgcagcatatgtggatgatcatcagcatcatcccattcatgacaaccatgccatcaggtcgtcaaccatccaaggtagctgaatttttgagatgccacggcg

SEQ ID NO: 6125 - DNA, 382 bp, Zea mays
  Clone ID: LIB3279-059-P1-K1-E4
tcgacaccgagaaaagcgcagcaaagcaacgcaaagcccacgccgctacagtgctctcttgcctgccgctacgagccaacgactcgaacgcatacactccaatggcagcgacggtgatggcctccatgagccccctcgcctccgccacccccggcgcgcgtcgcgctttccctgtacggctgctccaggcttctacactcgcgccgcgccggcgcgccttggccgtgagggcccagagcgacgacgccgagccaaaagaggaggtggcctcctcctcgccttctccgtccgccaccccggcgccaaagtccaaggcggcggagactgcgagccccgggctgggggacgcgctggcattcagcggcccggctcccgagcgcat

SEQ ID NO: 6126 - DNA, 159 bp, Zea mays
  unsure (1)..(159): unsure at all n locations; Clone ID: LIB3279-059-P1-K1-E5
tcgtcgactccgataaaagcgcagcaaagcaacgcaaagcccactcctctacagtgctctcttgccngccgtgacgagccaaggacttgaacgcattcactccaatgtatagatactgtgattgcctatcatgagcccccttgtctacgccacccccgg

SEQ ID NO: 6127 - DNA, 143 bp, Zea mays
  Clone ID: LIB3279-059-P1-K1-E6
agaacccacaaggttcactcatggcgcccacgtccatgctcccgttcgcgccctccaatacgtcgctgccctattcctcccgcgccacaactgccgccgcgttcgctcctcgtgggctccaccacgccgcggccggaaggagc

SEQ ID NO: 6128 - DNA, 402 bp, Zea mays
  Clone ID: LIB3279-059-P1-K1-E7
cctccccagtcgccgccagccgcgcgcacacccaccgagagctcgggctttctttctccgttcctccctcgcgcgctcagggtttcacgatggaggccgaggcggcggccaagagggcgcgggagggcggggaggacgccaccgcgccggtggcggtggccgaggcggcggtcgccggtgctggcgagcaggcggtgatcttcgccgtcatcccaggatggttctccgagatcagccccatgtggcccggtgaggcgcactccttgaaggtggagaaggtgctgtttcagggcaagtcagactaccaaaaagtgaaggtttttcagtcctccacgttcgggaaggtgcttgtccttgacggatttattcaggagacagagagggttgagtgttccataccaa

SEQ ID NO: 6129 - DNA, 399 bp, Zea mays
  unsure (1)..(399): unsure at all n locations; Clone ID: LIB3279-059-P1-K1-E8
cccacgcgtccgcccacgcgtnncggangaggggtcccgtgttcgtgggaggaaatgtgaaatggagggcttttcgccttgttctggtaactactcatggggaagtgaagctggtacccgcaagacccgtattcttgacgtggtctacaatgcatcaaacaatgagcttgtgaggacacaaacccttgtgaagagtgccattgtgcaagttgatgctgccccattcaagcagtggtacctcactcactatggagttgacattggtaggaagaagaaaacccctgctgcaaagaaggataatgctgaaggacaagaggttgaggcagcagctgaggaaacgaaaaagagcaaccatgtcacgaggaagcttgagaagcgcaaggagggacgtacccttga

SEQ ID NO: 6130 - DNA, 401 bp, Zea mays
  Clone ID: LIB3279-059-P1-K1-E9
cggacgcgtgggatcaatggaaagcaagttgaaattaagagaaccataccaaaaggttcggtgcaatctagctctaaggatttcaagactaaaaagatatttgttggtgggcttccgtcaacactaacagaagacgaattcaagagtttctttgcaagatatgggactgtggtggaccaccagattatgtttgatcatgaaaccaaacgttcccgaggctttggatttatagtttttgcttctgagcaagttgtagatgatttgttagcaaatggaaatatggttgaccttgctggttcaaaggtggagatcaagaaagcagaaccaaagaaatccttcaatgcaccgccaccaccagtgcatgttagaaatgctaggtcagcatatgatagcggctctag

SEQ ID NO: 6131 - DNA, 332 bp, Zea mays
  Clone ID: LIB3279-059-P1-K1-F1
gttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggc

SEQ ID NO: 6132 - DNA, 411 bp, Zea mays
  Clone ID: LIB3279-059-P1-K1-F10
cccacgcgtccgcccacgcgtccggttatttcacagtttatgatggtaacggaacccttgagggagggggactactgaagggtgtttcatcaagatccaagcaacacatgagatgaaaggagaagggcatgtgatagagagcatcatgtgaacccgatgaagattaccactgtatcatgattcatcagctctaacatgcgcgacccaacactatgcttctccacttcaggacatggatatgactcttctatgtttaagccacggcagcttggtgtatttatgccaaagattttttgagcactaacacaccaaaccagcgcctatgaagtgcttttgtatacaacgatcacctgcttcttgcaccatccatggataatctacgtagctgcaaactgtcttagttacatatta

SEQ ID NO: 6133 - DNA, 403 bp, Zea mays
  Clone ID: LIB3279-059-P1-K1-F11
cccacgcgtccgagccagaagggcagcagtacttatagagttgttccaccatggccaatgatggagacgatggacaaagccaggattatctcttcaaaattgtcctgatcggggattcctctgttggtaaatcgaacttgctggcaagatttgcaaggaacgagttctacccaaactccaagtccactataggagtggagttccagacacaaaagttggtaatcgatgggaaggagattaaggctcagatatgggacactgctggacaagagcgctttcgagcagtgacatctgcttactaccgaagcgctgtgggagctcttctcgtctatgatattagcaggcgtcagactttcgacagtgttggtcgatggctcaatgaactacacaatcattctgatat

SEQ ID NO: 6134 - DNA, 409 bp, Zea mays
  Clone ID: LIB3279-059-P1-K1-F12
gcgtccccttccgccgcctcaccggccactcccacttcgtccaggacgtcgtcctcagttccgacggccagttcgccctttccggctcctgggatggagagctccgcctctgggacctctccaccggcctcaccacccgccgcttcgtcggccacgagaaggatgtcctctccgttgccttctccgttgacaaccgccagatcgtctccgcgtcccgcgacaagaccattaagctctggaacaccctcggtgagtgcaagtacaccatcggaggtgacctcggtggcggcgagggccacaacgggtgggtctcctgcgtcaggttctccccaaacacatttcagcccaccattgtctccggttcctgggaccgcaccgtcaaggtctggaaccttacgaactgcaagct

SEQ ID NO: 6135 - DNA, 303 bp, Zea mays
  Clone ID: LIB3279-059-P1-K1-F3
tacagattgacagcgtcatctatgccaagatcatggacccataccatgcttcctagggtgtggagaatccaataaatgctgtcctacaactcgcacaaaaaacaatgagaagtgaactcgggaagataaccttagataagcacttttgggggtagggaggcaatggaacaccttgtcgaaagaagattcacttatgcagccagagatcggggcctgaaaagaatccgctatgaaatcacgtacataaattctccagcacggattatgcaagctatggagatgcatgctgatgcaaaaaggaaa

SEQ ID NO: 6136 - DNA, 413 bp, Zea mays
  Clone ID: LIB3279-059-P1-K1-F4
cggacgcgtgggcggcaccctcgatcccgagcgtggttaatccacgcatcgaccggcgaacgccaccgtatcccatctcgaatacctccgcgctcagcgtcatggacggcttctccaaaacgatcggcggtggtggccctaacgttccggcgggatcccaccccgcgggcgggagccaggcggcggcagggggaggcgcgacgcagcggacgcagtatccgtatgtgactggtacttcagtcattgccttgaaatacaaggatggtgtgatcatggcatgtgacactggagcctcctacggatcaactttgagatacaagagtgtggaacgcattaacgctgttggcaagcatagcatcattggagcaagcggggagttcagcgatttccaggagatcctgcgctatctggat

SEQ ID NO: 6137 - DNA, 410 bp, Zea mays
  Clone ID: LIB3279-059-P1-K1-F6
gcgacccgtaccccgcctcccggttcaaccaaatccctctcgcctcatccccaccagcgcaaagccgccctatcgtcctgtcgtgagaagcaatggcgggccgtggcaaggcgattggcgctggtgccgcgaagaaggcgacgtcaaggagctccaaggctgggctgcagtttcccgtcggcaggatcgctcggttcctcaaggccggcaagtacgccgagcgcgtgggcgccggcgcccctgtctacctcgccgctgtcctcgagtacctcgccgctgaggtcctggagcttgctgggaacgcagcgagggataacaagaagacccgcatcgtgccgcgtcacatccagctcgccgtgcgcaacgacgaggagctgaccaagctgcttggtggtgccaccatcgcgagc

SEQ ID NO: 6138 - DNA, 345 bp, Zea mays
  Clone ID: LIB3279-059-P1-K1-F7
ctcccctcttccccagttccccttgtcctttgcgcaggggaaaaggagcgccgcagaccgagggacggcgacgaggtatccaatggccgaccctgacgtgatcgaagtgaccttcggcaacgacgtgattaacaccaccgtcacatcctccggccaggctgtggagcgctggatcgcggagatcctcgcgttgcaccgccccggcagcaacggctacagcatcatcgtcgggcttgacgttgagtggcgcccaagcttcggcccgcaccagaacccggtggccacacttgagctctgcgtcggacacagctgcctcattttcagctctttacgccactacgtccc

SEQ ID NO: 6139 - DNA, 354 bp, Zea mays
  Clone ID: LIB3279-059-P1-K1-F8
cggacgcgtgggcggacgcgtgggtttttttttttaatcaaaacggcacgaggttccattacttctcaaaatagctgtggcctgtagcttctttcattgtttcaaagcattacaacataagcagcaaaaccagaaacagtcctcataagcaccacttattagggcagtacaacacaaacgataagcgcggtgcagatcaagaaagaaccacaacatgtagaagccatataaaagcatgattaagcacagcagaccaccaaaagcttcttactgaaaaaaaaggccgccttaggcagaaggtttctccgacttgagtggcttcaccacctcccaagtgaagtcagggtcgtccct

SEQ ID NO: 6140 - DNA, 403 bp, Zea mays
  Clone ID: LIB3279-059-P1-K1-F9
ataccgcatacgtttcacccttcctctccccactccgaaccctagccaccgtgctcacttcccagctcgaacccgccgcgggcgagtccacggcagtgcaggacctgatcctgcggtctaggccgcggcggtgagatggtgatggtgtcaggcggcggagggaacgcgtgggcgaaggagatgaccctccgccgcaggatagccagcatattcaacaagacgcaggaacacttccctactctgaaggactacaacgattatctggaagaagttgaggacatgactttcaacctgatcgaagggatagatgtcgaggagattgaagcgaaaattgcaagataccaacaggaaaatgcggagcagatatacttgtccagagctaaaagggcggaagatcttgcgg

SEQ ID NO: 6141 - DNA, 401 bp, Zea mays
  Clone ID: LIB3279-059-P1-K1-G1
agtatggcgtggaggcttaccctttcacaccagatcggatcaatgaactgaaggaacaggaaaaggcagaaaaggagaatcaaactattcaaagcgtgcttggcacatctactcgagactatctcatttcaaacaagggagacaaggtacccatctctgagcttgaggggaagtatgttggtctttgctttgtggtggatggctttccaccactcgctgaattcactgaggtgcttgctaagatctatgagaaactcaaagaagtgggagagaaatttgaagttgtagctgtatccttggacagtgaagagtcatcatttaatgagagttttgcaaagatgccttggcttgcaattcctcaaggtgacattaagtgtcagacgctggttcgttactttgag

SEQ ID NO: 6142 - DNA, 411 bp, Zea mays
  Clone ID: LIB3279-059-P1-K1-G10
ttcccgtcctgtccttccacccggcggcttaaaccctagttctcactcccatcgccgcttcagctccgccgctgcagatggagttctggggtctcgaggtcaagcctggttccactgttaagtgtgagcctggatatggctttgtgctgcacctttcccaggctgctcttggggaatcgaagaagagtgataatgccttgatgtatgtcaaaattgatgatcagaaacttgccattggaaccctctctgttgacaagaacccacacatacaatttgatctgattttcgataaagagtttgagctgtcgcacacatcaaaaactaccagcgttttcttcactggctacaaggttgagcagccattcgaggaagatgaaatggatcttgattctgaaaatgaagacgaggagc

SEQ ID NO: 6143 - DNA, 401 bp, Zea mays
  Clone ID: LIB3279-059-P1-K1-G11
gagtggccatggcgtcatccgccgccgccgcctcctcggcttccgcgctcttccgcctcccggggtcgggtcacctgcgtgcaccgccacgaagcgggtggcgagaccacaggcggtcccgtcgcgcgaccgtgcggtgctcgttcgcgccggtggagacggcccggataaaggtggtgggcgttggcggaggcggcaacaacgccgtcaaccgtatgatcggcagcggcctccagggcatcgaattttatgctataaacaccgattcccaagcccttattaattcacaagcgcaatatcctctgcaaattggagagcagttgacccgcggcttatgtaccggtggaaatcctaattttggagagcaagctgctgatgaatcaagaaaaaccatagccact

SEQ ID NO: 6144 - DNA, 414 bp, Zea mays
  Clone ID: LIB3279-059-P1-K1-G12
gctccggctgcgctctgccttgctttcctgctacctgctctagcgcgagcgagcgaggtacggcggccgatctggcggcgcaggcggagggctcggccggggccggcaagtcggcgccgaacatggggaggggccgggtcgagctcaagcggatcgagaacaagatcaaccgccaggtcaccttcgccaagcgccgcaacggcctgctcaagaaggcgtacgagctctcggtgctctgcgacgccgaggtcgcgctcatcatcttctccaaccgcggcaagctctacgagttctccagcacgcagagcatgccaaaaacacttgaaaagtaccaaaaatgcagttttgcagggcctgaaacagcactccagaatagagagaatgagcaactgaaaagtagccgcaatgagtacc

SEQ ID NO: 6145 - DNA, 330 bp, Zea mays
  Clone ID: LIB3279-059-P1-K1-G2
cggacgcgtgggcgggcacaagatcaaactcatgcacacgaccttgtaaccggggctggagaggggtcgcataagatagagggcgaccaacataccacattgtacagaaaggggcgtggacatcactatgagttgaagatgcacgggccagggtctatttgcactgggatcagtcagcagtttcgaatgatgcgttttactgctggagaattacaaaagaagcttcgaacgtaggctggtcgaattgcatgaaccaaggactaatgacaccgttccctgatgttaacgcaaagccaggcgatgtaattgcaatcataaagacaactgttt

SEQ ID NO: 6146 - DNA, 395 bp, Zea mays
  Clone ID: LIB3279-059-P1-K1-G3
ggcggcggagcggaaggcgaaagagtagcagcagcaggcggcgccgagtagcggctccccacctcgagcttgccaccatggctagaggattgaagaagcatttgaagaggctcaatgcgcccaagcattggatgctggacaagcttggcggagcttttgctcccaagccatcttctggacctcacaagtctagggagtgcctgccactgatcctcatcatcaggaacaggctcaagtatgctcttacataccgtgaggtcatttccatcctgatgcaacgccatgtacttgtttgatggcaaggtcaggacagacaagacctaccctgctgggttcatggatgtcatttccatccccaagaccaatgagaactacaggctgctgtacgataccaa

SEQ ID NO: 6147 - DNA, 287 bp, Zea mays
  unsure (1)..(287): unsure at all n locations; Clone ID: LIB3279-059-P1-K1-G4
ggcggtggatcggatggcgaaagagtagcatcagcatgcggcgcccagtagggggggccctcctngagcttgccaccatggctagaggatngaagaagcatttgaagaggctcaatgcgcccaaggcattggatgctggacaagcttgtcggttcttttgctcccaagatatattctggacctcacaagtttagggtgtgcctgccactgatccttttcattatgaacagtctcaagtatgctcttacataccgtgaggttatatcctacctgatgcaacaccttgt

SEQ ID NO: 6148 - DNA, 412 bp, Zea mays
  Clone ID: LIB3279-059-P1-K1-G5
cggacgcgtggggttgtttcttgtggtcggccaagattccagtgcggaatatatgtgggcgatgataaggtgatccatttcacaagaggaagaggacaggaggtcggaacaggaactgtcgtcgatattattcttgtgagttccaccccaaaacgaagcaacacgccttgcccggtgtgcaccgacgaaaccagcgacagcagcacatagacgaacggcgtggtatcctcctgcctcagctgcttcctagctgggggtgctctctaccgtttcgagtacgcagtcaacccggcgctcttcctcgccaaagcgcgaggagggacgtgcacgctcgcttcctttgaccctgacgacactgtggcttgccgcgccagatacctggctggcaaacgtttaggtgctacaacctgtt

SEQ ID NO: 6149 - DNA, 408 bp, Zea mays
  Clone ID: LIB3279-059-P1-K1-G6
ccgtccgtaccctccagaggaccgtccctgctgctgtgcctgctgttgtcttcctctctggtggacagagcgaggaggaggccacccgcaacctcaatgccatgaacaagctcagcaccaagaagccgtggtccctgtctttctccttcggccgtgccctccaggcgagcaccctcaaggcctgggctggcaaggtggagaacttggagaaggctagagctgccttcctcgccaggtgcaaggccaactctgaggctaccctcggcacctacaagggtgatgctgccgccgacaccgagagcctccacgtcaaggactacaagtactgagttgcttctctttgcgtgcccgttttggaactcctgcctacgagctaggttgcggagtgtggtttgctcgttagagctt

SEQ ID NO: 6150 - DNA, 402 bp, Zea mays
  Clone ID: LIB3279-059-P1-K1-G7
ctgcccctccccgcgccgttctttttggttccccactcctcagtccccgccgccgccgaaacccgcagatggaggtcgtcgtcgccgcgaagcagaaggcgaagaaacacatacacctcttctactgctcagaatgcgaggagctcgccctcaagatcgccgccagctccgacgccatcgagctccaatccatcaactggcggagcttcgacgatgggttcccgaacctgttcatcaacaaggcgcacgacatccgtgggcagcacgtggcgttcctggcctccttcagctcgccgtcggtcatattcgagcagatctccgtcatctttgcgctgcccaagctattcatcgcctcattcacgctcgtgctgtctttcttcccaacgggctcattcgagcgcg

SEQ ID NO: 6151 - DNA, 374 bp, Zea mays
  Clone ID: LIB3279-059-P1-K1-H1
atttccgtcacaactcacaacccgagccccccaaacccgaagcagcaggagctcccctgaccttgctccgcctccgatcaaggaaaaggaagatgagctactacggccagcagccccccgtcggcgtcccgccgcagcaaggctacccggggaaggacggctacccgccagcggggtacccgccggccggctaccccccgccggcgcagggctacccgccgcagggctacccgcagcagggttacccacagcagggctacccgccgcagtacgcgcagccgcctccacagcagcagcagagcagcgggccttccttcatggaaggatgcttggctgccctctgctgctgctgcctcctggacgcctgcttctga

SEQ ID NO: 6152 - DNA, 398 bp, Zea mays
  unsure (1)..(398): unsure at all n locations; Clone ID: LIB3279-059-P1-K1-H10
cccacgcgtccgcgagcttcgagaagcacttcttgaaaagttacgcagagagaataagcttactaagtcatcagttatggtcactgctggtgcaaatcaagcttttgtgaacttggtcctcactctttgcgatgctggtgattctgttgtcatgtttgcaccatattatttcaatgcctacatgtcattccagatgacaggtgttactgacatattagttggtggttctgatcacaagacacttcatcctgatgttgattggttggagaaggttctgaaagaaaatgaccctatccctaaacttgttaccgttgtgaatccggggaacccctctggagcttttattcccaggcctatgcttgagaggatntcagatctgtgcanaaacgctggtgcat

SEQ ID NO: 6153 - DNA, 413 bp, Zea mays
  Clone ID: LIB3279-059-P1-K1-H11
tgctgaagcacaggccccagctgctgaggaggaggacgatgatgatgttgacctttttggtgaggagaccgaagatgagaagaaggctgctgaagagcgtgctgcagctgccaaggcttctggcaagaagaaagaatctgggaagtcatcagttttacttgatgtgaagccatgggacgatgagactgacatggccaagcttgaggaagctgttaggagtgtccagatggaagggctgctctggggcgcatccaagcttgtcccagtcggatatggtatcaagaagctgcaaatcatgatgaccatagtcgacgatcttgtctctgtcgacactctcattgaggactatctgtgcgctgagccagttaacgagtacgtccagagctgcgacatcgttgccttcaacaagatct

SEQ ID NO: 6154 - DNA, 59 bp, Zea mays
  Clone ID: LIB3279-059-P1-K1-H12
cgctcgcgcacacgacctagctgatgcgctggtggacaagtcacacattgagctttttc

SEQ ID NO: 6155 - DNA, 395 bp, Zea mays
  Clone ID: LIB3279-059-P1-K1-H2
cccacgcgtccgcccacgcgtccgtgctttttggtccacctggcaccggtaagaccatgcttgccaaagctgttgcaacagaggctggtgctaattttatcaacatatcaatgtcaagcattgcttcaaagtggtttggagagggagaaaaatatgtgaaagctgttttttcacttgcaagcaaaatttctcctagtgttattttcgtggatgaggttgatggcatgctgggtagacgtgagaatccaggggaacatgaggccatgcgcaagatgaaaaatgagtttatggtgaactgggatggtcttaggacaaaagacaaagaacgtgttctggtacttgctgccactaataggccatttgatcttgacgaggctgttgtcaggaggctcccc

SEQ ID NO: 6156 - DNA, 404 bp, Zea mays
  Clone ID: LIB3279-059-P1-K1-H3
tccatgaatgatcatcacatcatactattgggacacttcaacagataatagcacataaaggtcacattgtttatgcagtcaaaatgagaagaaagcatctgcataagcattgtttgcactttttggctacatagttcttataacgcttagataataccagctaacctggcatctcattttgcatcccaatccttcagcttcttacttccctttggtttagcaataggtgcattcatgcctgccatttttgcattatactttgctcgcagaggcccatttgttgaccatggtgcattccaatctgtagtgtcttcattaacaagatgcgtacatttcgtcctgccgctgcgcccgaaatgtttaacttgcatgaccttgggcaggatgctcttatccatcttatc

SEQ ID NO: 6157 - DNA, 410 bp, Zea mays
  Clone ID: LIB3279-059-P1-K1-H4
gtaaacttgaatatgtgttaattcttgttgtttttcctcttgttgtatttggtatacattcatctgaacaatttcccgtttctcctactcgctgccctcttccttgtttattcctctaatgtgttgctgccttgctgggtaacaagtgagtgcggccccatgtattttctcaccaatttgatgaattcgtacagaacttactttagtacagtaatctgttggaagggagttcctgtcttccatcaaatattctgctttttaccagggtacctggtttcatgtacccatggatgttttgtttctttcaaactttaatagcttcatataattcccaaaaaacaagttttctagcggtatctattaaataacatttctttgtgaggcgtattgctgcatgcttgtttattaag

SEQ ID NO: 6158 - DNA, 324 bp, Zea mays
  Clone ID: LIB3279-059-P1-K1-H5
atcggcaacgttcgctcctttcatattccatcctcccttgaaacgatttcacagcggcaaatgctccatcacagagcaatgccatattgatatgccatgctgccgcgtcaaaaatatgcagcaggaattccagccgccagcccaagcaagaagaaagagaggcctacatgcccttaacgccacggtcttacggccaccagctcagtccagcgcctacggtttctgcggcgcctgcttgaacgcaacggtgggtgcgatccgggaggctctgctgcggggctcggcgacaagctctgccgcgaaccagtccagcttctccgtgtt

SEQ ID NO: 6159 - DNA, 412 bp, Zea mays
  unsure (1)..(412): unsure at all n locations; Clone ID: LIB3279-059-P1-K1-H6
ggccggaccgacgcgtccgtccacgcgtccgaaggaagagagctaggatgctaaaccatccacacatgcaagcgagacatgtgtacaagactaatcaaaatttcaatactctgacgtaaagcagacgctatataaccaatcgtatcacagaaaacctttaatctttttcccgacacctaccaatattttaaaaaccatgttgcgctatacttaccaatgtacagaggaaacacagatgcattacaaacagcaagatgactggaatcaggatgcagcctatcaaacctctggaaagttttgacacgccaagaaatcacaattccaaggcatatgaagtgctgcttngaacgccctaattccaccgcagcttcgttgaaggagcaatgtttgtactgaagacatgagcaaactc

SEQ ID NO: 6160 - DNA, 334 bp, Zea mays
  Clone ID: LIB3279-059-P1-K1-H7
cggacgcgtgggttcgaaacctccgccccgtcgcataaacccctcctcgcctcctccgcccgagcctgcctcctcatcgacttatacgcctccttctcttaactcgacgcactagcctcagccaattgtcgcatttcgtcgctatggggtccacagcggccgtctccgtctccgcctcggcgatcgcgtcccgcggctgcgccagatccgaggctgcgcggcggccaggtggaatccgggtctgcggactccggagcgaggccctcacgtgtcactcgcttcggatctcgcaggcgcccgcgaggctgacggtggcgaggccgccgccgccggc

SEQ ID NO: 6161 - DNA, 257 bp, Zea mays
  unsure (1)..(257): unsure at all n locations; Clone ID: LIB3279-059-P1-K1-H8
gcctcattcatctccattagaaacaccgtcgcacccacactcttccttggggcgcagcccaaagccgcggaacgatgggtcgcgcgaagcatactgcgcgcaagtccacgggcggtaaggtccacaggaagcatattacgaccaaagaatggcgcaaaacggcccctgctaccggcggagagaaaaagccgcaccgcttccgcccgtncaccatggcgctgcgcgagatccgcatgtaccagaagagcacggagttt

SEQ ID NO: 6162 - DNA, 401 bp, Zea mays
  Clone ID: LIB3279-059-P1-K1-H9
cggacgcgtgggcagcagcgttgcagcgacgagcacaaaaagaaaaaggaaattcctctcaacatcaccagaccacgacctccctgccgagctccctccctctccgttggtgatggcatctcagagctccaagaccgcggacaccgccgcgcctccgccggaggttgcagccaccggagaggcggctccgggcgcggcttcttcaacaccggcacaaaaccctaacgctgctgcaaccgcagtggccggtgccacggatctagagaagaagatgcgccgcgcggagcggtttgggatgccagtactgatgtcagaggaggaaaagcgcagcagtcgcgccgagagatttgggactggctcttcaagtgtaaaggaggaagagaagaagaagccagggctga

SEQ ID NO: 6163 - DNA, 403 bp, Zea mays
  Clone ID: LIB3279-060-P1-K1-A10
ggatgctgatggtatgaacagggagtggagcatcaagagccgcgagctctctctccagctaaacagtgtcgttcttccacttggctcgcttcgggttgggctgtcgcggcacagatcactgctatttaaggtacttgctgaccgagttaacctaccatgtaagcttctgaaaggaatatgttataccgggacagatgaaggagctgttaacttggtcaaagttgattttgacagcatggaatatattattgatttgatgggagctccaggcaccttaatcccttcagacatttctgggagtcagtttcaggactccaacaatagccaattgagcagtgatgccattgaagagagtgtagcagaattgtgcttagcccttgagcagattaatggtggatatgag

SEQ ID NO: 6164 - DNA, 338 bp, Zea mays
  Clone ID: LIB3279-060-P1-K1-A11
tcgcccacgcgtccgcccacgctttcgcaaggacttgatggcgcgtgtgctgattcttatggtctcggtccactcaagccagcatatctacaccagggcaaccaatacataaggatggggaagaggtctaaaatgcattgtctgccctctttgcaggaggagctcgtctttagaacagttgccatctttgtcaagagttgccaatgttatgttactggtgatgagttccaggtgacggcaacattttagagattttgagtatttctatcagttggtactatggtttgccaattataagttactttacctaaatggtttttgttttaaaaaaatattac

SEQ ID NO: 6165 - DNA, 118 bp, Zea mays
  Clone ID: LIB3279-060-P1-K1-A2
ccaacgcgttcggagcgtggcctcactatccttgtagcatcccccatcgtgggcttcttatcggattcaaccgcaatggatatggacttcacctacgcgctagacgtctgcgccacag

SEQ ID NO: 6166 - DNA, 270 bp, Zea mays
  Clone ID: LIB3279-060-P1-K1-A3
cggacgcgtgggcccgcatcgaatccggcggatcgggagcgggagagaccactcccaaatcgcgtcgcgtcgcgtcgagagcgagagcggaagaggtgcgcgcgggggaaccgagccgactgatggagccgacggcggcgcccgccgcctgcgagatcgcgcgcctgccggatgacctcctgtcggcggcgctcggccggacggggccgctggacgcctgccgcgccgccgaggactcgccggtctttcgcgccagggacgactccgacg

SEQ ID NO: 6167 - DNA, 410 bp, Zea mays
  Clone ID: LIB3279-060-P1-K1-A4
cggacgcgtgggcggacgcgtgggcggacgcgtgggcacgagcgcaacaccatccacccaccagttcgaagcggaggcgaccggcaacctgcggcggagatgtcaggcaggggcaagggcggcaaggggctcgggaagggcggcgcgaagcgtcaccggaaggtgctgcgcgacaacatccaggggatcacgaagccggcgatccggaggctggcgaggaggggtggcgtgaagcgcatctccgggctgatctacgaggagacccgcggcgtgctcaagatctttctcgagaatgtcatccgcgacgctgtgacctacacggagcacgcccgtcgcaaaaccgtcaccgctatggacgtcgtgtacgccctcaaacgccagggccgtactttctatggcttctgcggcta

SEQ ID NO: 6168 - DNA, 412 bp, Zea mays
  Clone ID: LIB3279-060-P1-K1-A5
atagcctgcagccctccatccacgaactcccgttctccatttccagccatggcggtgtcgatcgagctcaccaaggagtacggctacgtcgtgctggtgctggtggcctatgtcttcctcaacctttggatgggcttccaggtcggcaaggcccgcagaaagtacaaggtgttctaccccaccatgtacgccatcgagtcggagaacaaggacgccaagctcttcaactgcgtgcagagggggcaccagaactctctagagtggatgcccgttttcttcgtcatactgctgctgggcggtctgcagcacccgaccatcgccgccggtctgggcggcatctacatcgtcgcgaggttcttctacttcaagggatacgccaccggcgttccggacaaccgtctcaagattgggg

SEQ ID NO: 6169 - DNA, 411 bp, Zea mays
  Clone ID: LIB3279-060-P1-K1-A6
cggacgcgtgggcggacgcgtgggctcgaggcgcaggtcgtcgagaagaccgtcgaggtcgccagtgcggaccgcaagaagtcctccgccaagggaggtggtaacaaggacgccaagcgcaagcgctcgcccaccgccttcttcctcttcatggacgacttcaggaaggagttcaaggccacccatcctgacaacaagagtgtcgctaccgttgcaaaggaaggaggggagaggtggaagtccatgacagacgaggagaagaagccttacattgaaaaggccgcggagctcaaggctgaggccgagaatggcgagggcagtggtgagaacaatgttgccactaagaaagccaagacagatgaccaggaggtggatcagccagcaaagaagctcagaaagtgcaaggctctt

SEQ ID NO: 6170 - DNA, 386 bp, Zea mays
  Clone ID: LIB3279-060-P1-K1-A7
gtggcatggcacaggttttgaacacggctccagtagcaccagcaaatgtccctatgccaaatccagcaccggcaatttcatctgtggcgccttcagaacaatctgcacccagcaaggaggatgttgaattagcaatggctatcaatgcctccattcaatcagctattgcagagggagtatcagtgcccaatgttcaaccaaatgcatccacccccaacaacaatggctgggctgcccctccaagtaattctcacaacggatggggaccaccagccactcctgcaccatcaaagacgagcggtcagtcccaggtccgggtagacgccccaagcagcagcacttacaatggatgggatgtgcccggaacaagctctagtcaaagttca

SEQ ID NO: 6171 - DNA, 167 bp, Zea mays
  Clone ID: LIB3279-060-P1-K1-A8
tcggggagacgttgtaccttcagcgccgtcgttgatgatagggagctgggggccttacgcgcattcaacgagagctagcatcatttgcggccgctatatagcagtttcggctccgcaagggtgctgtagaactagccttgattctgaatgtggaggtgtactctgat

SEQ ID NO: 6172 - DNA, 285 bp, Zea mays
  Clone ID: LIB3279-060-P1-K1-A9
ggaagcccttgtacccccaccgccgccgctgctgctagggagcggggcggtgccgcgcgcgcctacaacgagagctagcagcagtagcggtcgttatcttgtcgctccggctccgttcgtgttcccaagtcccagcctagatgccgcatatggaggggtccactgatcagatcgccgccggctggttcgctaaggagccggctttcgagcggtccgtgggcttgccgaggaccggttttttcagtcgccattaacatcgcaggctctggatttcttgccgagggg

SEQ ID NO: 6173 - DNA, 416 bp, Zea mays
  Clone ID: LIB3279-060-P1-K1-B1
cgcgagagcttgtcggagggctctctgtctctgtgataaaccgatacgcagaggaagctgcggagaggtgtccctgctctgctggtgagctgcggccagcgggtgaagtgaagtggaccggacgtggacgaaggagagagagagagagagaagaaagggcgccgcgggggccatggctggacacgcgccggcgagggacaagaccaccaccggcttcgccgctacgtgcagcctgctgagccagtttctcaaggagaagaagggcggcctgcagggcctcggcggcctcgccatggcgccggtgccggcagctggagcaggggctttccggccgccgaccaccatgaacttgctgtccgcgctcgacgcggccaaggccaccgtcggggagccagaaggccatggccaacgcaccg

SEQ ID NO: 6174 - DNA, 410 bp, Zea mays
  Clone ID: LIB3279-060-P1-K1-B10
gcagtcgcaagtcgccgagccgtcctaacacagcgagagggtttcgaattggcgccaagccgccaaccatttcccccaatcccgcctgccagccctagggtttctgctacgccatggcgggaaccgccgccgccgctcccatggacatcgacgcagccgcgccgcctcccccgccgcctggtgcggcggccaagggcaaggcgccgctctccgctggcggcagggcagcgccctgggtcgagaagtaccggccccagtccctcgccgacgtcgccgcccaccgcgatatcgtcgacacaattgacaggcttacaaacgagaatagacttccacacttgttgctatatgggccacctggcactgggaaaacatcaacgattctggctgttgcgaggaagctatatgggtct

SEQ ID NO: 6175 - DNA, 287 bp, Zea mays
  Clone ID: LIB3279-060-P1-K1-B11
ggctaaaggtggcattgcgcggatgatgatagacatggaaggcctaatcggggactggaaatctgttttaagggcaaaggctgctggtacagaggattctacagaggaaccaacatatgatggggcaaggggacggaggttagctggcgtaagctcaaagccagctgggcagctgaatctatcatacagaggtcaaggccacattgggttaacggaggggacatccgatggagatcgtcttgcacatgaccactgaaacttgaacaaaaagcaagcctgtgatgctg

SEQ ID NO: 6176 - DNA, 378 bp, Zea mays
  Clone ID: LIB3279-060-P1-K1-B12
cgtgcctcttatcggcagccatgatgctgcgcgcggcgggcaggggagtgctcggcgtaggaggcggcgatccagcgcccgcggtcgctgctgctgtggcggcgagcaggagcagaggataccacgagcgggtggtggaccactacaacaacccgcgcaacgtggggtccttggacaaggacgacacggacgtcggaacggggatcgtcggcgcgccggcgtgcggggacgtcatgaagctgcagatccgcgtcgacgaggggtccggcaggatcgtcgacgcgcgcttcaagaccttcggctgcggctccgacatcgcgttcttctccgttggtgagcagagccagatccttgtcgcgtcttgctcgcgttatgcaa

SEQ ID NO: 6177 - DNA, 412 bp, Zea mays
  Clone ID: LIB3279-060-P1-K1-B2
gccccttaaccctcgttcctctagccgtctcgcgcagccacagcctccatgggtcctccgacggcggtgcggctagctcaaccatggcggactccaaggccacctcggcggtcaccctccgcactcgcaagttcatgaccaaccgcctgctggcccgcaaacaatttgtgcttgaggttatccaccccggccgcgccaacgtctccaaggcggagttgaaggagaggcttgccaagatgtacgaggtgaaggaccccagcaccatcttaggtgttaacatacgcacccgcttcggggggcgccaccacaccggcagatggcaaacgagcattgaccgcgattttggaaacaagtatctgtacctcgggacttactggacgcaggaggaggcggcgatggcgtacgacatggc

SEQ ID NO: 6178 - DNA, 411 bp, Zea mays
  Clone ID: LIB3279-060-P1-K1-B4
cttcattagtggatcactggatgagaaagttcgcatttggaatgtccgagatcgtaagattgaggattggaatgatcttcatgagatggttactgctgcttgctattcccctgatggacaggttgcgatggtgggctctcacaagggaagctgtcatatatttgatacatctgagaagcttcagtacaaaagtcagatagatttaagaattaggaaaaagaagtcaggccagaagaagataactggcttccagtttgctcctggaagctcctcggaagttctgattacttctgcggattcgagaatacgagttgttaacggcgatgaatttgttcacaagtttaaagggtttcggaacacgagtagccaaatctcagcttctgtagctcagaacgggaaatacgtgatctg

SEQ ID NO: 6179 - DNA, 394 bp, Zea mays
  Clone ID: LIB3279-060-P1-K1-B5
catcatagttcttgatgatatcgaaaggttactggagtatgtagccattggaccacgtttttcaaacttgatctctcaaactcttctggtcctcctcaagagggttcctcctaaggggaaaaacctgcttgtgattggaacaacaagcgaggttggcttcctagaatctgttggaatgtgtgacgtgttctctgtgacataccatgtccccaagctgaaaaaggaggatgcgaaaaaggtattgcatcatcttgatgtgttcgatggcggggaccttgatgcagcagcagaagcactggatgatatgccaatcaagaagctgtacacgcttgttgagatggctgcgcaggggccaaccggaggaagtgcagaagcaatttatgccggagaagac

SEQ ID NO: 6180 - DNA, 418 bp, Zea mays
  unsure (1)..(418): unsure at all n locations; Clone ID: LIB3279-060-P1-K1-B6
cacccgcctccgccacccttaccaactactcaataanccctagnctaaaccccgagcgccgccgcggcgacctcctccgccggcaggatggacagcctcaggggagccaagttgccgggcgtgccgaagggcgggagtgcgctcgtgaaggtggcgctgctcggcggcgcggggctctacgccgtcctcaacagcttctacaacgtcgagggcggacaccgcgccatcgtcttcaaccgcctcgaggggatcaaggacaaggtgtaccccgaaggaactcacctgatgatcccgtggatcgaaaggccgatcatctacgacgtccgcgcccgacccaacctcgtcgagagcacctccggaagccgcgacctccagatggtgagaattggtcttcgtgtccttactcgacccatgccag

SEQ ID NO: 6181 - DNA, 397 bp, Zea mays
  Clone ID: LIB3279-060-P1-K1-B7
cagctctggtatgtatccatcaatggcgtagcgtgttgctcaccatcgtctccctccatggtctccatgcaggcgcgtacgacgacgaggacgcagcggcgcgcgcgtatgacttggcggcattgaagtactggggccccgacaccatcctcaacttcccggcgtctgcatatgaagcggagttgaaagaaatggaggggcagtccagggaagagtatattgggtccttaaggaggaaaagcagtgggttctcgagaggtgtttccaaatatcgaggtgtcgcgaggcatcaccacaacgggagatgggaagcgaggattggtcgcgtctttggaaacaagtatctctacctcgggacttacgggacgcaggaggaggcggcgatggcgtacgacat

SEQ ID NO: 6182 - DNA, 359 bp, Zea mays
  Clone ID: LIB3279-060-P1-K1-B8
ctctcttcgtcgcgccgccgtagcacgactccgactcggccatggcgacacccccagctctcctattcccttcgccctcttcggcatcttctccgccgtcatccgcgcaggtagaggcggtggtcctcttcaacgtctgcgacagctacgtgcggcgaccggaccaggcagaccgtgtcatcggcaccctccttggatccctcctccccgatggcaccgtccacgtccgcaactcctacgtggtcccccacagcgagtcggccgaccaggtcgccatcgacatcgactaccaccataacatgtacgcctcgcaccagaaggtgaaccccaaggaagtcatcgtcggatggttctcgact

SEQ ID NO: 6183 - DNA, 405 bp, Zea mays
  Clone ID: LIB3279-060-P1-K1-B9
ctctcttcgtcgcgccgccgtagcacgactccgactcggccatggcgacacccccagctctcctattcccttcgccctcttcggcatcttctccgccgtcatccgcgcaggtagaggcggtggtcctcttcaacgtctgcgacagctacgtgcggcgaccggaccaggcagaccgtgtcatcggcaccctccttggatccctcctccccgatggcaccgtccacgtccgcaactcctacgtggtcccccacagcgagtcggccgaccaggtcgccatcgacatcgactaccaccataacatgtacgcctcgcaccagaaggtgaaccccaaggaagtcatcgtcggatggttctcgactggatttggtgttctgggggaagtacgcttatccatgagttctattc

SEQ ID NO: 6184 - DNA, 416 bp, Zea mays
  Clone ID: LIB3279-060-P1-K1-C1
gtggactgcaaacactgaaaggtatagcaatgtgtgcgctggtctcaacgacgcgatggagaatctactggcatctgtggacaagaacgaggcggaggtatcaccatcaacactatatgccattgcctgtgtcatggagggggtgccgttcatcaatgggagcccccagaacacctttgtgcctgggctgattgatcttgctataaaaaacaactgcttgattggtggtgacgacttcaagagtggacagaccaagatgaaatctgtcttggtcgatttccttgttggtgctggaataaagcccacctcaatcgtgagctacaaccacttgggaaacaacgatggcatgaacctgtctgcccctcaaacattcaggtccaaggagatctccaagagcaacgtggtggatgacatgg

SEQ ID NO: 6185 - DNA, 410 bp, Zea mays
  Clone ID: LIB3279-060-P1-K1-C10
cccacgcgtccgggcactacttgactacacacggaaggccataaacaagcttactgagctgaagaagatgctggagaaatttaagaatgatgtggagaagcaacaagtggagcaaatgactgattggcaaacaaagcttgttatgatggactccaaggaacggcaatatatcctccaagtctcaaattataaggcaatgcttaatcgagtaggttatacgccagagatcaatcatggtgtgttgatggaaatggctgagcataagaaggatctcgagaggaagactaaacccatagctgacacattaaggagctaccaggatttacctccagataaagctttagctgcactagctatagaggacaaaaagaggcagtatgcagccgcagagaagtacctagaagatgtgt

SEQ ID NO: 6186 - DNA, 407 bp, Zea mays
  Clone ID: LIB3279-060-P1-K1-C11
cttctaaggcaggaccctaacttttggacaattaggcccttgtctgatatgatggttcgagctgccacagatgatgtccgcttccttctcagtatatatgcgaaaatgatggaaaagttaagcaaagtatctttatggcgtctggcagttcgcagtgagctgtactgtaggtgcttttgcttaagcgacaaccagtttgcagattggtcacctcttcctcctgtccctgatgacattgaggctgatgtttatgttcctgaagccgatatcctgtcagtcttagatgtgcctcctgggaaaatgggacgagttattggcagaaaggggtcaacgataatggctgtgaaagaatgttgcaaggttgaaatacatattggtggtgctaaggggcctccagacagggtgtt

SEQ ID NO: 6187 - DNA, 367 bp, Zea mays
  Clone ID: LIB3279-060-P1-K1-C12
gaaagaaaaacaaacaggttactcggaagcggttaaagccttagtgggggcaagactctggtagttcctgggaacctcccaactaggtgtgccaaaatatatgttgatattcaagagtgatgacagaaaagattatgagccggaaacagactgccttatgtggatgaacaaatttttagagatctacaccaagcttttttgggcagaactcaggtaaactgttcaagacgaagtcccgagtgtctttaagatttggtcactcatatggagcttcagtggaaattatgcatttcttttaaccatatggtgctcggtgcttgaggtatattttttattataaatatccatgtggggagaacatgttttg

SEQ ID NO: 6188 - DNA, 412 bp, Zea mays
  Clone ID: LIB3279-060-P1-K1-C2
gggagatccttcagttgccaagtcccagctcctaagagctgtcatgaacattgcccctttggctatctcaacaactggcaggggttcatctggtgttggtttgactgctgctgtgacttctgatcaagagactggggagcgaaggcttgaagctggtgccatggttcttgctgatcgtggtgttgtctgcattgatgagtttgataaaatgaatgatcaagatcgagttgctattcatgaagttatggaacagcaaactgtaaccattgcaaaggcaggaatacatgcctcactaaatgcaagatgtagtgtaattgctgcagcaaatccaatatatggaacttatgatcgttcattgacaccaacaaagaatatcgggcttccggattcactgctttcccgttttgattta

SEQ ID NO: 6189 - DNA, 417 bp, Zea mays
  Clone ID: LIB3279-060-P1-K1-C3
gccgtcaacatgacgcgcgtgatggccatgcctcggctctgccgcctcgacctcccgcccgccaccggcgcctgcgcagttgccggtcttcttccccatggaccatcaccgccgctgccaccgccgccgccgccaccggcggtcactccacacgcaagcgccaactccagtgctccagcgaccctcaccacgccagcgacgccaacgccgacgacaccacgtatgataccgtcaccatcggtgagcagtcagacgccgccgcgatacagccgggggtccaagatgatagctgacggcttctctgtcactcttggtttcgtggcatttgtgtcagtcctagctttctgaagaattgggcggcattcgtcaggcagttagaattatggcttagagaaacttagttgcttttccgatggg

SEQ ID NO: 6190 - DNA, 396 bp, Zea mays
  Clone ID: LIB3279-060-P1-K1-C4
atctcctcgcattttccttgcaaccgattgcctatccccctcccaaccaaagaccgatggcgcccaaggccgagaagaagcccgcggcgaagaagccggtggaggaggagcccgcggccgagaagacgaccgccgggaagaagcccaaggcggagaagcgggtccccgctggcaagtccgccggcaaggagggcggcgagggcaagcgtggcaagaagaagggcaagaagagcgtggagacgtacaagatctacatcttcaaggtgctgaagcaggtgcacccggacatcggcatctcctccaaggccatgtccatcatgaactccttcatcaacgacatcttcgagaagctggccggcgaggccgccaagctcgcgcgctacaacaagaagccca

SEQ ID NO: 6191 - DNA, 413 bp, Zea mays
  Clone ID: LIB3279-060-P1-K1-C5
cggacgcgtgggtctcgctccaagcacaccaccactccacagtgcactggagtctacagcaacgacagaaaagtgagcagcagacagcagcagctgctgccatggaggcgtggagatctctcctcgcgagcttcgtgctcgccgtgctggccgcgcaggccttggtggctgtggtcgagtccaggaccggccccgtggagcaggcgagccaaggtgacgacgtgaagaagccggactgcgtgccggggatagacccgtgctcgttcccggggaccggcggcggtcacggtatcacgcccgtgacgccatcgcacggtggctccagctccccgacgccgtcccacgggggcggcggcgggtacgttccaacgccgtcgcatggcgggacgctgccttccccgtcccacgggggg

SEQ ID NO: 6192 - DNA, 406 bp, Zea mays
  Clone ID: LIB3279-060-P1-K1-C7
cccacgcgtacgccgtagcatatgcatatgagcatatcctaaccacgagtcggggggcaagcgaacggacacgatggtggccttgaccgcggggatttccgtagccaccggcgtcgtgttcagccccgccggccgccggcgaggccgcggacacgccgcctttcgctgctcgtcgtactctgccggagagaggcaggctctcttcagccgcatcgaccccgtctacgatcatctgaacgacgtgctcagcctgggacagcaccggacgtggaagcgcatatgcgtctcttggtcgagagcgaagatgggggatcgagttcttgatctctgctgcgggagcggtgatttggcgttcctgctgtctcagaaggtcggcttagatggagaggtgatggctgtcgatttt

SEQ ID NO: 6193 - DNA, 411 bp, Zea mays
  Clone ID: LIB3279-060-P1-K1-C8
gcgccgccggcggcctcgcccgctgcgtcctctcgtcctccacctccggcatagcatcccatgcccgcccgctgccggcacccctgatgcccaaatctccctcctttaccgtccctttctccttgtcctgtcgcaggcaccactctctccagggattcttccacctggtcatcgcttcttccttccgccctccgtcggcgcatcatcagcaagtgcggcactacgccaagaaggagaggtcgcgcgctccgctcacgcccactaaatccaaagtcaagaaatacaagatgaaggccccctcgtccatgaagttcagattcagaaccatgaaagacggacaggtccgcaggtggagggccggcaagcgccacaatgcacacctcaagtctaaggaggccaaacggagacttc

SEQ ID NO: 6194 - DNA, 379 bp, Zea mays
  Clone ID: LIB3279-060-P1-K1-C9
gcgccgccggcggcctcgcccgctgcgtcctctcgtcctccacctccggcatagcatcccatgcccgcccgctgccggcacccctgatgcccaaatctccctcctttaccgtccctttctccttgtcctgtcgcaggcaccactctctccagggattcttccacctggtcatcgcttcttccttccgccctccgtcggcgcatcatcagcaagtgcggcactacgccaagaaggagaggtcgcgcgctccgctcacgcccactaaatccaaagtcaagaaatacaagatgaaggccccctcgtccatgaagttcagattcagaaccatgaaagacggacaggtccgcaggtggagggccggcaagcgccacaatgcaca

SEQ ID NO: 6195 - DNA, 410 bp, Zea mays
  Clone ID: LIB3279-060-P1-K1-D1
caaccctgtcgccggcaagccatggcgtcgcgcttccgctccttcactcgcccggccgccgccgccttcctccggtccactgccagccgaagcccctccgcttcccttccccgcaccctcgctcctgtccctagggcttcggccatggggcggcgcatggctctggcgcggtctctgcaaccgctgcacagcgccgtctcggcggcccggctgacgtcgcggctgggggcggaggtggaccgggccgtgtcgcaggagacaggtctcagtgtccctcgataatgaaaggaactgctccagatggcagcaacatcagcagcagatagttgtaagacttggtcatcataataatcatttttgttaaacggttacgttgtttatttagtggccattttttgctatgcgctaac

SEQ ID NO: 6196 - DNA, 386 bp, Zea mays
  Clone ID: LIB3279-060-P1-K1-D10
gcgagggcgggctggactacctcgggaacccgagcctcatccacgcgcagagcatccttgccatctgggcctgccaggtcgtgctcatgggcgccgtcgagggctaccgcatcgccggcggcccgctcggcgaggtcgtcgacccgctctaccccggcggcagcttcgacccgctcggcctcgccgacgaccccgaggccttcgccgagctcaaggtcaaggagctcaagaacggccgcctcgccatgttctccatgttcggattcttcgtccaggccatcgtcaccgggaagggcccgctcgagaacctcgctgaccacattgccgaccccgtcaacaacaacgcttgggcctacgccaccaacttcgtccccggcaagtgaggg

SEQ ID NO: 6197 - DNA, 373 bp, Zea mays
  Clone ID: LIB3279-060-P1-K1-D11
ggcaaccagcaaccatgaggccagacacggcggcctccgcctctccgactccgaagaagaaacccgacagtaaagccgcgctggacctcgcgtcgtggagcttcaacgtcaccacgtccgtcgggctcatcatggtcaacaaggctctaatggcgacgtacgggttcacgttcgccacgacgttaacggggctgcatttcgcgaccaccaccgtgatgaccctcgtgttccggtgggtcggcctgagccagccgtcgcagcttccgttaccggacctagccaagttcgtggtgttctccaacctgtccatcgtggggatgaacgtcagcctgatgtggaactccgtcggcttctaccaggtagccaagctgtg

SEQ ID NO: 6198 - DNA, 271 bp, Zea mays
  Clone ID: LIB3279-060-P1-K1-D12
acgcccactcgtccgcctgcacacgaagcctagaatagccctcctgttgtgggccacctactaggatccccaccaccccacccctaccccatacaacagggtgatggaggctaagatgggacgcttctttcagtacgtgaacaatttctttaaaggaggcgaccactttccctggtgcgaccacgacctcattcgtcggctgtaaaagagagcttgttaatgctgcaaatgatgcacagaggaatgaaagccttattaggctgtcatgggc

SEQ ID NO: 6199 - DNA, 387 bp, Zea mays
  Clone ID: LIB3279-060-P1-K1-D4
agatagtaatgtaactgattggtgtttgccggaattgattacgttaggagccaagactctggtagttcctgggaacctcccaactaggtgtgccaaaatatatgttgatattcaagagtgatgacagagaagattatgagccggaaacagactgcctcatgtggatgaacgaattttcagagtactacaacaagcttctcttggaggaactagataaactgctcaagatgaatcctgcagtgactattatctatgctgactattatggagctgcaatggaaattttccatttctttgaaccatttggtgctcgttgctgatgtagtattttttattatcaatatccatgtgtggtgaacatgttttgtttagtaatttagtttcttt

SEQ ID NO: 6200 - DNA, 408 bp, Zea mays
  Clone ID: LIB3279-060-P1-K1-D5
cttcaacattatgcacctggggtgcccgttgttttggcaggcacaaaattgggtgagttttatttacagcaagagcatgctgctgtcacttactgtatatagctgggctgactttgattcactatagtctgattagtcatgctatccttaactgctaaacttctatttctctgtgcactgttggaattactttggtttaggctgcactagtagtgaacattgcaattttgttataaatgtgatgttatgacgtgtcgagttgccaacagaacggacgaggagtcagccagccacacttttatctttctagtacaacttagtagtcatgggaagctcagggctattttttgttagtgcatgaactgtttgtgtttatgtgattagttgacacttagttaccattaaaca

SEQ ID NO: 6201 - DNA, 409 bp, Zea mays
  Clone ID: LIB3279-060-P1-K1-D6
ctcgtctcgtctcgtcacgtgccgccgccatggctgctctgggccgtggcctgcccctcctcctcctgctcctcctcctcgccgtatcgggggccgccaacgccgcggcggcgcccggcggcatgtccatcatcacctacaacgaggagcacggcgcgcgggggctggagcggacggagccggaggtgcgggccatgtacgacctctggctcgcggagcacggccgcgcctacaacgcgctgggcgagggcgagggcgagcgcgaccgccgcttcctcgtcttctgggacaacctccgcttcgtcgacgcgcacaacgagcgcgccggcgcccgcggcttccgcctcgggatgaaccagttcgccgacctcaccaacgacgagttccgcgccgcgtacctcggcgccat

SEQ ID NO: 6202 - DNA, 383 bp, Zea mays
  Clone ID: LIB3279-060-P1-K1-D7
cgacgccatcgtcaaggagaccatgcgactgcacccggtggcaccgctgctggtaccccgcctcgcgcgcgaggacacgaccgtggccggctacgacatccccgccggcacgcgcgtgctcgtcagcgtgtggtccatcggccgcgaccccgcgctgtgggacgcgccggaagaattcatgcccgagcgattcctcggcagcaagctggacgtgaaggggcaggactacgagctgctgccgttcgggtccggccgccggatgtgccccgggtacagcctcggcctcaaggtcatccaggtgagcctagctaacctgctgcacggcttcgcctggagcctccccgacggcgtgaccaaagaggagttcagcatggaggagatct

SEQ ID NO: 6203 - DNA, 408 bp, Zea mays
  Clone ID: LIB3279-060-P1-K1-D8
cacaaacgccggcgcaaactctcgcccgagcccgacagatcttcaattccccattccgcccaccgatcgaccttcacgccagtctcggtctcttccgaaggcgtcgcgcgcggttgtttgagaggagaggaggaagatgagggagtgcatctccgtccacatcgggcaggccggcatccaagtcggcaacgcgtgctgggaactttactgcctcgagcacggcatccagcctgatggccaagtgcctggagataagaccgcgggacatcacgatgatgccttcagcaccttcttcagccagactggtgctgggaagcacgttccccgtgcaatcttcgttgatctagaacccactgtgatcgatgaggtgcgcactggcacgtaccgccagctcttccaccctgagca

SEQ ID NO: 6204 - DNA, 408 bp, Zea mays
  unsure (1)..(408): unsure at all n locations; Clone ID: LIB3279-060-P1-K1-D9
cacaaacgccggcgcaaactctcgcccgagcccgacagatcttcaattgcccattccgcccaccgatcgaccttcacgccagtctcggtctcttccgaaggcgtcgcgcgcggttgtttgagaggagaggaggaagatgagggagtgcatctccgtccacatcgggcaggccggcatccaagtcggcaacgcgtgctgggaactttactgcctcgagcacggcatccagcctgatggccaagtgcctggagataagaccgcgggacatcacgatgatgccttcagcaccttcttcagccagactggtgctgggaagcacgttccccgtgcaatcttcgttgatctagaacccactgtgatcgatgaggtgcgcactggcacgtaccgncagctcttccaccctgagca

SEQ ID NO: 6205 - DNA, 414 bp, Zea mays
  Clone ID: LIB3279-060-P1-K1-E1
cttttgagtacctaaggcttactagcttgggggtcattggtgctcttgtcaaggttgatgatactgaagtcatcagttttttgctgcaaactgaaataattcctctgtgcttgcgaaccatggagatgggtagtgagctatccaaaactgtggcaactttcatcgtccaaaagattcttctagatgatgttgggctgcgctacatttgcgccactgctgagcgtttctttgccgtaggcagtgttttagcaaacatggttgtttcacttgctgatcagccctccacaaggctgctgaagcacatcattcgttgttacctccggctgtcagataaccctagggcttgtgctgcattgcagagctgccttccagacatgctcaaagatgggaccttcaataactgccttagggatg

SEQ ID NO: 6206 - DNA, 284 bp, Zea mays
  Clone ID: LIB3279-060-P1-K1-E10
aaaaaaaaaaaaaaaaaaaaatttaaaaaaaaaaaaaaaaaaaaaagaaataataaaaaaaaaataaaaaaaaacaaaattacaaaactataaatttaaaaaatcaaattttaatttttttcttttttttatctttatactattttattcctttcttttttttttttttttatatatgttctttatttcctctttatttatctttctattacagctatctttttctgattacttttctattttttatttatttttaattttttttttcttcttttttttttttt

SEQ ID NO: 6207 - DNA, 409 bp, Zea mays
  Clone ID: LIB3279-060-P1-K1-E11
gttgcgattagactatgtccataggcatgagaattacaaaatatatatgtccttacttattgttggttatttctttgtgctaatgactacactgttgaagttattgttctcgtgaggaattatttgtgaaagtctccaattttctgtacaacgttgatatgattcatgtcggcgttgtggagcatgctcatatgcgtgaaagagaagatcatgtactcatgcttcgacgcgaacgcgaggcatgaaaccatcgtcaacacttcatcgtgtccgccatgcttcatgttcaccacagcttcaggcgccgcagtgacatcatacccatgctctagatgcagacggactgccactgagaccgtctttcaggggaaaagaacgcatctcatcaatatggttgtgacggcagtta

SEQ ID NO: 6208 - DNA, 407 bp, Zea mays
  Clone ID: LIB3279-060-P1-K1-E12
cggacgcgtgggtggaggaggagcaccatatgaaggagcacaatgtggatacccatacaagtttggaggagggtatggatatttgaaaggtgaaggtctagaggagtgtgcattaacgatatgagcttcaatagtaggaggagctgtgatggtaggatttatatagggaggaggttaagcacccatggatggttggtagggatatggaggatgatcatatgaatatagagattggaggttgtggacttagggaacacggatggacagaaacatccgtctaacgacgatttatgggagaaaggtcatggaaaatacatgtcccacattgataggggtgtcacgatgttgtggagattggtcattgaacatgttggtgaaggttttaaagtttgaacttccacctgtga

SEQ ID NO: 6209 - DNA, 414 bp, Zea mays
  Clone ID: LIB3279-060-P1-K1-E3
gtgaaaacaggaagaagaagaaaaaaagaggagagagagcaaagcccagataaactatcaccggtccttctcgtagctaacgtcgctgccccgcccgttctgcgacgccgcgctgtcgtccaccggcacgacgccggcgtccttgcggctccggtacttgatcagaccgtacagcttcttgatctccctgatcggtgcgtccttggcgaaaccacccgcgctcccgctggcctcgtcgaagtgccccgaccatctcgacgtcagtctcggcggccgtgccgcggcgagggtccgctgcggctgcgcagctggcggcgctgacggcgccacgtgctgcagcgcgctgatgacggtgcggagcgcgcggctcggggacccgcggttggcgagcatgatctcgccgagctcggcggg

SEQ ID NO: 6210 - DNA, 410 bp, Zea mays
  Clone ID: LIB3279-060-P1-K1-E4
gagcgcggcaggctagagcctcgttgctgaggaggggagatggcgggtatgggcgatatgccgatgaggcctgcgcggccgggcccgccgatgcagcaccgtggtccgcccccgatggcgcgcctccgccccgaaccaatcgaccgcgagaagacctgtcctctgctgctcagggttttcacaagggttgctggtcaccaccaaaatgaagagtttgcagtgagagggaaggaaccaaaggatgaagttcagatttacacatggaaggatgcgaccctccgcgagctcactgatcttgtgaaagaggttgctcttccagcaagaaaaaggaatgcaaggctttcttttgcatttgtatacccagacaagaatggtcgttttgttgtcagacaggtgggttcgaccttcgc

SEQ ID NO: 6211 - DNA, 412 bp, Zea mays
  Clone ID: LIB3279-060-P1-K1-E5
ggtgtagtgaagcgagaagatatgtttatcacctctaagttgtggaatgatcatcatgctcctgaagatgtgcctgaggcactaaatcacagcctgaatgatttgcagcttgagtacctggatctttatcttatccattggccatttagagtcaagaagggagcaaatagcagtcctgaaaatttcgttacacctgacatccctgctacttggggggcaatggaaaagttatatgatgctggcaaagctcgtgccattggtgtgagtaacttttcctcaaagaaattgggtgacttgcttgctgtagctcgtgtacctccagctgttgatcaggtggaatgtcatcctggttggcagcaaactaagctccatagcttttgtcagtcaactggtgttcatcttactgcttact

SEQ ID NO: 6212 - DNA, 414 bp, Zea mays
  Clone ID: LIB3279-060-P1-K1-E6
cccacgcgtccgccaagtcccatcgccgagcagaaagtcaggaacagagctcaggcgttggcgattggcatctccctcccctaagccatggctaccgggcggcccgtacgactcgtgctggatgcctccctcctcctcgacccctcctccaccagggaggcggcggcggtggcgctgcggcccggggtagaggagttgctgcggcggttgcgctactccaacctgagcgtggcaatctgctatgcagagggcatgccaactaatgagtcagactttcttgaaaaggtcgcaagctcacacttgtttggatctatagtacttcttgcaaaaagtgggaatctttctccaattgaattaatgatagaatggagccgaacaagtttttgtttttatgcgacttcaagagttgacaaa

SEQ ID NO: 6213 - DNA, 405 bp, Zea mays
  Clone ID: LIB3279-060-P1-K1-E7
gcggaagagagatcgtggagactggagagggggggaacgcacgagtcgaaggcggatctgcggaagcgcgagcgggggcgcgagagcgagagccccgcaccgcgtcctccggagccgtcggaggccccgggcagcgatagcgcgccgagggccaggagcaggagcagcgccgcgcacgccagcagcagcgccgccacgaccgccatcgacggcctcccgccccgcttcccgcccccgccacttccgcctagcagcggcctcccgcctcgccccgccagccggcccgccatgcccccgccgcctacgttgcagctcacgcgtggtggctccgctcgtctggcttcctgccggttctaggcttctagctcgctctccctctctgaccagagtcgcggggttttttat

SEQ ID NO: 6214 - DNA, 310 bp, Zea mays
  Clone ID: LIB3279-060-P1-K1-E8
cccacgcgtccgcgacgagtctggcccggcaattgttcaccggaagtgcttctagggtttcacaagttcctcgtcgttacctagtctcaaattatgtcccctccatttctcgagatatgtgtggcagatttgcatgatacgtttgtttgtttccatcggacctgaagtcttcttggggataggctcccccctttgtatgttgtggctccaatccatgtgcgagcacgctgtgtctgtcgtgacacctggttcgtgagatgggttgtcaaacttgattggtttgttgggcctggctggaagaacttatagt

SEQ ID NO: 6215 - DNA, 374 bp, Zea mays
  Clone ID: LIB3279-060-P1-K1-E9
cccacgcgtccgcgacgagtctggcccggcaattgttcaccggaagtgcttctagggtttcacaagttcctcgtcgttacctagtctcaaattatgtcccctccatttctcgagatatgtgtggcagatttgcatgatacgtttgtttgtttccatcggacctgaagtcttcttggggataggctcccccctttgtatgttgtggctccaatccatgtgcgagcacgctgtgtctgtcgtgacacctggttcgtgagatgggttgtcaaacttgattggtttgttgtgcgtggctggaagagctgatagttatatatttggcttggactgtgccgcttgtatgtatctgaattctgaaagcgttgtaatctgag

SEQ ID NO: 6216 - DNA, 411 bp, Zea mays
  Clone ID: LIB3279-060-P1-K1-F1
gcagcagcaaatagtggttggcctgttggtactctatatcgtcccttccagggtacccgtcctccagcccattatacattatacttgctccagataagaccaagagcgtcatggccaacgccttgcctctcatcgtcgcgctggtcgccgccgccgggtgcgcggcgctggcttcggccacgtcgtacaccgtcggcgactcgcagggctggacgacaaccggcgtcgactacagcagctgggccagccgcaacactttcgtcgtcggagacacactagtgttcaactacgtgagcaaggcgcacacggtgacggaggtgagcaaggccggctacgacgcctgctccggcgccaacgcgctcagcgacgacgacaccggctccaccaccatcacgctccagaccccgggca

SEQ ID NO: 6217 - DNA, 405 bp, Zea mays
  Clone ID: LIB3279-060-P1-K1-F10
cccacccacgcgtaaaatgaggacaatgattgttggatacgcactgagttattaccttagggggggtataattgaatccttcaactccaaggataataaacttgtactcacaagtgaaagccttaagcatgggctcaacatgctgcaaagcatgcaaagtgataacaagagctcgaaaaaatcactgaaggatgttgtcacagataatgaatttgagaaaaggcttttggtggatgttataccacctaatgacattggagttacctttgatgatattggagccttggagaaagtaaaggacacattaaaggagctggtgatgcttcctttacaaagacctgaattgttctgcaaagggcacaataacaatgccttgcaaggtaatattgcttttctgacctcctg

SEQ ID NO: 6218 - DNA, 406 bp, Zea mays
  Clone ID: LIB3279-060-P1-K1-F11
cggacgcgtgggttcgctgtcaagctttgtggtacttctggaactggatcttgccttgctgcgtactttgtctgcaatacaatattcagtgccatcaggacaatcataggcaataaaaattattatgacatcaggaaaccatgcatcggaagcctatgctatgatttctctaatttggagaaatttctcaacctcaaatctgtcagagagagcctaggggttggagatatagagtttgtttcatgcagcccaactgtctatgaggccatgctattagattggatgaggaaccttgaagttggaatccctgaactccttgagagcgacatcaaagtgttgatttatgctggagagtatgacctcatatgtaactggcttgggaactcaaggtgggtaaactctatgg

SEQ ID NO: 6219 - DNA, 326 bp, Zea mays
  unsure (1)..(326): unsure at all n locations; Clone ID: LIB3279-060-P1-K1-F2
ggagatagccgacttcctcagggctaacctctagtacatacacagctagccgctgatcgttggtggtggtggtggtggtcgtcgtcgtcgtctccacggaaaacttcactcgtttttatagcaagacaagaagatggtaagcctgactttacagtcgttgtaccgatctgcttgctctcttccttgtgctgctgtccatggcaaggcaagtggtgcgctcaaaaaggacaggcaggcagctgcctccccccatgttatgatgacaaaactctagtagctaggaaaggaatcacggtgaccttttgtttcaaaaaaaaaatannaaa

SEQ ID NO: 6220 - DNA, 413 bp, Zea mays
  Clone ID: LIB3279-060-P1-K1-F3
cgccattaaaccccacccgcgcgcgcggcggccggcggcgagccctcacccatccgagcaagccgaggaggaagcgagcgcgcgaaagtatcaggaggaggcatgggtaccctggggcgcgcgatcttcacggtgggcaagtggatccggggcacggggcaggccatggaccgcctcggatccaccatccagggcggcctccgcgtcgaggaacaggtttcaaggcatcgtacaatcatgaatatttttgagaaagagccaaggatccatagagatgtgtttgttgctcccagtgcagcagtcattggggatgttgagattggtcatggatcgtcaatctggtacggatccatattgagaggtgatgtcaacagcattcatattggatctggtactaatatacaagacaattc

SEQ ID NO: 6221 - DNA, 414 bp, Zea mays
  Clone ID: LIB3279-060-P1-K1-F4
gaaaatgtggacaagattgttggatacgcagtgagttatcaccttaagcacaataaaattgaaacctccaactcgaaggataataaacttgtactcacaagtgaaagccttaagcatgggctcaacatgctgcaaagcatgcaaagtgataacaagagctcgaaaaaatcactgaaggatgttgtcacagagaatgaatttgagaaaaggcttttggtggatgttataccacctaatgacattggagttacctttgatgatattggagccttggagaatgtaaaggacacattaaaggagctggtgatgctccctttacaaagacctgaattgttctgcaaagggcagctaacaaagccttgcaagggaatattgcttttcggacctcctggcactgggaaaactatgcttgcc

SEQ ID NO: 6222 - DNA, 413 bp, Zea mays
  Clone ID: LIB3279-060-P1-K1-F5
gatcggttggaggagcggaacattaagaagggggagagggagatggaggaggcgcgcaaggaagaggagcggaaggaggaggcgggggacaggaatacccaggagccgcagcaaggtcaaggcctcagcctctcactcgccaacggcagcgacagcggcaggtctggaatgttgccgatgtcgaacccttcagctaatcccacacagcttacaattttctatggtggatcagtatgtgtgtatgactcggtgccaccagaaaaggctcaggcaatcatgcttatagctgcggctgcagcagctgcggcagccaccaaaggcagtgctgccactgcttttaatcctccaatgagcacttctgtagcagctggacaagctcaggttgttgctgaccctagctcaataagcaagct

SEQ ID NO: 6223 - DNA, 412 bp, Zea mays
  Clone ID: LIB3279-060-P1-K1-F6
cctaaacccagaacccagcccgccgcaaccctagtcgccgccggcaccacaccaccgccatagtcacctccatggccgcggcgtcggaggacgcgttgcggcgctcgctcgcggagcgccaggccgccgtggacgcgcaggccgaggccgtgcgcgcgctcaaggccggcggcggcgcgtccaaggccgacgtggacgccgcggtcgaggcgctcaaggcgctcaaggtcgaggccggcgccgccgcgcgccggctgcagcaggcggtcggggcgggcgcgggtggcgccgcgagggaggagctgcgccaggcggtggtcaacacgctggagcggaagctgttttacataccctccttcaagatctaccgcggtgtcgcggggctctacgactacgggcccgccgggtgccg

SEQ ID NO: 6224 - DNA, 410 bp, Zea mays
  Clone ID: LIB3279-060-P1-K1-F7
gggagatgagctacaacttgactcctttgagactaacttatttgtttgagtacacttgaagtagtctcgaaggacaattgaaagggaaagtgaacctggacgacaaaaagacttccactacactccgtgacatagccaagaaaagaggaaaagagatggagaaagaatggctcggttcagccaaaccagaaccagcttgtggcgtaccggactgtccggtgcccaggctggcccggcggcaaactggccgctctcgagaaaagtaaaaggcgttgcggctaaaaatcaccggactgttcggtggtgcaccggactgtccggtgagccaacaacgctcgtggccaacggtcggctgcgcaatcagcgggcgacgcgtggcccgcgccaacggtcggttgggcacaccggac

SEQ ID NO: 6225 - DNA, 407 bp, Zea mays
  Clone ID: LIB3279-060-P1-K1-F8
cgcagtttctaatcgtttggagagcacacaagaatgtcgttcgtgcagctctctggtgctggagtcgctgcagtggccttcacgaacaagagcctagtctctcggcacgcagcgctacgggtctgctcgtcgaggcgctcgatccgtagcctggtcgttaaggctgcaactgtcgtcaccccaaagtacacttcactgaagcctctgggagatagggtgcttgtgaagcttggtgccgcagaggagaagacagttggtggcattttgcttccatctactgcccagactaaaccacaaggaggtgaggttgttgctgttggagcaggaaggaccatcggggacaagaaaatagctgtggatatagagactggagcacaagtagtatactcaaagtatgctgggactga

SEQ ID NO: 6226 - DNA, 407 bp, Zea mays; identical to SEQ ID NO: 6225
  Clone ID: LIB3279-060-P1-K1-F9

SEQ ID NO: 6227 - DNA, 413 bp, Zea mays
  Clone ID: LIB3279-060-P1-K1-G1
ggcaggatttgaaaatctcgcgagaggccttgtccttgtccacttcctcaaagcagcggaaggggagaggccagggtgcagcagcaggacccccaacggcaacctccgccacgcaccacggagcaaccaagcagcaggtaaggcaaggtaagtgacgagacaaagatggtgcaggaggagatgccgcaggcatggtggttcgacagccacaacctcgcgaggccgtcgccatggctgaacagcacgctctcagagctggatgacaagaccaagcaaatgctgaagctgatcgaccaagacgcggactcgttcgcccagcgcgccgaaatgtactacaagaagcggccggtgctggtggacatgctcggcgacctgtaccgcacgcaccgttcgctggcggagcagtacgacct

SEQ ID NO: 6228 - DNA, 362 bp, Zea mays
  Clone ID: LIB3279-060-P1-K1-G10
aagactttcctccggtgaccaagatacggtggcacccattgtggcgcaccatcttaggttcagtaaagctgtcgcaaggaattcttcgcctgcttggaatgcccttatgatcctgaattcagcatcaggttcttcactgaggattagatcttcaaaaacaattcttttctcactaggaatgccggcatcctcagatatcattctcatgctgaggactagcagtgactcaattgcagtattgtacagttcatgctcctcgtaggcacaaaacgtgtaccaaagtgttgatggatcaggttggatttttgatcgatgtatacactccaaaatatattcaaggacatgaatttgaccctgtgaag

SEQ ID NO: 6229 - DNA, 186 bp, Zea mays
  unsure (1)..(186): unsure at all n locations; Clone ID: LIB3279-060-P1-K1-G12
acgcccactcgttcggtggagtacaacgcctcgtatgcataccactcggtgtttgtctatttcgaccgcgacaacatttcttctcaaaggatttgccaagttcttcaaggattccatctactagtagagggttcacgctnaaaagctcatggagttccagttcaaacttgtaggcttgtttaggct

SEQ ID NO: 6230 - DNA, 182 bp, Zea mays
  unsure (1)..(182): unsure at all n locations; Clone ID: LIB3279-060-P1-K1-G2
aatattcagtgttttgggatctttgtaaggtctatctcgttacagcgaaagtgcctctctacttagatttatgagtaattgttgcttttttgtatgaacatggtaatggcttgtcggagtaccagaggtttactatgttggtttatgctgtgaacgtaagcgagccatattctttggtntgc

SEQ ID NO: 6231 - DNA, 381 bp, Zea mays
  Clone ID: LIB3279-060-P1-K1-G3
ccgcattcgttccaactcctgagcactttctcctcgtcccagacaagccagtcgaagccgagatacgaccatggactccaccggcaccggagcagggggtaaggggaagaagggagcggccgggcgcaaggtcggcgggccaaggaagaagtcggtgtcgaggtccgtgaaggccggtctccagttccccgtcggccgcatcgggcgctacttgaagaagggccgctacgcgcagcgtgtcggcaccggcgcccccgtctacctcgccgctgtcctcgaatacctcgccgctgaggttctggagctcgccggtaatgctgccagggacaacaagaagactcgcattattccgcgccacgtgcttctggcgatccggaacga

SEQ ID NO: 6232 - DNA, 390 bp, Zea mays
  Clone ID: LIB3279-060-P1-K1-G4
gtgtgaccatcatgccaaaggacattcagctggcaaggaggatccgcggcgagagggcctaatcgccacctcaaacatcgtgacaaaaacatgaagtcctggggttattgttaatctggtgccattgtaaggacatatgagtagggtttgttttgtggatcgcaagtttctcttctgctactgttgctgctacctttgctggtgttattgctagggtcgaatacttaagttaactatgcgctgacagtctggactagcagtgttatgtgcgctgctggaccttgcgcgcaatgctgtggccgatttgttcgttaatgtcaagaattgtgttacagtgcgtgtatatatgtgtgtcgccgcatttttatttttgagaattgttttaagctg

SEQ ID NO: 6233 - DNA, 409 bp, Zea mays
  Clone ID: LIB3279-060-P1-K1-G5
ggaagagggcgaaatggtgaagcacaacaacgtcatccccaacgggcacttcaagaagcactggcagaactatgtcaagacatggttcaaccagcccgcccgcaagcagaggcgccgcatcgctcgtcaaaagaaggctgtgaagatattcccccgcccgactgctggtcctctacgccccattgttcaatgccagactttaaagtacaacatgaagtcaagggctgggagaggctttacccttgaggagctgaaggctgctggcatcccaaagaagcttgctccaaccattggtatttctgttgatcaccgccgcaagaacaaatcccttgagggactgcaggccaatgtccagaggcttaagacatacaaggccaagctggttatcttcccaaggcgtgcgcgcaag

SEQ ID NO: 6234 - DNA, 421 bp, Zea mays
  Clone ID: LIB3279-060-P1-K1-G6
cttttgtatagcatgcacgtaagaaatgaccaaaaaatataacaagaatgcagctgttagtttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggcccctttaaaaaaaccaaattttccttccccgggatgggaaactaaaaatttttttttggggcccaaaaaataaaattatgggcccggtttttaaaaccgtgggaaaggaaaaaccccgggggtccccaaataaaatcccttgaaaaaaaaaccccttttggcaaggtgagtaaaaaaaaaaaagccccccccc

SEQ ID NO: 6235 - DNA, 345 bp, Zea mays
  Clone ID: LIB3279-060-P1-K1-G8
tgaggctatccctgtggatcagatcgacccagcattggttcagaagggtctcgctgaattcactgccaagcttggtgcggcctctactgacctggagaaggctgaggcccagatcggagtcgatgttcacagtgccctcaatgctgcattgaccggttaattggtggcattttaaattgtcttgtatttttcatctacagttttagagtgagtttaagtttgcaaactcatgggcatgggatggagggaatgatcctaaataaattatactccatctaaaacatggacatatgttggttctctcctgtaatgctgccagagacaacaagaagactggcaacattt

SEQ ID NO: 6236 - DNA, 378 bp, Zea mays
  Clone ID: LIB3279-060-P1-K1-G9
tgaggctatccctgtggatcagatcgacccagcattggttcagaagggtctcgctgaattcactgccaagcttggtgcggcctctactgacctggagaaggctgaggcccagatcggagtcgatgttcacagtgccctcaatgctgcattgaccggttaattggtggcattttaaattgtcttgtatttttcatctacagttttagagtgagtttaagtttgcaaactcatgggcatgggatggagggaatgatcctaaataaattatactccatctaaaacatggacatatgtttcttgtttcctgaatcctgcatggatttctttttgtactggtgaacattttaactttgagctcaagacccggagcttgtttct

SEQ ID NO: 6237 - DNA, 411 bp, Zea mays
  Clone ID: LIB3279-060-P1-K1-H1
cgctcgtcctcctcctctcctcctggacagcagagcacagcacaacacaccgagaaagaacaagcagccgccaccggagctcagaaccaccatcagcagcagcagcacacccggtcaaccttccacacacgcgcgcacacacacatggcgtcgcagcagaggcaacagcaggcgggagcggcggcggcggcgtcctccgccgtgggcttcgaggactacctgccggtgatggcggagcggctgggcgaggacgggctgatgcgggagctggcgagcgggttccggctgctgatggacccggcgcgcgggctcatcaccttcgacagcctccgccgcaacgcgccgctgctgggcctgggcggcatgtcggacgccgacctccgcgggatgctcgccgagggcgacttcgac

SEQ ID NO: 6238 - DNA, 354 bp, Zea mays
  Clone ID: LIB3279-060-P1-K1-H10
cgaatccccagaccaaatcgccgtcgccgtcgccgtcgcatcggagcagcgggagtcccagggtcccggaccgaatccatttccagacacccaaggccaagatccatcgctcgttccaaccagccttcttcttcttctgcttggtcgtctgatctcgttttccattcgtgtccaatccgatccagccaaccgctgtgaatgatggcagctcaacctgtaccaccagaccggcgcggccgtggcggaggctaccggctgttccacgcacaaacgttgtaccaaagtgttgatggatcatgtcggatttttgatcaattcatacactccaaaaattatttaaggacctgaatttta

SEQ ID NO: 6239 - DNA, 407 bp, Zea mays
  Clone ID: LIB3279-060-P1-K1-H12
ctggagacctgggaagaacatgctcaacaagcatatgaattgttggacgagggagggcaaccgaccaattgtgattgaagaacttgcatcggaacttggacttggcccttcgatctcatttcatgttgttctcaaagattggatcagacattcagatggacacccaggaagttgagttgccccttgaccaggaggaatccacctaccgtctggacgaaaaacgatcccatccatggggcagcgccaggtgtaccgaatctttggcacagcgatcagggatctatttcgcaaatgaacggaaagatagcacaattctttttctttttgtgctagtgccagtattgtggaacgaatttataaggtttgggggttgggctgctaacatttatgttcgaaattggacccct

SEQ ID NO: 6240 - DNA, 409 bp, Zea mays
  Clone ID: LIB3279-060-P1-K1-H3
ctccacgccaggagtgggcgagtggcacaccgcacaccagccttcgtgttcctcgcggtttcatccactcccgtcgcccgttccacctgtgacctgccaaggcaccaagcctgaccgacttcgcttacggttcccggtgacccccgcccaccctcctcgcgatgtctgacgtcacctccgactcggcgcagagacgccgttcgccgccgccgccgtcgccgtcgccgtcgatgccgcgtttccagcagcagccgagcgggcgccagccgcccccgcccggcgccgaccccttcgtcttcggcatcgtggccttcatcggcatctgcttcgtcctggtttcactctcagtcccatcaagtgttctacatcaagttcctgaaggacatgtttgggtgtactggaaaggagg

SEQ ID NO: 6241 - DNA, 412 bp, Zea mays
  Clone ID: LIB3279-060-P1-K1-H4
agcaatctctagcagcagatcctcgtgcaaagcaaagcgctagccttcctactgtcccgatggcccgcacgaagcagacggcgaggaagtccactggcggcaaggcgcctaggaagcagctggccacgaaggcggctcgcaagtctgccccggctaccggcggagtgaagaagccccaccgtttccgccccggcaccgtcgcgctccgggagatccgcaagtaccagaagagcacggagctgctgatccgcaagctgccgttccagcgcctggtgcgtgagatcgcccaggatttcaagaccgaccttcgcttccagagctccgccgtcgccgcgctgcaagaggcgtccgaggcctaccttgtcgggctcttcgaggacaccaacctctgcgccattcacgccaagcgcgt

SEQ ID NO: 6242 - DNA, 330 bp, Zea mays
  Clone ID: LIB3279-060-P1-K1-H6
ctttgctctcgcctcgcgcgctcccccccccccccccccgcgcgcatggtgccgttcgccaccgcaccgcgccgatggaggtcgccgccgtgcccagatccgccgcggcctgccgtgcggcgcccctgctcccggccgttcgagccgctgcgtgccacctggccctgccccggcgcgcgttctccgcatccgtcgcggcggcaccggcgccgcgccgcctagccgctcgttgcgctgcggatggtgacagcgtggagacggcgccggaggcggtccccattgagaaaaggttccctcccttcccgagcgttatggacatcaaccagatcc

SEQ ID NO: 6243 - DNA, 403 bp, Zea mays
  Clone ID: LIB3279-060-P1-K1-H8
cagctcgctcgtcccagctgatcaggtcgagcacctagtagcgacctgctcgatcatcagtgtagagtgtcggtaggtgtctgtctctcttggtggctggttgcaacggtcatggcgacgtcgtctcgtcgggtgcccttgctgctgctgtgcctgggcgtgctggtgtcctgctccttcgcggcgggcagcttggaccaggagctggacatcacgtggggcgacgggcggggcaaggtccttgacaacgggcggctgctgacgctgtcgctggaccgcacgtccggctccgggttccagtcccggcacgagtacctgttcggcaagatcgacatgcagctgcggctggtgccgggcaactccgccggcaccgtcaccgtctactacctgtcgtcgcagggcg

SEQ ID NO: 6244 - DNA, 335 bp, Zea mays
  Clone ID: LIB3279-060-P1-K1-H9
cagctcgctcgtcccagctgatcaggtcgagcacctagtagcgacctgctcgatcatcagtgtagagtgtcggtaggtgtctgtctctcttggtggctggttgcaacggtcatggcgacgtcgtctcgtcgggtgcccttgctgctgctgtgcctgggcgtgctggtgtcctgctccttcgcggcgggcagcttggaccaggagctggacatcacgtggggcgacgggcggggcaaggtccttgacaacgggcggctgctgacgctgtcgctggaccgcacgtccggctccgggttccagtcccggcacgagtacctgttcggcaagatcgacat

SEQ ID NO: 6245 - DNA, 187 bp, Zea mays
  Clone ID: LIB3279-001-P1-K1-A1
accgcctccgccgccgacaacagcgtagtgtagtgtacttccggagagggttggggagagtggtagtgatccgcaatgtcgacggaggaggctgttgtggctgaagtcccggtgaccgaggtgccagcggaggtcccggcggcccaggtggccgaggcgcccaaggcgaaaaaggcgcccaaggaga

SEQ ID NO: 6246 - DNA, 314 bp, Zea mays
  unsure (1)..(314): unsure at all n locations; Clone ID: LIB3279-001-P1-K1-A2
ggagcagccgcagtcccaccgaccccgccggcggtcgccctccatctcctcgccgctgcgctgtcgtttctcttttcaataatgaagatgagccgtggtggtagtgccggtggtggtcaaagttctctgggttatctctttggaagcggtgagccccccaaaccagcagtggcaccagctgcaagtgctccacctgttgagaaaccatctgctgcanagactgatgcggccaagcaggttgctgctggggttaccagccaaaccaataactaccacagggctgatggtcagaacactggcaacttccttacgga

SEQ ID NO: 6247 - DNA, 321 bp, Zea mays
  Clone ID: LIB3279-001-P1-K1-A3
agcacgcgtggacggacacgtgggtaaaactgtaaaggtgtccactaaaggtccatcgggagaagaatatgcatggtaccagtgcacagtgaatggtggacgtgatagccgagctataggagcatatgaactagcgaaagctgtggaagaattgggcgcaggagaaatacttcttaactgcattgattgtgatggccaaggttgtggatttgacatagatttggttaaaatggtttctgatgctgtgacaatccctgtcattgcgagcagtggtgctggagctgttcaacatttttctgaaatttttgagaaaacaaatgc

SEQ ID NO: 6248 - DNA, 451 bp, Zea mays
  Clone ID: LIB3279-001-P1-K1-A4
cggtctctatggccaagaaaggggcgaagagaaagcagcagccgccgccggcggctcccaccgcgaagaaggggagcaaggctgtgcccccaccgaaggctgcgaagagagcgcccaagaagcaggagcttctcgagtcctccgacgattctgatacggagcagcagctcctggaggaggcctcccacctcgacgtcccctctgattccgacgccgaagagctctctgggtcggacgctgaggctgacgagctctcgggctcggatgccgattccgacggaagctcgagcagcggcgacgacgtggaggatgaggaggaggaggaaggtgaatgaagtgatgatgaccccctggcggacgacttcctcgctggtagcgacgaaggaagcgagggtggtgactctggactggagtcagacgagtctgatgacctcgaggcaaaatcacgagc

SEQ ID NO: 6249 - DNA, 376 bp, Zea mays
  unsure (1)..(376): unsure at all n locations; Clone ID: LIB3279-001-P1-K1-A5
cgtccctctcccctctctcccccaaggccccaacccacttgagcgagccctagagaaggcaaaagccatggcgtccttggttgttcgtgccgccggcgccgccgccgccgccgcccgtcttccctccctccgtcctcgccgcaacggcagcggggtgctctccggcttgagggtcggaacagggcactacggcgcgcggctcgcgcttgcttcgtccacagcttctcacaaagagttcaagatcgcctgccttactgtcgatgacagcagtttgggcccggnggatgaatattttggcctctatactcctaagctgcttgcaggtactgaagatgattatgagtctgacccccgcatgccaggcgaggatgagttc

SEQ ID NO: 6250 - DNA, 429 bp, Zea mays
  Clone ID: LIB3279-001-P1-K1-A6
cggacgcgtgggccgttcaggacacggtcaaggcgccgtcgccatccgaggccaaggtgatgaagagggcgaccatggtgagcgtggccaccacaacggtgttctacatgctgtgcgggtgcatgggctacgccgtcttcggcgacgccgcgccggacaacctcctcaccggcttcggcttctacgagcccttctggctgctggacatcgccaacgtcgccatcgtcgtgcacctcgtcggcgcctaccaggtcttctgccagccgctcttcgccttcgtcgagaagtgggcagcggccacgtggcccgacagcgccttcatcgcccgggagttccgcgtgggccccttcgcgctcagcctgttccgcctcacctggcgcacggcgttcgtgtgcctcaccaccgtcggcgccatgctgcttccctttt

SEQ ID NO: 6251 - DNA, 215 bp, Zea mays
  Clone ID: LIB3279-001-P1-K1-A7
ccacgtagggagggtactgaaatacggaccgtaaggacagggaggtggggcatgggcccatacttgtctgtatgaagaagacgcttgtcttccacgcgggacgcgcccccaaggtcgaacgcaccaactgtgtcatgcacgaataccgtcttcagggcgatgactccgtaggtataccgtaagactcatttgtggtgtgccgtaattttcagaaa

SEQ ID NO: 6252 - DNA, 296 bp, Zea mays
  Clone ID: LIB3279-001-P1-K1-A8
acagtagcacactattttatttctagggtctttgcctttaagcctatacccgggatttgtagtgttgagctgaggggctgaactgcttaatctgaatgctgaatttctgatgcctggacctctggtcggtttatccaagccctggacgatcaggagctctgatcaaccgatcagaagccgattaaatcgactgatcgtccgattaatcactctaatcgttctgatcgggcctctggcgatcaaaaactgatcgccgaacttaaaacattgctttctgtgaaaaagtattgtatgag

SEQ ID NO: 6253 - DNA, 384 bp, Zea mays
  Clone ID: LIB3279-001-P1-K1-A9
ccaaaacccaagcccctgcgaccccgagataccaaagccagcagaagaaggggggcagcaggcgatgcacatgcaggcgcaggcgccttctatagccccagctgccggaatcaccacggagcagatccaaaagtatctggatgagaatcagcagctaattttggctatcttggaaaaacagagcctaggaaaattggcagaatgtgctcagtatcaatcacaacttcaggggagccttttgtatctcgctgcaatcgcagatgcccaaccgcagactggtgtaagccgtactcagatggcgccgcctggtggatcttttgtaggagggtcgtacatgtgacaagtgcctatggttccaccgaggacacctttaacatcccagca

SEQ ID NO: 6254 - DNA, 390 bp, Zea mays
  Clone ID: LIB3279-001-P1-K1-B1
tcggcgaacaccaggagggaggggagcagcattcacaaccacaatccatggtggggaggactaggagccccgaggaacaactccgccctcatcgcaatcatcaccgacgaggacaccgccactggcttcttgatggccggcgttggcaatgttgatctgcgcaagaaaaccaattacctccttgttgacaacaagacgacagttaaacaaatcgaggacgcgttcaaagaatttactgcacgggaggatattgctattgtgctcatcactcagtatattgccaacatgataagatatctggtggatagctacaacaagccaggccctgctattctggagatcccatccaagggccatgcatatgatccagcgcacgactcggtgctgtct

SEQ ID NO: 6255 - DNA, 335 bp, Zea mays
  Clone ID: LIB3279-001-P1-K1-B10
agatgattactaagaactttgaagattatcctgagcaccgcctcaaatttttttctttggtccgtgcaattggcacccattgcttccaagcattaatccagctttcaagccagcaattgaagcttgtgatcgattcgattaattgggcgttcagacataccgagagaaatatcgcagagactggccttagtctattgttggaaattttgaagaactttgaggcttcaggattccaaaatcaattctacaaaacctactttttgacaattgagcaagagatttttgcagttctcacagacacattccacaaacctggtttcaagcttcatgttttg

SEQ ID NO: 6256 - DNA, 393 bp, Zea mays
  Clone ID: LIB3279-001-P1-K1-B11
cgccgccgaacccgccaccagccttctcccatcctcgaagcacggaaggctcccagaaggagctctcacctcgcagccatctctggcacgtccgtccttcttctccctcggtccctccccttctccacagctatcggattggcgttggagtggagatcgacccgggctcggaattcccttcgttggtaaggaaccctaatttggtcagatgggatttccaacttcgacaaagcccgcgaggtcgatcgatctcagttgacgcgagggattggaaaactaagttgcgggtgtagttaattttctaggaagattggggtttcagctcaaactcccatgctcgacgctgaagacgaccctggcgggagatgacgaggatcttcgtgcagcgcggga

SEQ ID NO: 6257 - DNA, 451 bp, Zea mays
  Clone ID: LIB3279-001-P1-K1-B12
cccacgcgtccgcagttttccaatatcgagaagcaataatgtagtgtagacaacggatccggagcgacgttcttaataacccagtggcaaagcggggcggacataaccagaaagtcttacaacatcaggtgttgcaaaccacaacggggacaagagcagcacacaagcctgacgatgaccgcatcaggatacttctagtactcatcaccatcatcaccttcctcaccctcatcaaactcagcaccaacctcctcgtagtccttctcgagcgctgccagatcctcacgggcctcagagaactcgccctcctccataccctcaccgacataccagtgcacgaaggcacgcttggcgtacatgaggtcgaacttgtgggcgatgcgggagaacacctccacaacactggggggagtggagatcatgcacacagcgcgctgcaccttgggcaggt

SEQ ID NO: 6258 - DNA, 453 bp, Zea mays
  Clone ID: LIB3279-001-P1-K1-B2
cccacgcgtccgggcaaacaccgctccagccgccttcgctgctgctcgtgtgtctcgtggagagctccgcggctggaccatggacccggacctggacctcgacctagacatggatatggagacgctcgccggcgacagcggcggcgaggccgagcgcaacgaagccgccgaggccgaggctgaggtggagcggtacgaggccgccgaagccgaggccgacatcctccgcgaccgattccgcctcgccgtcatcagcatcgccaccgccgaaggaaagaaggccggaatgacggtcgccgaccccgttgtttcctgcatcgccgacttggcgttcaagagcgcagagcagctagcaaaggatgcagagttgtttgcacagcatgccggtcgcaaatccgtcaggatggatgatgtcatactcacagctcacaggaacgagcatcttatgggcct

SEQ ID NO: 6259 - DNA, 452 bp, Zea mays
  Clone ID: LIB3279-001-P1-K1-B3
cccaaggtttctgatactgttgtggagccctacaacgcaacgctctctgttcaccagctcgttgagaacgcagacgagtgcatggtgctcgacaacgaggctctctatgacatctgcttccgcacgctcaagctttccacaccaacctttggtgatctcaaccacctcatctctgcaacaatgagtggtgttacatgctgccttcgtttccctggccagctgaattctgaccttcggaaacttgcagtgaacctgatccccttcccgcgcctccacttttttatggttggattcgctccactgacctcacggggctcccagcagtaccgcgccctcactgtgccagagctgacccagcagatgtgggactccaagaacatgatgtgtgctgctgaccctcgccacggtcgctacctcacggcatctgctatgttccgtgggaagatgagcac

SEQ ID NO: 6260 - DNA, 452 bp, Zea mays
  Clone ID: LIB3279-001-P1-K1-B4
ccccgctgcatctccagccaacgcgcccgtgttcgcgcgccgggtgttttctgccgcggtgcccgccgtggtgccgacgaagaagacggcgacggtccccgccccatcttcagccaaagcccccgtgtacgctggcctggcgttttctaccgcagcgcctgagcccagctccctcccgatgccctccttcgtactccttcccgcggagtccgaggccactcgtggccttcggtgcctcctccgcatcggcgacctcgcctgacacggctgccgtctctcagtcggcctctcttcaccattcggcctggtctctgctcccctcgcttttctggttgttccctatggatggttggcgcctgaagggcggatggatccgatggaaagctagcttctccggatccggtcagatcatatctcccggtaacacgttccgatcaacctcttccggtatt

SEQ ID NO: 6261 - DNA, 445 bp, Zea mays
  Clone ID: LIB3279-001-P1-K1-B5
tatactgctaagctgtctgactttggcctggcaaaagctggccctgaaggtgatcagacccatgtatcaacacgggtgatgggaacctacggttatgctgcccctgaatatgtgatgaccggtactttcctcactgtttgtatatgcttggtgtctgcatttcttagaagatatcgtctaacagtttgggtatgaacttcatgtcgattttccagacactgaactattgtttgtactccatgagctgagatcacatattttgccacttcctatgctatgtctttcattatctgaatatagtaactttgtagcaatgtcttataaccaggaaaaaaacgtattattcttaatgcatgatctgatatcacatataccatcacacctacacttaatgatacctaatgtgcaggccacttgactgctagaagtgatgtctacagcttcg

SEQ ID NO: 6262 - DNA, 451 bp, Zea mays
  Clone ID: LIB3279-001-P1-K1-B6
cactttagttacatcatgatcaacatgtcgcgttaggatatcttttatctttgaaagtataatgtgttacctaactacaagaactcaaatataggacttcttgttggagatgctctaaggagatcgaggatgatcccgtctacggtggcaagcagtactacaattaagtaataatggagggcggcctggtgttgacagccaaacagcgacaggaataccctggcggatggaacccgttcgtgttatggcgcggcgtgcctcgtggcgccatagagcttcattacaatcatcttcttcgtgttctacgctatcttcatgacactatctatggttgtctatatttagagagagaatatggatgaaggagtatcctctatatttagagtgtactctagaggacatctttgaagtctatagaggagagaatcttttctatatttatagctagtag

SEQ ID NO: 6263 - DNA, 226 bp, Zea mays
  Clone ID: LIB3279-001-P1-K1-B7
ttgggagaaacgaaacaagcccttatccaagatgagttaagaatatgaacggtcatttttttcaggcataaatataaatccgttctcttgccatggtatttagcacgcacaagcaacgcttgaataagtcttgcaaattcaacacaggttctacgaaagtggctttggctaaggaacgactgcaatgtcgagaaacgacactaagttctttcagcgcttcccacca

SEQ ID NO: 6264 - DNA, 411 bp, Zea mays
  Clone ID: LIB3279-001-P1-K1-B8
cccacgcgtccgcccacgcgtccgggttctttgcatggaaggaacatatatgatggttgctgccagctagatattcaatattcaaatctcagtgaactgcaagtccattacaacaacgaccgatctagagatttcacaaatccatcattacctacagaacaacgccctagggcctctcagcaagcttatcctgatccagctaatctctatgccttccaacaagctggagcttcatatgcacagatggggagggctgcaatgattgctgccgcatttggtggaactttacctcatggagtgactggtaccaatgaacggtgcacactcatagtcagtaatctgaataatgataaaattgatgaagaatagctcttcaatctgtttttcttgtacggaaacatagttcgtatc

SEQ ID NO: 6265 - DNA, 342 bp, Zea mays
  Clone ID: LIB3279-001-P1-K1-B9
cggacgcgtgggcgaagatgatctgccaattagcgatgagccggcaaaaacttggtgaagggacacagcacaaaaggaatcttaacttctatcgactgttggtgttcctagatcggaaccctgctcgccggagaatcttcatcgagtgagagttggctgtaggttgcttccgtggtcgtaactttatgcttgacgggttcgtcgtttcttcgaccgtctgtatgtgtattcggcgaacctttagcaatatacatatcccgattggctaaataaaaaaagaaatcttacctttataggtgtcttggaaccaaataacggttcacatctcatagataataatgt

SEQ ID NO: 6266 - DNA, 271 bp, Zea mays
  Clone ID: LIB3279-001-P1-K1-C1
ggttcgggttcgggttcgtgaggttctccggggttcggtttcgtgggtgagcggatcgagatggcggcgtccgatgttgagtaccgatgcttcgtcggcggccttgcctgggccacggacgaccacttcctctacaacgccttcagccacctacggcgaggtcctagagtacaagatcattctcgatcgggagacgcagaggtcccgcggctcctgctttgtcaccttctccacggaggaggctatgcggaacgccatctaaggcatgaac

SEQ ID NO: 6267 - DNA, 178 bp, Zea mays
  Clone ID: LIB3279-001-P1-K1-C10
acgctcacacgtccgactatatcaaccaatatgcgccaaacacacatgactattagagcactagggcacacattaagaggcacagcacatgttaaaatacggctacgactgatgacgaaggttgaacctaatcggtaatgcactatatgtaagggaatgttgactaagtaataaaata

SEQ ID NO: 6268 - DNA, 299 bp, Zea mays
  Clone ID: LIB3279-001-P1-K1-C11
gcgccggcggcgggctcacgcagctgcgctgcgggcacgtcttccactccggctgcctggagggctggctgcgggcccgcgccgactgcccctactgccgggccaccgtgcgagctcgctcctaacagcaggaaggaaggaaggatggatggatggaaagtgtggaactggatgacgatggttttattaaccgtgtgtcgctgctcacctcttggtggaaccactccactagtatggggggttcttttgcttcatcttcctttgcccgttgaggtagactggtagtactgaactttgcg

SEQ ID NO: 6269 - DNA, 448 bp, Zea mays
  Clone ID: LIB3279-001-P1-K1-C12
ctccacttggtccctctcgcatggcggcggcggcatcggcgtcgacgccgcagggggtggcggagcggcggggcatcccggcggcggccttcgtcgaggacgtcgaggcctacctccggcaggccgggcttgacgttaactccgccctcgccttcctccaggaaaggttgcaacagtacaaaatagtggagatgaagcttctagcacaacaacgagaccttcaggcaaagattcctgatatagagaagtgtttggatattgtttcaacattacaagctaaaaaggatttgggtgaggcacttatagctgattttgaattatccgaggggatatactcctgtgcgaaaatcgaggatactgactcagtgtgcctgtggttgggtgcaaatgtgatgctggagtactcttgcgatgaggccaatgcccttttgaagaaaaacttggaaaa

SEQ ID NO: 6270 - DNA, 452 bp, Zea mays
  Clone ID: LIB3279-001-P1-K1-C2
ttgaccaccaaaccaattaatggtgctattttcattttcaatccaagaacgggtcaacttgtccttaaggttatccacacaagtgtatgggcggggcaaaagcgtcttgggcagctcgccaagtggaaaaccgctgaggaggttgctgcattggttcgatctcttcctgtagaagagcagccaaagcaaattattgtgacaaggaagggcatgttggatcccttggaggtccatctacttgacttccctaacattgttattaagggcagcgagctgcagcttcctttccaggcttgcttgaagattgagaagtttggtgatcttatactgaaggcaactgaaccacaaatggttctttataatatatatgatgattggttgaaaagtatatcatcatacacagcattctcccgcattgtgcttattctacgtgcacttcatgtgaataatga

SEQ ID NO: 6271 - DNA, 453 bp, Zea mays
  Clone ID: LIB3279-001-P1-K1-C3
tctcagtctccctagcaatctctagcagcagatcctcgtgcaaagcaaagcgctagccttgctactgtcccgatggcccgcacgaagcagacggcgaggaagtccactggcggcaaggcgcctaggaagcagctggccacgaaggcggctcgcaagtctgccccggctaccggcggagtgaagaagccccaccgtttccgccccggcaccgtcgcgctccgggagatccgcaagtaccagaagagcacggagctgctgatccgcaagctgccgttccagcgcctggtgcgtgagatcgcccaggatttcaagaccgaccttcgcttccagagctccgccgtcgccgcgctgcaggaggcgtccgaggcctaccttgtcgggctcttcgaggacaccaacctctgcgccattcacgccaagcgcgtcaccatcatgcccaaagacatccagctc

SEQ ID NO: 6272 - DNA, 431 bp, Zea mays
  unsure (1)..(431): unsure at all n locations; Clone ID: LIB3279-001-P1-K1-C4
agaacttcgacttcaggcccggcatgatcatcatcaacctcgacctcaagaaaggcggcagcgggcgctacctcaagacggcggcctacgggcactttgggagggacgaccccgacttcacctgggaggtggtgaagcccctcaaggcggagaagccgtcttctgcatgaggcgcctcctctgtttcggaagaagcttttggtctggtctgcctgcgctctatcatgcttttttatggctcctacgtgttgtgattcttgatctgccccttgcttatcatttgtactgtactgtcactgtcctaataagtggtacgtgtgcggngtcgtattgtgtctgcttattcacctagaggattatttctggttttgctgcttatgtaatgcttttgaaacgatgaaggaagctacatgctctacagctgctttgag

SEQ ID NO: 6273 - DNA, 455 bp, Zea mays
  Clone ID: LIB3279-001-P1-K1-C5
ccaaagtcccaaaggccgccgccgcccgccagcccaccatggccgcgcagtccttcctcctcgccgccactgccgccgccaggtcccccgcggtcttcgccgctccctattcctccgcacgccctttccactcggtccacttcgtcgccggcccgtggggcgccgccgccgccaggtcgctcgtcgtcgcggacgccactaagaaggccgtagccgtcctcaagggcgcgtctgaggtcgagggcgtggtcacgctcacgcaggacgacgatggacctacaactgtgaatgtccgtatcactggacttacccctggacttcatggcttccacctccacgagtttggtgatactaccaatgggtgcatatcgacaggaccacattttaatccaaacaatctgacacacggtgcaccagaagacgaagtccgtcatgcgggtgacctgggaaacatt

SEQ ID NO: 6274 - DNA, 396 bp, Zea mays
  Clone ID: LIB3279-001-P1-K1-C6
cccacgcgtccgcacgcacaccaatcgcccacaagcgctcgcaggagaggtcgaaaccctagcttttgcggcggcggcggcggagagaagatgatctacgacgtgaactcccccctcttccgttccttcctcagccagaagggcggcgccgacaagaggaaaatggaggagcataaaccaaaggagcagaggcccaaggccaacgagaacaagcctgtgatgaacgaatgagtatctccagaagctttgttcaatgtgcaaccaagtccgatgtccgtttgctctggttagcttaaaaccaacgcttccaataatcctattggtgtcttagtttccccttatagtgttatttgctcggcttgaacatggcaaacggaaatgaaacttgaactacct

SEQ ID NO: 6275 - DNA, 442 bp, Zea mays
  Clone ID: LIB3279-001-P1-K1-C8
cggacgcgtggggatggtgaaaactaaagatcatagtcatattgctgattggggggttccgatatcattattgcgcgacaaaataggtggtgatcatcggggccgctaacatagaggagccgatactactactgctgctatcaactcccatttgacgcgttgctctaactactccaggcaaccaattctctagtcgactatcaatatgaaagagtaaagtacatcggcatttcgggtgtacatctaggtctatatactattcaagatgacattcccattttaacttcatttgtcacactataatggcgtgtttggttgcaattacgagatgggattggacgatccatcaaataaggttgattggttcagcataaaggatgagacaacaccggtcgatggatgagaggacccctggatgtcccaactggccacaactgaacac

SEQ ID NO: 6276 - DNA, 438 bp, Zea mays
  Clone ID: LIB3279-001-P1-K1-C9
accaactctttcccaaatccaccgccggctcggctcgcccatcttcgcgccaagcaccggagctccgatggcccgcacgaagcagacggcgcgcaagtcgacgggcggcaaggcgccccgcaagcagctggccaccaaggcggcgcgcaagtcggcgccggcaaccggtggcgtgaagaagcctcaccgcttccgccccggcaccgtcgcgctccgggagattcgcaagtaccagaagagcacggagctgctcatccgcaagctgcccttccagcgcctcgtccgtgagatcgcgcaggatttcaagaccgacctccgcttccagtcctccgctgtcgccgcgctgcaggaaggccgcgaggcctacctcgtggggctcttcgaggacaaccacctctgcgccatccacgccaagcgcggtaccatcatgcccaagga

SEQ ID NO: 6277 - DNA, 358 bp, Zea mays
  Clone ID: LIB3279-001-P1-K1-D1
cgagttctcctcaaccaaattcaaagtcacagcggcgaaactctctgcgatttctggccgcggcaagggcggaaagggtctgggcaagggcggctccaagcaccaccgaaaggtgctttgtgacaacatccatggtattaccaagccagatatccataggttgacgaggaggcgcggacttaatcgcatctacgttctcatctactataagacccgcacttgtttcaagatcttgtttgagaacataataccgtacttcttatactacaacaaacatgtccgcctgtagaatataaccgtcattagcttatcctactgttttaacctccaatgctctaccttttattgttatagctgt

SEQ ID NO: 6278 - DNA, 314 bp, Zea mays
  Clone ID: LIB3279-001-P1-K1-D10
attcgttcccgcccgccgatggcgatatccatcagccatagacacgacaacatggctcgcgcgaatcacaccgtccgcacctccacccaatgcaacgcaccctacaagcaggtcgccaccaacgcgcagaggaagtctgcgccgactacctgcgacgataagaagccccacacgtacaggcccagcaccgtcgcgcttcgcgagatccgcaagtaccagaagagcacggagctgctcatcctgaagctgcccttccagcgcctggaccatgagatcgctcacgacttcaagacggatctgcaggtccagagtca

SEQ ID NO: 6279 - DNA, 420 bp, Zea mays
  Clone ID: LIB3279-001-P1-K1-D11
caaaaccagaccatcaaacaagtgccatcgccctctcgcagtcgccgcaatggggggcacggtcatcatgatcaaggctgacggcgtccataggggcctcattggtgagatcatcagccgttttgagaagaagggcttctacctcaaggccttgaagcttgtgaacgtggagaggtcgtttgctgagaagcactacgccgatctcgcctccaagcccttcttccagggcctcgtggactacatcatctctggccctgtggtggccatggtctgggagggcaagagcgtcgtcacaactggccgcaagatcattggcgccaccaaccccctggcttctgagcccggcaccatccgtggcgactttgctgtccacattggcaggaatgtcattcatgggagggacagcattgagagtgctaa

SEQ ID NO: 6280 - DNA, 433 bp, Zea mays
  unsure (1)..(433): unsure at all n locations; Clone ID: LIB3279-001-P1-K1-D12
ctttttgcataaatcaccatataattcttcatatgagtaaactatanaaatttggcaagagccatctaagtggtaggtgacaaatatattttcataacttgcaaagctctcaacattgttagtcaagcggtgaattcccaagtttttaaatctataacaggaatttgttttctacagtagagtgttattccagtaagcctgtcatatatgactaacttcaattatttcatcagggatctctcattcaactacttcttgggagcatttgcctttatttatatgaacaattagtttgtttcttgactaccttctggtaaataatagttgctaagccgtaagagcactgccctcttaatttcttgatggccaaaaatagtaggacatatgctttcaactatcttaattaataaattaggagtggtcctcatcttaa

SEQ ID NO: 6281 - DNA, 433 bp, Zea mays
  Clone ID: LIB3279-001-P1-K1-D2
gccaggagggcgccgccgccaccaacgcaacgcgcgccgccgcagatctccgccaccgacgcgccggccatggagtacgagcgcattgagaagccgttccccgtccagcagggcggcgggttctcgcccaagcggctgcgcgcgatgctgctgggggtggacaagcgccgcaaggggcaggacggcgccgccgaggaggacgaggacggcggcggcggcggcgactacggcgccctgcccaaggcccacgccagatccggcgccggcgacggtggtggcgccacgtgcgaagaatacaaggacggtgacgtggtgagcaccacctcagagttctcgtcctcgctggagacagcgggtgggcaccggccccgggacgcccaccccgtcgccacgggttctaggaccagggtgccgcccgaggaggactcgtgcg

SEQ ID NO: 6282 - DNA, 449 bp, Zea mays
  Clone ID: LIB3279-001-P1-K1-D3
tttaggtgctggaacaccaggttcaaacaatttttgctcaagtagtactgaaggccttccaagaacttggcaacctggtgaaacaaatgatccaataaatcaaattccgtcactccgccgtcagtacctcatgatatttctgataatcatcttgtagtgcaaaatacttactccgattctgtccatctctactatttctaagaattatgtcttaaccatcctcctgtgcatcttttcttgtgaatttgtaagcttcaatctcaaatccgctggccccttcttttagaatgaaccgaacctccaatattctcttgatgatgcttaacatacagagaaacggtgtaacacaaaacagcacaatccatttctttgtactgtttctttttcaaatattttactgttttcaatattgaatctatgtcttgaatgaattgctagcttatctaatt

SEQ ID NO: 6283 - DNA, 456 bp, Zea mays
  Clone ID: LIB3279-001-P1-K1-D4
gcaggccgccgggcgccgccgaggggatcggagcaagatgttcttccacatcgtgctggagcggaacatgcagctgcacccacgacacttcgggccgcacctccgcgacaagctcgtttccaagctcatcaaggacgtcgagggcacctgcagcgggcggcacgggttcgttgtggcgatcacgggtgtggaggacatcggcaaggggctcatccgggaaggcacgggatacgtcaccttccccgtcaagtaccagtgcgttgtctttagacccttcaagggcgagatcctcgaagctgtcgtcaccatggtgaacaagatgggcttctttgcggaggctgggccggtgcagatcttcgtgtccaaccatttgattccagacgatatggagttccaatcaggagatgtgccgaactacacaacttctgatggatcggtgaaaattcaaaatgagag

SEQ ID NO: 6284 - DNA, 338 bp, Zea mays
  Clone ID: LIB3279-001-P1-K1-D5
gacaattcgttgctcgcgatcctcgcttcgggatccggaagagatggccaagtcgaagaaccacacggcgcacaaccagtcgtacaaggcgcacaagaacggcatcaagaagcccaagcgccaccggcagacctccaccaaggggatggaccccaagttcctgaggaacctgaggtattcaaggaagggcaacaagaagagtggtgaggctgaggagtaggaaggaaagcatggttgtgttttctatgttttagctcagttgtaaggtggaactaaatggtgttatctgatggcaaggaccttttgctccgaaatgtttttatgataatcatgttttg

SEQ ID NO: 6285 - DNA, 444 bp, Zea mays
  Clone ID: LIB3279-001-P1-K1-D6
gcggctgctgcggcgtggcgggcgccgagcgatgcgggagccgtcactgctggtgcgggaggccgcggcggagcagctggaggaacggcaggcggattgggcctactcccgccccgtggtggcgctcgacttcctttggaacctcgccttcatcctcgtctccgccgtcgtgctcgtgctcagccaccacgagagcccctccatgccgcttcgtttctggatcgctgggtacaccgcccagtgcgtcgtccacatggtctgcgttgccatcgagtatcgtttgcgatacggccagctcggcgggtcgccaattcctgtcgacgaggagagcggaagtggtagtgcatcatcgtcctccagcgacgacgacagagagcacggctcccatagtcgaagtggtgactgcctcagtatagctaaacatctggagtctgctaacacaat

SEQ ID NO: 6286 - DNA, 305 bp, Zea mays
  Clone ID: LIB3279-001-P1-K1-D7
cccacgcgtccgatcgccccagattttacatgtagctaacttagcagggcaccgagaatgcgataatttattctctggagttgtagcagcgacctagaggtgtcattctgtagcacattgtgtaacatgtaggagagagataaacacatatccccattctttctattgaaacaccagaaatagttgctcttgctccataaaaaaaaaaaaaaataattaatattattgagaaaattattttatttatattttaaaaatataataaaaattataattgggggggccgttctagaggatccaaggtt

SEQ ID NO: 6287 - DNA, 360 bp, Zea mays
  Clone ID: LIB3279-001-P1-K1-D8
gaccgcccgaagaagaaagtagtcatcagcgagtgtggggagcttccagtggtgtaagtggtactcatctgttgtcggtcttacctaacctcggatggatggcgatatttcccccacctgaacttgtcgtgctaccctcccccccccccacccccaccctgctagttatagagaatatttcgaattgaagtaaggtcccaaatctgagggcatactgttgcttctctgctggaataaatgtgctccttgttcatgggacaaaatataaataataagaactttttacttaacttactatgtcttatgtgtgcttcttattactatttaaaatttatatgggggcggcccttttaaaggttc

SEQ ID NO: 6288 - DNA, 430 bp, Zea mays
  Clone ID: LIB3279-001-P1-K1-D9
cctaagtctcggaccccaaccctcgaggaaggctaccggagatggctacatcttgagcgggggagaagctcaaggtcctctgggactcacacgtcaacgacgaggagcagtgggcgctcaattataagctgctgaaggctgctggtctgtttgcgggatccatcttcctgatgcggaacttcggtgatctgatggccatttagtaggcttatcagcgttgcttacttggatcctatgagtgttgttttgatgttccaataattcctgctatgaatattaaagttattttgctcttaagaggactagatttgtgccgatagtgcttgatcttagactttgtagccatagagattagacccctttaatattctgcgtgtaccgtggatatttttggaacgatggtatcattcctgcaccccaaataattttt

SEQ ID NO: 6289 - DNA, 443 bp, Zea mays
  Clone ID: LIB3279-001-P1-K1-E1
cgcagagctctcatcctctctctctctctttctcgcgctcgctttgcttcctcgtcgaggggcaaggtcctgcattgatggcgaccgaggtggctgagactcccgcgccgttggcggaggcggtccccgagacccccgcggaggcaccggcggcgcccgccgccgaggcgaagcctgccaaggccaagaaggcctctgcgcccaagaagcgtgccaacccgacccacccgccgtacgccgagatgatctcggaggctgtcacgtcgctcaaggagcggacggggtccagccagtacgcgatcgccaagttcgtcgaggacaagcacaaggacaagctcccgcccaacttccgcaagctcctgctcggccagctcaagaagctcgtcgccggcggcaagctcaccaaggtgaagaactcctacaagctgccagcgcgcgccccg

SEQ ID NO: 6290 - DNA, 361 bp, Zea mays
  Clone ID: LIB3279-001-P1-K1-E10
ctggccggcgcttttcgctaagctcctggagacgcgcagcgttcaggatctaggcctctgggttcgatctggtggtggcgctgctccacttgctgcttcccgcccagctgggggtgctgcagctgctgctgcccctgctgcacaggagaacaaggaacagcccaacgaggagtcttgacgaccacatgggccttaacctgttctactgaaagtctgagaccctcgctacccagccattatcacattcccttatgctggccaagacttatcttacgttatgtctgtaggcttcttgttatcacaaagcctcaacgcttgagtttttcgagaagtggctatgacaatttgatgccttacccta

SEQ ID NO: 6291 - DNA, 443 bp, Zea mays
  unsure (1)..(443): unsure at all n locations; Clone ID: LIB3279-001-P1-K1-E11
cccacgcgtccgcacaactccacaagatctagaacctaagaacctgcanaggagaggaaggggagcttggggaggagatggccggcgccgagggcgagaggtgggtggggctagcaacggacttctcggaggggagccgggcggcgctgcggtgggcggcggccaacctgctgcgagccggcgaccacctgctgctgctgcacgtcatcaaggagcccgactacgagcagagcgaggccatcctctgggaatccaccggctccccgttgattcccctctcggaattctctgaccctatcattgcgaagaaatatggagcaaagccggacatagaaaccttggacatcctgaacactacagctacccagaaggatatcgtggtggttgtgaaagtcctgtggggtgatccgcgtgagaagctttgtcaagttatccatgatacc

SEQ ID NO: 6292 - DNA, 234 bp, Zea mays
  Clone ID: LIB3279-001-P1-K1-E12
gatacacataaataacggcacgatttcacactaatattaatggagatcatctcggtaaaaggtatatcgataaacctagacacaaacccaatgacatgtgctagtcctaacctaacgtgatcagacataccatcccaatgccttttttacacatcccagccttgctcatgtccctccaagaacacgctaatgacatccctccttgccggcgccgggtttcatcacacatacatg

SEQ ID NO: 6293 - DNA, 438 bp, Zea mays
  Clone ID: LIB3279-001-P1-K1-E2
ctcatggcgccgccgcagccgaagtcgggcctcttcgtgggcatcaacaagggccatgtcgtcaccaagcgcgagctgcctctgcgcccgtcccaccgcaaggggaaagcaacgaagagggtgtccatggtcaggggccttatcagagaggttgctggctttgctccttatgagaagcgtatcaccgagcttctgaaggttggcaaggacaagcgcgctctgaagcttgccaagagaaagcttggaactcacaagagggcaaagaagaagagagaggagatgatgggcgtcctcaggaagatgagatcggctggtacgcacactgacaagaagaaataaagcatttcaagttcatgaatgtggcagccagagattatcaactgtgttttttccctacctctagaaactagacatggcaaagtatttttgaccgaaaca

SEQ ID NO: 6294 - DNA, 446 bp, Zea mays
  Clone ID: LIB3279-001-P1-K1-E3
cccacgcgtccgcaaagcgttgcaggtaggcccacagtacaaggagtacgccggaagcttcgccgtcgtgccgggctccggcgccgggaagacgcggaaagtgaagctctccctgtgcatcaccgaagtgctgttcgatatcgacgctgacggcgataaaaccgtcgacgtcgttatcgtgccgcgcacaaatgctaagatcacgctcaacgctcgccccaccatcaagaatcggaactaggagctagctgctactagtgctcatcaagcacactgtacgtacgtacgtatgtactcgatcgcgtggtcattcatcgaccatcatcgtttatatgctgtcacgcacagtgcgggacggccagtgttgcattattgtgtgttttatttcgcatggattaggatcgagccgcgccaatggtagattctacggaataaatataataaca

SEQ ID NO: 6295 - DNA, 448 bp, Zea mays
  Clone ID: LIB3279-001-P1-K1-E4
ctggtgcagctgacactgatgagccctcagaatcggacgccaagtctgatgaagccatgggagccccagtggagcaggaagtggccccagcttccaccatggtaaagaaggaacagaaggagagtgcccggcacaggaacgtggtcagcaaggccctgccacccaaggcgatcctgaagaggaagaaggcgcagtcctactggtcatgggctggcccagctgccatggtggctgccgtgctggttgccctcctcgcggtgctgggatactaccagtactacctcccagcgaatgccagcaactgagtgggcgaggtcggtgcactcgcggccaggcattcatttatgacgtggagaccaattttgcaggtgagaagaaagagtgcaaggtctgcttgagacctgaaggaccggaggatgttcgctttcgatgttgttagttggagccg

SEQ ID NO: 6296 - DNA, 302 bp, Zea mays
  Clone ID: LIB3279-001-P1-K1-E5
ctcacgcatttgataatgcttagtcgtacgcatcgatcgcaacgtttgatcaacactttgggtccctggttgatctacaagtggccccatcttccactatgttaaataatgaacataatgagagtgcatcttcacatgatcttgatgatcaatgctcctgcatccatggcgatcctgaagagttagatggagctgttctactcctcatgagcttgtcccactttacatgtacactgacaatcatctttgctcttctttcagtgctgtgatactaccagttctacctgtcaggaaatgccact

SEQ ID NO: 6297 - DNA, 450 bp, Zea mays
  Clone ID: LIB3279-001-P1-K1-E6
cggacgcgtgggtcacgactggtgttccgcctctctggaaccggttctgttggtgccaccatccgtgggtacatcgagcagtgcgagagggactcctctaagaccggcagggattcacaggacgcccttgctccgctggttgatgttgcgctcaagctctccaagatgcaagagtacactggacgctctgcccccaccgtcatcacataaattttgaagagtgttttagaatgagttgaggcgcttacacaaactttcattccggcctcttgttccatagtttttcttgcatgttacatctcaccgatgaataaaatgtatgtatcagacttgtctcgtttttttgcccatccaagcagcaaattagccgctggcacagcatgcggtaataatcttgtcacagtgctgtaattgggagcgtttttcttgttagaagtgtttctggtttgt

SEQ ID NO: 6298 - DNA, 367 bp, Zea mays
  Clone ID: LIB3279-001-P1-K1-E7
ggaaatcataccatagctcttgcagggtgcagaaaaggggtagagagaagaacgggccggggtgcctcaaccggaaggaaacgcggaccacgagagagagacccgtcaagggagtgagtcactactgcagaggtccaggttggtgggtggatgtcaggcaaggcacaatgcaagtgaacatcaggagccgtggccatgtacagtgctcgcatatatagggccggtcgtccaagcgacgctaaactgcgctagtagtaggggaggagaagagagcacggagcatgcaaaagcagtgcaggtgcgcgctgctgagccagtagtagccactgtgtgccaccgctgctaggactactactagcgctcgcac

SEQ ID NO: 6299 - DNA, 366 bp, Zea mays
  Clone ID: LIB3279-001-P1-K1-E8
cgcggtcactggttagtaggaagaagggaaggaggaggggggagcggtgtcggggtatcgtgtcgtgcccatgggcgtgcacgccaggtcgatgagctggtacatggggtcgccggcgccggggagcgccgccgagggcgaggggcagcgcgcgctgagaagcagctccggtggcagcgacggcagcttcgacaccaacatggtcatcatcctcgccgcgctgctgttcgcgctcctcttcgcgatgggcctcaactcgctcgcgcgctgcctcatccgctgggcacgccgcgcaccggccggggaggacggctgcgccggcgggctaaagaagcgcgcgctccggagcatccccgtcgaggtgta

SEQ ID NO: 6300 - DNA, 401 bp, Zea mays
  Clone ID: LIB3279-001-P1-K1-E9
tatgcaccacaaatcctggctgtaatttttatagttcctcacctctccaagtttgtgaactgcctgtacaactgccagtataagtcgttcttcgttgcattttctggtctgacagagcaaatcaagttagaccgttatcttcagcctcatttccgctactacatgagggaagtgcgcaccgtggtatactcacagttcttagagtcatacatgagtgtgacaatggaagcaatggccactgcgttacgtgttactgttgatttcattgaccatgaactgtcacggttcattgtagctgggaagctgcactgcaagaatgataaggttgctggtgttctggagactaaccgatctgatgagaggaatgttttttaccaagcgaccaatagcaaggtgacttt

SEQ ID NO: 6301 - DNA, 448 bp, Zea mays
  Clone ID: LIB3279-001-P1-K1-F1
cggacgcgtgggccaggccctggtgcccgagcgttctcgtgcggcaagtgggcgccgccggcggactacgccaggtgcccagttcctcgtcgggtccttcgtcgacgacgagcacccaccaaaaattcgagtattagactctacatgtcaagaaagtatggcgccaggaagcaaggcggagcggaaagcagcactagatgctggcgcatggatgttcaatgtcgtcacatctgttggtatcatcatggtcaacaaaggcttaatggcgactcatggctttagttttgctacaacactgactggacttcattttgcaatgacaaccttgatgacgttagtaatgaaatggctgggatatattcagccatcttatttaccattaccagaactagtaaagtttgccttttttgcaaacctgtcgatcgtcggaatgaacgttagtttgatg

SEQ ID NO: 6302 - DNA, 337 bp, Zea mays
  Clone ID: LIB3279-001-P1-K1-F10
cagcattggatgcctgttctggcttttggccaggatggttctgcagatgaggggcgactatgctccctgggcacaagtgggaagtcatggttgatctgttcttctacagagacccagaggaagcgaaggagcaggaggaggaagctgctgcggcccctgagtttgctgcagtcactgattaccaaggagctgatcagtggggtggtgaccagtggacctctgatgtggctgcaccacctgttgctcctactggtgctgattggggtgctgcaccagcttcggttcctaccggtgatggctgggatcaaactgtggcccctgttcctggggatggcac

SEQ ID NO: 6303 - DNA, 448 bp, Zea mays
  Clone ID: LIB3279-001-P1-K1-F11
ggctatgcgccaaccatcaccgtggtcgtggccaagaagcggcaccacactcggctgttcgccagggacgaacagcagccgcagacgaagaccgggaacgtgcctcctggcacggtggtggacacgggcgtggtggacccgtccgcgtacgacttctacctgtgcagccacactgggattctggggacgagcaggccgacgcactactacaccctggtggacgagcacggcttcggctccgacgacctgcagaagctgatctacaacctgtgcttcgtgttcgcgcggtgcaccaagccggtgtcgctggcgacgcccgtctactacgccgacctcgcggcctaccgtggcaggctctactacgaggctgccatgatggcgtcccaggcccagcgaggggggtcctttgacgtcactaacttcccgaggcttgcacaggatgtggagg

SEQ ID NO: 6304 - DNA, 467 bp, Zea mays
  Clone ID: LIB3279-001-P1-K1-F12
aatggcggggggaggacgcgtccggcctgcccgggcggtagataggagaggtcaagaactacggcacgaccgccgacgtagcagggggatctgttcgcctcccgtaccgagacccccctaccctttcgtcgacgactaggcttgcggcgaccgcccttggcttcgccgtcggcgagcatcaccagggactgacgattggcgggggagcgaatgcggagatgggctgatcagaactgcgacaaggtccggttttctctctaaaccgcggtctctggaggtgggtttgctttttccgtagtcacagatggacgacgacgacggcagcctgggcattcggaactggggcttctatgacaccgtgaaaggcagcctcggcctgcagctcatgtcgcccatgccacctgatcgggacacgaagccactgctcccgagagctggtttcttgcagcagcatgggcatcacaatg

SEQ ID NO: 6305 - DNA, 440 bp, Zea mays
  Clone ID: LIB3279-001-P1-K1-F2
gatcgggatggcctcccaccattccgagcccctcgaccccgccgacgctgacgacccctgagataacaacccagaattaccatgcccctcctatcatatcgttaccaaacctggtcaactcccagtcgagtttcttgaaccctcagctgcccagaagttggtaattggatttgactgtgaaggtgttgatctctgccgcaatggtgctctctgtattatgcagcttgcattccctgatgctgtttacctagttgatgctattgagggtggaaaagaacttattcaagcttgtaagcccgcacttgagtctgatcatatcaccaaagttattcatgattgtaaaagggacagtgaggctttgtattttcagtttggcataaaactgcataatgtgatggatacacagattgcttattctctgatagaagagcaagagcagg

SEQ ID NO: 6306 - DNA, 213 bp, Zea mays
  Clone ID: LIB3279-001-P1-K1-F4
cccacgcgtccgtgaaaatgaaatggacatcgtcttggatgctgtgaacaaaataaggtctgtgaagccaccaacagattcaaatgaaagacgtcctgcttttgcactttgccgaggccaagagatcgctgccacaatccagtgctatcaatctctaatcgtgtatctttcttccatatcacatctcaagatcctgacagagaatgatgaaac

SEQ ID NO: 6307 - DNA, 456 bp, Zea mays
  Clone ID: LIB3279-001-P1-K1-F5
caaaacggaaatagctcgcggtcgcggtttcttgcgccactccggctcagccgccgcccgcgacccgccacagccgccgcagacgagatgggcatcaagggtttgacgaaactgctggcggacaatgcgcccaaggcgatgaaggagcagaagttcgagagctacttcggccgcaaaatcgccgtcgacgccagcatgagcatataccagttcctgattgtagttggaaggacaggcatggaaactctcacaaatgaagctggtgaagtcactagtcatttgcaaggaatgttcaaccggacaataagattactggaagcgggaatcaagccagtttatgtttttgatggcaagcctcctgatatgaagaaacaagagcttgctaaaagatactcaaaaagagatgatgcaaccaaagatctgactgaggcagtagaggtaggagataaagatgcg

SEQ ID NO: 6308 - DNA, 237 bp, Zea mays
  Clone ID: LIB3279-001-P1-K1-F6
cggacgcgtgggaaaaaaaaaaaaaaaaaaaaaaaaaaaaaaaaaaaaaaaaaaaaaaaaaggaaaaaggggaaaaataaaaacgaacaaaaaataaaaaaaacaatcatctaacgtcaccactattaaattctcctctcctaattttttcgccctggtctctgtttttcccctttctatacccaaaattctcgccttttcccactttttccttttttctgttttttttttattctc

SEQ ID NO: 6309 - DNA, 363 bp, Zea mays
  Clone ID: LIB3279-001-P1-K1-F7
aaacacacaacacaaccaaccacctcactcgatctctcatcactcgcaagtccagggatcagcaaccagagctcggctccaagcctccaactccaacccaaggagacagatacgttcgcagatggcgggtgcagcgaaggcgtcgtggatggtggccatgagcgtgggcgccgtggaggcgctcaaggaccagggtggcctctgccgctggaactacgcgctgcggtccgtccaccgcaccgccaaggccaacgtccgcagcagcctcgccgcgcagcgggacaaggagctggccccggcggcggagtcgaagaggcggccgggcaaggccgccgcgggaggagggatgaagaccgtcatgta

SEQ ID NO: 6310 - DNA, 282 bp, Zea mays
  Clone ID: LIB3279-001-P1-K1-F9
agcaactgtaatcagagatgaagttgggctgtcacttgacaaggccgacaaatgagttcttggaacagctgcaaaggttgtccttacgaaagagtcgacaacaattgttggtgatggcagcacccaggaagaagttactaagagggttgcacagattaaaaatctcattgaggcagcagaacaagaatatgaaaaggaaaagctcaatgagaggatagcgaagcttgctggcggtgttgctggcattcaggtggggagcacaaaacagaaaactgaactaaa

SEQ ID NO: 6311 - DNA, 374 bp, Zea mays
  Clone ID: LIB3279-001-P1-K1-G10
tcggaagctgtacggggcggtgatgtctgggaacgtgacaaggtgcacaactccgcgtggaagaggctgtctgcgactaggagatcgttcccatcaacttcgtcaccggcgagcacaagagccccgagcacctcgtccgcaacccgtttggtcaggttccagctctgcaggatggtgacttgtacctcttcgaatcacgagcaatctgcaagtacgctgctcgcaaaaacaagccagagctgttgagggaaggaaacctcgaggaggcagcaatggtggatgtttggatcgaggtggaggttatccagtacaccgatgtactgaaatctattctttttcaggttcttattattccttatgcttgggggaaccac

SEQ ID NO: 6312 - DNA, 359 bp, Zea mays
  Clone ID: LIB3279-001-P1-K1-G11
ggcgcttggcttctgccttctccttccctcacgctctcggtctctccctctgggtcccgaggacctaaaccctagagccggcagacgccactgtccgtggagcagagcaggctgcagcaccgccgcgccggtgtgcggcgtgccggcgtgtgccctccgtcgtctgcccgtctgcccgtctgttcttcgctgtctgctcaagacacggtgaacagtctgttcttcgccgtctgctcgtcttccccgacggcgccctagccctggtcggctgtccggccttccgcgcccacttgcccatcggcgggcgggggctcgccttcatggaagcccaaaaaaccgatgggccccaaagtcattta

SEQ ID NO: 6313 - DNA, 444 bp, Zea mays
  Clone ID: LIB3279-001-P1-K1-G12
cgacgtctctcctctgggtctggggccgagacaccgagcacgtactaccagcgggatgggggcgtctcccagattcaagcccatcgaggagtgctgctcggaggggcggtcggagcagacggtggccgccgacctggacggcacgctgctcatctccaggagcgcgttcccctactacctcctcgtggctctcgaggccggcagcgtcctccgcgccgcgctgctgctcctgtccgtgccgttcgtctacgtcacctacgccttcttctccgagtcgctggccatcagcacgctggtgtacatctccgtggcggggctcaaggtgcgcagcatcgagatggtggcgcgctccgtgctccccaggttttacgcggtcgacttgcaccccgagagctggaggggtgtcatctccttcgggaggcgctacttcgttacgggcagtcc

SEQ ID NO: 6314 - DNA, 453 bp, Zea mays
  Clone ID: LIB3279-001-P1-K1-G2
gggcggacgcgtgcgatctccttcaaccaggactacggctgcttcgcagcgggcaccaagtcgggcttccgcatcgacaactgcgaccccttccgagagatcttccgccgggacctcgccgccgagggcggagtcggcgccgggggagggggtatcggcgtcgtcgagatgctgttccgctgcaacatactcgcgctcgtcggcggcggagataacccccactacccgcccaacaaggtcatgatctgggacgatcaccagagccgctgcatcggggagctctccttccgctcccccgtccggggcgttcgtctccggcgcgagcgcatcatcgtggtgctcgagaacaaaatcttcgtctacaacttcgcggaccttaagctgttgcaccagatcgacactttgagcaaccccaagggcctctgcgccgtgtcacagcagcccgggtccatt

SEQ ID NO: 6315 - DNA, 454 bp, Zea mays
  Clone ID: LIB3279-001-P1-K1-G3
cccacgcgtccggcgggcggacaaggagcaggcggaggaggagctgtgccaagccacaatgggtatctcgcgtgactcgatgcacaagcgccgggccaccggtggaaagcagaaggcctggaggaagaagcgaaagtatgagcttggtcgccagccagccaacaccaagttgtcaagcaataagacagtgaggagggtccgtgttcgtggaggtaatgtgaaatggagggctcttcgccttgatactggtaactactcatggggaagtgaagctgttacccgcaagacccgtatcctcgacgtggtctacaatgcatcaaacaatgagcttgtgaggacacaaacccttgtgaagagtgccattgtgcaagttgatgctgccccattcaagcagtggtacctcactcactatggagttgacattggtaggaagaagaaaacccctgctgcaaag

SEQ ID NO: 6316 - DNA, 452 bp, Zea mays
  Clone ID: LIB3279-001-P1-K1-G4
gtttgctaagatggaagagggcaatgactactatgttgtcaggaaaggtgatgtggtggcagtttacaaaactctaagtgattgccagggtcagatttgctcttcggtatctggtcctgctgcaagtgcctacaagggtcactcttggagcagaggaaaggaggaatacctgtcttcacggggactaagtgatgctacatacgtaatcaatgcagccgaactcagggaagatatacttggcccccttgtgccctgtagtttccaggacatacttggttctagttcaaatcaactggctccaaatcatataggcttccataatgttatagcatctcagactggagcacaatatgttgatctgaaccatgaagccagatctagttcatccagacatatctcaccagcaaatttcaatcataccggaactgttgatgcacaacctatctcaaaac

SEQ ID NO: 6317 - DNA, 407 bp, Zea mays
  Clone ID: LIB3279-001-P1-K1-G5
acgcgtccggacagacccctttgccctccctactggaccactccgacgcccacagcgccttcggcgagctgcacctgtccaccggcggcagcgaggggcgaggggggctaatactgtaggcggaggaggaaccgagccgatggggcagcagtcgctgatctacgcgttcgtggcgcggggcaccgtggtgctggtcgagtacaccgagttcaccggcaacttcaccaccattgacgaccagtgcctgcagaagctccccgccaggaacaacaagttcacctacaactgctacggccacacctttaactacctagtctaggacggtttcacgtactgtgtagttgctgacgaatcagccgggcgacaaattcccatagctttcctggacagagttatggaagacttta

SEQ ID NO: 6318 - DNA, 424 bp, Zea mays
  Clone ID: LIB3279-001-P1-K1-G6
gcggcgaccctccctccttcgctccttccgcgccgcctcccggccgtcgccgccatggtgaagggctcgcgggagccgggcaacctaccaagtcagctaaggccatgggcagggatctgagggtccacttcaagaacacaagggagacagcctttgcgcttcgcaagttgtctttgaccaaggctaagcgataccttgaggatgttattgctcacaagcaggcaattcccttccggagatactgtgggggtgttggtcgcaccgcgcaagctaagtcgcgccactccaatgggcagggccgttggcccgtaaaatcagccaggttcatcctggatttgctgaagaatgctgagagtaacgctgatgtgaaaggcttggatgtggacaacctctatgttcacacatccaagtgaatcatgcccag

SEQ ID NO: 6319 - DNA, 401 bp, Zea mays
  Clone ID: LIB3279-001-P1-K1-G7
aaagaggcaaactgtgtgtacctacatcacagtaaaactgaagctacacaatgttcttcacttgccaaccatacagtacagcattattcgaagtactcgacttggatctagaagcataaagataacaatagtaaaaggaaagataacccacagagagaaatcacccaaagcagaaaacatccctgctcataccaaccaattcctcaaatggctgcgccattgctcctcctcgccagcttggtccattcggtgtggaatgaacccggacagtcaatgcgctcataggtgtgtgcaccaaacagatccctctgcgcttggatcagatttgcaggcaatcgacttgatctgtaggtatcgaaatacgaaaggctagcagtcattcctggcgtgctaatgccaac

SEQ ID NO: 6320 - DNA, 389 bp, Zea mays
  Clone ID: LIB3279-001-P1-K1-G8
ttccacccggtggccaccatccttagctacctcaccaaggcaccactggttccggccggcacaccggtggtgaacgctcttgcaaagcagagggcgatgctggagaacatcttgagggcctgcgttggcctggccccagagaataacatgatcctggagtacaagtgagcgaagtggcgtggcctgcagctagatatggaggaggctgcacgaaggggagggactagagaggcgagattagctgtggagttgtgttggcttctcgtgttttcttttgcgttcttttcctggtcttcgctgtggcgcttttgtattttaattgttggacccgtaactatcagggctctgctattagcgcttgaagcctgtaatggcatatcatgatataa

SEQ ID NO: 6321 - DNA, 319 bp, Zea mays
  unsure (1)..(319): unsure at all n locations; Clone ID: LIB3279-001-P1-K1-G9
tccacccctgcggccactttcatctcatgcctctgaaaggcctcatctactccgtgggtggcaccaaggtgccactgtttgacttaacancctactacgtttatttatttctcgaactatcgctcgctcctgtccctagactataacatgacttactcagtactatgtaatgatgccgcgtatcatcctgctcaatgtggagtaccttgcaagaacgattaatactatactctccacataaattataaacatttaaaggcactcatcgccgtatcactacttccttttctgtaatgcatccgacaattccctcttttat

SEQ ID NO: 6322 - DNA, 445 bp, Zea mays
  unsure (1)..(445): unsure at all n locations; Clone ID: LIB3279-001-P1-K1-H1
tggtcctaggagtctggcaactcggatggttcaagtatgtggttggtttgcaccctctgcggttccaattcacatgttggctcgtgctgcacacaaagtcccaaagaagcaatggaggggtccaaggtggagaaagtggtggcgaccacttacttgtggccttgcaacttctaggatgaagaaatctgaagctgaagcagctgcaatgttaatgaggtttggaattgccagatgcagtgcagagcccgaacatgtacagttccatgatctgatcangctatatgctcgaaagctaggaggcacaagaacagctccggccatggtccagtcagtgtacctgcaaggctcaatcaaacattcctctgagcacctgtgggcttcgagcttcatggtttttggattggttctgatcctctggtgtagaacttggaccatcttgactaat

SEQ ID NO: 6323 - DNA, 354 bp, Zea mays
  Clone ID: LIB3279-001-P1-K1-H10
cccactcgtccgggtgcttgacgagtaaattaacaagaataataataatgctggtaatgggggtacaaatgcaatgaatgctgacatgtttaatgattttataacaaactttacaccagatgtgccggctggaataactgatcaggcaaggcaagaagatgctcaagagtttataagttttgccatggatagagtgcatgatgaactggtgaatcttaatggtaatggggaggatttagaggagggtatggttgattattctggtgatgatgcttgggagacagtcggaagaaagaacaaatctgcacttggtagaacacatagttttgtttcctctgagctaagtggtatttt

SEQ ID NO: 6324 - DNA, 286 bp, Zea mays
  Clone ID: LIB3279-001-P1-K1-H11
cctcccacgcgtccttccactcgtccgtaaaaaaattcctcattttcttctacacggggatagggtgaaagacagggcgccggcagcgactatatcttggctctgcaagggcggcaaatgtctgggcatgggcggagcaaagcgccaccgttaggtgctccttgacaacatccagggcatcaccaagcccgcgatccgtaggctggctcggaggggcggcgtgaaacgcatttcggggcttatctacgaggagacccgcggcgtcctcaaagatctttctcgagaa

SEQ ID NO: 6325 - DNA, 332 bp, Zea mays
  Clone ID: LIB3279-001-P1-K1-H2
gcaaaaccctaacctctctcactccgccgccaccgggggagcgcgaggaggacccttcatggcccgccgcacgaacaaagctcccatggccaacctcggcggtggcgccgaggcgcacgcgcgattcaagcaatacgagtatcgcgccaactccagcctcgtcctcaccacagactcccgcccgcgcgatactcacgagcccaccggagagcccgagacgctctggggcaggatcgaccccaagtccttacgcgaccgcgccgatcagaacatgccgccctagcttgaggagaaactctccaagtcgcgcaccaaaaagtctaagcgcgacg

SEQ ID NO: 6326 - DNA, 406 bp, Zea mays
  Clone ID: LIB3279-001-P1-K1-H3
gcaaaaagcttaaaccagaaatcgtcatcgcccttacacatatcgatttggtttatgacatgattggataggagctccgaacgcgagccatagacgggagttgatgccaccgggcgatgaatggtcgcatcctcaggacctcggcgtgcaacagcagcggtaagaactcgcccccttcctcttcggtggtagtctcacgatcttcctccgcagccattgaactttaaaatgagaaccaaaagcacaagagaaccaaaagcacaagagaatcaaaagcacaaggtttctggcctccctattaggggattccacggagggactcctctcagggataaaccaattggctgtcatttttcatatcgcctacttcaatagcctacaacattagcagtacccggctttttac

SEQ ID NO: 6327 - DNA, 455 bp, Zea mays
  Clone ID: LIB3279-001-P1-K1-H4
attggagtctacgtcaaaagttcgagaggatctttatttccaaaactacatgaaggacccgaatgcacgcaggtggaaccccagtgatgcaactgtctgcaccagacagaggaagacggagacctagcatggacagtcgtctgaaatttgaccgtggcagtaacaaagaacatgataaagctgagagagatggaggcagatatggtagagacgatcactctccaagccgtgatgggcctgatgatcagatgtttgatggtttccgtggacggccctctaatgctccttttgttgctgaattcccccctccaccgatattgatgccagtacctggtgctggtcccctaggaccatttgttcctgcacctccagagatagcgatgcatatgctgagagagcaagggccacctcctccgtttgaaccaaatggcgcaccacatggcagcacaggaatg

SEQ ID NO: 6328 - DNA, 466 bp, Zea mays
  Clone ID: LIB3279-001-P1-K1-H5
ttcccggaaggacccacgcgtgcgcttaattctatgaatctgttgttgtacatggctccaatcgctgttatcttcttgcttcctgcgaactatctttatggaggataatgttgtcggcgttacaattgagcttgcaaagaaggatttcacgattgtttggttgctgttgttcaattcttgcttgtcgtattttgtcaatttgaccaatttcttggtgaccaagcatactagtgcactgactctacaggttctcggaaatgcaaagggtgccgtggcagttgtcgtctcgattatgatattcaggaatcccgtgtccataacaggaatgctcggttatacttttacaagttttggggtcattctttacaaggaatacaaaaagcgccacatcaagccatggacaccctaggagacagtgaatatgggaagtcatttttttttgctttcagcgcctaaaacttttttt

SEQ ID NO: 6329 - DNA, 469 bp, Zea mays
  Clone ID: LIB3279-001-P1-K1-H6
cgaccgacgcgtccgaacttacagcggactcaaagatcttgagtcattaggcataaaagagctggagcacctggagaagcaggtcgattcgtccttggagcacataagatctacaaggacacaacacatggttgatcaactgacagaacttcagaaaaaggaacaaatgttttgtgaagcaaataagtgtctttgaagaagactggaggagagcaaccaggttatatggcagtatgcgtgggagcaaagcgagcggcattctgaagtgcaaccgcagcatctcaatggcaataacttcttccatcccctcgatggtgctggtgaacccacccttttagataggggattcttcagaggcactgactagctcatgcatgaccaccttcctgcccccgtggttgccatgaaatcgaactactgctcaatttcgaattaataagcatgggcgcatgcagctggctgtgctata

SEQ ID NO: 6330 - DNA, 207 bp, Zea mays
  Clone ID: LIB3279-001-P1-K1-H7
ttacctccctaataacaaactattcattatcgattttggctatcttccacttgtgtaagtgttacaaatgtgtattcgctcttacctaacctactatatatttttatttttctcccacctctatcttttctttctatcttctctttatttcctctcttactcttttttaaaattatatttttacaatttatttctttttccttatct

SEQ ID NO: 6331 - DNA, 186 bp, Zea mays
  Clone ID: LIB3279-001-P1-K1-H9
tcttccacccactcgttcgctcgtgcaaggctttcctaactgcgcacggcatcatacaccggccgtgcggccacatcggctacggccccctcttcgcactctccctctccacatcctgagcgctccgttaggtcgccccacccctactccatacgatcccatgaattaaccactttcacattaccc

SEQ ID NO: 6332 - DNA, 391 bp, Zea mays
  Clone ID: LIB3279-019-P1-K1-A1
cgctatctttcaaacacaaacagctctggccgaataatctttctttaagtacctcttttgtgtgaggatgtatatcgccatgaattactcgattccctctctataaacccatcaaagtaaaccaatttctcctgtcactcgtacctaactcgatctcaccagactgtcgatggcctctttgaaccctatcgatcttctaggaaatgatgctagagagccaagccaggtcgctgtgtcttaacctcacaaagtcgggaaagctcctgctgatgttcaagctgctaaggccgctaagtgacgaaccaagcgtgctactactcctcaagcataaagcagtctaggaatgctcctcaaagaggacgaattggtactggtggactccatgcatttt

SEQ ID NO: 6333 - DNA, 451 bp, Zea mays
  Clone ID: LIB3279-019-P1-K1-A10
aaaaaaaagaaggtcattttcattttctccatttgatttttgccgaccggagaaaatatgggcttgccgtcttcttcttcatttcaccaggaacttttatttgaaatcggtttgatttagccatggcaaacgcggcatcgggaatggctgtgcatgatgattgcaagctgaaatttatggaactgaaggcgaaaagaacattccgtaccatagtctacaagattgaggataagcaagtgattgtagagaaactcggtgaacctgaacaatcatatgatgactttgcagctagtcttccagctgatgattgccgatattgcatttacgatttcgactttgtcactgcggagaactgccagaagagcaagatcttcttcattgcatggtaaaagcaagatattgtcactcatgtcttttgatctgtttagattatggtcatcaatgtgtgttt

SEQ ID NO: 6334 - DNA, 438 bp, Zea mays
  Clone ID: LIB3279-019-P1-K1-A11
atcagatccaacaaatcttcttcttcttcttcttcttcgatcatcatggccagtatcaagggtcacggagttcccatgtccaccgccacaatgcgcgtcctcgctactctttacgagaaagatctccagttcgagctcatccccgtcgatatgagagccggtgcccacaagcaagaggcccaccttgccctcaaccccttcggtcaaattcctgctctcgaggacggtgatttgacgcttttcgagtcaagagccatcacacagtacctagcagaggaatacagtgagaaaggtgaaaagcttatctcccaagactgcaagaaagtcaaggcaaccactaacgtatggcttcaagttgaaggtcaacagtttgaccctaacgcctctaagcttgccttcgagcgtgtctttaaaggcatgttcggcatgaccactgac

SEQ ID NO: 6335 - DNA, 463 bp, Zea mays
  Clone ID: LIB3279-019-P1-K1-A12
cggacgcgtgggcttccataagagtcttagttctaactataaatacacatatctcactctgtctgatctccgcttctcttcgccaacaaatgtcgaccgctcctctctccggcttctttctcacttcactttctccttctcaatcttctctccagaaactctctcttcgtacttcttccaccgtcgcttgcctcccacccgcctcttcttcttcctcatcttcctcctcctcgtcttcccgttccgttccaacgcttatccgtaacgagccagtttttgccgctcctgctcctatcattgccccttattggagtgaagagatgggaaccgaagcatacgacgaggctattgaagctctcaagaagcttctcatcgagaaggaagagctaaagacggttgcagcggcaaaggtggagcagatcacagcggctcttcagacaggtacttcatccgacaagaaagc

SEQ ID NO: 6336 - DNA, 485 bp, Zea mays
  Clone ID: LIB3279-019-P1-K1-A2
cacccgtcacgaagaaaaggaggtagcagcagcgactgcgacgagcttcacaacgcttcgagctcggcgtgagcgattatcccgtcttctacacgtaatctgagatctaaaccgagattttcttcatcttcatctctcagagcttctctttcgaatggctttctttcgccgtataccggaggaagcatctctagtgacttatgcggcgctaagcttcgtgcggaatcgcttaatccgttaaatttttccagttccaagcctaaacgcggagttgtcactatggttatacctttctcaaagggaagtgcacacgaacaacctcctcctgatttggcatcatatttgttcaagaaccgaattgtatatttgggaatgtctctcgtaccttcagttactgagttgatacttgcggagtttctttaccttcagtatgaagacgaggaaaagcctatttacctttacataaactcgactgggacaaccaa

SEQ ID NO: 6337 - DNA, 485 bp, Zea mays
  Clone ID: LIB3279-019-P1-K1-A3
acgcttcgtctctctgtcttttttcttctctcaacgccgttgattcgccatcgtcgctaccgagggtcgggaggtttacgacttttggactaatctcctctgtggagagcaatgactaaaactcgtgggactgatatgacaaagaaaaagggtaaacatgtttctgaaatggatttcaagactcatcagcatactgaatttttcgataagttgatagagctcacgcctgctagattctacttacctgatgagacagaaaggaaatggtatccaggtcttagcaaggctcaaaaagctagagccaagaaaaaaacaaatgacaacctaaagaaggcgaagagagataagttggacccagagaagtctgctttgacgactctcgatttactgaaggagaagatagagaaggaaagattggcttcacagaagcagaagcttaagaagaaacacgcggatttacgggagcagaagctagagcaggaaaa

SEQ ID NO: 6338 - DNA, 448 bp, Zea mays
  unsure (1)..(448): unsure at all n locations; Clone ID: LIB3279-019-P1-K1-A4
cggacgcgtgggttctcaagctccgtatttttttctcaatagttgatatagatccgttatggcatggattgagattgatagatttggtggagaatgacgacgataggaggattgttaatggggattggaagatcattcagaagaaagagatcttcttctcttgacattctctctcccaaaagagctccaagagacttttacaagggcaaaaactgcaaacctactggtttccacacgagaaaaggaggatatgttgtgcagccagataagttgccgaattacgtagtccctgatctcaccggctttaagctgaaaccatatgtatctcaatgcccgatacaagtcaacacanacgagtcaactgaagcttccaagtgaaaaatagtcagtcagaagatatatatgtttttaagtcttcttcataaagctntaagttatgagtatgttc

SEQ ID NO: 6339 - DNA, 479 bp, Zea mays
  Clone ID: LIB3279-019-P1-K1-A5
cgaagcaaaaaacctcgctcgctagctatgtgaagaaactatcttcgttataaaactttccggcggcgttttccgacttccgagagcaggttttgaggtggttttatgcgccaaaacatctaaccggagtgtcgttgtacggtgcttagtagttttcaataacacgcttcagttatggggaatgcttgttgtgttgctactcgagacaaaatggttgtgcctaatacatcagcagtcgagaattttcaaagaaacaatgtgaggtattctcctaactggagcttccgatgggataatagaggaggacgcgtggcaagggaagagacctctgttagtttgttatctgatcggattagtcgtaacgatgtctctgatgtcaaatctgaaactgctcttgtatcatcacaaggttctcctttggacaattttcagacgcagtcatggcagaaatctcctgcttctgatcaatcattttcaag

SEQ ID NO: 6340 - DNA, 458 bp, Zea mays
  Clone ID: LIB3279-019-P1-K1-A6
acagaatcaactagttttgtttttcctctttcaaaaatgcatttctcttcgtcttcaacatcgtggccttggacaatcttaatcacattgggatgtcttatgcttcatgcatctttgtccgctgctcaactcacccctaccttctacgataggtcatgtcctaatgtcactaacatcgtacgagaaaccattgtaaatgagttaaggtcggaccctcgtatcgctgcgagcatccttcgtcttcacttccacgactgctttgttaatggttgtgacgcatccatcttgttagacaacacgacatcatttcgaacagagaaagatgcgtttggaaacgcaaattcggctcggggatttccagtgattgatagaatgaaagctgcggtggagagggcatgcccaagaaccgtttcatgcgcagatatgctcaccattgcagctcaacaatctgtcacttt

SEQ ID NO: 6341 - DNA, 420 bp, Zea mays
  Clone ID: LIB3279-019-P1-K1-A7
caaaagagagagagtgtatccatttttggaggggaaaacaaagtatgcagcagccctgtgtgatagtgggttcgaagtactgctcaccaaaccctgtaggtttggcgatcgtccgtaaggtgatgaagataacggacggtaacttcgtgataacgagtgcggacggtaagttattgttcaaggtgaaggatcctttgtttagtcttcacggcaagaggatcttgctggattgttctggagctaaggtcttaactttgagagggaagatgatgaccatgcatgacaggtggcaagtgtttagaggagggagtacggaggagggtgctctactatacacggtgaaaagatcgtcgatgattcagctagcccctaaacttgaggtgtttttggctaacaacgtacaggagaagatatgtgatt

SEQ ID NO: 6342 - DNA, 414 bp, Zea mays
  Clone ID: LIB3279-019-P1-K1-A8
cacaagactccattattctcctgcttcttcgtctcttcaattattttctctgaggcgtgggtgggattcaaccatggctaatgcaacatcaggaatggcagtccatgatgactgcaagctgaaatttatggaattgaagacgaaaaggacacaccgtttcatcatttacaagattgaggagctgcagaaacaagtgattgatgagaaaatcggtgaaccgggtcaaacccatgaggaccttgctgcaagtcttccagctgatgaatgccgctatgccattttcgattttgattttgtcagatctgagggtgtcccaaggagcaggatttttttcgtggcatggtctccggacacagcaagagtgagaagcaagatgatctatgcgagctccaaggacaggttcaagagagaact

SEQ ID NO: 6343 - DNA, 385 bp, Zea mays
  Clone ID: LIB3279-019-P1-K1-A9
cggacgcgtgggtttctcgagaaaaatgtcttgctgtggaggaaactgcggatgtggatctggctgcaagtgcggcaacggttgtggaggttgcaaaatgtaccctgacttgggattctccggcgagacaaccacaactgagacttttgtcttgggcgttgcaccggcgatgaagaatcagtacgaggcttcaggggagagtaacaacgctgagaacgatgcttgcaagtgtggatctgactgcaagtgtgatccttgcacctgcaagtgaagaagcctttttaaataagcagagataatcgagtctctttaattaattaagttattcaataagtaaaccatatataggatggtgttttagggttggtttatgtgtaataatggc

SEQ ID NO: 6344 - DNA, 446 bp, Zea mays
  Clone ID: LIB3279-019-P1-K1-B1
gcaacaaccaaacactcatttctccacatcttgagagaaaaaaacagagcaagtatattagagatctcatggcgatggcggtctccggagctgtcctcagtgggcttggttcttcgttcctcaccggaggcaagagaggtgccaccgcattggcaagtggcgtatgcactggagctcacagagttggcaggaaaactcttattgtcgctgctgcggctgctcagcctaagaaatcttggatccctgccgctaaaggtggtggcaacttccttgaccctgaatggctcgatggctcgctaccaggagatttccggttcgacccattgggtttggggaaagacccggcttttctgaaatggtacagagaggctgagctgatccatggccgatgggcgatggcagcggttcttgtgatcttcctcggccaggcctggagcggtgtggca

SEQ ID NO: 6345 - DNA, 476 bp, Zea mays
  Clone ID: LIB3279-019-P1-K1-B10
cggacgcgtgggacaacaatggcgagaggctcttcccaatcccaacaatcaacctccaccggttcttcaaccgcccggcccggtctggccgctcctcgtggttccgccgccgctactgccggcatgcgtcgccgcaggctcggtggcggtggtggcgtatcctcaggcggcggatctggagttggatcaggatcgagcaacatgctgagattctacacagatgatgctccggggttgaagatctcaccgacggttgttctgatcatgagtctctgtttcatcggcttcgtcactgctcttcacgtctttggaaaactctacctccacaaatccggatcccaagcttagatccggatcaggacctggatcgtttaatcggtgatcgctgttttttttttttttttttagtatgtttccttgtgttttggttcccttttttagtcttttcgatgagaaccatgtaaatcgctaagcgt

SEQ ID NO: 6346 - DNA, 479 bp, Zea mays
  unsure (1)..(479): unsure at all n locations; Clone ID: LIB3279-019-P1-K1-B12
ggtttttggagtggctgcgtctagatcgctggtttacacgcctttgttaaccggttcgagtggcaactacgtaattaacgtgaaatcgattagagtcaacggggaaaagctctccgtggaaggtccgttggcggtggagctgagcacggtggttccttacacgattttagagagctcgatctacaaggtgttcgcggaagcttacgccaaagctgcgggtgaagctacatcggtgcctcctgtcgcaccgtttgggctctgcttcactagtgacgtagattttccggcggtagatctagcgttgcagagtgagatggtgcggtggaggattcatgggaagaatctgatggtggatgttggtgngggagtccgatgctcggggattgttgacggcgggtcaagtcgagtcaacccgattgtaatgggtgggctacaattagaaggctttatattggactttgatttgggtaactcaatgg

SEQ ID NO: 6347 - DNA, 461 bp, Zea mays
  Clone ID: LIB3279-019-P1-K1-B2
ctttcaatctctcttgattccaatccattcttcttcaagtgccgggttctcgggtcggaggttctaagtctagctagggataatggctactgtcactactcatgcctcggcctcgattttccgaccttgtacttcaaagccaagattcctcaccggttcttccggtaggttgaaccgcgacttgtcgtttacatcgatcggttcatcggccaaaacgtcgtcgttcaaggttgaagctaagaaaggagaatggttgcccggtttggcatcgcctgattatctcaccggcagtcttgccggtgacaatgggtttgacccgttgggtctagcagaggatccagagaacttgaaatggttcgtccaggcagagctggtcaacggacgatgggctatgctcggtgtcgctgggatgcttttgccggaagttttcaccaagatcggaatcataaatgttcctgagt

SEQ ID NO: 6348 - DNA, 416 bp, Zea mays
  Clone ID: LIB3279-019-P1-K1-B3
cttacactttatctaaactccaacccattcttttgtaattacaccaatctcgtttacaaggttgggagtctataatgtaatagtggcttctatcaccactcatctctcttccactattctcctacctagaacttaaaagacaatatccctcacaacctctttcacggtgactaatcctctcgtaaatattaaatctctcatttcatcgaccaaaacatctccccataagaaaggagctaataacaccaaaaaccggcccgattcttcatcgcaacaacatctcatcaaaatctaccttgaccacaattcttaacaccctcctattattgcatagcaaccagcgacttaattacattctgaccaaaatgttgtgattaacaaacaacataccatcctctctataatcgatagactat

SEQ ID NO: 6349 - DNA, 450 bp, Zea mays
  unsure (1)..(450): unsure at all n locations; Clone ID: LIB3279-019-P1-K1-B4
ctgacacttgggcctatcttcagcttattgtgttgtgacgcatactcgccgcantcttgaggtgggggcgtcgcaggtgctaccgtctgctccatcaacagagctccgttgagcttgaacgggtcatgatcaggagctgtatcaatcccaggttgaatcttcttgggaaagaaagttgcaactgtgtcgagattcgcacagagcaacaagaagagcaacggatcattcaaggtgttggttgtaaaagaagacaaacaaaccgatggagacagattgataggtcttgcctacgacacttctgatgatcaacaagacatcaccagaggcaagggtatggatgactctgtcttacaagctcctatgggaaccggaacttaccacgctgtgcttagctcatacgaatacgttagccaatgtcttaggcaatacaacttggacaacatgatggat

SEQ ID NO: 6350 - DNA, 477 bp, Zea mays
  unsure (1)..(477): unsure at all n locations; Clone ID: LIB3279-019-P1-K1-B5
cttcgtgaaaaccctaacggggaagaccataacccttgaggttgaatcatccgacaccatcgacaatgtgaaggcgaagatccaagacaaggaaggaatcccaccggaccagcagcgattgattttcgccgggaaacagcttgaagacggccgtaccctcgccgactacaacatccagaaggaatcgacgcttcatctcgtcctccgtctccgtggtggtgctaagaagaggaagaagaagacttacaccaagccgaagaagatcaagcacaagcataagaaggttaagctcgctgttcttcagttttacaaaatcgatggatctggaaaggttcagcgtttgaggaaggagtgccctaacgcaacctgtggagctgggactttcatggcgagtcattttgatcgccattactgtgngtagtgtggactcacctacgtttaccagaaagaaggagttgaagcctgatctgttgtagc

SEQ ID NO: 6351 - DNA, 472 bp, Zea mays
  Clone ID: LIB3279-019-P1-K1-B6
gaagaagagaaacaacaagaagtagtaatggcttcctctatgctctcctccgccgctgtgggtacatccccggctcaggccaccatggtcgctccattcaccggcttgaagtcatccgctgcattcccggtcacccgcaagaccaacaaggacatcacttccatcgcaagcaacgggggaagagttagctgcatgaaggtgtggccaccaattggaaagaagaagtttgagactctatcttacctccctgaccttagtgacgtcgaattggctaaggaagttgactaccttctccgcaacaagtggattccttgtgttgaattcgagttagagcacggatttgtgtaccgtgagcacggaaacactcccggatactacgatggacggtactggacaatgtggaagcttccattgttcggatgcaccgactccgctcaagtgttgaaggaagttgaagaatgcaagaaggagt

SEQ ID NO: 6352 - DNA, 367 bp, Zea mays
  Clone ID: LIB3279-019-P1-K1-B7
cacttttatatatgtaaacaatactagatcgaaaaaaacctctctcgcatcagaggggagttatatatctagggatattacccactatccttaataatctctaatcctctatcttcacatgatgcactataactccaccttatttaccgctatcattggcattttacaccacaacgttagaaatacatctttcattgaatctgctccaactgcaaagcctaaaaaatcatctatctctggccaaaactaaccctgtcactgtctatcccatgattgcatcagaagacttttcccacaaaattactgtaacgaacaattatttttatggaaacaccctgattttatccaatggcacaccttcgctgat

SEQ ID NO: 6353 - DNA, 392 bp, Zea mays
  Clone ID: LIB3279-019-P1-K1-B8
atcacaaaacccaattagccggagatggccgcaacatccgccgctgctgcagctgcttcttgcatcatgggtactcgggtggctcccggtatccatcccggttcaggtcggttcacagccgtgttcggtttcggaaagaagaaggcagctcccaaaaagagtgccaaaaagacggtgactacggaccggcctctttggtacccaggcgccatttctcctgactggcttgatggttccttggttggagattacggttttgatcccttcggtttaggcaaaccggccgagtatcttcaattcgatatcgattcactagaccagaatctggctaagaacttggccggagacctgatcggaacccgtacggaagctgccgacgccaaatcgacgcc

SEQ ID NO: 6354 - DNA, 386 bp, Zea mays
  Clone ID: LIB3279-019-P1-K1-B9
actctctcctcttcacaaatctcacatcctcactcctcagctcctcaaatcagaatgaatgaatccgcgcaaaattacttttccgtgcaaaaaccttcagagacttcatcagggccgtacacaagtccgccaccaattggttatccgactagagatgcggtggtgggtgatcctccggcagcagcagtggagacaaactccaagggcgtcaaccccgaagccataatgagttgttttagtacttgtatggagtgtatcttctgctgcggcgtatgctccagcctctgtacatcagagtaaatcagcatgatgagacagaagtcgttgcccaaacctgaaaaacaacacgtgatagaaaatctatatatatatatatatatatatat

SEQ ID NO: 6355 - DNA, 341 bp, Zea mays
  Clone ID: LIB3279-019-P1-K1-C1
aatctgcaatatataataagatttaaaaatatttctgtcaaccgcgtgaataggacaatggcaggcatctacaaaaccgcgcagatctgtgattgggagcagcttcttcacacgctcaagctcaccgaacgctgctatcaatgctttactagttgatctgtaaaactttaagatcactcatggtgtagatatcacaccctacccgtacgattctcgtctgcaccatgtgcttcctcgtgtatacaatctacagacaggatgctgtccgttctaacagtgccagacatgaatctgcaggatctggaaaagagcttgttcgatggggaaaggtaggtactgaa

SEQ ID NO: 6356 - DNA, 423 bp, Zea mays
  Clone ID: LIB3279-019-P1-K1-C10
atctacttagagaatttgtgcgcttgggagtccctgattattaaataaaccaaggatttgaccatgactgcaattttagagagacgcgaaagcgaaagcctatggggtcgcttctgtaactggataactagcactgaaaaccgtctttacattggatggtttggtgttttgatgatccctaccttattgaccgcaacttctgtttttattatcgcattcattgctgctcctccagtagatattgatggtattcgtgaacctgtttctggatctcttctttacggaaacaatattatttccggtgccattattcctacttctgcagctattggattgcatttttacccaatctgggaagctgcatccgttgatgaatggctatacaacggcggtccttatgaactaattgttctacacttttta

SEQ ID NO: 6357 - DNA, 501 bp, Zea mays
  Clone ID: LIB3279-019-P1-K1-C11
ctgtccgcaacacatggacgaaattaaaatcgtctccaacatgtggctctctcagctgttactactctatggttccgtgcgcaaactttatcagctgatcgttgaagctttcctctcatcacagatctcaaccataccgtactcggacctggttatcacttttcaactctctcaaaaatgtggatgaacgagtcctaatggaccaatgatatacaaaggaatataccatcttttttaccaatataacccatacggtgccgtttgggatgtgagaatcgtgtggggacactccacgtcagttgacttagtcaactggatttcacaacctccagctgttaatccatctcagccgtcagatatcaacggttgttggtcaggctccgtcacgattctaccaaacggcaaacctgtgatcctctacaccggcattgaccaaaacaaaggtcaagtccaaaacgtcgccgctccggttaacatctctgatccttatctccgagaatg

SEQ ID NO: 6358 - DNA, 379 bp, Zea mays
  Clone ID: LIB3279-019-P1-K1-C12
agctactccggtagtaaggaccggtggtgaaaatccacaacaacggcagtttatggtgatggaaggcatttgggtaccttcacacgatacaactaataatagagtttacgctcctgtggcgacacaaccgccgcaatcttcaacgtcgggagagagaagcaatcggggttgcaaatctcccgcaacatcttctactactacacacacaccacaccttcttcctctttcataaatatatagttaccgatttgtatgaaaatcttgtttcttctttatatatttgttttgtaaccaagaatgttcgttctaggtttaagagttttgaataaattgtaacaatagatatacattgcacacaattgaataaaagaaaaagttt

SEQ ID NO: 6359 - DNA, 484 bp, Zea mays
  Clone ID: LIB3279-019-P1-K1-C2
tggagaaaccgggtcatgaaacggatattgcgggttcaagacgaacccatctgaagaaatgattgagaatccactcttcgacatcttctcactgcttgctccaaacaggattttgttgatattttctcgaaattcagtggggctgagcaagaactgctttttcagttgtatactcgggttgttgtgaatttgcatcagacaatagaggaagagtttgatgaacaatgtcacgaaactcaggtcggaccaattcttgatacagtcgaggagctggtcgaagaacagagtttggatcccttgttttctgataagactgatgtaatggcaatagcatatgatcttacaacatctaagaagaacgagatacaaaagttaacagttttgctccaaagggctgaagaacagaatcgccagaaggaagcccggatcagcatgctcaaaaaacaaacacaagatctctcaggcacagcggacagaatcgaaa

SEQ ID NO: 6360 - DNA, 462 bp, Zea mays
  Clone ID: LIB3279-019-P1-K1-C3
aaacaacaagaagaagtaatggcttcctctatgttctcctccaccgctgtggttacctccgcggctcaagccaccatggtcgctccattcaccggcttgaagtcatccgcttctttcccggtcacccgcaaggccaacaacgacattacttccatcacaagcaacggaggaagagttagctgcatgaaggtgtggccaccaatcggaaagaagaagtttgagactctatcttacctccctgaccttagtgacgttgaattggctaaggaagttgactaccttctccgcaacaagtggattccttgtgttgaattcgagttggagcacggatttgtgtaccgtgagcacggaaacactcccggatactatgatggacgatactggacaatgtggaagcttccattgttcggatgcaccgactccgctcaagtgttgaaggaagttgaagaatgcaagaaggag

SEQ ID NO: 6361 - DNA, 442 bp, Zea mays
  Clone ID: LIB3279-019-P1-K1-C4
gagattacggaagcttcgcttgatttgggatttttagggttttctttctgcggagacgactccgagagaccaacagtgatttgacaatgacgctacctccaggtctttactccggcaccagctctcttgctctggtggctcgtgcttcggcttttgggttgggtctcgtctatgggaacatgaagctcaaggtccttaagatcaaatcgatgtcacagaagaaggttgaagccaccgctcatcattaaaccactcttctttctttacaataagatgccaaaagctgggggtgatgtctccccggttagtttgatttcttctttcatgattcatcctttagcataagaaggaacaaatgtgtttttgaaaagcatattatacggttttaagacctttttggagccataattgccattggcttaaaacccgagtcaagaacatc

SEQ ID NO: 6362 - DNA, 456 bp, Zea mays
  Clone ID: LIB3279-019-P1-K1-C5
ctcataaattgtccgaaagccctaaaaatctgagtctcgcattaagtccaaacactttcatgtggctcctttcgtcaactccacagagatctcctcatggctccaattgctgtcggcgatgttgtaccagacggaactatctccttcttcgatgagaatgatcaacttcagaccgcctccgttcactctctcgccgccggtaaaaaagtcattctctttggtgttcctggtgctttcactcccacttgcagcatgaagcatgttcctgggttcattgagaaagcagaggagctgaagtcaaagggtgttgatgagatcatttgctttagcgtgaacgatccgtttgtgatgaaagcatggggaaaaacatacccagagaacaaacatgtgaagtttgtagctgatgggtctggagaatacacacaccttctcggacttgagcttgaccttaaagac

SEQ ID NO: 6363 - DNA, 483 bp, Zea mays
  Clone ID: LIB3279-019-P1-K1-C6
agagaaaaaaacagagcaagtatattagagatctcatggcgatggcggtctccggagctgtgctgagtgggcttggttcttcgttcctcaccggaggcaagagaggtgccaccgcattggcaagcggcgtaggcactggagctcagagagttggcaggaaaactcttattgtcgctgctgcggctgctcagcctaagaaatcttggatccctgccgttaaaggtggtggcaacttccttgaccctgaatggctcgatggctcgctaccaggagatttcgggttcgacccattgggtttggggaaagacccggcttttctgaaatggtacagagaggctgagctgatccatggccgatgggcgatggcagcggttcttgggatcttcgtcggccaggcctggagcggtgtggcatggtttgaagctggagcccagccagacgcgatcgctcctttctcgttcgggtcgcttcttggaacccaat

SEQ ID NO: 6364 - DNA, 460 bp, Zea mays
  Clone ID: LIB3279-019-P1-K1-C7
attttctcaaactctaaaatcaatctctcaaatctctcaaccgtgatcaagatgcagatctgcgttaagactctcaccggaaagactatcaccctcgaggtggaaagctctgacaccatcgacaacgttaaggccaagatccaggataaggaaggtattcctccggatcagcagaggcttatcttcgccggaaagcagttggaggatggccgcacgttggcggattacaatatccagaaggaatccaccctccacttggttctcaggctccgtggtggtatgcagattttcgttaaaaccctaacgggaaagacgattactcttgaggtggagagctctgacaccattgacaacgtcaaggccaagatccaagataaggggggtattcctccggaccagcagaggttgatcttcgccggaaagcaacttgaggacggcagaactttggcggattacaaca

SEQ ID NO: 6365 - DNA, 439 bp, Zea mays
  Clone ID: LIB3279-019-P1-K1-C8
atcgatctaatcttttcagctctctccatcgtcgtcgtatctgtgactctcgtgatcatcgcctgaaaaaaatttgagataatggccagaaagttcttcgtcggaggcaactggaaatgtaacggaactgctgaggaggtgaagaagattgtgaacactcttaatgaagctcaggttccttcacaggatgttgtagaggttgtggttagccctccatatgtttttcttcccctggttaagagcacattgaggtctgacttttttgttgcggcacaaaactgttgggttaagaaaggaggtgctttcactggtgaagtgagtgcggagatgcttgtgaacttggatattccatgggttatccttggtcactctgaaaggagggcaatccttaatgaatcaagcgagttcgtcggagacaaggttgcctatgcacttgctc

SEQ ID NO: 6366 - DNA, 469 bp, Zea mays
  Clone ID: LIB3279-019-P1-K1-C9
cggacgcgtgggtaaatcattcatctcatttcttcaactggctttgcttctttctttcttgttcctcaattataattttttcacaggtttgagatcttatcatagagttttgttttaagtttgtgagatggaattagtgtctggaaaagtagttccaggttgctccaacgcaggcaatcctttccatgagtgtactgctatctgttttgagagagtaaactctccagatgtccacaagaaggagaagaaactctttgggtttggtaagagaactcccagcagggatcagactcctccagctagtccggctcgtggaagcagatcacctctggccagctatttcgccaagaagaaggttgagtcgtcagcagagagttcaccatcctcttatgatcacaccaatggcaacttcttaagtcgcctttccccgctacagggacgcaagatcgagccttcaagcaatgtcgat

SEQ ID NO: 6367 - DNA, 477 bp, Zea mays
  Clone ID: LIB3279-019-P1-K1-D1
aaaaaaatctttatttctcttctccaaaagagttattataaaaagaaaaaaagaaagatgagaacgtttatatatattcccctcaaatctctctctgtctcaaactgtttgtctacagacgacaagtagattccttttgctttgctttctcagcatgcaataattgtcatattatttctccattaagattcttgtttctttatttcccgagattattttcttgatttcctcctctgcttgctcttcccggagcttgttttttcaaagaatcaagatttgagatttgatggaatcaagaatggaaggagatgtgtattctggatttggagagagataccaaatggatggtaagttgttgcataatttccagaagagctttgttcaagttcaagacattcttgatcagaaccggcttttgatcaacgagatcaatcagaaccatgagtcgaaacaagctgatcacttgggaagaaatgt

SEQ ID NO: 6368 - DNA, 224 bp, Zea mays
  Clone ID: LIB3279-019-P1-K1-D10
aaattggatactaagaaaagcaacaactatgaacgacatttaggggatcaaaaaagtgtcagaggaagaaacatactctagtgaatgtcgataatatttaccacaacatagacctatgattaccgttggccaagccatccaaatatatggaagccgcaccaaactttgactcgagttcgggcgtcataaaaccatgctcatgggtgctgcgtgtacaagcagag

SEQ ID NO: 6369 - DNA, 464 bp, Zea mays
  Clone ID: LIB3279-019-P1-K1-D11
ttctttctctagctctcttggttttttgctaaaaacagagcattttctctctagctctcagtgtttctttaccataagtttcgtcatattagtacatgcaagtgtaagggatggtgatggaggaaggaagaagcatagaagaagggcttttgcagctcaagaacaaaaacgacgattcagagtgtcgtattactgcttgtgttatccttagcacttttgtcgccgtttgtggctccttctcttttggtgttgctactggttacacttcaggtgctgagacaggagttatgaaggacttggatctttctatcgcgcaattttcagcttttggctcattcgccactttaggagctgcaattggtgcactgttctgcggtaatctggcaatggtcattggcagaagaaggacaatgtgggtctccgatttcctatgcatcactggttggctctccatcgcttttgct

SEQ ID NO: 6370 - DNA, 415 bp, Zea mays
  Clone ID: LIB3279-019-P1-K1-D12
ggctgaaaaaaacaatggcgatgatgcttctgcaaattcctccttcgtcttccttgttgagcaccagaaaccttcaaatccgattcttccactcttcagtttcagcttcctcgaagaaattcagatgcagagccgtccgtgagaaggcggaggacattgataagaacatttcgccgccgtcttcttctcctcctcctccttccgccgaagaagttaccaagaaatatggccttgaagttggtctatggaagatattaagctctaaggatgatgaaggaagtgatggagacaataagaagaagaaatcaaaaacagatgaggctaaagagttacttgcaaagtatggtggtgcttatctcgctacatctattactctttctctcatttccttctcactctgctatgtccttgtgac

SEQ ID NO: 6371 - DNA, 181 bp, Zea mays
  Clone ID: LIB3279-019-P1-K1-D3
aaaatataaaacattttacttcttcctgcacttctcaaccaaaagagccaactcaacaggggctgtttctttccttgccttttacaaaactctcataaaacttcccctcgcttactatgaacttctcgaacgcggacctttaccaattaggaatactcttaccaacccaatttccccctca

SEQ ID NO: 6372 - DNA, 476 bp, Zea mays
  Clone ID: LIB3279-019-P1-K1-D4
aggatgtccaaaaccaatatgaaattttgcaatagttattttctggtcgatccgaccaaagcaaggtttcttgatctccttttgcttttgttttcctccaacctgaccagtgcaagattcatcgattctcctccggatacgcttaaaggcttccggagaagtttcgcgagtcgatggatccttgcgttggccatcttccttcaaaaagtattaatgctcttaagtaaaccttttgcattcattggtcaaaagctcacatattggctcaaccttcttacggcaaatggaggcttcttcaacttgatacttaaccttatgtcaggaaagctggtcaagcctgacaaatcttcggcgacgtatacttcttttataggatgctcagatcgacgaatagagcttgacgagaagataaatgttggtagcatcgaatacaaatcgatgttgtcaataatggcttctaagatctcttatgagag

SEQ ID NO: 6373 - DNA, 478 bp, Zea mays
  unsure (1)..(478): unsure at all n locations; Clone ID: LIB3279-019-P1-K1-D5
agaaagatcaatctagagagaccaaaaagagatcggaagagatggcttctacctccgcgatgtcgttggtcacaccacttaaccagacccgttcgtctcctttccttaagccattacctctgaaaccatccaaggctttggttgcaactggaggcagagcacagaggcttcaagttaaggccctcaagatggacaaggctttgaccggtatctccgcggctgctcttactgcttcgatggtgattccggagatagctgaagctgctggttctggaatctctccttccctcaagaatttcttgctcagcattgcttctggtggcctcgtcctcactgtcatcattggtgtcgtcgtcggcgtctccaactttgaccctgtcaagagaacctaagacctatatatctttcttacatcattattngaatctggtctccttctgtggtattcgttcaatgttgcagcaatgaacttttggat

SEQ ID NO: 6374 - DNA, 478 bp, Zea mays
  Clone ID: LIB3279-019-P1-K1-D6
gcttccataagagtcttagttctaactataaatacacatatctcactctctctgatctccgcttctcttcgccaacaaatgtcgaccgctcctctctccggcttctttctcacttcactttctccttctcaatcttctctccagaaactctctcttcgtacttcttccaccgtcgcttgcctcccacccgcctcttcttcttcctcatcttcctcctcctcgtcttcccgttccgttccaacgcttatccgtaacgagccagtttttgccgctcctgctcctatcattgccccttattggagtgaagagatgggaaccgaagcatacgacgaggctattgaagctctcaagaagcttctcatcgagaaggaagagctaaagacggttgcagcggcaaaggtggagcagatcacagcggctcttcagacaggtacttcatccgacaagaaagctttcgaccccgtcgaaaccattaagc

SEQ ID NO: 6375 - DNA, 464 bp, Zea mays
  Clone ID: LIB3279-019-P1-K1-D7
ccctgctttccttcaccgccgttacgcaacaagcgtcaaactaacggccataagcgcggggttaaaaaccgtcgagcaaacgacgttaacagaggataacagattctcaaccgtcggatctgactctgatgaatacaatccaactcttccaaagccgaggatcctcgtcaccgagaaactgggagaagccggcgtgaatctcctcagggaattcggcgacgttgactgctcttacgatctttcgccggaagatctgaagaagaaagtggcggagagtgacgctctgatcgtgagaagcggaactaaagtgacgagggaagtgtttgaggcggcgaaggggaggttgaaagtggtcggaagagccggagttgggattgacaatgttgatctgcaggcggcgacggagcacgggtgtttggtggtaatgctccaacggctaatacggtggctgctgccgaacatgg

SEQ ID NO: 6376 - DNA, 479 bp, Zea mays
  Clone ID: LIB3279-019-P1-K1-D8
cccaaacacaaaaatactgctgaggaaaagcaatccacacgattcgattcaaagttttcaggttttctctaaaagtttggattttgatttcgttgctgaacggaaaaagaatcagctcctttcagtttagggttttgggtttctgtttggtctctatcagatgatgtgtgaggagattcttcctctgtttgtgtctgtttcagatggaagacaatgataagtctccccctaaggattactataagattctagaagttgattacgacgcaactgaggaattgatcagactcaattatcggaagcttgcattgaagtggcatcctgataagcacaaaggcgatagtgcagctacagaaaaatttcaagagattaatgaagcttataatgtgctgatggaccctgctaaacgttttgagtatgatttcactggtatatatgagatccacaaatacactttacgggaatatctcgccagattt

SEQ ID NO: 6377 - DNA, 439 bp, Zea mays
  Clone ID: LIB3279-019-P1-K1-D9
ctttagcaatggaagaagaagcagtctttcttttaatctccgccagcttcctacccgcttgactgtttcctgcgctgcaaaacctgagacagtggacaaggtgtgtgcagttgtcagaaagcaactctcacttaaagaggctgacgaaattactgctgccaccaaatttgctgcacttggtgctgattcccttgatacggtggagattgtgatgggactagaggaagagttcgggattgaaatggcggaggagaaagcacagtcaatcgccacagttgagcaagcagctgcgctcattgaggagctcttgtttgaaaaggccaagtagaatatctttattacattagcaaaaacgaaaaaaatcaaaacccaaaccactatcttattgtttcgttagctagagagcaattgtgtctgtgaaagaatttatgttattttg

SEQ ID NO: 6378 - DNA, 485 bp, Zea mays
  Clone ID: LIB3279-019-P1-K1-E1
gtgacagggaaagggaaaaagaatgggagcggttgagggagcgagatatgggaaggagtagggatggagagcgtgagaaggaaagagaacgggagaaggagagggagagggagagagaacgggaacaggaacaggaacacgagcgtgagaaagataaggatcgagagcgggatagggaaagggagagggagcgtgataagcagaaggaccgtgagagggacaagaaagattatgattccaagcatgagaggtatgaggatggcggtagcaggaagagtggctcaaagacgagtagggcggaagaggatgcctacttgtataggagagatacagatgtcaatgaaatttcagcaaaagggaagtacaataatcctgatatgcaagctgacaaacacagccgaagaaaagatgattctgaagatacagataagtggcccactgacaatagagacagctatgacagaaagaccctgtccagatatgaa

SEQ ID NO: 6379 - DNA, 429 bp, Zea mays
  Clone ID: LIB3279-019-P1-K1-E10
gatgaatctaaagaatcaagatctcctagagacgacgacggtcacggaactcacacctcatggaccgccgctggatccgtcgttgaaggagctagcttattaggctacgcttcaggaacagctcgtggtatggctccacgcgctcgtgtcgctgtttacaaagtctgttggctcggtggttgtttcagctcagatattttagctgcaatcgataaagccatcgccgataacgtcaatgtcctgtcgatgtcactcggcggtggaatgtcggattattatagagacggtgttgcgatcggagcattcgccgccatggaaagagggattttagtatcttgctcagctggtaatgctggtccgagtagttctagtttatcaaacgtagctccatggatcacaactggtggtgctggtactttagatcgtgat

SEQ ID NO: 6380 - DNA, 455 bp, Zea mays
  Clone ID: LIB3279-019-P1-K1-E11
gaagaatttgaggcgattgggtaagcgatgcacatcgtcttctctgtcgatgatttgaccgaatccttctggcctgttcccgctccggcgccgtcgccgggatcgtcatcgactccgtcaccgacgcagaacgtggcggatgggatgactcgaagtcaatcggagtgggcgttccacaggcttatcaatgagttgtctggttccgattcgagccctacgactaacacaatcgagagatcacctccaccggttcagtctctttcgagattagaagaaaccgttgacgaaaccgaagatgttgttgagattcagaaaccgcagaatcatcgacggctccctgttgatgatcaagggaagaatcggaatcgtgctccgtcgtctgatccggttgattcttcagctcctgttgttgtgatcctaatcagtatcatgcgattcttaagagcaagctcgag

SEQ ID NO: 6381 - DNA, 415 bp, Zea mays
  Clone ID: LIB3279-019-P1-K1-E12
gcgacgactgagacttctgggctgacgtcatacccgtcgacttaaatcgtttcatctcgggatttgtgtatcttttctatttttgtatattatcttgtttttttaattatgcgtaatcaatttttattggtgtgagtttggtttgagactttctctctctcttttgttttctgagttttgagctctgtctgaagtttgaacaattctaatttgttataatttttattactaaaaaaaacaaaaaaagaaaaaaaacaataaaaaaaaaagaaaaaaacaacaagacaaaaccaaaaatgaagatataaaaaaacaaaccaaaaaaaaatggggggcggcccttttaaaggatccaagtttacgtccccttgcatgcaacgtaatagtttttttttggggtccccaaaattaaatt

SEQ ID NO: 6382 - DNA, 463 bp, Zea mays
  Clone ID: LIB3279-019-P1-K1-E2
ggcgtttttgcaaacgaacatcagtctgaatgcgatcaagatcgtcccggggaaatacagtgctgtcaccgatcatcagtttcgtgcgccgtatcgaattaggtgcgccgccgcttcacctgggaaaaaacggtataacatcgctctgcttcccggagacggtatcggtccagaagttatctctggtgctaagaatgtgcttcagaaagctggatctctcgaaggactggagtttgatttcaaggagatgcctgtcggaggagcagccttggatttggttggagttccattgccggaggaaactttcacggctgcaaaactatctgatgccattcttcttggagctattggagggtacaaatgggacaagaatgagaaacatctgagacctgagatggctctgttttaccttagaagagatctcaaagtctttgctaatttgagacctgctacagttttgcca

SEQ ID NO: 6383 - DNA, 475 bp, Zea mays
  Clone ID: LIB3279-019-P1-K1-E3
gcgcaaaaaatcaaaaattcgccgagagcacaaaccctaatggcttctctctcaatggcttgcggtgacgttagcttctgtcatcctttccgctcttcttctccaaaggtctcacttcgcagttccgttcatttcgcgacgagtctttcctcaagtcactccatttctgggcttcgcgctgttttgcctctgaagatttctacagttgcttcccccaattctcaaaagcttcattcttttaccgttttcgctcataagggctacaagatgaagacccacaaggcctcagcgaagcggttcagagtgacgggtagagggaagattgtgaggaggagatctggaaagcagcatttgttagctaagaagaacaacaagaggaaattacgtctatcgaaaatgacggaagtgaaccggagcgactatgacaacgtgatcggagctctgccctactttgaagtcaatcgaaaggcgactt

SEQ ID NO: 6384 - DNA, 451 bp, Zea mays
  Clone ID: LIB3279-019-P1-K1-E4
cggacgcgtggtttagcggcagacgagagagctaaagcaaggagcaaccctaaccatggcgactgaaccagctactgaatctgtgcaatgcttcggaaggaagaagaccgcagtggccgtcactcactgcaagcgtggatctggtttgatcaagctcaacggttgcccaatcgagcttttccagcctgagatcctccgattcaagatcttcgagccggttcttctcctcggaaagcaccgtttcgctggtgtgaacatgaggatccgtgtcaacggtggtggtcacacatcccaggtttacgccatccgtcagagtatcgcgaaggctcttgttgcgtactaccagaagtatgtggatgagcagtcgaagaaggagattaaggatatcttggtgaggtatgataggactctgcttgtggcggatccgaggaggtgtgagccgaagaagttt

SEQ ID NO: 6385 - DNA, 471 bp, Zea mays
  Clone ID: LIB3279-019-P1-K1-E5
gttccttagtaagagggatagattctacagaaagactaaatatacattagtgattctggttctgtgttggtgtaggatgttcaggtaatcaggtacgaagtgcgactggagcagacagagataagtagttgacgtaaccttcagagaccgagatcacaaaccgatggcaagcaagcgcagtggtggtgagagaccactgatccttctctcatcctcagaaagaatggctcaaaccatgctgcttacttcaggcgtcaccgccggccattttttgaggaacaagagccctttggctcagcccaaagttcaccatctcttcctctctggaaactctccggttgcactaccatctaggagacaatcattcgttcctctcgctctcttcaaacccaaaaccaaagctgctcctaaaaaggttgagaagccgaagagcaaggttgaggatggcatctttggaacgtctggtgggat

SEQ ID NO: 6386 - DNA, 455 bp, Zea mays
  Clone ID: LIB3279-019-P1-K1-E6
ctgcgtgtattaaatacttgtctattaaatactatagtatcaacgattgttattttccttttataccctttttttagttgacgggttgaagcaaaaagggaacttttaatatttttttctattttctttgatatctatatgtacatgcccttatgtatctgtcaaaaaaggggaaaatttcttatttatatttaattcaatatttaaataaaattataggaaactgtaaatgagagtttctttctcacatacaccttcgatcacattacattgtcatctcggatgcatcaatatggaaatatttaattgatatctgaagccatgattatgattcgatttttgtttatttttaatacaaattgattcttaatacaaagagaatgtaggatcttgttatgttctcgaatcaaaaaaaatattgaaacgcccttttagttattactttgcaaaaatac

SEQ ID NO: 6387 - DNA, 478 bp, Zea mays
  Clone ID: LIB3279-019-P1-K1-E7
ggcaacagaaggaaaaaaccccatcaacatgaactctatgtcttcaagtcttgcaagaaccggtcaatgggttttttctcaagatattccgaccgatgttgttgttgaagtcggagaagccaatttctctcttcataagttcatgttagtggctaagagtaactacataaggaagctaataatggaatccaaagatagcgacgtgacaagaatcaatctctcggatatacccggaggtcctgagatatttgagaaagctgccaagttctgttacggtgttaacttcgagatcaccgttcagaacgtggcggctcttcattgcgcagccgagtttcttcagatgaccgataagtactgcgacaacaaccttgctggtcggacacaagacttcctttctcaagtagctctctctagcctctctggagctaatcgtgtcctcaagtcttgcgagattctccttcctatttctcgtgatctt

SEQ ID NO: 6388 - DNA, 401 bp, Zea mays
  Clone ID: LIB3279-019-P1-K1-E8
cggacgcactttttttttttttttaaggaaaaaactccgtcaacatgaacatctatgtcttcaagaatagcatgagcggggcaatgggttttttcttaagatattccgaccgatgttgttggtgaagtcagacaagccaattcttctcttaataagttcatgttagtggctaacagtaactacataaggaagctaatattggaatccaaagatagcgacgtgacaagaattaatttctcggatatacccggaggttctgagatatttgagaaagctgcctagttctgttacagtgttaacttcaagatcactcgttagaacgtggcggctttttattgcacagccttgtttttttagatgaccgatatgtactgcgacaacaacctttgttagtcggacac

SEQ ID NO: 6389 - DNA, 421 bp, Zea mays
  Clone ID: LIB3279-019-P1-K1-E9
cggacgcgtgggcaaaaaaagacacttcttaagcttcaacaagaaagaaatagtattcgcatagtattagaagatggattttttcaatcaagctaaagccgtaaggatgcgtaacgtccatgataagtatctaacagcggatgaggacgaggaaacggtgactcaagacaggaatggttccgacaagagagctagatggattgtcgagccggttcgtggttcctttgaagtgatccgtttaaggagctgctacggtaactacctcaccgcttcgaatgagcggttcttgctcggagccactggacgtaaagtggtcttgtctaaaccggctcgactcgactcctccgtagagtgggaaccggtgagagaaggttccaaaatgaagctcaagactagatacggaaacttgcttcgagccaac

SEQ ID NO: 6390 - DNA, 471 bp, Zea mays
  Clone ID: LIB3279-019-P1-K1-F1
cggacgcatggggcaaatgtttggagaaggcagccaagcttgatcccaactgtatggctacgtagatttgctgttgctgtccaacgaatcaaagatgcagaaaggtctcaggatgcaagcgaccagctttcatgggctggcaacgagatggcttcagtgataagagaaggagaatctgttccaattgaccctcccattgcttgggcagggcttgccatggctcacaaggctcagcatgaaattgcagctgcttttgttgctgaccgaaatgaattgacagagatggaagagcgggctgtgtacagcttaaagcaggcagtaacagaggatcctgaagatgctgtccggtggcatcagctcggtcttcatagtctctgctctcaacaatataaactctcccaaaaatacctaaaggcagcagttggtcgttctagagagtgtagttatgcatggtcaaatctcggtatttcg

SEQ ID NO: 6391 - DNA, 463 bp, Zea mays
  Clone ID: LIB3279-019-P1-K1-F10
cggacgcgtgggcaagtttggatcttcgtttcgatttggattagaagctggttctaaacctgagatccttcttgctatgagctgcttgtgtaaaggtagccctgatgcctttcttgtgtgcaatggattcaaagatgctgagtatatatcattggctctgcttgggagaaaactggcgttgaatactgtgattgtgcttgagcaagaagaagagcttgatctggttattgagctgagccagaagatgaatgtgaggcctgtcattgggttaagggctaagctgaggactaagcattcgggtcatttcggatcaacttctggtgaaaagggtaaatttggattgactactactcagattgttcgtgtggtgaggaagctgcgtcaatctggtatgcttgattgtctccagcttctgcattttcatattggttcacagattccgtcgacttcgttgctctctgat

SEQ ID NO: 6392 - DNA, 485 bp, Zea mays
  unsure (1)..(485): unsure at all n locations; Clone ID: LIB3279-019-P1-K1-F12
gagaagaatagtttgatcatcttgtgagaaaaataatggctgcttcagtgatgctatcttgggtgacattgaaaccagctggtttcacggtggagaagacggcggctagaggattaccgtcgctcacaagagctcgtccctccttcaaaattgtcgccagtggcgtcaagaagatcaagaccgacaagcccttcggaattaacggcagcatggacttgagggacggcgtcgacgcctccggcagaaagggcaagggatacggtgtttacaagtacgtcgacaagtatggagctaacgtcgatggatacagtcctatttacaacgagaacgagtggtcagcgagtggtgacgtgtacaagggaggagtcaccggattggcaatttgggcggtaactctcgccggaattcttgccggaggtgctcttcttgtgtacaacacangtgctttggctcagtaaatcttaaagttgttagcgcatgtgtaa

SEQ ID NO: 6393 - DNA, 477 bp, Zea mays
  Clone ID: LIB3279-019-P1-K1-F2
ctagccaatgctgctgcctttccgatggttctcaaagccgccctcgagctcggtgtctttgacactctctatgctgaagcctctcgcagcgactcgttcctttcaccatctgaaatagcgagtaagctaccaactacacctcgtaaccctgaggctccggttttgttggaccgtatgcttcgtctactcgctagctattctgtggtcaagtgtggtaaggtctcagaaggaaagggtgagagggtctacagagcagagccaatttgcaggtttttcttgaaggataacattcaagatattggatcccttgcttctcaagtcattgtcaatttcgatagcgtcttcctcaatacttgggcacaattgaaagacgtggttctagaaggaggagatgcatttggccgcgcacatggtggtatgaagctctttgactatatgggtacagatgagagattcagcaaactatttaaccagacc

SEQ ID NO: 6394 - DNA, 483 bp, Zea mays
  Clone ID: LIB3279-019-P1-K1-F3
cacagcgttccggcgatgattttctctctcggaggctactcgatgaacaatttccacgatgtcacgcgatatagtgattcctctgtacacgacggcgcgtcgattcaacggagaagtacagtttctcgtgacgaacaagagtccatcgtggatcaacaaatttaaggaattagtgaggaaactctctaattacgaagtgatttacatcgacgaagaagacgaaacgcattgtttcagcagcgtcaccgtcggtctcactcgccaccgtgagtatttcaaagagttgacgatcgatccttcgaattcggagtattcaatgtccgatttccggagttttctaagagacacctactcgttgagaaacgacgccgtggctacgagacagatccggcggcggaggccacggattctgattttggctagaggcagatcgcgagcgttcgtaaacaccggcgaaatcgcgagagcggcgagacagatcgg

SEQ ID NO: 6395 - DNA, 490 bp, Zea mays
  Clone ID: LIB3279-019-P1-K1-F4
atcacatattaccaaatctaatcgccgacatacattgaactcaaatccgctcagaatctccgacggtgagttccaatccatggctcaaaatcaacaacctattttccagaccaaacctccagaacaatttgcgcaaatacctatcaacatcgagcgtgattcttcaaccacacgcatgaaccaaaccggaaacacaatccggaaaccaaaccactggccaaccatcaccatctcaatcatcttcgtcatcatcggtcaatccatagcgaaactcctcgaaaacttctactacgacaaaaccaaccgaagcgaatacaacgaacaccgtcaaaacgatggcgtttggactcaatctcttctccaaactggtggttgtcctctacttattctgccgttcctcatcttcatcaccaagaacaaacgcaaccaccatcaacaacctccgatcacttgcgattcaatccacttaaaatccttagctgtgatctac

SEQ ID NO: 6396 - DNA, 419 bp, Zea mays
  Clone ID: LIB3279-019-P1-K1-F5
cgttgagatggtgacaaccgatggtgctgatttgggggtgggattggatttgggaaagaggaaggtgaaggagatgttgtttaaatccattgatggggaaagacttattggtatctctgggatgagtggttcagggaaaaccactcttgccaaagagcttgcccgggacgaggaggttcgaggccactttgggaacaaggttttgtttctgactgtgtcacaatctcccaatcttgaggagcttagagcccatatatggggatttcttactagttatgaggctggggttggtgctactcttccagaatcgaggaagctagtgatccttgatgatgtttggacaagggaatctctggaccagcttgtgttcgaaaatattcctggaaccacaacttttgtggtctcacggtctaaactcg

SEQ ID NO: 6397 - DNA, 269 bp, Zea mays
  Clone ID: LIB3279-019-P1-K1-F6
cggacccttggggttaacccagagtaaagcttgaaactttgaactaaaaaattggctttttggggggtgtcggaaatgcttggtcctccctttaacttcagggcagtttcaagatcgtttgttccgttggcatcaagcccatccacgttcaagactgttgtttttttttttaaaaaaaagccagctcctgctaagtccaaggttgtttttgagactagcgatgagctcgccaagtggtttggtcctgacaggaaaattttcttgcctga

SEQ ID NO: 6398 - DNA, 476 bp, Zea mays
  Clone ID: LIB3279-019-P1-K1-F8
gccaaccacgttttccagctcttgttctttcgattctcagagaagacttttcagaacatgcgtccaactttctcagataagcaacaatggtgaaaggtcccggtctctacaccgaaatcggcaaaaaggccagagatcttctgtacaaagaccacaacagtgaccagaaattcagtatcaccactttctctcctgccggtgttgccatcacctcaaccggaactaagaaaggtgacttattgttgggagatgtcgcttttcagtcgaggcgaaagaacattactactgatttgaaagtttgcactgattctacttttctgatcaccgctaccgttgatgaggctgcacccggactgaggtcaatcttcagcttcaaggttcctgaccaaaattctggcaaggttgagctgcaatacttgcatgagtacgccggtatcagcacaagcatgggattgactcagaacccaactgtcaac

SEQ ID NO: 6399 - DNA, 454 bp, Zea mays
  Clone ID: LIB3279-019-P1-K1-F9
gcagatgctcaccgtacggatttgatgaccattacaagattcgtgttgaatgaacaatcaaagtatccagaatctcgtggtgatttcaccattttgcttagtcacatcgttttgggttgcaaattcgtttgcagtgctgttaataaggctggtttggctaagttaattggacttgcaggggaaacaaacattcagggtgaagagcaaaagaaacttgatgtgctctctaatgatgtctttgtcaacgctttggttagcagtggtagaacttctgttcttgtctcggaggaagatgaggaagctacgtttgtggagccatccaagcgtggaaagtactgtgttgtttttgatccgcttgatggatcttcaaacattgactgtggtgtttccattggcacaatttttggaatttacacgttggaccacactgatgagccaaccactgcagatgttc

SEQ ID NO: 6400 - DNA, 118 bp, Zea mays
  Clone ID: LIB3279-019-P1-K1-G1
ctcccggcttccacacacgggacttcacccgctcgcctttacttaatcagccatcctgtaggtcggtgtctcctagcttcgtactgcacatccttcaccgtcaagcgtctaacatcga

SEQ ID NO: 6401 - DNA, 482 bp, Zea mays
  Clone ID: LIB3279-019-P1-K1-G10
caagacaaccacaaaactctcactccaaaactctcaattttgccttcctttgatcgaatactacaatggcgtctgtatctgcaattggagttctcaaggtacctcctgcttcgacttccaattccaccggaaaagccacggaggcggttcccacgaggactctttctttctcctcctctgttacttcatccgacgacaagatttcactcaaatccaccgtctcccgtctttgtaaatctgttgttcgcaggaatccgatcatcgtctctcccaaagccgtctcagattctcaaaactctcaaacttgtctcgatcctgatgctagcagcagtgttttggggataatcttaggaggtggagctggaactcgtctttatccacttacgaagaagagagcgaaaccagctgtgcctcttggtgctaactataggcttattgatattcctgtgagcaactgtttgaatagcaacatatcccagatc

SEQ ID NO: 6402 - DNA, 467 bp, Zea mays
  Clone ID: LIB3279-019-P1-K1-G11
gaagttttcaacagattcgtcggagaatcttcgaatcaacggcggagaaatggctcgatcgcgcctctcatcacgatccaacatcatcactcgtcccttctccgccggcttcagccgattaatctcaacggacacaactccgatcacaatcgagacttcgcttcctttcacagctcacttatgtgatccaccgtcacgctccgtcgaatcatcgagtcaagagcttctcgatttcttcagaaccatggcgttgatgcgacgtatggaaatcgcagccgattcgctttacaaagcgaagctaatccgagggttttgtcatctctacgacggccaagaagctgtagctataggcatggaagctgcgattacaaagaaagacgcgattattactgcttatcgtgatcactgtattttcttaggtcgtggtggttcgcttcatgaggttttctcagagcttatgggaagac

SEQ ID NO: 6403 - DNA, 476 bp, Zea mays
  unsure (1)..(476): unsure at all n locations; Clone ID: LIB3279-019-P1-K1-G12
ctcactcctcagctcctcaaatcagaatgaatcaatccgcgcaaaattacttttccgtgcagaaaccttcagagacttcatcagggccgtacacaagtccgccaccaattggttatccgactagagatgcggtggtgggtgatcctccggcagcagcagtggagacaaactccaagggcgtcaaccccgaaggatgttgtgctgccatatgctgctgttgtgtcctggatgcatgcttctgagacttcggaattaacgatttcatgcaaattattgatgtaataaaagagtatttgatgctagttatgttacctactctctgtttggaatatactctgtggatggttgttactatgttttatgtaagtgattatatatatatatatatatattccgntgaattgggttgtcgaatagatccatcgatgattgaaccatcagtcagtaacgaaaggatgtgtttcagttcctcacgc

SEQ ID NO: 6404 - DNA, 481 bp, Zea mays
  Clone ID: LIB3279-019-P1-K1-G2
gatctcaagtctctctctcttagtgaataaattagggttcgttgattctctgttcttaagctcagtaatcgaggagaagaagaaaagggaagatcgggaattgggaaactgagaagtcaaaaaggcaaatgcgagtggaggagattgagttttagaattccaatgtcttgggctgctcctgatgatatcttcttctccacttctcttgctgcttacctagacaagaaacttcttgtgttgcttcgtgatggtaggaaactgatgggtctacttcggtcctttgatcaatttggacgtggaaaaagaagagcttccagctcatatggttcaggttccagaagcagagataaaaagggctcagaaagcagagaaggaagaaatgcttttaaagggcacaatgcggaaaagaatggagttccttgatctcgattagggcattttcctatgtgttgcagcattgtagaaactagaagatctcaag

SEQ ID NO: 6405 - DNA, 461 bp, Zea mays
  Clone ID: LIB3279-019-P1-K1-G4
gaaagatctgaaacagcgaacacaacagagagacttcttctcggtatcttgtcttcactgggtggaaactaaagaaaattggaaaagggctgacttttttggtttggtgaagttcgtcgtggggactcgggacaatataataaagatgagtcctcgcttactctgagtgttatctatgtagttgcttcaatttttgtcactcatttgccttcgattcctccttaagaaactgacgattcttctattgggaatcggtcaacgtcctcaagtttatcagagatcttagggtttctaatcagatatttgattcatcaaaatcaccaactagggtttacaaagtccatgcttttcgatcattgatcagagagctttcaagaaatatttgcaagaaaatggcaatggctccagtaataaagctggtcttaggttcagttgcctttgccattttctggatattagca

SEQ ID NO: 6406 - DNA, 456 bp, Zea mays
  Clone ID: LIB3279-019-P1-K1-G5
tcttctaccaatctaattcctctcttcagcttcttgtgttgacgcatactcgtcgcagtcgtgagatatggccgccgcagtttccaccgtcggtgccatcaacagagctccgttgagcttgaacgggtcaggatcaggagctgtatcagccccagcttcaaccttcttgggaaagaaagttgtaactgtgtcgagattcgcacagagcaacaagaagagcaacggatcattcaaggtgttggctgtgaaagaagacaaacaaaccgatggagacagatggagaggtcttgcctacgacacttctgatgatcaacaagacatcaccagaggcaagggtatggttgactctgtcttccaagctcctatgggaaccggaactcaccacgctgtccttagctcatacgaatacgttagccaaggccttaggcagtacaacttggacaacatgatggatgg

SEQ ID NO: 6407 - DNA, 446 bp, Zea mays
  Clone ID: LIB3279-019-P1-K1-G6
ccggaacttagccgacgagcgctgatcaaatcaaccggagaagcaaagctatagatctactatcgccttcacagttgctatcagagatgtataataatatgggaccccggcctggaatggcaatgcctcaggcaaatcctcagcctagcccatttgggaatccgttctctggacctggctctggacttatccggagtggcttgggagcttatggggagaagattttcggttctagctctgagtatgtgcagagcaacataagtcgctacttctccgatcctcaatactattttcaagtgaatgaccagtatgtgaggaacaagttgaagattgttctacttccattccttcacaggggacactggactcgaatatcagaaccagttgggggtagactttcatacaaaccaccgatatacgatataaatgcaccagacttatacatt

SEQ ID NO: 6408 - DNA, 477 bp, Zea mays
  Clone ID: LIB3279-019-P1-K1-G7
ccggaacttaaccgacgagcgctgatcaaatcaaccggagaagcaaagctatagatgtcgtgtctccttcacaggtgctatcagagatgtataataatatggcaccccggcctggaatggcaatgcctcaggcaaatcctcagcctagcccatttgggaatccgttctctggacctggctctggacttatccggagtggcttgggagcttatggggagaagattttcggttctagctctgagtatgtgcagagcaacataagtcgctacttctccgatcctcaatactattttcaagtgaatgaccagtatgtgaggaacaagttgaagattggtctacttccattccttcacaggggacactggactccaatatcacaaccagttgggggtagactttcatacaaaccaccgatatacgatataaatgcaccagacttatacattccgcttatggcctacggcacttacgctgttc

SEQ ID NO: 6409 - DNA, 473 bp, Zea mays
  Clone ID: LIB3279-019-P1-K1-G8
gtacattgtcctgccaacgtttgcttatgagcacaagatttttgtcggtcctttttctaggaagttccccaaggctcaagtatgggttgcaccaagacaatggagctggccattgaacttaccacttgagtttttcggtatctttcgtgctaaaatcatcaaagacagggacttatctacgccatgggctgaggagatcgaacagaaagtcctaagctccccagaagttggaattggaccatatgtcgaagtagcgttctaccataagcggtcaagaacccttttagtcactgatgctgtgatcttcgtcccgcggaaacctccctcgagtatcagcaacgaatccttgttggcctcggctaagaatggactagctgtgaagatacttagcaaaggaaaagacattcctaatgatcctgtggttgataatcctaacacccgccaaaaaggatgggaaagaatggttctgcaaa

SEQ ID NO: 6410 - DNA, 426 bp, Zea mays
  Clone ID: LIB3279-019-P1-K1-G9
tcttcttcttcttcgtccctttgaagatatggtgaagaatcttaaagtggatcctgttgctaaggtcactgcctccaccacttccatggtttctgcaaaagagaataagaatcagtcagaggcagagccatcatattatgaaactcttgagacatatcaaggcctgccttgtccttatggtggctactatggatactactatccaggtcttgatggttcagttggagaagcaaaggataatggatactatggttatggaacagaagttcagtacccggtaatgcaaggggaaaatgggtctgtgatctacttgatgccagggtttcagtcttatgatgcaagccaaacttatatgcctataaacccgggtggtgtatcgagtcaagcacttcattcgccgatgtatgctgcttcaggttattatca

SEQ ID NO: 6411 - DNA, 450 bp, Zea mays
  unsure (1)..(450): unsure at all n locations; Clone ID: LIB3279-019-P1-K1-H1
aatctctctgtccaatttccaaagtcaactcctttttggtttttgttttactttctgattgccggtgctctactgtggaacaacaactacacacacacacaaaaaaaaacaattttctgtctatatatatattaaggatccaaattagggagagaccaaagaggaaattaataacaatcaattcaacaacgaatggagattgaagaagcgagtcgtgaaagtggacatgttgcgtgcggatcatggattcgccgcccgaagaaagtaaactgggttcttatcgctaaagcttccaaacgccgnggctcatctgtttattgtgctgctctcctcaacatcttctgttttgaccccattactgcttctctttcctcctatcctttggcaacacacacgcttaaggatagtgatggtgatcctgtggctgcttcagngcaccctggtggggat

SEQ ID NO: 6412 - DNA, 469 bp, Zea mays
  Clone ID: LIB3279-019-P1-K1-H12
caaccaaaaaaaagaaaacacaaaaacaaagattataatggcttcctcaaccatggcttgggcctcccctgccttcgccggaaaggctgtgaagcctgccgcatcagatgtcctcggaagcggccgtgtgaccatgaggaagactgtcgccaagccaaagggtccatcaggcagcccatggtacggatctgaccgagtcaagtacttgggtccattctccggcgagcccccgagctaccttaccggtgagttccccggtgactacggatgggacaccgctggtctatccgccgacccagagaccttcgccaggaaccgtgagctagaagttatccacagcagatgggccatgctcggagccctaggctgcgttttccctgagctattggctaggaacggagtgaagttcggagaagcggtttggttcaaggccggttcacagatcttcagcgacggaggattggactac

SEQ ID NO: 6413 - DNA, 454 bp, Zea mays
  Clone ID: LIB3279-019-P1-K1-H2
ctagggttttctttgcacactactcgctccaatgggaaagggaacagggagtttcggtaagaggaggaacaagagtcacacactctgtgtgagatgtggtcgtcgtagtttccacatccagaagagtcgttgctcggcttgtgcttacccagctgctcgcaagaggacttacaactggagtgtgaaggccatcaggaggaagactactggtaccggaaggatgaggtatctccgtaatgttcctcgtcggttcaagactggattcagagaaggtactgaagccaagccaaggagcaaggcatcagcttcatcagcttaaagagccagttcgagtagtctctcaggaaggactaaagcttagcattttttgcattcaactagttgaagattacttttcatgtggatctcatacattatgttatgtgggttttgtttcttttgttattcacttaat

SEQ ID NO: 6414 - DNA, 464 bp, Zea mays
  Clone ID: LIB3279-019-P1-K1-H3
atctcttggaggggttcttctttctgtaacaggtactgaagccatgtttgcaaatcttgggcgtggacctcggtctcaatcagagttgctttcgccgttgtcgtgtacccctgtctggtggtacaatacatgggccaggcagctttcctgtcaaagaacctcgggtctattcctaacagtttttacgattcagtcccagatcctgttttctggcctgtctttgtcattgccacacttgcagccattgttggcagtcaggctgtgataaccactacgttctcaataatcaaacaatgccatgccctagggtgcttcccacgcatcaaagtagtccatacttcgaaacatatatatggacagatctatatcccggagatcaactggatcctgatgatccttactcttgcaatggctataggctttcgagacacaactttgattggaaatgcctacggaatcgcatg

SEQ ID NO: 6415 - DNA, 489 bp, Zea mays
  Clone ID: LIB3279-019-P1-K1-H5
aaaaaaagagagaaacaaatcatgaggacaatggttgatttaggaaagcaaagagatcatagctatgaccacatgcaaatcataaccactcctacctccgtggattgttctcgcgaattccgtcaccgacgaacacttcgttcactcatcgaatgcatgattccatactgttgcacttaccaacaacaaccataccaaaacgacaccctttcagtctcttccacttcatcctcgtcttcatcctcagaccactcttcctcctcccagagtagcagtaccgtaagtggaactttcttcggacaccgtcgtggccgagtcagcttctgccttcaagacgccgccgtgggatcttcaccgctgctcctcctcgagctagctgttcctacggcagctttagccaaagaaatggacgaggaaggtgttctacgcatagccctcgagtgtgaccgtcgtagaagcagcaatagtccgtcgtcttcgatctttgat

SEQ ID NO: 6416 - DNA, 372 bp, Zea mays
  Clone ID: LIB3279-019-P1-K1-H6
taccgaattcccggtccgcccagcccgtccgaaaatctctcgatctctatctgcgaaatttcacggtaggtatttgaaatggcgacagttcgagggcaattgatctgggaaatcgtgaaaaccaccaattgtttcttggtgaagcagttcggtagaggaaactctaaggttcaattcagcaaggaaactaacaacctcaccaacgttcactcttacaagcactctggtcttgcaaacaaaaagactgtgaccatccaggccgctgacaaggaccaagctgttgtgctcgccaccaccaagaccaagaagcagaacaggcctaagctctctgtcaacaagtctttcctcaagaaggaattccccaggatgtca

SEQ ID NO: 6417 - DNA, 460 bp, Zea mays
  Clone ID: LIB3279-019-P1-K1-H8
cacacacacccagagagagacagagattcatcgatatggcggtttcttgcaaccactctgcgattctcttctctccatcatccaccgctggttcctcctccgttacttcttcctcgtcgctcatcggctttcctcgtttccaaacgctgcgtttcaaatcaagaagcgtttattcgaaatctagagtttcttctcctgtctcggcattgcctttacgttctctagaagctctgattttcgattgcgacggcgtgattctcgaatccgagaatctacaccgtcaagcttacaacgatgctttctcgcatttcgatgttcgatgtcctccttcttcctctgagtctctcgattggagcctcgagttctacgataagtttcagaatctagtcggaggtgggaaaccgaaaatgcgttggtatttcaaagaaaatggatggccaacttccaccatttttgactc

SEQ ID NO: 6418 - DNA, 468 bp, Zea mays
  Clone ID: LIB3279-019-P1-K1-H9
agctttcgacctctctcttctcattcctttgcaacttctcacttctcgaattccttctctggaaaatcagaaatggctcaagtggttgctaccaggtcaattcaaggctcgatgttatctcccaacggtggatctgtgtctacaagatccgagaagctattgaaaccagcgagttttgcagtgaaggttcttggcaacgaagcaaagagaagtggaagagtctctgtaagaagcagaagagtggttgatactactgtgagatccgctcgtgttgagactgaagtcattcctgtttctcctgaagatgtgcctaacagagaggagcagcttgagaggttgttggaaatgcagcagtttggtgatacatcggtagggatgtggtcgaagccgacagtgaggaggaagacaaagattgtttgcaccgttggtccgtcgaccaacacacgagaaatgatatggaaattggct

SEQ ID NO: 6419 - DNA, 183 bp, Zea mays
  Clone ID: LIB3279-020-P1-K1-A1
tcccgcgctgctgtactctctcacctccttcgccgttgtctaccagatcatcccatggcgtcggagaagaagcagtcaaactctttgcgggagatgaaggtccagaagctcgtgctcaacatctccgtgggcgagagcggtgatcggctcacccgtgccgccgaggtactggagcagttgagc

SEQ ID NO: 6420 - DNA, 186 bp, Zea mays
  Clone ID: LIB3279-020-P1-K1-A10
tttatttttttttttgccagaaccaaaagtggcaggctcctcttagagccttaataggtggtaaagataaaacataaagataaccaggagatagtatttcaacacccgttcagccatggatcggaccttgcctacccagctatgatgtacaaggccaggttcagaagccagaagttgccgatgtcc

SEQ ID NO: 6421 - DNA, 455 bp, Zea mays
  unsure (1)..(455): unsure at all n locations; Clone ID: LIB3279-020-P1-K1-A11
cggacgcgtgggcggacgcgtgggcggacgcgtgggccgcgagctggtcacggacgccaacttcgactgctccgggaccgggttctcgctgcaggccatggactcgagccacgtcgcgctcgtcgcgctgctccttcgcgccgagggcttcgagcactaccgctgcnaccgcaacctctccatgggcatgaacctcaacaacatggccaagatgctccgctgcgctggcaacgaggacatcatcaccatcaaggctgacgacggctccgacaccgtcactttcatgttcgagtcgcccaagcaagataagatcgcggattttgagatgaaactgatggacattgatagcgagcacctcggaatcccggattccgagtaccaggccatcgtccggatgccttctgctgaggttatgaggatctgcaaagatcttagcagcatcggagacacagtcg

SEQ ID NO: 6422 - DNA, 426 bp, Zea mays
  unsure (1)..(426): unsure at all n locations; Clone ID: LIB3279-020-P1-K1-A12
cccacgcgtccgcccacgcgtccgcctgagagcatgagcattgccgtaaagttgatgaagaaagcgcggagactgaggacttcttgctgctaggatagcagatcgattacaagccctcggagaagcaactaaagtcggcatgttccatcaggcaagctttagaagcagaaatttgtctctgacttactacacggccagccaaaacggtcgaagtggtttttgatgacatccagcagccaaaactggctccgcgctgacagtaaagtanaactgactgaagattgcgggcgacacgcgcccaatgcacgcatagtccatttaatttgttctggagatgtcttctttatccaactcagcaactgtatatttgtatatcggccaaaaagaaaggaaataaattcaggtcaaggctggccatttatactt

SEQ ID NO: 6423 - DNA, 148 bp, Zea mays
  Clone ID: LIB3279-020-P1-K1-A3
agttgttgaacaaatatctggaaaggatcacatcctaaatcatttaagcatcccaacaggatgtttcacccattcagagattagtatgggtggactgacagaaccacaagccagagagaaggcagataaagaaggatttgagataaat

SEQ ID NO: 6424 - DNA, 452 bp, Zea mays
  unsure (1)..(452): unsure at all n locations; Clone ID: LIB3279-020-P1-K1-A4
cggtgactggtgggccgccgccaccctaagccagttgcggaggtttacattggtctctgggtcggcgacgagcacccaccaggagtcttgacaagtttttccaatggaccaagtaccgaatggaaggcataagggttcttttgcgaagccaagagtagctgtgctttcagattctgactctgactctgaaggttttgtagaagagcnaacttctagatactcaaagtcaaacgggaaggctttatctgcgancctaaaaactgtnttaaaggcttcagccctttctaaaggtgaggcaagcaaaggaaaagcatacagtagtgacaaaggtggaaagggttcttcattacatgcagtgcctaccaagtctgatgcccaactaaagctagagcttgatattcctccaaattctagaatgctaatgaattgggaagcaactgtactattgcaag

SEQ ID NO: 6425 - DNA, 440 bp, Zea mays
  Clone ID: LIB3279-020-P1-K1-A5
gcagactggtttaggtggtgtcggaaatgttgggcgccttcggcttccgaaggtcctcaaaaacatgatttaacaatgcctctggagtataatgtgtggacagggatcttcgaacaagagcccacggtatgaagaagcacggaaataatacgaaagatggagcagagccgaagctgcgcagaagggagcttcggcatgatggcagaaaagaggaaaccgacttaaagaggaaaagactatctagacccagataaattactatagagttgttgtcataggcaaagggcctggatgtaattttgcatgggctgcgacccgtgcctataaataggtgaacagtattcccgtactgttcacgctgacttggcatctgctttcgcgtcacgcttgtacccttgctttccttcgagccgaaggtatatttgtaatttggtattggt

SEQ ID NO: 6426 - DNA, 376 bp, Zea mays
  Clone ID: LIB3279-020-P1-K1-A6
cggacgcatggggtctaagaatggatcgagggccttacacaatcttgaattaagcactgtggttgcatagatggtgttgcatgccacatttgaccgatgaataatctgtatgcatgagacttgtcgcgtcttatcagccatgaaatcagtgcataaggccatggcacagaatgccgtaataatcttcgtcacaggcgctggtatatgctgtttccactccttattagccatcgtcacctaactacctaggggggcacacgaaggggattcaaacttactaacccttagagtgtgcaagtgaatgtattttttagagagagctaatactactgacttagctgaagtctagaactgatcgaccgggaaaacactgtgg

SEQ ID NO: 6427 - DNA, 452 bp, Zea mays
  unsure (1)..(452): unsure at all n locations; Clone ID: LIB3279-020-P1-K1-A7
gatggcggcggctaggagagcgctcctgacccacctccgcgtgccggtggtccaccctgcagcggcggcagcgaccatccccgcggcaggtcggctcctgtcgtcgacgacggagagaaagggctcgttcctcgacaagggcgaggtcgctgaccgtgtcatctccgtcggcaagaacttccagaaggtcgaaccctgaaaggtgncacctanngctcattttcagaaggaccttggacttgatagcttggncactgtggagatcgtgangncgttggaggaagaattttcctttgagattcctgacaacgaagcaaagaagattgactccatcaagacagcggttgattccattgcttcgcatcctcaagcaaaataagaggatttcttttttttcgtatttcaaagggtgttttgctttcaaaacttatgcgacacgggactagtttttt

SEQ ID NO: 6428 - DNA, 307 bp, Zea mays
  unsure (1)..(307): unsure at all n locations; Clone ID: LIB3279-020-P1-K1-A9
ccaacactataaattaaggagctatttttagagaactactcgagttactctgatagagtgatcccgaaattacgagcccacaaaaattttaaattatcattaataaccttattttcaaccagaaaattaaggggaaaaccattttaataaaggcttgtttgggcaacctaattttccaagggatttttatttttcaaagaaaattagtctattttttcttgaaaggaaaatggaattcctttaaaaattagngtatcaaactagccctaaatgagcaagagaaattatgtatcgaactatcaatggg

SEQ ID NO: 6429 - DNA, 199 bp, Zea mays
  Clone ID: LIB3279-020-P1-K1-B10
cccgcccgtacgctaggggcacgagggagaagctaggaacggcggcggcggcgtcatggcggcgcggaacatccttcgcggtgcagcatgcggccaccgtttgctcgtgcccgtcccctcaggcgctctggctggttctggaagccggaacatcgacgctgtcactagggaccttcgtctttacgcatcaaacgaaaca

SEQ ID NO: 6430 - DNA, 461 bp, Zea mays
  unsure (1)..(461): unsure at all n locations; Clone ID: LIB3279-020-P1-K1-B11
aatgaaggcagatgcatgccatctgtagttgagggcaaaacaaaatagggagatgctgaagaaaaggaaaggacagatgaagctggaaatatcgataaaattagcacggatgacactgggaagaaagatggatatgacactgaaaagaaagattgaggtgatgatactggaggtgaatcagagcagaaagggcaaacaccatcancaacaccctttttctcgtttaagaatctgtcaagtggacaaaatgccnncacaggtcttaccgnaactggattttcaagcacataattcttgtttggctgagcctctaaagatggctcaagtgctgctcccctatttgggctgaaagctgatggttcttcgttcccttcttttaatcttggtgctgtcaccaatgggggttctgccacaggttttgctacttcagcagaggcactcaagatgtttgctatgacaga

SEQ ID NO: 6431 - DNA, 403 bp, Zea mays
  unsure (1)..(403): unsure at all n locations; Clone ID: LIB3279-020-P1-K1-B12
tgaacaccctgacgggggagcaccgtctggaggatatcgtcgactagcgatgcggcgacgttgatgtggaagccgtggaagccatcctggacatcgcagcgatgtgcaccgactcagacccggcgcagcggccgtccatgagcgctgtcctcaagatgctggaggaagagatcctgtccccctgcatgagcgagctgtgctacnagcagcacctggagctctgagccgaggaagcctgactacgatgcanttcatgatggatgagacngtgtaggaagcaaaagttttgtagatatgacgatgatgaaccgcgtacgtagtgagggtgtttgtgagcagctcaaaagtaggaaagtgcagaaccaacaacctgatcggcatgttacatacatagatcttctaa

SEQ ID NO: 6432 - DNA, 186 bp, Zea mays
  Clone ID: LIB3279-020-P1-K1-B2
acctggtgccctaccctaagatccacttcatgctttcgtcctacgctccagtcatttgtgctgagaaggcctaccacgagcagctgtccgtgtcctaaatcaccaacagcgccttcgagccattctccatgatggccaagtgcgaccccttgcgtggcaagttcatggcatatggcctcatgtacc

SEQ ID NO: 6433 - DNA, 169 bp, Zea mays
  unsure (1)..(169): unsure at all n locations; Clone ID: LIB3279-020-P1-K1-B4
atttatttaggtgccttgatctcaatggaaggggtttccttacaactgcagatattcatactctatttagagacgtacaccagaaatggattgtgggagggaactatgagcttcgcatagaagacagtgagggantgaatttgggacatggtgaaacccgcagatcctc

SEQ ID NO: 6434 - DNA, 465 bp, Zea mays
  unsure (1)..(465): unsure at all n locations; Clone ID: LIB3279-020-P1-K1-B5
ccagaacgcacaaatcttcctgaaaatacaattatattcagacaagcaccatattgcgaattaatagttcatatgctgcgcgcggtagggaagaaggggagagttggcccaatagggtgaaggctgtctcttcacaattgacgttttgttaaggtctgagtctgacatgcatatcatccttttttgggatagatttttttttttttttgctttgtcttnatttgtttgcagagaagctagtgatgaggctgtatnatttataaaagtgtccaagnaatgtaagggaactgtgcgcttatgagcaagcaggctggcggcagataaagaaaacagttcttccgatccgtggtcaatcaaaaaaattatcttctcctagagagcccacaggctttcttcagagaataatagtgcgtgggccgagatcctgcccagatcggcggcagtaggtgtacaagccacaaccac

SEQ ID NO: 6435 - DNA, 461 bp, Zea mays
  Clone ID: LIB3279-020-P1-K1-B6
ctccgaagccatcgtccccgtcccagcctccccggactccaggggcaaaagctgcagcgtcgagatggtgaaggggcgcacggggcagcgcgtgaggctctacgtccggggcaccgtccttggatacaagcggtccaagtcgaaccagtacgagactacgtcgctggtgcagatcgagggggtgaacaccaaggaggacgtcgcgtggtactgcgggaagcggatggcctacatctacaaggccaagaccaagagcagcggcacccactaccgctgcatctggggcaaggtcgcccgcccgcatggcaactccggcgtcgtccgcgccaagttcaggtccaacctgccgccggaatccatgggccgtaaggtcagggtgttcatgtaccccagcagcatctaaagataatctgaatgtgtggagggaccctttcttctagattttatcttcagctgtcctt

SEQ ID NO: 6436 - DNA, 423 bp, Zea mays
  unsure (1)..(423): unsure at all n locations; Clone ID: LIB3279-020-P1-K1-B7
tcgcaaaaagaaaanaaacacttgaaatatcagttcattagacngggattccagagggcccgtgaataaagggaaggtaaggagtggcatatcttatgcgagatgggggcggccgaatccgtgccggagacctccatacacgaatttaccgttaaggattgcaacggcaaggaagtgagcctggaaacctacatggggaaggttctcnttgaggnancgncgtctccaaatgtgggttcacgtagacttttttcnctcggttgacggagctnnatcagaagtacagggacaaagacttcgagatattggcattcccttgcaaatcagttcttgcgacaggagccaggttctgatcaacagatacaagacttagcttgcaccagatttaaagcttgaatcccagtttttagaaggtgcgcgtaa

SEQ ID NO: 6437 - DNA, 444 bp, Zea mays
  unsure (1)..(444): unsure at all n locations; Clone ID: LIB3279-020-P1-K1-B8
tctggattctaagtaaagcggatagaagatgacgacgacgacgatgatgaggatttggctcctggccaatcgagtagaacaataaagatcaatgaatcttctgaatctgtgactaagccaacagatgttttaagcaaaactaacggatcagaggttgccaataaagaagggagcaagagctggatgcccaaatttattgcgaaacctatgtcngcaagcgcagatcctcataagagacagaagatcgaatgcncggctgtccaagacaccnngaaaggccaagatgatgaacaaaaaagtgaacctgcgaagcaaaccaatgttatccagtccctttgccagaactacgatagtgatgatagagaatgaatgaggacaccggccttttgaagccataacagtcctggttgccaatgctggattataccagaggatgttaacaca

SEQ ID NO: 6438 - DNA, 419 bp, Zea mays
  unsure (1)..(419): unsure at all n locations; Clone ID: LIB3279-020-P1-K1-C11
ggacgaaggagcggcggcgaggtctatggcgtcgacggcggggtacctggcgcggcgggcggcgcagaaggagcgggtgcgcctgctctaccgcagggcgctcaaggacacgctcaactgggccgtccaccgccacctcttctaccaggacgcgtcggatctccgggacaagttcgaggccaaccgacacgttgataacctggacgtggtcgatnggctcatcgactatgcggaggctcaatacaggaacanncagcaccccgatccctacattgttccatgggcaccaggcggcactaaattcacaagaaacccccctccaccttgagggatcgagatcatctacaattatggcaaggaggaccagtaaacaagagtcctgcaagcggtgggcagaacttccacaggtccaaatcact

SEQ ID NO: 6439 - DNA, 463 bp, Zea mays
  Clone ID: LIB3279-020-P1-K1-C12
cccacgcgtccgcccacgcgtccgcccacgcgtccgcccacgcgtccgaactgcccctttcactcctcctccggagtctgtccatctgacaaccccttcctctccagaggtcccatatgcaaagcttctgacatcgatcaacaatagcaagaatggtgaagcagggggtgatctccagtcgtatccaaactacccagacagcccaattgggcgcctgatatctccaagctcgggctgttctggcacatcctccccattccctgaccctgagatgcaggcttcttcacgcagcgctttacgcttgttcccagttcgtgagccccctaagatattggatggcgagggcgttgcgacacagaagttgatacctcgccatatgcgcaacggtgggtccctcttggatggccagatctcagcagctgtaccagttgtggacttctctggccgacttcaacccaacgag

SEQ ID NO: 6440 - DNA, 449 bp, Zea mays
  unsure (1)..(449): unsure at all n locations; Clone ID: LIB3279-020-P1-K1-C3
catcaatatcttttatacaaatttagtcaaacttaaaatagtttgacgaacaatatttagatttatactctgctttaaaaggagacagcagtccacagtatcatgattaaattggttccaatcaccgcaatacggtttgaaaaaacataccaacaatgattccttggcacagaccagacgcaacctttcttctccagacatgcttccacaatctttaaataattttgctaagacgacccctcacattgtgaaaagacaccagacaacgaancgttgcggtcacaaatttcggcagacatttttctactacaaaatggcacaacagggaggtttacacttgaggattacatttaaaaaaggcagtatttttttatttacagtcctgttttgttctactttcttctcaacaactgcataaccctgagaaaatgctgctacgcaaacaagac

SEQ ID NO: 6441 - DNA, 451 bp, Zea mays
  unsure (1)..(451): unsure at all n locations; Clone ID: LIB3279-020-P1-K1-C4
ccgccaacctgagtgccaccggccacctcaccaactcccctacaagccgccgggcaagtgccgccgggccgaacgaccgaagcatccacttccaaagtgttttgtttgttgtccgcctggcgcctgcccccataactactctgccaccaatccggggaggaatcaacctagcggtaagcggacatggcggcggcgaagatagcgccgtctatgctctcgtcggactttgccaacctcgcttcggaggctgagcgcatggtccgcctaggcgccnactggctacatatggacatcatggatgggcacttcgttcctaacctgactattgtggctccggtgatccagagcttgaggaaacataccaaagcatatttggactgccatcttatggtcacaaagccttcagattacgtagaacccattggaaaggctggcgcttctggattcacat

SEQ ID NO: 6442 - DNA, 464 bp, Zea mays
  Clone ID: LIB3279-020-P1-K1-C5
cggacgcgtgggtgagatcaaagaatgctcgtggccagcaaggctcatatccaattaagctattctacacttcaaacatgcccatcattctgcactctgcactgattaccaacctctatttcatatcccagcttctctacaggaagtacagtggaaacttccttgttaaccttcttgggatgtggaaggagtctgaatactctggccattctgttcctgttggtggtcttgcttactatgtaactgccccatcaagtttggctgatgtccttgcaaatccattccatgcactgttttatgtggtcttcatgctgtcagcttgcgctctgttctcaaaaacgtggattgaagtttctggttcatcagcaaaggatgttgctaagcagctcaaggaacaacaaatggtgatgccaggacatcgtgagtcaaacttgcagaaggaactgaaccgatacatccccact

SEQ ID NO: 6443 - DNA, 388 bp, Zea mays
  unsure (1)..(388): unsure at all n locations; Clone ID: LIB3279-020-P1-K1-C6
cccaaccaagggcaatccctctccgccatccaatacaatcacgcctgcgcacacgcaaccccagctcaagccccaagtccaaaccctaacccggcggcggaagatatggccgacacggggcgcgacgccttccctgacgaggcggagcccgcgttcaccctcgacgagtacatggaggacatcgaggccgtggagctggaggcggatttggtgctgggcggtgacgagggcaaggagtgcacctacgccggcgggtacctcaagcgccaggnccgcttctcctgcctcacctgcgtgcctgatggagtcgccggggtctgtaccgcctgcagcctcgcctgccacgacgggcatgagattgttgaactttggacaaagcggaagtttc

SEQ ID NO: 6444 - DNA, 425 bp, Zea mays
  Clone ID: LIB3279-020-P1-K1-C7
gcttccctcccgacccactcgcccaaaaccgtagcgccctcgcctgctcgccgccgccgtcgttgcgagctccccatcttcctccgttaaccatggcgacccagatcagcaagaagaagaagttcgtcagcgacggcgtgttctacgccgagctcaatgagatgctgacgcgggagctcgcggaggacggctactccggcgtggaggtgcgtgtcacaccgatgcgcacggagatcatcatccgcgcaacgcgcacgcagaacgtgctcggcgagaagggccgcaggatcagggagctcacgtctgtggtccagaagaggttcaacttccccgagaacggcgtcgagctctacgccgagaaggtcgtcaaccgcggcctctgcgccatcgcgcaggctgagtccctccgctacaagctcctcgga

SEQ ID NO: 6445 - DNA, 455 bp, Zea mays
  Clone ID: LIB3279-020-P1-K1-C8
cccacgcgtccgccatgagtaattttctctgtatgcctgctcaactattgccaagtacagctgacttccacattagtgactccctatctgactttggtatcaacgattatgaattcaactactctgaggatctcttgcaagagtttgacgccctcgagttcttcccagatcagggtgactctggtctccttggtattgaagagttagaacctctttcggatttcacagatatcggatgaacatagatgagcaaattatggttgatgggatgctgtcctataccaagaggagacaagatcgcctctggcaagagcccaaggatataggttgagttgctcaaccatgcacagatgtgctgcaagctttatcatggctggctggagcaaagctgctggcttggtgaggtcacattgatctgacaagcttgaggatgggtttgcactaatggcggcatt

SEQ ID NO: 6446 - DNA, 335 bp, Zea mays
  unsure (1)..(335): unsure at all n locations; Clone ID: LIB3279-020-P1-K1-C9
cccacgcgtccgcctatgtggaccaagctgggcagaagaagcaggactatgagaagactaaggcaaatattgagaaggagagcacaagctcaaagaaggctaagactgatgacgacgatggctcgaagtccgaggtcgatgatgaggatggcggtagtgacgaggaaaacgacgacgacgagtaaatagtatctccgctgtcgngaggtancaaatcgattgttaggtccccaattagctcactggtttgctatctttaatgttaagttgtttggaacaggtgtttatgaaggggatctattagtttcgtgaggttgttagtgtagtgcattagc

SEQ ID NO: 6447 - DNA, 321 bp, Zea mays
  unsure (1)..(321): unsure at all n locations; Clone ID: LIB3279-020-P1-K1-D1
cccacgcgttcgaccacctccgtctccgcgatcgaagctcctcacaaaccgttatcgtggccatggcagccgtcgcgcctgcaagctccttgtaggaagtgctgccatcttccctggcctgcgtcttctagccctctcccctcttcgatggcactaccaggctgtacgttttgtttcattgtccgttcgctcagtgctcttgatttgncattttcntctatgttttttatgtcttttatttatttagactattttnctatctttaacgttaanntttttggaacaggtgtttatgaaggggatctattagttttgtgaggt

SEQ ID NO: 6448 - DNA, 358 bp, Zea mays
  unsure (1)..(358): unsure at all n locations; Clone ID: LIB3279-020-P1-K1-D10
acttgttccagctagctaggagagagagctttgtctaggccgcggaatgatgaacagggagccaggagactggcactgcagggcgcgccagcaccttaacttcataccgtcgggatgcatgccagcgctgcagtgaaccacgtggagttggtgatcgtagcggcggcggtggccacttgcgtgggcgtggcgggacctccttcgtccgtgtgtatagtgctggctctgatgtcccccctggggactggtaccncttctgcggcgcacacatcttggacagccggtccaactgcttgatgtgctctgcctacattgatgaggctgacggcacctgtgatagtgacatgtcacgctcacg

SEQ ID NO: 6449 - DNA, 165 bp, Zea mays
  Clone ID: LIB3279-020-P1-K1-D11
gttccttacagggacagtatctttacaagatggccgccagtggcaatttcatgaccggggggaactagaattggacttccgacaccgccattaccttagacactcatcatatcttaacgctgccttccttgttcgttcttgaatatgtcaagaacgggacctaat

SEQ ID NO: 6450 - DNA, 454 bp, Zea mays
  Clone ID: LIB3279-020-P1-K1-D12
cccacgcgtccgcccttgccgccgccactgcccgatccaggtgtgcagactgctccctcctcctctccgctccgaatggcccgcacgaagcagacggcgcgcaagtcgaccggcggcaaggcgccgcggaagcagctggccaccaaggcggcgcgcaagtcggccccggccacgggcggcgtgaagaagccgcaccgcttccgccccggcaccgtcgcgctccgcgagatccgcaagtaccagaagagcacggagctgctcatccgcaagctcccctcccagcgcctcgtccgcgagatcgcgcaggacttcaagacggacctgcggttccagtcctcggccgtggcggcgctgcaagaggccgcggaggcgtacctggtggggctcttcgaggacaccaacctctgcgccatccacgccaagagggtcaccatcatgcccaaagacattcagc

SEQ ID NO: 6451 - DNA, 460 bp, Zea mays
  unsure (1)..(460): unsure at all n locations; Clone ID: LIB3279-020-P1-K1-D2
cccacgcgtccgcccacgcgtccgcccacgcgtccggtttgattttgtcctagtgatgcggatcggttttgttttcttcttctccggcgccgaacgcctctctcctccgccacaccactcagcactcagcagctgagcccttcgccctcacacactatcgttctgtccgcaagcagcacacgggccggggccgatcttactcgtcnagcaaggtgagcaaggtggacccatctgatataaagcacaaaaacatctatccaacaaattatcnccagcagataacagcagcacgaggtcacactctcattcactaatcgcgtttcatgttctccccctgtggttaattagcggccacacgtcgcacaatcaaaatatctctcccatataaactccgattccattgattcttcatcgatttatctgaaatcaaattatacccatcataatgtttcataatctt

SEQ ID NO: 6452 - DNA, 447 bp, Zea mays
  unsure (1)..(447): unsure at all n locations; Clone ID: LIB3279-020-P1-K1-D3
cgcgttttcaaaaatcaaaaccccagccggaacagcgaaaccccttccaccatagcccgtaggaaacggagcagcggttgcggtttctctctccgtcgctctcaccgctcgccgccggctccgtatccggtccgcaaggcgggcctggcgtcaaggtcctccgctccgtccccttcactcgcgaccggagtcccctcttcgttggttcgccaatctacttggtcggcccacccctttccccccgatcgatctgtncttctcgctaagcgnncnatcttgacctccctccctcgtgcgagattagccagtagaaagttccccgcttttcattcaggcacacttccaccacctcgctttgctgcttcactgcttgcttctgttgggcggagtgctaagaggacggcacgggagtcaagatttcttccccttaacctgccctttcgtgtt

SEQ ID NO: 6453 - DNA, 426 bp, Zea mays
  unsure (1)..(426): unsure at all n locations; Clone ID: LIB3279-020-P1-K1-D4
cggacgcacaaccccagcgaggcttgtcggtcatggtgtgcgtgcatccaatatagcgaccatggcacgcgcatgaaccggcgtcactaagccacaacgactcgcgtgatcaacgcatgcaccgtcaaatggtcggtgcggcaaccgctgaataagctcaactatctacacagttactgtattatacattgagatctaaagccttgcacctaatgtntgtggtttaacgacatgaacatgtgattataaagttaagnnatnttggactttcttnnttttattaagctccactgaaaccattatgtgataatggtgttgctgtaactatatggtatcgtgctcctgaactattacttgcgtggaaacacttcaccagtgctgtataataatttacaattggtttcatttttactaaaatgcttacac

SEQ ID NO: 6454 - DNA, 207 bp, Zea mays
  Clone ID: LIB3279-020-P1-K1-D5
gttggcttctcctccccctccggttcgggttcgggttcgtgaggttctccggggttcggtttcgtgggtgagcggatcgagatggcggcgtctgatgttgagtaccgctgcttcgtcggcggcctcgcctgggccacggacgaccactccctccacaacgccttcagcacctacggcgaggtcctcgagtccaagatcatcctcgat

SEQ ID NO: 6455 - DNA, 471 bp, Zea mays
  Clone ID: LIB3279-020-P1-K1-D6
gtccagagtagaaggttcaagagccgaatcgaatatggttgatgctttgactgcaaaaaatgcagagattgaatctcttgtcaaatcattggactcttggaagaaaagagcagcagcttcagaagaaaagcttgcttctttagaggaagatatggatggtctcaagaggaaccgggaacttactgaaaccagggttatacaggctttacgggaggaacttgctaccgcagagcgtagggctgaagaagagcgcatttctcataatgccacaaagatggcagctgttgagagagaagtagaactagaacatcgagctgttgaggcatcaaatgctctagctagaatccagagagctgctgatcaaagctcatcaagagtgctggaattggagcacaaggtgactgtgcttgaggttgaatatgcttcattgcaacaagaactgcaggagatggaagctcgtaaccgccgcac

SEQ ID NO: 6456 - DNA, 411 bp, Zea mays
  unsure (1)..(411): unsure at all n locations; Clone ID: LIB3279-020-P1-K1-D7
cccacgcgtccgcccacgcgtccgcccacgcgtccggcgcacccggttccgcgtgcctttccccacctactctcgcggctctcgccagccagtctagggtttcggtcccggcgtgcttatccgcccccgccggccatgtcgaagcaaggtgcgttcctatccttgttggatccggtcattgtttggtgccgattggttgggtttttttttgcctatcgagggggtctgacgagacggccgggtccgnaccgaggtgggttttgctntgcaggagggaaggccaagccgctgaaggcgcccaaggccgacaagaaggagtgcgacgagacggatcttgcctatctgcagaagaagaaagatgaggaaaaagcactgaaggagcttatggccaacgcacaaaatggcgcgatt

SEQ ID NO: 6457 - DNA, 350 bp, Zea mays
  unsure (1)..(350): unsure at all n locations; Clone ID: LIB3279-020-P1-K1-D8
ggctttttcacagaggaacagccttggaaggatatatatatcacagaactccttaattgtatcaaagaggaacatctgaaggattttgaacaagagtattgtttagcagaaaagatagaaggggcaacggaggacacagatattgcagttgaactttataagctcagtatttccaccctagatctattgaaactagcatccaaagaggaacagggtgattatgtcggtgcatggtacagtatgcttttgtcctgtgctcaagaattgaagcatggcgtggcactttggcaagagttttatcatgcaaatgtctgcgacagatgtagttctgaggcgngcactactttatt

SEQ ID NO: 6458 - DNA, 396 bp, Zea mays
  unsure (1)..(396): unsure at all n locations; Clone ID: LIB3279-020-P1-K1-D9
gtcggtccacgcacgccgctcgcgcttcgcgtcggttttatgcacgactccttttcgcacccggctggccggctccccacctgctcgcctctcgcgcatcctaccaggagggtgggagacccaggcagcggaggtgtgcgaagctcgcttcgcaccacgcgctgcggcctgcggggcgagagatcgaggcctgagctagggtctggtggcggagatgtcgacgccggcgaggaagcgcctgatgcggnacttcaagcgccttcagcangacccgcccgccggcatcagcggcgcgccgtacgacaacaatatcatgctctggaacgccgtcatattcgggccggatgacacgccgtgggatggaggcacgttcaagctgactctgcaatttacaga

SEQ ID NO: 6459 - DNA, 122 bp, Zea mays
  Clone ID: LIB3279-020-P1-K1-E1
cacgcgtccgctccctcagacccttaccaaccaggcaaccaaaccttctacgatggccgtgcccgtgtggcaggcgacggtgtgaatgagagcatacactcaaagaatgctaagactgataa

SEQ ID NO: 6460 - DNA, 466 bp, Zea mays
  unsure (1)..(466): unsure at all n locations; Clone ID: LIB3279-020-P1-K1-E11
ctcatttgttgatacgatgtacctttgggaagtaagttgtctggacaaaaaagttataataaatttcataagtagtgcatattattaacaattcaatctgaccaccactaatatcaaataattacttctgttatacatctaaatataggcccagtaatgctagaattatgaattggtttatgcatgaaacactactgtacaacttcaaaatgntgcaactcatgtggtctatggagtacaatcctaatctcttttcaatgttggagagtgacactggcacatccagcgcaagcacaaaggatgaaagtgttctaggacagtgtggaaagtttgagcggaaaaaattgcaagcagctaagaaagatgaccagatccctctatctgtctttgttgttgctagtgttcttgaggctagaaacaagaagttattgggtgaggcaaaaggtctagacgatgttgtcaaggt

SEQ ID NO: 6461 - DNA, 464 bp, Zea mays
  unsure (1)..(464): unsure at all n locations; Clone ID: LIB3279-020-P1-K1-E2
tctattcgttccccgcctcaccccgagccagccgtctcgctagggtttcgccgccgccgccggcgccgccgccgctatgcctcgccgcagctcaggaaggtctgccccacgcccagctccccgtgctgctccagtgaggaacccgccacagccagcacgccaggctcctcctccagctcctgttcgagatggtggtggctccatgttnggaggaattgggtccaccattgctcaaggtatggcgtttggcacgggtagtgccatggcacacanggctgttgatgctgtattaggtccccggaccattcagcatgagactgttgcctcagaagctgctgctgctgcccctgcccctccagtgatgaatgctgacgcttgcagcatccattctaaggctttccaagattgtctcaacaactatggcagcgagatcagcaagtgccagttctacctagacatgctgg

SEQ ID NO: 6462 - DNA, 459 bp, Zea mays
  unsure (1)..(459): unsure at all n locations; Clone ID: LIB3279-020-P1-K1-E3
ctgaaaatggttcgcagagttcagtcatcggccgcgtctctaattttgtgactagggcaattgcagcttacccatccgcaacgtggagggcatgctcgtgcgtccatacactgctgcacgctccaaaattctcccttggagcacaagacattagaaagactattgccgaatcctttgcgcaagcagcgttttcccgcttcaaatctgtatccnacaagcctgctgggctatggaaaccactgctgttggcgatatcctcgtgctacatcnnctatcccgatgccatcgaacaagtcctgaacaacgttgatggtaacggttttgcgatctgggcgtttgaattggcacaagtctcaagcagcttgttcaatcctggcctgtcatctgaattcgagatcaagttagctgtgctgacgctatttactgtgatcaaccatctcgtggccctttccacgggtg

SEQ ID NO: 6463 - DNA, 456 bp, Zea mays
  Clone ID: LIB3279-020-P1-K1-E4
ggcctactccgcccatctcaaacgctccggcaagatggagcttcctgagtgggttgacattgtgaagactgcgaggttcaaggagctccctccttatgaccctgactggtactacatcagggctgcatctgtagcaaggaagatctacttgagacaaggcattggtgttggtggcttccagaagatttatggtggccgccagaggaatggctcacgcccacctcacttctgcaagagcagtggtgccatttcacgcaacatcctccagcagctgcaggagatgggcatcattgatgtcgatcccaagggtggacggcgcatcacctcccagggaaggcgtgatctggaccaggtggctggaagggttgctgttgaagcttgagcaatctcatatttggtttctatgatgtcatgtttgattgttgagatggctacactttatttgcactttggatt

SEQ ID NO: 6464 - DNA, 469 bp, Zea mays
  Clone ID: LIB3279-020-P1-K1-E5
catgaagataggccgtattgaggatgttactccagtccccacagacagcacacgcagaaagggtggtagaagaggaaggaggctgtaatttcgagtcctgacgtggtgccctgtcagatgtagcagttcaagtctgtctgcatctaatatactgagttattaggttttgtatcgattgaagttttgagtgaactcttgaatgcttaccaatactcattcttgacatggcatacaacatagcagcacaattacaagaggccctactgactgtttgtctgtgtttgatcggtactggggagcggtgtcaacctatggtttcgggtgaccctaacaatggacagcatgttcctgacttcctatggctttaatctgaactagctacatctgaactagcttgtctctatagattacagctgtaatggtccgaacaactaggtttaatttgaagcaatcagcccgtggtttaaaa

SEQ ID NO: 6465 - DNA, 459 bp, Zea mays
  Clone ID: LIB3279-020-P1-K1-E6
cagaaagagacacagtcacacagcgtagggcgctgcggcctgcggggaggaagggcaccagcttggtctttctcatccattcgcaaatcgcaacaaatcttgcatcttatcttaccctagaaaaacaaatcttgcatcttcagctgtctgtacgtgtgtgagagagagagagagactgcgtgccgcagcagcagctctggacaggcttacagtcagagagcgagggaggagccgggaagaggaggccggagggaacaaaaggggaagtttggttctttcctctaccacctggagcgtccccttgctagcgcccggtccggtgagctccataccatccagggagtgtgaggaaccgtcgtcgttgctggcgatccaagagaccaggagatgggcagcggcaggaacggcgctgtggtgaggcggtacgttcggtccaaggagcccaggatgaggtggagc

SEQ ID NO: 6466 - DNA, 257 bp, Zea mays
  Clone ID: LIB3279-020-P1-K1-E7
cccatttcatcccggcattttccttgcccaacgtgctctccctcccatttcctgcgaggtggttggtggcgatggccttcaagctgatcaccaagcccgcggcggcgtcgcccgctgctgcttactggggagatctcgcccgggggccgcagggtacgagccgcgttgccttcggaccagcgcccaggaacaaggggcttcgcgcgggcaacaactccgcaacgcccatagctaaaggagagaggggtgatcgaagt

SEQ ID NO: 6467 - DNA, 454 bp, Zea mays
  Clone ID: LIB3279-020-P1-K1-E8
ggagagcagcgcggcggcccgggcgccggagcctggagggtaggggaagagaagagaagaggcgatggcgtcaatcgggtcttccaacatcggattccagctgctgaagaagtctggttggaaggagggcactggccttggagcgcaggagcagggaaggctggaacctgtagagactcgtgttaagaataacaagcgtggtataggttctaaagaaccaaaaccacagcctaaggttggggatgacattgaaacacatcctcaaaagcccaaggaaatgcaatcaaagaaaagggcaaaattagctgcaaagaggataagaaaaatgcaagaagaggagaagcgcttgaaagagaaggaattcgagatggcttttttcaaggaattttggcctgataatgtgtaaggcagaaacttcaacacttgacaatgtagctgctgactttgcctgata

SEQ ID NO: 6468 - DNA, 309 bp, Zea mays
  unsure (1)..(309): unsure at all n locations; Clone ID: LIB3279-020-P1-K1-E9
gacgccacgcgtccggccctctcgagctcgctccgtggcctggtggccctgattccaccggccctccgtcccgctcgcccgagcggggcagcggcggcggccccggcaccccgcgcgcggggtcggacggggagaggggcgggggtcgtggcgctggcggcggcgctgccgtcggacgcgcagtggctggagcggctgccggagaagaagaagcctntgtgcacncacagcctgccgagcatcgaggcgtggctgcgcagactnnggttcacgcattcccnntaggaccccgccgtctgggtcgccgag

SEQ ID NO: 6469 - DNA, 150 bp, Zea mays
  Clone ID: LIB3279-020-P1-K1-F1
gagacaccgcgtgcgaaccaagcagaccacaacaagaagaagcgtagtcgtcgccggaaggaaaggcgcggagcaagatgtcgtggcaggcgtacgtcgacgagcacctgatgtgcgagatcgaaagacagcatctcagcgccgccgcat

SEQ ID NO: 6470 - DNA, 455 bp, Zea mays
  unsure (1)..(455): unsure at all n locations; Clone ID: LIB3279-020-P1-K1-F10
ctgctctccaagatcgcgatggcgtcagaaaagaagcagtcgaacccgatgcgggagatcaaggtgcagaagctcgtgctcaatatctccgttggagagagtggagatcgactcacccgcgccgccaaggtgttggagcagttgagtgggcagtctccggttttctccaaggcaaggtatactgtgaggtctttcggtattcgtcgnaatgagaagattgcatgctacgttacggtcaggggtgagaaggcaatgcatcttcttgagagtggcctcaaggtgaaggagtatgagcttctgaggaggaacttcagtgatactggctgctttggttttggtattcaggagcacattgatcttggaatcaagtatgacccgtctactggtatttatggcatggacttttacgtcgttctggaacgagctggttattgtgttgcacgccggcgcaagtg

SEQ ID NO: 6471 - DNA, 460 bp, Zea mays
  unsure (1)..(460): unsure at all n locations; Clone ID: LIB3279-020-P1-K1-F11
cccacgcgtccgcccacgcgtgcgcccacgcgtccgcccacgcgtccgcacaaagacatgaattatagcatggaatccagtgcttctgatagaagctcatctgggccatcagagaagcagctgtatgacaaacaagggaagggtatattccatcctgtttgtggggtcaagactcggaaagtcactgcagatgaagctgctgctatagtaatggcagctactcgaggactgggtgctgcaaatgactcacttaacaccatgaaaggaaccaaggacaatgttcgcacccatgttagtaacgatccttcttccagctttggaagtttttcatctttacaggaccgagatgcactgtccaaacacatttcaaatagtgatgttgatgctttaattaccaggaggggacaggcccaaagggaaggtnttggaatcattgacgatgattggattgcaaacacta

SEQ ID NO: 6472 - DNA, 279 bp, Zea mays
  unsure (1)..(279): unsure at all n locations; Clone ID: LIB3279-020-P1-K1-F12
ccagaatgccagtagagtggtggatggcgagatgtttctgtttggatagtattctgtgctccaggttgaatatttgtaatgctaaaaaaaaaaaaaaaaaaaaaaaaaaaaaaaaaaaataaaaaaaaaggacaaacgatataaaaaaaaaaaagattaaaaacgcatacatacaaaaaaaataacacttatatagagacacctaaaatncaatgaactgcacaaaaaaaaaaaaaaaaaagggctggggaaaaaaagnancccaacctaacttaaccg

SEQ ID NO: 6473 - DNA, 130 bp, Zea mays
  Clone ID: LIB3279-020-P1-K1-F2
cggacgcgtgggcgttactcttcacgactttatattgcttatgctccccttgttgtggttggaacacttctggcagcatcggtacctgttgttggttttaatgcaataatgacgtcagagcactttggca

SEQ ID NO: 6474 - DNA, 454 bp, Zea mays
  unsure (1)..(454): unsure at all n locations; Clone ID: LIB3279-020-P1-K1-F3
cgacatcttccgcttcgtcggggacatccctgcctctaccgccgttgaggcgcagccagaggcggttgctgtagtcccgcctgtggctgctccacttgccaacggcacagctactcctgctgtggagcctgccactcctgatgatcatggtgccgtgccacagcaggaacatcatgttgtggaccgatcactgcctcaacctgaagaggacgagggtgaggtttacaatccgccgcaagaggaagtagtggatgaggaacagccttgtgctgaagtgataaatgaagttccaaacaatgtggcacctgtggtggcaactacagttgcctcagtgttgcaggaggaggcaccaaagaagtcatacgcctcaattgtcaaaatcatgaaagaagttccattgcctgctcctgcgcctnctactaggccttcaccacccaaactagagaagcagtct

SEQ ID NO: 6475 - DNA, 454 bp, Zea mays
  Clone ID: LIB3279-020-P1-K1-F4
cggacgcgtgggaccacgctgacatgtccctatacctcgcattcgattacgcagagcacgacctctatgagattatcaggcatcacagggagaagctgagttcctccattaacccatacactgtcaaatccttgctgtggcaactgctcaacggcctcaactatcttcacagtaactggattatacatcgagatctaaagccttccaacatactggtcatgggagaaggagatgaacatggaattataaagatagccgattttggacttgctaggatatatcaagctccactgaaaccattatgtgataatgggggtgttgtaactatctggtatcgtgctcctgagctgttacttggggggaaacactacaccagtgctgtcgatatgtgggcagttggttgcatttttgctgaactgcttacactgaaacctctattccaaggtgtggaagc

SEQ ID NO: 6476 - DNA, 433 bp, Zea mays
  unsure (1)..(433): unsure at all n locations; Clone ID: LIB3279-020-P1-K1-F5
ccgggatgcagcagccacaaccattattcttgttccactgaccactgcatcaggtccaagtccaactctccaagcggcaagcgccatgccttcttccgcgcaggttctgctctgcctcgccgncgtgctcgcggcggcggcggccaccaccgccgaggcgcactcgcagtgcctggacaacccgccggaccggtccatccacggtcgccagctggtcgaggccggcgaggtcgtccacgacctccccggtggcctcagggcctacgtcagcggcgccgcgagctcgagcagcgccgtcgttctcgccttcgacgtcttcgggtacgaggcgccattgctcagacagatagcagacaaggttgcaaaggcagggtactttgtcgtcgtgcccgatttcttgaagggagactacttagacgacaagaaaaacttt

SEQ ID NO: 6477 - DNA, 443 bp, Zea mays
  unsure (1)..(443): unsure at all n locations; Clone ID: LIB3279-020-P1-K1-F6
cgccgttcgcgcatcctattgccctcgcgccaccgtcgccgccgccgccgctgcagcgagccaccgccccgccgtcgcttgaggtagacaccaatccaccgccatggggcgtatgcacagccgcgggaagggtatctcttcatcggcgctgccgtacaagaggactcctccgatctggctcaagacagctaccaccgaggtggaggagatgattaccaaggctgcgaagaagggccagatgccgtcgcagattggtgttctgctccgtgaccagcacggcatcccgcttgtcaagagcgtgactggtagcaagatcctccgcatcctcaaggcccatgggttggcgccggagatncccggggatctctacttcctcattaagaaggcggtggcgattaggaagcatttggagagggaacaggaaggacaaggactccaaattc

SEQ ID NO: 6478 - DNA, 394 bp, Zea mays
  unsure (1)..(394): unsure at all n locations; Clone ID: LIB3279-020-P1-K1-F7
caaaccctagcccgctacccctgccccttctctcttcgtcgcgcctccgcctgcgccgtcgtagcatcctcctccgccacctcggccatggcgacatccccagcgctcctcttcccttctccctcctcggcatcctctgcgccttcgtcggcgcgggtggaggcagtggtgcttttcaacgtctgcgacagctacgtgcggcgcccggaccaggcggaccgcgtcatcggcaccctcctcggttccctcctctccgacggcanccgccacgtccgcaactcctatgtcgtcccccacagcgagtcagccgaccaggtcggcatcgacatcgactaccaccataacatgtacgcctcgcaccagaaggggaaccccaaggaggtcatcggcggat

SEQ ID NO: 6479 - DNA, 409 bp, Zea mays
  unsure (1)..(409): unsure at all n locations; Clone ID: LIB3279-020-P1-K1-F8
cgaattgatatgagtgagtacatggagaagcacgccgtctcccgtttggttggtgccccacctggatatgttggttatgaggaagggggccaattgactgaatcagttcgtcggcgaccttactcagttgttctgtttgatgaaattgagaaagcacaccaggaagtctttaacatattgttgcaactgttggatgatggaagaatcactgattcacaaggcaggactgtcagcttcactaactgngtcataatcatgacatcgaacattgggtcaccattgatccttgacacacttagaaacaccacagacagcaagggggccgtgtatgagataatgaagaagcaggtgattgagatggcccggcaaacattccggccagaattcttgaacaggatagatgagtaca

SEQ ID NO: 6480 - DNA, 408 bp, Zea mays
  Clone ID: LIB3279-020-P1-K1-F9
gggaacgggagcgggaggggaatccaattgcgatggcctccgactcgggcgatttcggtggggagaacaagtcgttggaaacggcgaggcggctgctggaggagaccttcacgagtgaggcagaggcggaggcgctaccgagcttgccctcggggttctacgacgccttcgtcctgaggggaatccgcgtcgtccaggccctccagcccggcacactcctctgccacttcaacgtgccctccagactactcaactcgggcggcttcctgcacggcggcgcaaccgcctccctcgtggatctggttgcctccgccgccttcgccactgccgggctacgcaccaggggctcaccccttgagatgaacatctcctaccttgatgctgcttttgctgatgaagaagatgata

SEQ ID NO: 6481 - DNA, 319 bp, Zea mays
  unsure (1)..(319): unsure at all n locations; Clone ID: LIB3279-020-P1-K1-G10
ctcgcatcttccctcccaccgatgcgctcgcgccgccgctccccatcccccctcgacgcacctccccatcggccgccccacccccgcccgccgcgtcggcatcctcctcgttcgcggttggctcgagcggcaccgatggagcgacggctccgtttcccagaaggcgaaaggccgatgagaccgacggacgattcgtgccgatcgcacaccgtcatgcggtggcgagccgggcggacggggcggcggcggtctcnccntacgcggtgcatannngacatgagggtgctgctgtctaggtcgtgtaggtcggtcgccggtc

SEQ ID NO: 6482 - DNA, 399 bp, Zea mays
  unsure (1)..(399): unsure at all n locations; Clone ID: LIB3279-020-P1-K1-G11
gctccttctgtttttcagataaggtatggcggttacaaaggtgttgtcgctgtagatacaagatcaaatcataagctttctttgagaaaaagcatgtcaaagttccagtcagaaaatatcactcttgatgtccttgcatacagcaagtaccaaccatgcttcctgaatcggcagttgattactcttctctcaacacttggggttagcgataatgtctttgactaaagcagaaggaagccttaaggcagttgnaccagatggtaactgaaccacaggcttgtcgtgaagcagttgaacttatgcccatgggagaagtaaccaatgtngttaaagaattgttgtcatgtggctaccagcctgatcatgagccatatcttttccatgctgctacaaactttt

SEQ ID NO: 6483 - DNA, 421 bp, Zea mays
  unsure (1)..(421): unsure at all n locations; Clone ID: LIB3279-020-P1-K1-G12
ctcggactagttttttatgaagattcggcgatggcggcgacgatccaatccgtgaaggcgcgccagatctttgacagccgcggcaaccctacagtcgaggtcgacgtgttttgctcagatggaacctttgcaagggcagctgttcccagtggagcatcaactggtggatatgaagctctggagttgagggatggtggctctgactatttggggagtggtgtctccaaggctgtgaacaatggtgaattctgggaanggacctgctctgntngncaaggaccctacagcacagactgagattgataacttcatggttcaacaacttgatgggaccaaaaatgagtggggatggtgcaagcaaaagcttggtgctaatgcgattctggctgtgtcattagctgtttgcaaagctgggctagca

SEQ ID NO: 6484 - DNA, 462 bp, Zea mays
  unsure (1)..(462): unsure at all n locations; Clone ID: LIB3279-020-P1-K1-G3
aagaactgccatcataagggaggcgatacatatgcggtattcattgttgccctacttctacacgctgttcagagaggctagtgtaaatggcattcctgtcatgcgtcctttatggttagaatttcctgacgataaagaaacttataacaatggcgaggcatttatggtggngcccagccttttagctcaaggaatatacgaagagggccagaaatcagtgtcggtctaccttcctgggaaggagtcatggtatgacttgagaaatggatcttcatacaagggaagcgcgacacacaagctacaggttttagaagatagcattcccagcttccaaagggctggtacaattgtgccaagaaaggacagattcagacgcagttctactcagatggtgaatgatccatacactctggtgatagcactcaatagctcaggtgctggagaaggcgaactttatgtgga

SEQ ID NO: 6485 - DNA, 207 bp, Zea mays
  Clone ID: LIB3279-020-P1-K1-G4
aagaactggcttgaggggggaaactatgcgctttccatataaaacgtgaggcatcaaatacgcgacatggagaaacccgcatatcctttcaagatctcgctatcagaccttatttcttgcaagcaaggtgggactgtcgccagcatgcttatagatgtgcgtggcttctgggcccacgacaacagggagaaccttctccaggaagag

SEQ ID NO: 6486 - DNA, 424 bp, Zea mays
  Clone ID: LIB3279-020-P1-K1-G5
cccacgcgtccgcccacgcgtccgaacaaagttctgtagatataaaaatataacatcgggcgcgctctggagagtctggatcctcctgaacctccaagcagcaagcgatgaatggagggacgcaagcaattagcctgatggtgcaccttgctgtgccatggctctgccttgcttcttgggcagctctgctaccagcgctactagcatctggaaatgtgggtgcagcagcttcgacactgagagcagagtacatgaatttgaacttcagcaccgcttctgcgacccccgacaagtacaagagcttcatcgcttctgttcgtgctggcttggtgagcaaagcggggggcaacagcagcgggatccccgtgctggtcgacgaagacgacccgctcgcgctcgagtcgtttctaaacatcactctggt

SEQ ID NO: 6487 - DNA, 471 bp, Zea mays
  Clone ID: LIB3279-020-P1-K1-G6
gattttcgataaagagtttgagctgtcgcacacatcaaaaactaccagcgttttcttcagtggctacaaggttgagcagccattcgaggaagatgaaatggatcttgattctgaagatgaagacgaggagctgaatgttccagtagtcaaggaaaatggcaaagctgatgagaagaaacagaaaagtcaagaaaaggcagttgctgcaccttcaaaatcaaggccggattccaagaagagcaaggatgacgacgattctgatgaggacgagactgatgattctgatgaggatgagacggacgattctgatgagggtttgtctcctgaagaaggcgatgatgattcaagtgatgaagatgataccagtgacgatgaggaggaagacactccaactcctaaaaagcctgaggtaggcaagaagagagctgctgaaagttccgtgctgaaaactcctctatctgataagaaagc

SEQ ID NO: 6488 - DNA, 199 bp, Zea mays
  unsure (1)..(199): unsure at all n locations; Clone ID: LIB3279-020-P1-K1-G7
ccagccgtcgttatgtctaagcgaggtaggggaggtncggctgggaacaacttgcggggtcactgggtctaccggtggcgagcacggtgaactgcgcggacaacacgggcgccaagaacctttacatcatctccgtcaagggcatgaagggccgcctcaacctgtttccgtccggctgtgtcggcgacatggtcatggt

SEQ ID NO: 6489 - DNA, 438 bp, Zea mays
  unsure (1)..(438): unsure at all n locations; Clone ID: LIB3279-020-P1-K1-G8
gcctttgatatgatacttggcatttcttgcagtgaaaatagagatgattatgaaagggtctgggagaactttggaaaatttttaaagctgggtgccatggaagataaggaaaatcacaagagaattgctcctttgttgcgcttcttctcttctcaaagcaacaatgaattaattagcttggatgaatatgtggaaaacatnaaacctgagcagaaggacatttacttcattgctgcagatagtatgagcagtgccataaatgcncctttcttagagagactaacagaaaaagactatgaggttctacttttggtcgaccctatggatgaattggctatccagaatctgagctcctacaaggataagaaatttgtggacattagcaaggaagatttggatttaggtgataacaatgaggaaagagagaaggagataaag

SEQ ID NO: 6490 - DNA, 451 bp, Zea mays
  unsure (1)..(451): unsure at all n locations; Clone ID: LIB3279-020-P1-K1-G9
ggagaaagaagctaggaaggagaaggaggcgagggaagccggcagggagccggcggcgaaggagaggctgatgaggcgcaaggccgggaaggagacgggtggagaggggaaggagccggcgaaggaggtgaggggagagggcaagcagaacgacacgcaggagaaggcgaaggccaacgtctgcccgcagttcttcaaggtcttcttccccgagcagtccacggagcggctgagaatcccaaccatgtncaaccagcacctcaaggagcagcagccaaccggagcagtttccctgagaggcccgagcggcaacagatggcaggcagcgctcgcttccgagtccgagtcggaggccgcgtggtgcttcgaccagggctggaaggagtttgtcacggaccactccctcaggctaggccactttctggtcttcacgcgcgacgggcccggccag

SEQ ID NO: 6491 - DNA, 411 bp, Zea mays
  Clone ID: LIB3279-020-P1-K1-H1
gcgatctcttccccggcctcttgcttgctagcgttgtcaggaggggttctatcttctgtcgtgccttattaaaagatgtaaatgaaacatggtacataacttcaagaaacaaaaaacaaagaaaatgagaaagattggtgatattggatcaattcagtttgcatgcagagattgaaaattggtggcgtgtctgcatcagctcagtttgcatgcagcgattgtatccccatatcgagcggtactccttgggctaacaacagcagggaaacgtctggacacctgcttccaaacagcaggggaagggaaaaactgtcctgggaaacaaagtggaattgaaaagccaattaaatccatgtcggggctttccttccctaggctattagccacttgatgccaaacaaacccaagatc

SEQ ID NO: 6492 - DNA, 402 bp, Zea mays
  unsure (1)..(402): unsure at all n locations; Clone ID: LIB3279-020-P1-K1-H10
ggagattatgataaagctttcctcggatcgtattatagatcaggtgctcttggaattgagagaatatgccacagaggttgatgttgactttgtgcggaaagccgttcgtgcgattgggagatgtgcaattaaattggagagagctgctgaaaggtgcatcagcgttttgcttgagctgattaagataaaagttaattatgttgttcnngagagctntgattgttatcaaagacatcttcagacgctaccctatgncgtttgagtctatcatngctacactttgtgaaagtctggacactttaaatgaaccagaggctaaggcatccatgatgttgataattggagaatatgctgaaagaattgacattgctgatgaactttctgagagtttcttggaaacat

SEQ ID NO: 6493 - DNA, 367 bp, Zea mays
  unsure (1)..(367): unsure at all n locations; Clone ID: LIB3279-020-P1-K1-H11
atccgcctttgatataaagaagacgctcccgaatccgtctccgcctcctgtcgctcgctctccctgtctcccgcacgccgacccgcagccgccgccgttcgccatgggtttcctcgacgcgctctaccgtgtggtgatgcgccgcaacgccgtctacgttaccttcgtcgtcgccggcgctttcgcgggcgagcgggcggtggactactgcgttcacaagatctgggagatgaacaacctcgggaaaaggtaccaanacatatcggttttggggcagaggccagctgaggaatgataaattttggtcaccagtttgcttcggtttgacccgttcattttggcacaataataaacgaatgtaacttac

SEQ ID NO: 6494 - DNA, 95 bp, Zea mays
  Clone ID: LIB3279-020-P1-K1-H12
attttctacaaaacccggcttgctctagtgctgtcattgaacagggtcgttctactcaagcatgagtttgccattgaatggatgcaatactttga

SEQ ID NO: 6495 - DNA, 417 bp, Zea mays
  unsure (1)..(417): unsure at all n locations; Clone ID: LIB3279-020-P1-K1-H2
cggacgcgtgggcggcgcccgcagggcctcgtggcggatcatctcctccatcgagcagaaggaggaaggccgcgggaacgaggcgcacgccgtatccatccgcgcctaccgctccaagatcgaggccgagctcgcccgcatctgcgacggcatcctcgcgctcctcgacttccacctcgtcccatccgccggcggcgccgagtccaaggtcttctacctcaagatgaagggtgactaccacaggtaccttgctgagttcaagtcaagtgcanagaggaaggatgctgcggagagcaccatgaatgcctacaaagctgctcaggatattgctcttgctgatctggctccaacccaccccatcaggctcgggcttgctctcaacttctcagtgttctactacgagatcctcaactcccc

SEQ ID NO: 6496 - DNA, 285 bp, Zea mays
  Clone ID: LIB3279-020-P1-K1-H3
gaaaaaagagtcagcccaaatgtcatctacagcacacgtcatttgcccggtgacacggcaacgctggcagttggaggcattgacggcgtgctccgcgttatatgccaaagaactggtgacatcattcgcagtcttgtcgttgacgcagatctcccagcagaagccacatctagatcccggcagcaaatagagaagaaacgtgttcgaaggattgaccctgatgcacagttggacggtattccgaggcgtctgcgccctcaaattaccagcctatcggttgggatg

SEQ ID NO: 6497 - DNA, 400 bp, Zea mays
  unsure (1)..(400): unsure at all n locations; Clone ID: LIB3279-020-P1-K1-H4
ctcaaaaggaacatacattcggtccctatgtgcggacttgggtaaagcacttggaagctgtgctcatttaactgccttgcggagagactcgataggtgaatactcggtcaatgatgcttggaacttcgatgagcttgaagaacaaatcaccaaggggtatttatgagcatgccagtgagccgagctaggttatatgcggcttgcaaccagtggcatccatgctgccatgtcagtcccaaagctgtcaacgtgggcttcagcgaagagttgcanatccagttcagttcatcctcaaccttttgtcatatagaggaacacgaagctccgttagttgtatgtgtgttgtgggtttcaattgatctcagtattgaatcgattttggcagtattgatgtatacca

SEQ ID NO: 6498 - DNA, 267 bp, Zea mays
  Clone ID: LIB3279-020-P1-K1-H5
gtcaatatgaacatacattcggtccgtaggttccgactagaatataccctactgcagctgcgcgcgactgactgacgggctgacagacccgtttaccaagtactccatcctggtcgctccaaagcatctaacaaccagggatcggatcccgatgggctcattgtggacgtgccctttagccgaactggactatatccgaatagagagcattaccatgcctgctgccgtgtcagcattatggctcgacccatgtgcatactgacagag

SEQ ID NO: 6499 - DNA, 376 bp, Zea mays
  unsure (1)..(376): unsure at all n locations; Clone ID: LIB3279-020-P1-K1-H6
attctctacaaaacccgccttcctctagtcctgacattcaacaaggttgatgttgccaagcatgagtttgccattgaatggatgcaagactttgaggcatttcagacagctgtggaatctgacaaatcatactccgctacatatacccgaagcctctctctggttcttgacgaattctacaataatttgcgctctgttggagtatctgcgatttctggttctggagtcaatacattttttgaagctatagaagccagcgccaaggaatacatggaaacctacagggctgatcttgacaagaggattgcttgaaaagaaagattggaggaagagcgcangaaggagaatatggaaaaattgcagaaagatatgatga

SEQ ID NO: 6500 - DNA, 457 bp, Zea mays
  unsure (1)..(457): unsure at all n locations; Clone ID: LIB3279-020-P1-K1-H7
ggcacccattggcgtactctgatggacgtctttatcgcaaaggcctcttaatggtcggggtcgatcaatgccgccagcactattgatgtgcttaagcccatcgatagaacgacattggcattattggacgccatgtgcagacgacaagttctgctgaacaatgaacgacacttacttcaaatggagggtatgaggtaatcctaagccctntggggcaaagacaatagtctgcgaccaaatgatagaacccttgggcagggattanctggcctcaatacgtttgcattgctgctaactgcaccaaatatcggtgcgaaaagcacaatgatgcgtgccacctgactggctgntggacttgctcaacttggctgctatgacccctgcacgtcatgtgagtcgacccttgcggattacatctttactcgcctcggtgcaacagatcggattatgactgggg

SEQ ID NO: 6501 - DNA, 416 bp, Zea mays
  Clone ID: LIB3279-020-P1-K1-H8
cccacgcgttcgcgtgaacgcaaaacaacaaaatacatgacgaagtacgaacgtgcgcgcatcctgggtacacgagccttgcagataagcatgaatgctccagtcatggttgagcttgagggtgaaactgaccctcttgagattgcaatgaaggagctgagagcgcgcaagatacccttcacgatcagacggtacttacctgatggaagctatgaagactggggagtagacgagctcattgtggaggactcctggaaacgccaggttggtggagactgaagacgcggatctacttggcatggaaagggtatgtggtgcagtgggtctttcctgtagttacaagtcttcgttgccactatgagtggatactgtagcgaatgaaccaagacgaaatgatgctatgttaacttaacgtc

SEQ ID NO: 6502 - DNA, 310 bp, Zea mays
  unsure (1)..(310): unsure at all n locations; Clone ID: LIB3279-020-P1-K1-H9
attcgcgttgcagagggactgatgagatgagccagcgaccagcagcaccttgtacttgacggagacggcgtagcagttgaatgcgcggttgtcctcgcggagctccaggatgtcccgcgcgacctgcctcgccgtcgactccacgtaggggctgcttatgcactcgaagtcgctgcagagctccccgaagtccatgccgtcnaccatcttatgcgtctcagacctcttctcgggggggtgcttgaancccnncgcgactgggtgcacacgggtcaaccaacgcgtcgtacaccacgcaagaacgaacgcg

SEQ ID NO: 6503 - DNA, 296 bp, Zea mays
  Clone ID: LIB3279-023-P1-K1-A1
cttgggaattctgtgcagtctgatcaatttgatgaaatggttcatccaagtgacgttcttggtccatcaattcctggaccaactgttcttctggtggattgccccacacagtatcatatgccagaacttttttcactgcacccccttagcttcttttatgaagattctccagaacaaagtggcaagaaagtaaattgcataatccacttaggtccatcacctgtgactagatctgttgactaccacaactggatgaaaaaatttggtgcaacgcaacatatcatggcagggacatg

SEQ ID NO: 6504 - DNA, 382 bp, Zea mays
  unsure (1)..(382): unsure at all n locations; Clone ID: LIB3279-023-P1-K1-A10
ggaaaaaacattgttaagggagatgtgcttataggtcttccttccagtggtgttcattcgtaacgggttctctcttgttagaagagtactggagaaaagtggactttctttggatgatcagctcccaagaaatgatggcataacaactacggttggtgaagctctaatggcaccaaccttcatctatgttaagcaggtgcttgagattattagcaaaggtggtgtgaaaggactagcccacatcactggtggtggctttactgacaatatcccaagagtattcccctccggatgcggngcaaaaatttttactgggtcatgggaaatacctncaatcttcagttgccttcaacaggctggaaacattgatgacgcagagatg

SEQ ID NO: 6505 - DNA, 347 bp, Zea mays
  Clone ID: LIB3279-023-P1-K1-A11
gtttccagaccggataagatcagtgctgctgatattgctgctatctgccaagaggctggcatgcatgctgtccgcaaaaaccgatatgtcatcctccccaaggactttgaaaagggctaccgaaccaacgtgaagaagcccgagacagactttgatttctacaaatgagtcaacccagagtgttgaactcgtttctttctgcaaatgagtcaacccagagtgttgaactcgtttcttgtttatcaattgattatcttttaccatcagctgagtttatggatagttgccattacaaataattaagttcctcaatggtgatgtgtgttcttgaaatgattttttggatt

SEQ ID NO: 6506 - DNA, 357 bp, Zea mays
  Clone ID: LIB3279-023-P1-K1-A2
cccacgcgtccgcggacgcgtgggagcagccgcccggtgctccctctctgcagatctccgttggcagccgccgaggaaccccttcacagcgcggaagatggctgaacaggaggccccagtcgtggttgaggcaccaaccccagttcttggggagcctatggacttgatgactgctctgcagctcgtgatgaagaagtcaagtgctcatgacggacttgtgaagggtctccgtgaggctgccaaggccatcgagaagcacgccgctcagctttgcgtgcttgctgaggactgtgaccagccagattacgtcaagctggtgaaggcactctgcgctgagcacaatgttcacctggtcac

SEQ ID NO: 6507 - DNA, 399 bp, Zea mays
  Clone ID: LIB3279-023-P1-K1-A3
ccttggagcagcatttgtaccagagttggaagggaaatttttggcgacagaaaacttttaccatacttcaaagttctttggtctgagttcgaagcccttcctttctgatctgatggtggctggggagaaattttgccatggggattggtcgaagattaaaaataagtacagttcttttgatgacggacaactgcttcttttttgcttttcctcagcatatattattgctctactgcatgatacgcttaaaatgccactggatcataaaaggattgatgttgtaaaccaaatccatggcgtgcctgttgactgggcattgggtgctttcattgtgcagacgacgatgaacagaacagagtactcagattcatcagtttcatatctaaacagctatgactc

SEQ ID NO: 6508 - DNA, 157 bp, Zea mays
  Clone ID: LIB3279-023-P1-K1-A4
ttttagaggatccaagtttacgtccgcgtgcatgcaacgtaatagtttttttatggggtcacctaaattaaattcactggccgtggtttaacaacgtcgggactggaaaacccttgccgtacccaaattaaacggcttggaagaaatcccccttttc

SEQ ID NO: 6509 - DNA, 337 bp, Zea mays
  Clone ID: LIB3279-023-P1-K1-A6
cacgccttctcggactactcgctcctggacgacgtggtcggcctggtgctgcactcgtcgctcatggtgccctacttctcgtggaagtacagccaccggcgccaccactccaacacggggtccctggagcgcgacgaggtgttcgtgcccaagaagaaggaggcgctgccgtggtacaccccgtacgtgtacaacaacccggtcggccgggtggtgcacatcgtggtgcagctcaccctcgggtggccgctgtacctggcgaccaacgcgtcggggcggccgacccgcgcttcgcctgcacttcgacccacggcccattacacaccggagccgccag

SEQ ID NO: 6510 - DNA, 390 bp, Zea mays
  Clone ID: LIB3279-023-P1-K1-A7
gggtgctggcactcgatcatacagctaccgcgttgttatgcaaactggtgatgctgagctggaaatgcgagggcgctgcagtgctggtcagaaggttcttgcttctcttataatcagactagcacttgcggaaactttctgcctgaactgcggtatattggctttggatgagccaactacgaatctagatgggccaaatgcagagagtcttgctgctgcgctgttgagaataatggaagcccaggaagggcaggaaaaacttcaggtgattgtatcactcatgatgagagatttgccatcttatcggtcaaaggcagcttgctgagaagtactatcgagtctccaaggatgagaaccagcacagcataattgaatcccaagagatatttg

SEQ ID NO: 6511 - DNA, 374 bp, Zea mays
  Clone ID: LIB3279-023-P1-K1-A8
aactcctcctggcctcctgggtgtggaagcggcggcagcggtgcgcgattcagatcggcaacgacggcgacgcatggtccctcccgccaccagccacaatcgtcgccagcgaccttttccccgattgtacctgcactggttagagttggagaagaccaacccccaccgtcttgggacccggtaccatccccgagaggggttctccaagaatcagcatgctcttatcaaaaagtgcaacaaagaagccttctcctaaagctggtgatccaaaaaaacatggaggttctccaaaagagaaattaagagcaactctagagaagactcttgtggacctcttgcatgagcacaagacaacttgttataggggtcaaaat

SEQ ID NO: 6512 - DNA, 411 bp, Zea mays
  Clone ID: LIB3279-023-P1-K1-A9
gtatgtctctcacctggttattgtatcgtgaaatgattattatttatcagtggctgtcagagttattgaagatggttctcttaatgtctggaatcatgtacagacacaatgctacgcatcttgtcactttgaacagaaaaccctttgtaggcaaacaactacatgaataatgtagctgcctaactgtaattcatattctagtaggttcataggaaccttgttttggcatatttagggtttagattatgcatgtgtttctcagaataaactagcatgccacctatatctttgttaatcgttgtcctttgcttcaggaacggttgaaccggtcattgatggtctgtcaagataagtttgaagctgccaagctccagaagatgaaaacagatgcaactcaagaactggaatcct

SEQ ID NO: 6513 - DNA, 407 bp, Zea mays
  Clone ID: LIB3279-023-P1-K1-B1
accaaaagctttcttaatcttccgtgtgagggcactgtacgggggtatggataggtactcgaggggccggctgtctctgtcaaagacgtttataccttcgagtacccggtttatcccccacaatattcccacgaggggaggttacagacagtcattaaggtaaaccctattacagacacggccctaatcagacctgacctcgcggggcccatcactatgggtcgaatcacacatgagcctcccccgacagtggggatgtgggaggcccgcagacatcatgcggggccttcatctgcgacaccagagcgagggggagcgaaggggtctcaccggtcttctaacgggtcgcgcccccgacctgctctggcatgttgtggctgtagccttcttcagagtgatgaggagac

SEQ ID NO: 6514 - DNA, 411 bp, Zea mays
  Clone ID: LIB3279-023-P1-K1-B10
cccacgcgtccgttaatatatgcttgtttttttataaaaaaattgtggcaccaacgttgggcatggcttaaaagtagatgctcccaaggccatgggttgtacaacacctgcttgcttaccgaaaatatgcatggcttctttcttcttcagtggatgttctactatatagatcaacaaacccccgattgtactttatcacaaacaaaattttgaatcaatcgctggtgaagttctacgtggtgattttcattggtacctgactattgtgggcttttaaatgaacccttggcttggaacgtttatctttttcgataaatttcttggttggtctttgttttgattgaaattttgggacctatcgtcttattgtactgggtaaagatgttctctattgttctggaggcttatctt

SEQ ID NO: 6515 - DNA, 252 bp, Zea mays
  unsure (1)..(252): unsure at all n locations; Clone ID: LIB3279-023-P1-K1-B11
gttccacagatattagaacctttgagatccttcttcgcacgtatgaagtacnagacgttgctctgaagagcctgacctccgatgaggcttatgtggggcctcttccgcagaaaagaagaatgcccacaaccccaggtgaaaacacggactgcccacaaaggacttcctccattttggttaggccatgcatcagtgctagagggcacacggtgtacttaacctttgcaaggctttgctcttcagcattggcat

SEQ ID NO: 6516 - DNA, 421 bp, Zea mays
  Clone ID: LIB3279-023-P1-K1-B12
cccacgcgtccgcggacgcgtgggccggttttcagttggtggccacgcgcacggggacggggttcttcctttgctggcgcccccgcctccgattccgcgatgataacccaccatccctccctgctccgcccatctgtcctcaccctccgggccgacgtcctccgtcggcgcccaacactgtacgccgccgcctcctcgccgcctctccgattgtgggctttgcgcgccaccaccggtggaacttcgcccgtcagtggcgatggaggcaaacgcgctgtgccggttcccacgcgtgggcccgccctgctcggcttcgaacgtagcaacttcctcccgcttgctctcatcggcgacatcatattgggtcttctagatcctaccctaggatgccttgcacacaaatactccccctcaaaggacc

SEQ ID NO: 6517 - DNA, 433 bp, Zea mays
  unsure (1)..(433): unsure at all n locations; Clone ID: LIB3279-023-P1-K1-B2
cccacgcgtccgcccacgcgtccggtgaccatacattagcctggaagaagtgccttgtagacatttgtccaatttcatgatgattgaagcaactgcnaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggccgtttaaaaggatcaaagttaactaacgcgggcatgcaaagtaaaagttttttaatagggcaaccaaaataaaattaacgggccggggtttaaaaacgtgggaactggaaaaaccctggggtaaccaaaataaatcgctttgaaaaaaatccccttttcgcaagttggggaaaaacaaaaaaggccccaaccaa

SEQ ID NO: 6518 - DNA, 428 bp, Zea mays
  unsure (1)..(428): unsure at all n locations; Clone ID: LIB3279-023-P1-K1-B4
atttagaagcgcccctcctcctctcccccatccgtacccaatctaatcgacacccggccgagatgggccgcaagttcttcgttggtggcaactggaaatgcaatggaaccgcagatcaggttgagaagattgtcaaaaccctgaatgaaggaaatgttccctcttcagatgttgttgaggtcgttgtcagtcctccttatgtgttcctcccggtggtcaagagccagctgcgccaagagttccaagttgctgctcagaactgctgggtgaagaagggaggtgcattcactggtgaaattagtgctgaaatgctcgtcaaccttggcgttccctgggtcattcttggacactctgaaaggagagctctgctgggagaatcaaatgagtttgttggagacaaggttgcttntgctctgtctcagggacta

SEQ ID NO: 6519 - DNA, 430 bp, Zea mays
  Clone ID: LIB3279-023-P1-K1-B5
ctcttccttttcacatgggtgaccttcctcatcgcggaggcgtgcctgctggcgggatcagtacgcaacgcgtaccacacccggtacaggggcgtattctacggcgagtccctctcatgcgagacggtgcggaagggcgtcttcgctgctggcgcggcattcaccttcttcacggccatcctgggcgaggtatactacctcagctactccaaatcccgagatgccgctggtggtgctggctccagcattggcatgggcccttacaactaaaggagcttgatcgaggcaggcaggcagcccccgtgttttcaactctgggcgtgttcggctggctacaagccgacactgttgcagctgtttggactgctgcagctgcaatccatagagagaaaaatactgtagaagccgcagccgcagcccgattgcagcc

SEQ ID NO: 6520 - DNA, 115 bp, Zea mays
  Clone ID: LIB3279-023-P1-K1-B6
gccccatccggccatcccacagcgaatctcccaaaccccgcgtccctgcattcccaattgggagcggtatcacgtaagagatcacattacagcgacctgttgctgagcgagtcca

SEQ ID NO: 6521 - DNA, 421 bp, Zea mays
  Clone ID: LIB3279-023-P1-K1-B7
gtgaaattggggaagaaggatgccggtcaaaccggtgagggaaaggaggaggcgtgggtggtgctggccacacagctcgctagagcagtgcaggcactgtgcaggttgagtgtcgcccgggcaaggctctgtgccgagagatttgctgatgctgagcttcgggataagcttactgctggcattagcgtcgatgatttgagggggatgcttgacaaggttttgattgattcagatgctgtgtcagtcttgaagggggtgtacaaccacttgctcaagttcagggactttctctcctgggaagcagctatggccatggcagtaattgaaacagacagttcaattgagaagccgcaatctgctgttgacaacgaagcagctggttcaagtgaaaaggcacaggctggtggggacaaagcaaagg

SEQ ID NO: 6522 - DNA, 422 bp, Zea mays
  Clone ID: LIB3279-023-P1-K1-B8
tgaaatttatcggacatcccaaagcaaaaagcgttctgctctggaagatatccaggggaggattcgggagttgcagcttgatgagaaccggaaaagggaattggcaactgcccttcacgttcagttcaaggattggttatacgcttcgggcaatatccgccagctctactgtctacagggcgattaacgatgggatttgcaagactgactacccttttgccgactcctactccaaaacattcgacaattgtcgaaagctgaccttcctttccctgggagagaggattcccacccgcgcagaaggatgtgaagatgtactgttacctacttttttacagattcatttgggtatattccctttgctgcgagttggaggtactaattaggatgtaatctccaagcctactcattttttttggccc

SEQ ID NO: 6523 - DNA, 424 bp, Zea mays
  Clone ID: LIB3279-023-P1-K1-B9
caggaacagagcgaggcgacgccgcggcacctcttctccggcgaagggaaatgggggcgggttccaggggatctgatcgggcatgttgtgaggaagaacaactccttccttgtgaagcagttcggcaacggcaatgccaaggtgcagttcaccaaggagccgaacaacctctacaacatccactccttcaaacactcgggtttggcgaacaagaagactgtgacgatccagccagctgcaaaggactcggctgtggtcctctctactaccaagaccaagaagcagaacgcacctgcgaagctcagccacaagtctgtgatgcgcaaggagttccgcaagatggccaaggctgtgaaaaaccaggttagtgacaactactacaggcctgatctgaccaagccagctcttgctaggctaagctcgg

SEQ ID NO: 6524 - DNA, 426 bp, Zea mays
  unsure (1)..(426): unsure at all n locations; Clone ID: LIB3279-023-P1-K1-C1
tccaaagccaaaaccccaatcgcacaggagagaccgagagagaggtttnccatccatgggtgcccggcgtcgcttccgtgctggtcccgcaggagcccgtcctcctcaaggacatcctcgcctcaccgtccccctgcgggaacaccgctgtctccgcccgccacctcttcggcaacggagtcgcgccgccacgctcctcggacgacggcatcaaggacgccgctgccgaccgccacggtgaccgcgacctctccatccccaagatcttcaccggagacgtgctggacctgctcgacgatgctgcgaggctggacctgatgctggcgctgacgggggacggcggtgcggcgtccatggccggcttctccgcgcgcgggtggtgggtctcgaaggaggatggcgacgcggtgcagctgaaggtgccga

SEQ ID NO: 6525 - DNA, 430 bp, Zea mays
  Clone ID: LIB3279-023-P1-K1-C10
ttcccgggggggcgccacgcgtccgcgccctttcttctatttccttatttttttttactcatttggtttttttatttttcgttgtttttttttttttgtgtttttgttttttttttttttttttttatttttttttttttttttctttttttatttacaattatttttattttttttttatattttttagtaccccacggcggcaccaccccctaaatacgccgcccaacaacaaaaggggcggcccaccaaaaaacacaacagccccccccaaagaaggaggttatagaggactacaacaccctgcccaaaaaaagtgggcaccaaaaaagcggtaacaccccccccaaaaaagggggcggggggggccccccaaaaaattctaacggcccccccaccatccacccaagtcccccaggataaaaacaaa

SEQ ID NO: 6526 - DNA, 428 bp, Zea mays
  Clone ID: LIB3279-023-P1-K1-C11
ggattttgccgcaacagaagttgatcctggtgttgcatggtacttgtatccaagggttgggtacctcccctagtggggcacaactgaggaaacagctatttcttcattgaagaggtcgcttggtgctctgaacacacaccttgcctcaaacacataccttgttgggcatgctgttactctagctgacattgtattgacatgcaacctctaccatggaattgcacggatcttgaccaagaccttcacgtctgatttccctcatgtcgagaggtatttctggaccatggttaaccagcctaacttcaagaaggtcattggtgaggtcaagcaggcagagtctgcaccttctattccgaaaaaggctgctccttctaaggagccaaaggcaaaggatgtcaagaaggaggctccaaaggaggcccccaagc

SEQ ID NO: 6527 - DNA, 59 bp, Zea mays
  Clone ID: LIB3279-023-P1-K1-C12
gttcggcgcgaggccgcacgcgtccgttagctgtgtcctaaccacctcttacactaagt

SEQ ID NO: 6528 - DNA, 422 bp, Zea mays
  Clone ID: LIB3279-023-P1-K1-C2
agtatgcatctgtcagaaactttacaccttgcttcacttgccaagtagaatgtgaacttgtgtgtcttctatgtagtccgagatcaaagtaacatatgtgctgatttgcaaccccgactttgattttgttgaaatttaactagtggtttgctccttttgtagtttcactgctcaagtggcatcagttttatggaggtaatgtttccttgtttggcacttctatatacatttctgttgccatacttgtaccactttggtgtatacacacacacctgtgttttcataagattttatattttttcagcatgttgttagtcaatgttgcaaatatacgttcaatatgtaatcagtaagctgcctgactactcttccgggttcatgttcttttcaagaggaattttctggacatttcgttcctatta

SEQ ID NO: 6529 - DNA, 406 bp, Zea mays
  Clone ID: LIB3279-023-P1-K1-C3
gcgcgtccttactcctccccctccctcctaaacgacgcgagaagacgcaatcctgggagctccgaaccctagctcctaatttgaggccccggtgtcatcgattcctcaggaggcccgccgcgattcggctcccgtagcagcatagggctccaccgctccccagctgcatcagcatcgacggcggcggcgcgccgccgcgactacgctcgaggaagcacctagtctcggcgggttctcgttcttggaggccttccataaggcggtttcgtggtgtccgagcccggatctacggcgatctgcaagcggaaggcgatagatgaggcgattcagtggtaacccccaatccggtgggtttccggctggcagaggcggaaaggttcgggccttcggcgggtgatcagatttc

SEQ ID NO: 6530 - DNA, 434 bp, Zea mays
  Clone ID: LIB3279-023-P1-K1-C4
cggacgcgtgggccgccgcagcccgcagtcgcttgcgcgcagcagcacttcgcaccgccggcccatcccatcgccggcagtgtctgctcgatccgatggctcccacgaagaagtcgaagaagagcacagagagcatcaacaacaagctgcagctggtgatgaagagcggcaagtacaccctgggctacaagaccgtcctcaagacgctgcgcaactccaagggaaagctgatcatcatcgcaaacaactgccctccacttaggaagtctgagattgagtactacgccatgctggccaaagttagcgtgcaccatttccacggaaacaatgttgatcttggcactgcctgcggcaagtactacagggtgtgctgcctcagtatcatcgacccaggtgactcggacatcatcagtaccacccctggcacccagtga

SEQ ID NO: 6531 - DNA, 318 bp, Zea mays
  Clone ID: LIB3279-023-P1-K1-C5
gggggggcgcgacgcgtccgccaaacacatagagacccaccgccttcttttttctttaaagccgaaatccgaaatcgggcccccagacccagattgcacgacgcaaccgatccccaaatccccaaatcttcccagttccttcctcccgttcgacccagatcgaggcctcgatccaccggccatggcgctggagtgggtggtgctgggctacgcggcgggcgcggaggcggtcatgctgctgctgctgacgctgccggggctggacggcctgcgccggggcatggtctccgtggtgcggagcgcgctcaagcccatgat

SEQ ID NO: 6532 - DNA, 428 bp, Zea mays
  Clone ID: LIB3279-023-P1-K1-C6
cccacgcgtccgcccacgcgtccgctcagatataagctcaccagcactaccccttcccatcctctcccactccctcctccctcctccctccccccgtccagtccactgccattgggcgagaagccgagaaggacagggagggagcgagagcttgccaggccgtcccgtccagagccgctatgtccggcggcgcgcccctcctggccctgctgctgctggcggcggcggccatgatcgcgccgtccccggccaatgccgccgtgtcgtacgaccacagggccgtggtcatcaacgggcagcgccgcatcctcatctcggggtccatccactacccgcgcagcacgccggagatgtggccgggcctgctgcagaaggccaaggacggggggcctggacgtggtcccagacgtacgtgttctggaacgggc

SEQ ID NO: 6533 - DNA, 291 bp, Zea mays
  Clone ID: LIB3279-023-P1-K1-C7
cccacgcgtccgcccacgcgtccgaaaaaaaaaaaaaaaaaaaaaaaataacaagtagagggatataaaaaagaggggcggcctctttcctccctccttcctttccacccccttcttctcacttatctctctcttgtcttgtatttcctatgttctttccattccccctctttcttcacccttttttctggtaaagccccttctctacccatctctctctccttttaaaacatcttgctttccttctctctttcacttgctgagatacccacacccattgcctttcctaac

SEQ ID NO: 6534 - DNA, 336 bp, Zea mays
  Clone ID: LIB3279-023-P1-K1-C8
gggcgtacgcgtcctcccatgcgttcgaaatgacttctgaatcacccaagaatacgccaacatcgacgctcggagaaatgcttaaaagatcaaagacttgcatattcaatgttttacgggcgccatggttgtcgatgtgctaaacgacttcccagctttggcggtgccaaacttgatcatgtcgatcggtgctggcacagacccggccatacgctctggtgacatccttctaatgaagagcatccttgttgacgtcatcacctacattgatctcttgcgcaagaccctctgctgtatccggatgaactacctgtgggccctggactacaacgttct

SEQ ID NO: 6535 - DNA, 418 bp, Zea mays
  Clone ID: LIB3279-023-P1-K1-C9
ggcatcaccgccgcgacgacgatggcagcctcgctccaagccgcggccaccctgatgcggccggccaagatcggcggccgggcgccctttgcctcgctgccgtcccgcccgtcgtcgcaactcgcctgcagggcgttcggcgtcgacgccggcgccgccaggatcacgtgctccctgcaggacgtcgccagcaggtgcgtcgacgccgcgaagctcgccggcttcgcgctcgccacctcggcgctcctcgtctcgggcgcgagcgcggagggcacgcccaagaggctgacctacgacgagatccagagcaaaacgtacatggaggtgaagggcacgggcacggcgaaccagtgcccgaccatcgacggcggcgtggagtcgttcccgttcaaggccgtcaagtaccagatgaagaagc

SEQ ID NO: 6536 - DNA, 367 bp, Zea mays
  Clone ID: LIB3279-023-P1-K1-D1
ttcccaagacctcttcagacccgagaagcgcagctgcggccatggacgccaccggcactggagctggagggaaggcgaagaagggagcggccggtcgcaaggccggcgggccgaggaagaagtcggtgacgaggtccgtgaaggccgggctccagttccccgtcggccgcatcgggcgctacctcaagaagggccgctacgcgcagcgcgtcggcagctgtgcccccgtttacctcgctgtcgtcctggtgtacttatcctcttaggttttgtatctctcctttttctctttcattgtcatcatgatgttgttcttgtttatttgtcttgtgctgttctttattcttatcttttttttttattttta

SEQ ID NO: 6537 - DNA, 315 bp, Zea mays
  Clone ID: LIB3279-023-P1-K1-D10
gagagcagagggccagaggcgcagaaggcagtcgcggacaggaggaagaggaagaagaggcggcagcgagcgaggatgccgtgcctgaacgtgtcgaccaacgtgaacctggagggggtggacacctccgccatcctcgccgaagccttcaagtccgtcgccaacatcatcggcaagcccgaggcctacgtgatggttgttctcaagggttcggtgcctatggcatttggaggtacccaggagccagcagcttacggggagctggtttccatcggaggcctgaaccctgatgtgaacaagaagcttaatgctggc

SEQ ID NO: 6538 - DNA, 409 bp, Zea mays
  Clone ID: LIB3279-023-P1-K1-D11
cccacgcgttcggcaggggcgctagcagacgagcagagcaggctagcatcactggagcggtaccgcagcggcgcagtgcagtccgcagccgtccagcctcatcccgcatgcaggggctgttggcgctcctcgctcttagcctttttgttctacctcgtttgttatattgctcgcgtgtcttgcgcctatttgttgtgtgtcctcaaatgttttttgtatttatttttttttgctgggtttgtcctttcttttttagtgctttcagtttttcattttgtttctaaattctttttttgttttatccctccgttgttttatatgttctatcctttattattatttcttttaatttcttttttatttttttgtgtcgtgtttttttatttttttttttatttttttttttttt

SEQ ID NO: 6539 - DNA, 431 bp, Zea mays
  Clone ID: LIB3279-023-P1-K1-D12
gaaacctctcaaaccctagccgcctcctgcaagtttcagagctcaggaatctgcgcgcatggcgagtgagacggagaccttcgcatttcaggctgagatcaaccagctgctctcactcatcatcaacaccttctactccaacaaggagatcttcctccgcgagcttatctccaactcttccgatgcgctggacaagatcaggttcgagagtctcactgacaagagcaagctcgatgcgcagcctgagcttttcatccaccttgtcccagacaaggccacgaacacgctctccatcatcgacagcggcatcggcatgaccaagtccgaccttgtcaacaacctcggtaccatcgccaggtccgggacgaaggagttcatggaagcccttgctgccggcgctgatgtgtccatgattggccagttcggcgtcg

SEQ ID NO: 6540 - DNA, 426 bp, Zea mays
  Clone ID: LIB3279-023-P1-K1-D2
cccacgcgtccgcggacgcgtgggccctcccccaatcgtctcgctcgcaagtcgcatcggacggacggtctcaggcgcatcggcctcgccgctgcacaacgccggagacgatacgacggcggctacgggatgacggtcttccacttcctcaactgcgccttcctcaccttcgggcctcacgtcgtctactactccgccacgcccctgtcagagtatgatacaatcggcacttctataaaagcagctgctgtttatcttggaactgcgcttgtaaagcttgtttgcttggcaacattgctcaaagtacctgagaatgatagctttgacccctatcaggagttaatgaaagtttttattggattcatagatgtagctggactgtattttgctttgacccagctgacccacagaaacatctctcagaat

SEQ ID NO: 6541 - DNA, 305 bp, Zea mays
  Clone ID: LIB3279-023-P1-K1-D3
caaacttaatttcgcgccgccgccgtaccctatttttctaactcgaaattcggatacccggggaggacaaaatgacgcttggcccccctatccacaaggttaaacacgtctttggcgttgcgcacatcttcgcctccttcaacgacactttcatcatggaggtatctcagcattccaagtacttttgcgagttctgtgggaagtttgctgtgaagaggaaagcagttggaatttgggggtgcaaggactgtgggaaggtgaaagctcgtggtgcttacaccatgaacactgctagtgcggtcacc

SEQ ID NO: 6542 - DNA, 155 bp, Zea mays
  Clone ID: LIB3279-023-P1-K1-D4
tctcggccccgtcgccggcccgggccctccggttcgacctcgagtccggccacaccaagtgcgtctccgacgagatcaaggtcaacgccatggccgtcggaaagtaccacatcgtcgggcccgaccccaactcacccgacgcccagctccccgag

SEQ ID NO: 6543 - DNA, 425 bp, Zea mays
  Clone ID: LIB3279-023-P1-K1-D5
cccacgcgtccgggtggttcaatgaagcaaagcaattcggatggcgctttagatgctatggcgcggagaccagctgatcctgaagaagagcttagatggatgtctcaagaagttcgtggttatgttgaggctgttttgaatagtctggcagcaaatgttccgaaggctattgtgctgtgccaagtggagaaagcaaaggaagacatgcttaaccagctatacagctcgataagcgggcaaagcaacgctaagattgaagagcttcttcaagaggatcataatgctaagcgcagaagggagaagtaccaaaaacaatcatctctcctgtcaaaacttactcgtcaactcagtatccatgacaacagggcatctgtttcctcgtattctaatgacagcactgaagttgagagccctcgaacaccaag

SEQ ID NO: 6544 - DNA, 426 bp, Zea mays
  Clone ID: LIB3279-023-P1-K1-D6
cacaaatgtcactcttgagacgcctggcaagagcaagaagtggcatcccaaattctacagaagagatgaaagtagaaagaacttgcttatgggacaatggctagactttgtccgtgacaatcatgtgcaggagggagatatctgcctctttttaccgacaaaagatgagataagacacacatttatggtctatattcttcatgaaacaacccattctagatgtggggctggctttcaaagggttggcccatgccttggtggtgcatccagggcaaagatggcttcagaagttcatattgaggatgaaccaaccgctggagaacatgtttcgtcggacagtgatatgccagaaaattctcatgaacctctggagagcggagactcggatgatccatttgaacctccatactttgtaccatgcaggag

SEQ ID NO: 6545 - DNA, 422 bp, Zea mays
  Clone ID: LIB3279-023-P1-K1-D7
gcttatcagccttcgaacgagatgaaagatggcggtgaagctgcaccaaatgcaacagttccatcaaatgcgcaactggtggaagcaaggatggatgtcaatggcaacaagactggcccaaagaggaaacggacaagagtcggccgtgggggaaagaagctgagagtgtctgaagcccgacgtcaaaggcctgagcgagtaagggagcaaccgctagtctgcaacatttgcaacgtgacttgtgatacaagagctgtatttgacatccatctaggtggcaaaaagcatcaatcacgactcaagcgctctcaaggcccagatatgttgttcggtcctttggttgcgcgtgttcctccaaaccagtcagcagcacacatgacaggagctcttgaaccactgtaccatggcttgggagctccttt

SEQ ID NO: 6546 - DNA, 421 bp, Zea mays
  Clone ID: LIB3279-023-P1-K1-D8
acctaacgtaccctcttccgcgccgccatgtctgggaggaagaagacgcgggagcccaaggaggagaacgtgacgcttggccccgctgtccgcgagggagaacacgtctttggcgttgcgcacatcttcgcctccttcaacgacactttcatccatgtgacggatctgtctggaagggagacgctcgtccgcatcactggtggcatgaaggttaaagctgatcgtgatgagtcctcgccttatgctgctatgcttgcctcacaggatgtcgcgcaaagatgcaaggagcttggaattactgcattgcacattaagctccgtgctactgggggaaacaagaccaaaacccctggccctggtgctcagtctgctcttagagctcttgctcgatctggcatgaagataggccgtattgaggatg

SEQ ID NO: 6547 - DNA, 407 bp, Zea mays
  Clone ID: LIB3279-023-P1-K1-D9
cgccttcgctcgcgccgccgccgccgccgccgctacgccccgcacctcgcttcatttcgtgtcgccaagatgacgaagcgcactaagaaggcaggaattgttggcaaatatggaaccaggtatggtgctagcttgcgtaagcaaatcaagaagatggaggtatctcagcattccaagtacttttgcgagttctgtgggaagtttgctgtgaagaggaaagcagttggaatttgggggtgcaaggactgtgggaaggtgaaggctggtggtgcttacaccatgaacactgctagtgcggtcaccgtcaggagcacgatccgccgcctgagggagcagactgaagcatgatatagctctttatattattggggtttcctgtagttgctcttgtcaggcatgttgtgggg

SEQ ID NO: 6548 - DNA, 424 bp, Zea mays
  Clone ID: LIB3279-023-P1-K1-E1
ggcctggtgctggccgtgacctcgtcgacgctcttcgcggggctcacggtgcggcagggcgaccgcggcaccggccagtcgtggacgccgaccaacgtcaccgcgcccctggacgccgccatcgtggggttccgcgacctctgcctgcaggcggactacgcgggggcggtatccgtcgctgcctgccgcgacggcttgcagtggtcgctctaccccgacggctccgtacgcccgcccgcgtggctcctccttcaatggcagtgcctggctgctgatgccagcgggggtgtgacggtgaaactctgcgacggggctggatcgtcttgcgagcgctgggtgttccgcaacgacggcaccatcttcaacaccggcaccgggatggtcttggacgccaggccatctgcgggggctaatgctactgcta

SEQ ID NO: 6549 - DNA, 431 bp, Zea mays
  Clone ID: LIB3279-023-P1-K1-E10
gcgattgctctcagaaggcactagcacgcaaaaaccccacgagagagacgaatcttccgggtctctcggtggcgagggcgctctccgaccgctcccgcgagtcgctcctcccgagcttcctctacgcctcctcggcgcgctctttcgctgccacaggagccgccgcgcgcctccctgtctcctccccagcgcctgccacggctggagcaggaggcggcgtgccgttctcgatccaggcgcccaaggagaagatcgagatgtactcgccggccttctatgccgcctgcactgccggaggaatcgccagctgcgggctcacccacatggccgtcacgcctctcgacctcgtcaagtgcaatatgcagattgacccagcgaaatacaagagtatctcatctggatttggtatcctgttaaaggagcaaggggcc

SEQ ID NO: 6550 - DNA, 414 bp, Zea mays
  Clone ID: LIB3279-023-P1-K1-E11
acgcctttgggcgagcctatataagggtgaaggaatataacggcgggggtggtcgctcctactgacgtggccgaagcccaagtcgtagttacagcaaaagcaggagtccgtgtaaatcacccaggactcgccgttcatcatctagatcccggtcaagatctgtttcttctcgttcaaggtccccatcaaaaggacgttctccatcaagatcaccagcaagatcgaaatctcctaatgtttctccagcaaatggtgaagcagcaagccccaagaagcagagcccaaacaggagcccatctggctcacgctctcctgatgcgaagcctgaataaaattgctatgctgttaaaggattgcagatggagtcaggagctcttcttttcttaacaatttgcctctgttctagtaccatca

SEQ ID NO: 6551 - DNA, 429 bp, Zea mays
  Clone ID: LIB3279-023-P1-K1-E12
cccacgcgttcggtttaatgcaatctgtcacttttttggctaccaagctaggggagcagtgccttccaagtttgactgcgattatgcctatgtcttggggcatgtgtgctaccacatcatagctgccggtttgaacggttacatggccacagtgacaaatgttaagagtccagcgaacaagtcggcgatgtggtgcggctcctatttcgtctataatgactgcgcagcgatggtcgcgtggcccttcagccacccaaatcggaaagcctgctgttcacatggctagcgttgacttgaaaggaaaagcatacgatgtattgaggcagaattcttccacgtttttgttggaagatgtctacaggaacccaggtccgctccagtttgaaggaccaggtgccgattcaaagcctatctcactgtgcgtcgagg

SEQ ID NO: 6552 - DNA, 424 bp, Zea mays
  unsure (1)..(424): unsure at all n locations; Clone ID: LIB3279-023-P1-K1-E2
aaaaagtctcctcttttcctcttcctctcccgttgccaggcatggggttggcctagttgtgcccgttgagcactagcagcctccttgaaacctccagatctgtgcctccaaggcccccgttcctcggcaacaagccgtccagatggacaccgccgcgcccctgcaactgaaagcctgcgccggcgacgccgcggagaagctgctgctcgccgtcgcagccgagggtcctatctgtggtgtgccagacttcaagatgaggggaaagaagagtgatgagctcgaacctgtcgatgctggcgatgaagatgatgatggtggtgacgatggggacgaggatggtgactttggggaggaggntgaagaggacgtctcagaaggggagggatatgacaacccaaagggcaatgagaccaagaagcaaaga

SEQ ID NO: 6553 - DNA, 426 bp, Zea mays
  Clone ID: LIB3279-023-P1-K1-E3
cccacgcgtccgcctatctttcccaaagttggtggctgatgatgtgaaacaaacagtagagacatctgattttagtgccttggaggctcctgcaagtgtcccagatgaaagccctaagatggaaatgaaacatgatcctgaatcggagttgatcgaaactactaatgcagatgctgatcatgtaactgaccaaaaggctgaaaatgatgtggacgagccttttatgtccttgggtcaacaatatgcccaagctgatgatgcatcaagggatccctgtccactccctggaaaatttgaaccgtccaatgaggacagtggtgacgcatacaattctgagcacacactggagatggaaggtaaaaggtttgtggcaagaaagccatgcaatccagcgtttgctgctgcccaattgaaatttgaagagct

SEQ ID NO: 6554 - DNA, 394 bp, Zea mays
  Clone ID: LIB3279-023-P1-K1-E4
gaaaagatcagctagcgagagaagcaatggcgtcggctcctgcgttctgcgtcgcgctgctgctgctgctggcttccgccgctgccgtccaagcggtgccgccccaggccggcacgtcgtccacctgcagcactgacctcctccgcctcctcccctgcctgcccttcatcgagggcaccgccaccgtgccggcggacacctgttgcgccaacctgggcagcatggtgcacgacgagccgcagtgcctctgccaggctctcagcaaccccagcacggcccccgtcgccgtcaacatgacgcgcgtgatggccatgcctcggctctgccgcctcgacctcccgcccgccaccggcgcctgcgcagttgccggtcttcttccccatggaccatcacc

SEQ ID NO: 6555 - DNA, 428 bp, Zea mays
  Clone ID: LIB3279-023-P1-K1-E5
cgcgcgattgtgggaaatcctgtcacatatccgcacggtgcgcctgacccgtgaccgcgcggcggacgcggaaatgatccggcgcctcctgaccgagggcgacctggtgatctgccccgaggggacgacgtgccgcgagccgttcctgctccgtttctcggcgctgttcgcggagctgacggacgagatcgtgccggtggccatggagaaccagatgagcatgttccacgggacaacggcgcgcgggtggaagggttggaccccttctacttcttcatgaacccgagccccgggtacgtggtcacgttcctcaacaagctcccagccgagctcacctgcagcggcggcaagagcagccacgaggtggccaactacatccagcggctcatcgcgtccacgctgtcctacgagtgcaccagcttcacccg

SEQ ID NO: 6556 - DNA, 332 bp, Zea mays
  Clone ID: LIB3279-023-P1-K1-E6
cgttcgaacgactgtcggaaatcctgtaacctatccgcacggtgcgcctgacccgtgaccgcccgggtgaggcggtaatgatccggcgcgtcctgaccgagggctacctgatgatctgccccgaggggacgacgtgccgtgagccgttcctgctccgtttctcggcgctgttcgcggagctgacggacaagatcgcgccggtggccatggagaaccagatgagcatgtgccacgggacaacgtcgcgcggctggaaggggttgaacccattctacttctttatgaacccgaacccaatttacgtggtcacgtgcctaaacaagctccttgcc

SEQ ID NO: 6557 - DNA, 380 bp, Zea mays
  Clone ID: LIB3279-023-P1-K1-E7
cccgtgcgctccaccgcccatctctcctcgctacggcggcggcgctgctgctgctgatgctccctccatcagcagcagcagcagtgccggcgcctgctctcttcatcttcggagactccctcgtggatgcgggcaacaacgactacctcgtgaccctttccaaggccaacggaccaccgtacggcatcgacttcgaatcctccggcggcaacggcaagccgacgggaaggttcacgaacgggatgaccatcgcagatatcatgggtgagtccctggggcagaaatctctcgctccacccttcctggctccgaactcgagtgctgcgatcaccagcagcgggatcaactatggctctggttcttctggcatatttgacgat

SEQ ID NO: 6558 - DNA, 369 bp, Zea mays
  Clone ID: LIB3279-023-P1-K1-E8
caaaaacccgccactctcagatccgcacagcgacgccgccagccagacccgatccgctcgcctcgctagggttttcgtccccgcgccgccgcgctcccggatcccaccgaaacaaccatggccggcggtcccgcggcggtgtcgttcctgaccaacatcgcgaaggtggctgcggggctcggagccgcggcctcgctcgcctccgcgttgctctacaccgtcgacggcggcgagcgcgccgtcatcttcgaccgtttccgcggggtgctcccggagaccgtcggcgagggcacccatttcctcgtgccctggctgcagaagccctttatcttcgacatccggacgcgcccgcgcaacttcttcttcaac

SEQ ID NO: 6559 - DNA, 351 bp, Zea mays
  Clone ID: LIB3279-023-P1-K1-E9
acgcatacgcctatctttaccaaagttgacgactgatgacactaaacaaacagtaggggggtctaagtttagggcctgggccgctactactactacaccacatgaaagccctaatacgcaaacaaagcatgatcctcaatcgaaatggctcgaaactactaatgcatgtgcttatcatatcactgacacaaaaagactgacatgaggcgctcgagccttttatgtcctcccatcaacaataagcccatgctgatgatacattaacgcaagcatctccactccatggaaaatttacaccgaccaatgccgacagggcgcgatgatactgttctaagcacacactttaaatgg

SEQ ID NO: 6560 - DNA, 314 bp, Zea mays
  Clone ID: LIB3279-023-P1-K1-F10
gggggggcccacgcgtccgcctacacgttcgtggacacttcgacggacgctcccctttttccgtttccacttgggggggcttatactcggcggtgggacagcacttctttaccatatcaccaaccccatggcccaatactatgccacaatacctgcctcctcttcctcactactccgaccatcaacatatgactacaactgcaaagggggatagtatcccaacctgagctggcctagttggctgtctgctacatacatagtattgctcacctcgtatcttcggggtaaacgacctgcaaatgctgtacatgcaa

SEQ ID NO: 6561 - DNA, 428 bp, Zea mays
  Clone ID: LIB3279-023-P1-K1-F11
agtatttagcctcagcgtcaaatgataaatctgcaattatatgggaggttgatggggatggagagctattactgaggcatacattgagtggccatcaaaagtcagtgatgatggttgcatggagccctgatgattgtcagctcctcacatgtgggcaggaagaaaccatccgacgctgggatgttaaatctggcaaatgtcttcatgtttacgagaagtctgccactggtttgatatcatgtgcttggtttccagatggaaagcaattatctggtttagctgatcaaaacttttgcatttgggatttagatggtaaggaagtagattgctggaaagggcagggatcaacaggaacatctgattttgctgtagcaaaagatggaaaccttataataagcatgagcaagcagaacacaattcttctattt

SEQ ID NO: 6562 - DNA, 361 bp, Zea mays
  Clone ID: LIB3279-023-P1-K1-F12
cgggtctagaaaaacaagctcattagatttctaaaaaaatattgggagttattgggcgggggagcatttttggaaggtttaaagctttatagaagtcatcattttcgtttattggaagaaatatttttggaagttgaaaagatgatctaacatacaaccaaaaataaaataaaggggtttacataagcactacaggaagaaaaaatacagtaaacagaaagaatcccaatgatgttaataaaaaagaaatagaaataaaaaaatagaaaaaaataaggagcccaaagggggggggccttttttgggggttcaaggttcctatcccgggcccgccaatttaatttctttttatttgggaccc

SEQ ID NO: 6563 - DNA, 416 bp, Zea mays
  Clone ID: LIB3279-023-P1-K1-F2
cgcagagccagagcaggggaagacgacgcagatctcgccacgcgaacacagttagatcgagggagtaagtgagagtgagagccatgacggagctgttcgacacggccgtgaccagcctcctccacctgccggaggtgctggaccgcctcgccgccgcagacggcgaccggcggtcggccggccaccacgcggcgcacggccacggccacggacgcgtccacgggctcggcggcggcggcggagcgccggtggacatcgtggagagcccccgcgagtacgccttcgtgctcgacgtgccaggcctctccaagtccgacatccaggtgacgctggaggaggaccgggtgctggtgatgaacggcggcagcgggaagcggaagcgcgatgaggaggaggacatgaacggcgaatggtgc

SEQ ID NO: 6564 - DNA, 453 bp, Zea mays
  unsure (1)..(453): unsure at all n locations; Clone ID: LIB3279-023-P1-K1-F3
cggnccgaattccgggggggggacgcgtccggacatccttatctaggtactgactactgagagggggggctctgttttacttctgggcagggagatcatgggcctgacaatccagctccaaagaaagttgttgggagtctgggactatgtggagaacgaggctgcacttgtgatggcagaagttgtgacagtttgtttcccctgaaaattgtagatttgcatctgatttcctgtccaacagctaggtccctttcagagaagagagttgcttgttttgattcccacatccggaatctgaagttcagagatgtctccaaacaaccagaagatatgtacgtaagcaactaccaaagatcattcttattggagatattcagcgcaaagcccacccaccaaataatcatgatgttcttctttccctagctgttgcagagaggtcggaactgtttgggc

SEQ ID NO: 6565 - DNA, 434 bp, Zea mays
  Clone ID: LIB3279-023-P1-K1-F4
cccacgcgtccgtcctcctcgcgattccaatccacgcacgcctcctccgcttccgcctcgctcaggcttatagtcagtgatggaacacaaggaggcgggctgccagcagccggagggcccaatcctatgcatcaataactgcggcttcttcggcagtgctgcgacgatgaacatgtgctccaagtgccacaaggagatgataacgaagcaggagcaggcccagctggctgcctcctccatcgatagcattgtcaatggcggtgacggcgggaaaggacctgtaattgctgcatctgtaaatgtggcagttcctcaagttgagcagaagactattgttgtgcagcccatgcttgtagctgaaaccagcgaggctgctgctgtaatccccaaggccaaggaaggcccagaccggtgcgcggcctgcaggaagcgtg

SEQ ID NO: 6566 - DNA, 431 bp, Zea mays
  Clone ID: LIB3279-023-P1-K1-F5
ggctggcctcaagtatctgggtcctgatgttgatgctatgaaagctgtggccgatgcctactccaaaaggtctctgaagtacttcgaaactgctctccgtgattacaaagctcagctggaagaagatcctattgtccacaggcacctttcctcgctgtatgacactctcttggagcagaacctctgcaggctgattgagccctactcaagggtggagattgctcacatagcagagatgattgagctgccaatgaaccatgttgagaagaagctgtcccagatgatcctcgacaagaaattcgcagggacacttgatcaaggcgctggctgcctcatcatcttcgaggacagcaagactgaggagatcttccctgccacacttgaaacgatcacgaatgttggcaaggttgtggacagcctgtacatgagat

SEQ ID NO: 6567 - DNA, 370 bp, Zea mays
  Clone ID: LIB3279-023-P1-K1-F6
tttttctttttttgttgttttttttttttgaagggcaagggtgttgttcaactaacttcacattgcccttagggggccagggtaatcctgcgctgaccgtgaactaacaggttccaatattttagagcaccacatgataagggtgatggcccactatgcaaacttatagaccgctcatttaccctagggggaaagggccctctattatgcatgccttgaacaacaaactttgggtggccctattttcccgccggtcttaaaatcttacatgagtcttcacggttctttggagcgctccctaaaggatgttttaagccctcccatttgattagcgagccaaaaaggaaattctgcatgagcggttcttttt

SEQ ID NO: 6568 - DNA, 396 bp, Zea mays
  Clone ID: LIB3279-023-P1-K1-F7
accacgcgtccggttccttctctcgtgcgcctttgctagctttgggatcgatcaaagctggtgagcgagcgagcgagtgaggatcggaacatctgccagcatcatggcctacgagcatgcgcagctgtctgccaaggccggcgccggcagcaggttcgcggtgacgtacggcctgctgaggcagtacatgaaggagcagggcggcagcggcgccaccaggagcctctcgccggccgtgggcgtggccggcctcatgccggaagccgacgctgctgctgcggcggccgaggcgaccgaggagaggaccaccgtgctggagctcttcctcgagcaagctggcacgctcaaagacgagcagcaaacgaagaggaatgagcgcgcttacgggagagcgcc

SEQ ID NO: 6569 - DNA, 464 bp, Zea mays
  Clone ID: LIB3279-023-P1-K1-F8
acgcatctcgacaggactcgctacccgaaagtgtaaccgtctcggccaacaaccgtgtctctctggtggcaactttccttgcgcatgtgagggatactaaataaaaggtccttgggatgactcactactacaactagaaatacatctccttcaccttcactgttaagcaatatagcttccgtctagaataacatgacctctctaaactctgcaaaacaatgctatttcgattgagcattttgcactcatgcacgaatagcttctaaaacgcaatagagtatgcattgcatttgacatgtcacgattccagaggttaaataatgtaagcatcctctctgcaacgactttcagtcacctaacataagggtggctagccatcttcctcccctgataagaaagttatcagcgtcagttgccagcatctcaaacagagaagtatgagatgagctcttatctctgcttca

SEQ ID NO: 6570 - DNA, 218 bp, Zea mays
  Clone ID: LIB3279-023-P1-K1-F9
acgcttatttatttacttactactaaacagttttttctctatatacttaatatcacgcgcagcatttacatgacaatccaactccaaaaaaaattttataatatctttaactattttcaaaacaaaacatcacttcttatttcataagtttttacattttatttccccttaaaatttttaaattttcatcttatttcctttccaacatctattttccc

SEQ ID NO: 6571 - DNA, 463 bp, Zea mays
  unsure (1)..(463): unsure at all n locations; Clone ID: LIB3279-023-P1-K1-G1
ggcccgnnccgaatnccggggggggcacgcgtccgggcaaaccggcaaggggagcgaagcggagagtctcgagagcaagggagcgcggtgacgggagcgttttccagggtttctcgatcggctgctatggcgaccagggtagcgtcgagattcctgcagcgcaggctcctgtcttccggcggcaaggtcctcagcgaggaggagaaggccgcggagaaagtgtacatcaagaaaatggaacaagagaagctggagaagctcgcacgcaagggccccagctcaggagagcaagcttcgtcgactacagtctctgcagcaagtgatgtgaaggctggggctgggccaacggagtcagcgtctgcaaacgtgtcaaccgacaagaacaggaactacgctgtcctggcaggcacaattgctgctctgagtggcctgggttggtatctattgtcaaagcctaagaagt

SEQ ID NO: 6572 - DNA, 367 bp, Zea mays
  Clone ID: LIB3279-023-P1-K1-G10
ggggcgtggggcctacgcgtcacattaaaacatgcagtctccttctactgggatgaataacatttctacatgttccactgcggtgagacagtcttatgggggggaggtcacctaatgggtaaactgaataatctgcaatgattaaaaccaggaagatgctgccgcgtgtgttgtattccaatattgattattggtgttaagtgacatacatttagtctgctgggtgatattaccggttgacagtgatgagcccatgctgtcactcgcaagcttggtaatagtagttagcatgagtttggtgcccagttacattataacttatcgtaccttcgagaacataataatttcccagcaattgtttcttttc

SEQ ID NO: 6573 - DNA, 431 bp, Zea mays
  Clone ID: LIB3279-023-P1-K1-G12
cccacgcgtccgcctgaaaggacgggaaaacttgtacaaaaaagaagctatcgggctcggtagaagattccaaaatgacgttggcgagctggcgaccgaagaaagtaagaatttcgccgagaggaatatatatctggttcttgttcccaataagatagctatacagaaagaacaggatgaattgaacaaaaagggtgctgtgagagaagagaaagcccattagacgtggtgaaccagaagagaacgccaaccagacagtggtgtacccctgtcagaactggtggagggaaggtttgaacccgagggaagaggtttcagcaaacgtttgatttgaactgtagaggccaaggtgccttgctgagattgaaacaagtatcacgcaggtacagttgctgtagaattgcagctctcgtaaatacaaggcaggctgg

SEQ ID NO: 6574 - DNA, 450 bp, Zea mays
  Clone ID: LIB3279-023-P1-K1-G2
tccggggtggcgcacgcgtccgccttgctcgacccttgcccgccgcctgaactcgcctcccccgcggccggtcccctgcatgctgttcgccgcgccgcaacccggaggagactactactacgagcaccaccaggacaccaggtagcagcaactgttttgctgcaatctgacaaagtggagggtttaagagtcgctgcttcttttatgtctgaacaatctttgctttatttgggattgctgggagagtattcttgcgcgacgaggaaaaggcacaagtttctgctccactgcatgcatcaagagcccatccggtttccttgttctgaggtgtcattcgctagtgctcagagccggcttggttttctcgaaagatcagcagccactcttgattcaggactttgtcacacctgatagcatctagttaatacatctttatccaagatggcactg

SEQ ID NO: 6575 - DNA, 469 bp, Zea mays
  Clone ID: LIB3279-023-P1-K1-G3
gccgcggccgggccgggattccgggtggcggacgcgtccgcccacgcgtccgcccacgcgtccggacaaatatgacaatggtgtcatcactccaagaccaccacctgttcattatagcagaccatcaagaactgacaggaaccgtaactaccgaggaaactaccaggatggccctccacagcaaggaaattaccagaacaaccgtcctccaccagaaggtggttaccagaacaacccgccgcagcaaggaaactaccagacataccgctcgcagcaagatggaagaggctatgccccacagcagaattatgcacaaggtggtcaggatggtagaggttttggaaggaatgattacacagaccgttcaggctacaatggaccacctgattttcgaagtcaaactcagtaccaagggcatgtaaatccagctgggcaaggtcaaggttacaacaacccccaagagcgtagc

SEQ ID NO: 6576 - DNA, 394 bp, Zea mays
  Clone ID: LIB3279-023-P1-K1-G4
gtttaattttcacaaggtttacctgatactagatgaatttattcttgctggggagctggaagaaacaagcaaaaaggcaataattgagcgaatgggtgaactggagaagctggaatgatgaagaccaggaagatgctgccgcgtgtgttgtattccaatttgtattattcgtttcaggtgttttacatttgctctcctggttgttcgttccggttgacagcgtgatgcccatgctgtcactcgaaagcatggtagtagtagttagcatgagtttggtgcccagttacattataacttatcgtaccttcgagaacataataatttcccagcaattgtttcgttcccctctgcagtgaaaaagaaaaaaacaaaacagcacgttattcgtgcgact

SEQ ID NO: 6577 - DNA, 427 bp, Zea mays
  unsure (1)..(427): unsure at all n locations; Clone ID: LIB3279-023-P1-K1-G5
cgattcccaatccagcaaaccctaccagccttttgcaaactcagagagggacccgatggcacccaaggcggagaagaagccggcggcgaagaagcccgcagaggaggagcccgcggccccggcggagaaggcccccgctgggaagaagccgaaggcggagaagcggctcccggcgggaaaatccgccggcaaggaaggcggtgttgacaagaaggggcggaagaaggccaagaagagcgtggagacgtacaagatctacatcttcaaggtgctgaagcaggtgcacccggacatcggcatctcctccaaggccatgtccatcatgaactccttcatcaacgacatcttcgagaagctcgccggcgaggcggccaagctcgcccgctacaacaagaagcccaccatcnacctccgggagatccagacc

SEQ ID NO: 6578 - DNA, 308 bp, Zea mays
  Clone ID: LIB3279-023-P1-K1-G6
gtttggctgcacacctttgcatagagctgcaagcactggaaacgcggagctgtgtgaattcctcattgaggaaggtgctgaagttgatgctgttgacaagacaggacaaacacctcttacgcatgctgttatatgcgagaacaaaggggttgctcttctgctaattagacatggtgctgatgttgatgtcgaggacaaggaaggctacactgcccttggccgagcatcgaacagcttcagacctgcactcatcgatgcagccaaggcaatgctcgaaggatgatctggtgctctgctcaaagacgatg

SEQ ID NO: 6579 - DNA, 261 bp, Zea mays
  Clone ID: LIB3279-023-P1-K1-G7
atcgaaatatattcgtcatgctaaagctactatcacttgaaacaccaatctctggggaggaatcataaacaaaggtggtgaatattaatctcactacatgactctacaaacaccttttactaatgctcttatattctataactaaagtgttactctactaataattacacatttaacatctatctatatttctcacaattatgtattcactctcctagtccgaacatctaacactttcaaacctcatcttattgatccatc

SEQ ID NO: 6580 - DNA, 425 bp, Zea mays
  Clone ID: LIB3279-023-P1-K1-G8
ctctgagaacggaaccatgattgagaacatgataaaggagggaaagattgttccgggggaggtgactataaagcttttgcaggaggcaatgataaaaagtgaaaatgacaaattcctgatcgatggatttccaaggaatgaggagaatcgtgcagcctttgagaatgttaccaaaatttctcctgcatttgtgctattctttgactgttctgaagaagatatggagaaacgactcctggggcgcaatcagggaagggttgatgataacattgaaactatcaaaaaaaggttcaaaacctttgatgactcaactctgcctgtcattgagcattacaactcaaaggacaaggataaaaagattgatgctgcaaaaccaatccccgaggtgtttgaagacgtcaaaaccatttttggcccatattctt

SEQ ID NO: 6581 - DNA, 298 bp, Zea mays
  Clone ID: LIB3279-023-P1-K1-G9
cgctgtctgtcaaccagtcggtcaactgttccttcttgacaatgacactaaaatcggggagggcttgctaactgtggagggggtgtatccatcaaattccggaacatcggaaaggccttccatattggggttgctagaagtggaaaaactcccatcttgcggtctccagaccgtgaatcatatgcacagactaagactaaagagtacgatgccattgctacgaattaccttacctatgtactttctcctccttgcagcggattctctatctattcacttaagtatgaaaagcacaaga

SEQ ID NO: 6582 - DNA, 464 bp, Zea mays
  Clone ID: LIB3279-023-P1-K1-H1
gcacgccggccggaccggaactgactggtgggggcgcgcgtccgtctgtgcacctacttgtatgatactctgaggcctagactgatatatgaaggaaacattggttctctttgcgaacttgttgatattctgaaagttgaagtgctgggggaacaactaagcagacgcggtgaatcagtagccggtctccgtccaatattgcaaaggatacttgcagatgttcatgagcggctagcattttgtgctcggactcatatccgtgaagagattgcaaatttccgtccttctgtcgaagatctagattatcctgggaaacttgaacgacctgtggatatgtcttcaagtgctactgttggtgacaactcagacatatatataacatggtacagaccattggagaaaacagtttcatgcctttcaaagctatatcgctgcttagagccttctgtcttcactggattagc

SEQ ID NO: 6583 - DNA, 113 bp, Zea mays
  Clone ID: LIB3279-023-P1-K1-H12
gaaggtattggctaaaggctaaccttttaaccaattatttaacgagccaggaggttccgggcttggttaaggaggggcgcctcctaaataactaaaggaggaatccgggggga

SEQ ID NO: 6584 - DNA, 429 bp, Zea mays
  Clone ID: LIB3279-023-P1-K1-H2
cccacgcgtccgcccacgcgtccgagtttccccgggactatgatggtgcgtgcctgcagatgcggctgtcgtacagtcccgcagctcatatattcctcttcctggtgcagtggacggactgcagcctcgcaggggctcttggtctgctgagaatcctcatatacaaggtttatgtggatggcacaacaaccatgtcgactcatgagaggaaagccagcatcaaagaattctatgctgtgatatttccttctttgctgcaactgcaaagggggatcactgatgtcgaggacaagaagcagaaggccatatgcatggagaagtacagaaagaaagatgaggatggacgggacaccttatctgatattgatgttgagagggaagaggagtgtgggatttgcatggagatgaacagcaaagttgtgttgccca

SEQ ID NO: 6585 - DNA, 427 bp, Zea mays
  Clone ID: LIB3279-023-P1-K1-H3
aaccaacctcctccttttccgcatcgcatcgagagcggggctgtaccgtgcgagactctactgctcgatcgccatggccgccgcgctcaggtgcccggcagagccgcagcggcggcgtcgccgtgcgggcgtcgctgttctcgcccaagcccgcggcggccaaggacgcgcggccgaccaaggtgcaggagctgtacgtgtacgagatcaacgagcgggaccgcgagagccccgcgtacctgcgcctcagcgccaagcagacggagaacgcgctgggcgatcttgtccccttcaccaacaaggtgtacaacggcagcctggacaagcggctgggcgtcaccgcgggcatctgcgtgctcatccagcacgtccccgaccgcaacggcgaccgctacgaggccatctacagcttctacttcggagacta

SEQ ID NO: 6586 - DNA, 350 bp, Zea mays
  Clone ID: LIB3279-023-P1-K1-H4
gtaattttggagatatatttgacgggaggcatttcatcaactttttgaaagatgaggggcgcgtaattgaacagtttccggagaggcttggtccaagagattcaaccattattatactggaaatgccacctgtgagctggtcaaatgaaaaatattacttgcatcaaatcctaccgttgttaaacaaatccagcttcatccatttaaccaaaccaatggctcgcttagccaatattggtttcagaccagagcttaattggctaagaggccgggttaattttcatgccctgaaatccacacttaaaatggagggattagggaataaactggtccataaactgcaggccagg

SEQ ID NO: 6587 - DNA, 112 bp, Zea mays
  Clone ID: LIB3279-023-P1-K1-H5
aacgccacgccgcgagactcccacgcggtccgcccccgcgtggtttggcctcgcaatggccgccgccgccgactacaaccgcgcgcaccgcccgtacgcggctcccgccccg

SEQ ID NO: 6588 - DNA, 279 bp, Zea mays
  unsure (1)..(279): unsure at all n locations; Clone ID: LIB3279-023-P1-K1-H6
gtccggcaggtatttgcttaatgctcaccttcttaaccatctatctatcgagcaggatggtccgtgctttcttatggaggggcctccgtaatcagctaatgnantaatctgtgtgaacttctctttttttgtcaataccatatccttactatcattatttaccctctttattttgtctcgaacacaagatttctgatgttatgttaaactgttttcaggttataaaattgtatgaaaggtgtgtgattgcatgtgctagtaattcagaattctggatcc

SEQ ID NO: 6589 - DNA, 448 bp, Zea mays
  Clone ID: LIB3279-023-P1-K1-H8
tcccgggggggcgggcgcgtacttaccaacctccttctcttcctatcgtatcgatagcgctactgtaccgtactatactctgcgccacattctcaacggggggtgtccattatttcaaatacaacaactgcaacgacgccttcacgagctgtcatggataggtatacgaagatgagcaacgctatgaagacgtatgggaagggcatcttcttctcgctgcgcgaatgggggaggcaaaaccctgctacctgggcaggcggcatggggaacagctggagaacgaccgatgatatcgccgacaactggggcagcatgacgtctcgtgcagaccagaacgacaggtgggcttcctacgccggacctggcgggtggaacgatcctgacatgcttgaggtgggcaaccgcggcatgtccgaggcggaataccgctctcactttaacatttggg

SEQ ID NO: 6590 - DNA, 433 bp, Zea mays
  unsure (1)..(433): unsure at all n locations; Clone ID: LIB3279-023-P1-K1-H9
ccgggtcgccggcgcgtccgcaccaacctcctnctcttccgcatagcatcgagagcggggctgaaccgtgcgagactctagtgctcgatcgccatgggcgtcgatctcaagtgcccggcagagccacatcggcggcgtcgccgtgcgggcgtagctgttctcgcccaagcccgcagcgtccaaagactcacggccgaccaatgtgcaagaactgtacgtgtacgagatcaacgagcgggaccgcgagagccccgcgtacctgcgcctcatcgccaagcagactgagaacgctctgggcgatcttgtccccttcaccaacaaggagtacaacggcaacctggacaagcggatgggcgtcaccgctggcatctgcgcgctaatacaacacattcccgaccgcaacagttaccgctaccaaaccatttacagctta

SEQ ID NO: 6591 - DNA, 313 bp, Zea mays
  Clone ID: LIB3279-031-P1-K1-A10
cagaggtgggctggcttctcctccccctcttaccaagtcctcttcgggttagggttacttagggttttgtggaggggcgatggcggcggctgatgtggagtaccgttgcttcgtcggcgggcttgcctgggccaccagcaacgagtcgctggagaatgccttcgcctcctacggcgagatcctcgactccaaggtcatcaccgaccgggagacggggaggtctcgcggcttcggcttcgttaccttctcctccgagaactccatgctcgacgctatcgagaacatgaacggcaaggagctcgacgggcgtaac

SEQ ID NO: 6592 - DNA, 317 bp, Zea mays
  Clone ID: LIB3279-031-P1-K1-A11
ccccaaacaaaacacctccataattcattgcttaaattgttccaaaacaatacaacggaaaaggggcttgtttttgccaagtgttcaacacatcagagattttcagataacagccttagtttacttacatgaactcaccagtttgtcatccaatttgcccggaaaaaatgtatctgggcagaacatcataacctaaactgtgtttttaaacgatccgacgaatacaataatcccaatataactcatatttgagtttgattgccctgaccaacccccaataaatacctctgggggttaaaactacatattcacatttt

SEQ ID NO: 6593 - DNA, 377 bp, Zea mays
  Clone ID: LIB3279-031-P1-K1-A12
cccacgcgtccggttgatcatccacatttcatatagccaatgtagacacctatgaagatgtgtaagtcaaaatggatattgaactgatttagagtttgaacaaactggttttcttttctgttactgcacttttttgtggtcctaacttctttttatggttgtagcaagcaagtcaggtgtcttgggaagtacttgagcattagttttatatggaactgctttaaatggttcttcagcggtgttggagattcttgtggtttcgataatttcccttctttgggacttgcagcatttaaaaatacgtaagtttgctatgactgttttgatattcctttatggctagtcggatgcccattccagtattccacatattgatt

SEQ ID NO: 6594 - DNA, 53 bp, Zea mays
  Clone ID: LIB3279-031-P1-K1-A2
aacaaacatggttgtagggagaggataggagaggtagaggagaggttttttct

SEQ ID NO: 6595 - DNA, 400 bp, Zea mays
  Clone ID: LIB3279-031-P1-K1-A3
ctggaggagagcctcggaaccttagactctacccgtgcggtttatgagagaatattggattggcgaattgccactccacagataattctcaattatgcatatctcctcgaggagcacaagtatttcgaagatgcatttaaagtgtatgaaaggggcgtgaaaatattcaagtatccccacgttaaggccatctgggtgacctaccttacaaagtttgtacatagatacaagcgaagcaagttagagcgagcaagagagctttttcatgaagctgtccaacaggctcctgcagaggaaaagaagcccctatatttacaatgggcaaaacttgaggaagactttggttttgcaaaacgtgctatgaatgtatatgatgaggcttgaagagctgtttctaact

SEQ ID NO: 6596 - DNA, 217 bp, Zea mays
  Clone ID: LIB3279-031-P1-K1-A4
ccggctactcctccccctattaccaagtcctcttcgggttagggttacttagggttttagagaggggcgatggcggcggctgatgtggagtaccgttgcttcgtcggcgggcttgcctgggccaccagcaacgagtcgctggagaatgccttcgactactacggcgagatcctcgactacaaggtcatcaccgaccggaagaccgagcggtataccg

SEQ ID NO: 6597 - DNA, 335 bp, Zea mays
  Clone ID: LIB3279-031-P1-K1-A5
gaccgcgctcgtcgtcccccgccggcccgcccctttcttgctcgagctgccgccacgccgggtgtgccccctccctgcgatccatccacgactgcgctcgctgcccccgctcgagacgctgacacgccctcgtacgagatctgcgccccctccgctccatccacgaccgcgccccccaagcgagtcgccgccatttcgccgattcccggccgctgcctagggttttggtgccagcgcggtcggagggttgtgcctgtgggtcgcgttcccagtgtcgcgcgcggcggcagaagggggagggagtggcggttctccggagaggaggtggaggaggt

SEQ ID NO: 6598 - DNA, 387 bp, Zea mays
  Clone ID: LIB3279-031-P1-K1-A6
cccacgcgtccgcccacgcgtccgcggacgcgtgggctgggacccgaagggcaaggttggagcgatcacccctcttccggacctggtgaccatccataccccgaaggaggaggacgagctgcgccctgctgtcttggcagctgaggtctaaggttccaacagcgtcctcgaaatggcagtttgatctggtcctagctaggtttgtatcttatgataagggcagtgctaagacagttcgttccgtgtcacttctgtttaaaattaagttttgccgagacaagctatatgtaccggatgaaagtgtggttccttattgtatgctctggaattttaattttggtatgtttattttttgccttagttcaacatgccttctgcttggacaaa

SEQ ID NO: 6599 - DNA, 426 bp, Zea mays
  Clone ID: LIB3279-031-P1-K1-A7
cgcactccgcaattccgcatcacgcaccccaccccaccgcccgcaaccgcaagctcagagtccctcccaccccaccccaccgtcccgctcactccagcccagcccgcgtccccacagcccagcgacagcgagcaccggcggcatccagccatgtgcggcggcgccatcctgtcggacatcatcccgccgccgccgccgcggcgggtcacggcgggccacctctggcccgagagcaagaagccgaggagggctgcagccggcaggaggagagcccccgtggagcaagagcaggaggaggatttcgaggccgacttcgaggagttcgaggtggagtccggcgagtcggagctcgagtccgaggacgagcccaagcccaagcccttcgccgcccccagcagcgcgcttgccagaggtggactaaacact

SEQ ID NO: 6600 - DNA, 469 bp, Zea mays
  Clone ID: LIB3279-031-P1-K1-A8
gtccccggatcccggccacacgccggcgcaaggcgaggaatctgcctccccctcctcgtggcctcccagaaagctccagagtttcacaccagggctgtggtcacaatacaaagcttatgaggatgcagttgtggagaacattaaaggaactattgcggatgctctggttcttgtgagagagcatcaggcggaggcaattggatgtgccactgttgcaggattcattctgttcagaggccctcgaagatttttataccgcaatacctttggccgtttgaagactgagaaggatttactgaatgatgccgagcaaagtatgatggagtaccaaacatctattcagaacttgaagaaagaatcaaaatacactctttgcaaagtagctatcggtgaaagcgatgtgcagcgtgggcgaactgatctgagatctactgggaagcagatacaatctcttataggttccatttac

SEQ ID NO: 6601 - DNA, 341 bp, Zea mays
  Clone ID: LIB3279-031-P1-K1-A9
aacacgcgtacgctcacgcgtactggacaagctcaaggctgagcgtgagagaggtatgacgattgatatcgctctgtggaagtcagacaccaccaagtactactgaacggtgattgatgcctgtggacaccgggacttcattaagaacatgatcactggtaccttcgaagctgactgtgctgttcttatcattgactccagcactggtggtatggaagctgatatcttaaaggatggccagagccgtgaacatgctttaactgcgttgaccacttggagtgaaacaaatgatttgctgttgcaacagaatggatgcatgcactcttaaatacttccaggca

SEQ ID NO: 6602 - DNA, 419 bp, Zea mays
  Clone ID: LIB3279-031-P1-K1-B1
tcggccacctcaacccaagtaacagagcgaggcgacgccgcggcacctcttcttcgttgatattgaggatttaggcgaagggaaatggcaaccgttccaggggatctgatctggcaggttgtgaggaagaacaacttctttcttgtgaagcagttcagcaacggcaataccatggtgctcaagaacaggacggttgtccacggcaccatcattcactcctttaaacacttggattttgctaacaagaaaactgtgactactctttcaggtaaaaacgatttgactgtggaccaccttaccgtgcgaggaaacaacatgcgctattacattctttctgacagcttaaacttgattcgcatggagtttcacaagatggtcaatgctgttgaataactaggtttgttgcaactacttctttt

SEQ ID NO: 6603 - DNA, 320 bp, Zea mays
  Clone ID: LIB3279-031-P1-K1-B10
gctaatcaaggggtcaggcctataacataaataccgaggccgctaccgattacctagttaggagggaggcagcctgacaaggccactattggcatagcgagagtggcagcaccatgagggctggtgattgtctacgtgggagggctcacctacggagcgacagatagtggtggcggctatcgtggctaccctggcggcagccgtggctccagggccagggagagcattggatactgcagggaacgagaccacgcctgctcaggcgtgtcccttgttgcagactagtctcatataacatacggcggtgcttaggctatcat

SEQ ID NO: 6604 - DNA, 350 bp, Zea mays
  Clone ID: LIB3279-031-P1-K1-B11
attattgtcgcaaaaaatcgactgatagtcaaacaacaacgattagtcagaaggagtcggagggctgctaccgctcacaagctctatcttatccaactatctcacgtcggtgctcacgtaccgtgatacaaccatcttcaccttcgagtccgttgaatagggttatgagggcattaatgttgtgattcagattaacctagcttttaattagctttcggccaagatctactagctgaatggttcaccccatcgatgacggtgtcgatcgcttacaaggaagatatagcgtgttacgatcgcccggttgtaggcgaggtactatgggggtacgatggtcgtgatgcattcta

SEQ ID NO: 6605 - DNA, 408 bp, Zea mays
  Clone ID: LIB3279-031-P1-K1-B12
gaagtgagttcattcagatagactaggatcggtggtgacaaccacctaggcacatcgactatgcaagagtacatggacgagtagaatgtgttgaccaagtcaagttgaggtgttggaagacttggtgattaggctatcaaggactagtagtagcatgtgtagagaaaatggaaggagcatatcagatatgctactcacaagggggtttagtggtttaggattcaaacccactacgcaaaaggtgaagttctattgagaactagaggcaacacacggtgtcatcacaaagcttctgttgatgtgaagagcttataactgtcaaatctacatattttgagttcgaccataatacctttagggttaagtggtttggctttaattatctaggggcacagtggaaatgtgtag

SEQ ID NO: 6606 - DNA, 437 bp, Zea mays
  Clone ID: LIB3279-031-P1-K1-B3
agggtacgctcttgatgggatcaagctcactaaagtacccagggcagccacaggaaattccgttctttcagaataccacattttcaatccctgtaaacgatccacaccaggtttggaattctgacgagcacgaagatttgcaagttcttgtgatcatttcgagaccacctgctaagatatttttatatgatgattggagcatgcctcatacagccgcggtactgaaattccccttcgtctgggatgaggactgcttcgaagcagcaaaagacgaactctaggtcacaagtgtttcctgcaatgtatctgcttcatccatgatcctgctggactactaaaattcacatgcactagtcgtaataaagccagtgcgctttttcatgtataattctgtattgtggctcgctaaaataaaatttggcaacggtttatgaact

SEQ ID NO: 6607 - DNA, 334 bp, Zea mays
  Clone ID: LIB3279-031-P1-K1-B4
cccacgcgtccgcccgaccactgccatgtcgaggcgcggcgactgggtctacgagaacaacggcgggacctgcgtggccatcgccggcgccgattactgtgtcgtcgcggcggacacccgcctctctgtcggatacagcatcctcacgcgcgaccactctaagatctgcgacctggctgacaaatgtgtactagcatcttctggcttttagggtgatattaaagctctgcacatgaacctagctgccagagaattgctatactaacaccagcatatcaaaaggatgagctgttctgtcatggcacagcttctcttcaataccctgtactacaag

SEQ ID NO: 6608 - DNA, 344 bp, Zea mays
  Clone ID: LIB3279-031-P1-K1-B5
gcacattatgctacctgtatttcttgtagctgctggtgacattgatagtggcgattttacgggttttcctctatcaatccagccaaaagtccgtggcttgcgtccgaaaacttcaactgctgaaaaacttgccatcatgtgtgtcttcccattattgttatctggtattttgggttctccttccagtcgtcaacagttggaagagtatctgaaaaaagtacttatccaaaacaccaaggatggttcattttctatgcatcatactactgagatcattaacgcagttcggttgctttgcttatttgtggagcaccatagtgtcatctttaacattttgtgggaga

SEQ ID NO: 6609 - DNA, 400 bp, Zea mays
  Clone ID: LIB3279-031-P1-K1-B6
ctaattccgcatccccggctgaggcagcagcggcggcgccggcaccggcaccggctcaccagcgataccgggaagaatggggaggtacagtcccgcgtacagccccccgaggagaggacatggcggcaggggaaggagcccaccttccaggagaggatatggcggtggccgtggtgaccatggctctgtcagcctcctggtccgcaacattccattgagatgcaggcctgaggaactacgtgtccctttcgaacggttcggccctgttcgggatgtttacctgccaagagattatcacactggggagccaagaggatttgggttcgtggagttcgttgatgcttatgacgcttctgaggcacagtaccacatgaatcgtcaggagtttgctgggcgtgaa

SEQ ID NO: 6610 - DNA, 456 bp, Zea mays
  Clone ID: LIB3279-031-P1-K1-B7
cccacgcgtccgcccacgcgtccgcctcccgctccgagaaagcaaacaagcgtcagctccgccggcggcctcgcgctctctcccccgccgcaccttctctacgccaggactgccaagatgaagctcgtcagattccttatgaagctaaacaatgagacggtcaccatcgagctcaagaacggcacggttgtccacggcaccatcaccggtgttgacataagcatgaacactcatctgaagacagtgaagcttacactgaaagggaagaaccctgtaacgctggaccacctcagcgtgcgaggaaacaacatccgctattacattcttcctgacagcttaaacttggagactttgctggtagaggaaacccctagggttaagcctaagaagccgactacaggaaagcctttggggcgtgggcgcggccgtggtcgtggacgtggtcggggacggggg

SEQ ID NO: 6611 - DNA, 462 bp, Zea mays
  Clone ID: LIB3279-031-P1-K1-B8
cccacgcgtccggcagcagccaaaacctacctagccgccgccgcaggcggccccccatcgccgccaagatgcagatctttgtgaagactctgacggggaagaccatcactttggaggtggagtcctccgacaccattgacaatgtgaaggccaagatccaggacaaggagggcatccccccggaccagcagcggctcatcttcgccggcaagcagctcgaggacggtcgcaccctcgccgactacaacattcagaaggagtccaccctccacctggtgctccgcctccgcggtggcgccaagaagcgtaagaagaagacgtacaccaagcccaagaagatcaagcacaagcacaagaaggtgaagctctccgtgctgcagttctataagggggacgacgccactggcaaggtgacccgcctccgcaaggagtgccccaacacagagtggggcgcgggcgttt

SEQ ID NO: 6612 - DNA, 395 bp, Zea mays
  Clone ID: LIB3279-031-P1-K1-B9
ctcgcgggggtcgacttcctagggttcgaggaacgtccgtccgtccgtccggggaaggtgcaggagggaggcggagatgatcgaggtggtgctcaacgaccgcctggggaagaaggtgcgggtcaagtgcaacgaggacgacaccatcggcgacctcaagaagctggtggcggcgcagacggggacgcgccccgagaagatccgcatccagaagtggtacaacatctacaaggaccacatcaccctcaaggactacgaggtccacgacggcatgggcctcgagctctactacaactgagccgccgcccctctctccctctcgtcaggttggtctgaattctgaagtcatgggtgcaattcgcttcgcgggggatctcttaagctcatcacatata

SEQ ID NO: 6613 - DNA, 367 bp, Zea mays
  Clone ID: LIB3279-031-P1-K1-C1
gtcgcacagcgacgtggacgtctgtctcgagatggagaccggcgcctagagcgcggtcgaggttcttgtgagactagcagacgtgttgagggccgacggtttcgagaacgtggaggcaatcaccggtgctagagttccgatcgtaaggatgtcggacccgggaagtggtttctcctgcgacatatgcattaacaaccttgtcgtaggagtccatattaggcttctagacgattacgcacatatagataacctgtacttcaactgtgcatcactgcagtatggccgggccaaacaaagaggcttgtacgaggagttccgtgggactcttttcagctacatgtatgtttttaattgcattaacttcttt

SEQ ID NO: 6614 - DNA, 333 bp, Zea mays
  Clone ID: LIB3279-031-P1-K1-C10
gtgcttcaggctgtgaagatacaccaaatatactttgcaatggtacatgttctatgtaagatttcttgtcgtgactcaatgtaaaagtataatttgtctgacattttctttgttattatagttgacccagttgtatatgagacccagaagtgtgtattggaagaaaatctttccaggagagctgaacactacttttttgaaatgaagcgggttacaaagggcagggatgcatgggctcatgggaacctacaagaacttggacagctgatctctgaatctggtcgcagctccatactcaactacgaatgtgggagcaaagagatgatccagctg

SEQ ID NO: 6615 - DNA, 359 bp, Zea mays
  Clone ID: LIB3279-031-P1-K1-C11
cagaaaaagaaaaagaaaaggcaaaggcaaaggaatcccaatcaggcaagcaaaaggaagaaccagctgctgcggagtgcggagatgtcgtcgcagctgatcgaggagcaccggtcgggcgcggaggtgcacgtcgggcacgagctgtgcgagcgcaagtcgcgcgagttcatggtggagctgggcctccccgacgggctcctcccgctgcccagcctggacgaggtgggctacaaccggtcgacggggttcgtgtggctgcggcaggccgccggcctgacccacaccttcgggtccatcggcaagcaggtgtggtacgacagggaggtgacggcgttcgtggagccggggcggatgca

SEQ ID NO: 6616 - DNA, 323 bp, Zea mays
  Clone ID: LIB3279-031-P1-K1-C12
gactgctctgccgctgctgctgtcgcaggcgcgccaccaacccgccgatgcgcgcgtagcggcgtaggtaccatcatcatccatccccgcgacgacccaccacccacccctgcagtctgcagcatccccttccccactcccggctggtctgctgcggccacccctgcgccgatccacctccgctgcttcctgcctcaatatattcgcccgcctcgtcgcgtccgaccccgccacagaaggccttccagaaccctccgacccctcacctccgccccgctccactctccttctccttccgggccggccgactccgatggccgtcg

SEQ ID NO: 6617 - DNA, 420 bp, Zea mays
  Clone ID: LIB3279-031-P1-K1-C2
atctcttttctgaaggaaaaaaaagttcagcgcgcagttaagcatagcaggacgaccacgacgatgtatcacccgcagtgcgagctcctgacgatggcgcacgaaacgccggacctggacgccggccagccgcacctaaccgtctccggcgtcgccagcatcccggcagagctgagcttccacctgctgcactcgctcgacgccgcggcggcggtcaatcccgtcacggcgccgccgcagtccaccatcgactacttcctcggcggcgccgatccccaccagcaggccatgcattacgagccgctgccgcccgccgcgggcggccaccaccagtacaccatggacatgtttcgcgactactgcgacgggcactaccccaccgtcgagccgtacattctggggacaatgactggagccctc

SEQ ID NO: 6618 - DNA, 367 bp, Zea mays
  Clone ID: LIB3279-031-P1-K1-C3
tgtcaggcgtgcatctgctcacatcatcgtgttgtctagctactctccatttgtaaaatggactcctcaatggctgtggctgaagaacgaattcaagcgcgtggacagggaaaagacaccctggcttatcgttctcatgcattctcccatgtacaacagcaacgaggcacattacatggagggtgagagtatgagggctgctttcgagaaatggtttgtgaagtacaaggttgacttggtgtttgcagggcacgttcatgcttatgagagatcataccgcatttctaatgtcaactacaacataacgtcgggaaatcggtatccagtgccggacaaatctgctcccgtttacataacggtcggtgat

SEQ ID NO: 6619 - DNA, 417 bp, Zea mays
  Clone ID: LIB3279-031-P1-K1-C4
ccaacggcaaccccgtccccaggtggtatttacctgacttcgaacatggttcaatcaaggatgattattgtgggggaagctcaggatacaactcggaattactgaagatcatggaaactaaccaatctcccccttgcaagcgaccgcggagagatcgaaaccgtgaaaaggcaccctcctcaaacaaaattgaagtcatggaacaagagatatggagagatttccctgaagatcttttcgaaactgtcatagcaaggcttcctgttgctgcaatttttcgattccgcactgtctgccgaaggtggtcttcccttttgggctcaaacagtttctcttgtcaagtctctgaagctccacatggactgccatggttctatacaattacttatgagaattcaaacaacaatgttgcgatgt

SEQ ID NO: 6620 - DNA, 442 bp, Zea mays
  Clone ID: LIB3279-031-P1-K1-C5
ggattgctcgccgcgaagacgacggcggccaagtcggcggagaaggacaaggggaagaaggcccccatctcacggtcctcccgcgcgggcctccagtttcctgttggacgaatccaccgtcagctgaagcaaaggactcaggcaaatggccgcgttggtgccactgcagccgtctactctgccgccatcctggagtacttgactgccgaggttttggagctggccgggaacgctagcaaggatctgaaggtgaagcgtatcacccctcgccacctacagttggccattcgcggagacgaggagctggacaccctcatcaaaggcaccatcgcaggtggaggcgtcatcccgcacatccacaagtccctgatcaacaagtccttcaaggagtgaagactagggaatgcacattgttagtttaaactggacatttctgtgtgct

SEQ ID NO: 6621 - DNA, 409 bp, Zea mays
  Clone ID: LIB3279-031-P1-K1-C6
gccctcgcctgtcctcagtcctaaccctcgcccgactcatatctatctgccccgcgccggcgtcgccatgccgttcactccgggtccctactctggcgtcagcaccctcgcccttgtagcgagggcatcggtcttcggcttcggtgtcgtctacgggagcatcaagctctcaatcctcaaggcaacaaagcctaaaaaggaagaagcgcatgctcatcactaaggacgacagggctgctacatgttaatttctatggaaggatgatataaaaatgtggttgcactctttctccatacgtgcaatttgatttatgatttggggacatcttgctggaacacacctggctgggtatcttaggtttgggtcataataaaattcttaggccatggctttgaatctggaaggggg

SEQ ID NO: 6622 - DNA, 337 bp, Zea mays
  Clone ID: LIB3279-031-P1-K1-C7
gccggcgccggatccaataggaggaggaggaagatgactgtgggcatgatcaacgcaaacccggtggtgcacgagcggtcggagcgcgccttgcacccccacgccgccgatgtgctcgaccctctcgatgtctttgatacggtgcgggacatcaaggacccggagcacccgtactccctggagcagctcagcgtgctgtcggaggagtccgtctccgttgacgagacgctcggacgcatccatataaccttcactccaactgtgcagcactgcagtatggccacagtcattggcctgtgccttcgacttaaagtgatgcagaactttcctccacatt

SEQ ID NO: 6623 - DNA, 449 bp, Zea mays
  Clone ID: LIB3279-031-P1-K1-C8
agaaaacccctgctgcaaagaaggataatgctgagggacaagaggttgaggcagcagctgaggaaacgaaaaagagcaaccatgtcacgaggaagcttgagaagcgcaaggagggacgtacccttgacccacacattgaggagcaatttggcagtggacggttgctggcatgcatttcttcccgccctggacagtgtggccgagctgatgggtacatccttgagggtaaagagcttgagttctacatgaagaagctacagaggaagaagggcaagagcgctgtagcttagagcattctcatggattgtcttgcaccgaaatgtgtgtcctgatgagtacactttttttggttagtcgtctcaagttcagagcgttatgccatgttttcagacctgattagtacactcttttctaaaagcgattgagctctagtccaatgtattgataat

SEQ ID NO: 6624 - DNA, 454 bp, Zea mays
  unsure (1)..(454): unsure at all n locations; Clone ID: LIB3279-031-P1-K1-C9
aaaataccaggcttggtacaacaccacttcttaaaaaagttgttacaattttttcaacatttgcagcttcagttctattgagatatgatgtcccactagcactgatttcttcttgtcccatctgcagatattagtatggatatgcatcacgtccagataagagtttgtgtatgaaacacatcaatatttccatagttgtcaaataagctacctgcacatagaagaacattgggcgatttggaataggccaaggaaaatcaattccagacgattgcctctcattaacagtcactccattttgcagtgtgccttcataaaagcagttggatggaaactttgagaggcatggatgcattctatattggacctataaatcagagatgatttgagttagaattattgctgatggtatagagatatcagatcacttctaantatgactattaatcttggc

SEQ ID NO: 6625 - DNA, 324 bp, Zea mays
  Clone ID: LIB3279-031-P1-K1-D1
cactcatcttttcgcgtttagaacctctaaaattttccccactcgccagtcgcagcagcacgtgtagccatggacgccagcggagcctgtagcaaggggaagaagggtgcggccgggcgcaaggcatgcggtcccaggaagaagtcggtgacgcggttcgtcaaggccgggctgcagttccccgtcggccggatcgggcgctacctgaagaagggccggtacgcgcagcgcgtgggcactggcgcccccgtctacctcgccgccgttctggagtacctcgccgcctaggttcttgagttggcagggtacgcggcgaaagacaac

SEQ ID NO: 6626 - DNA, 295 bp, Zea mays
  Clone ID: LIB3279-031-P1-K1-D10
gcggcgagttcaaatctcacaatcttcttgtagcacaccactgtcttcgtccaactcgggggcgatgtctgggcgcggcaagggcggcaaggggctgggcaagggcggcgcgaaacgccaccgtaaggttctccgcgacaacatccagggtatcacgaagccggcaatccggaggctggcgaggaggggcggcgtgaagcgtatctccgggcttatctacgaggaaacccgcggcgtgctcaagatcttcctcgagaatgtcatccgcgacgcggtcacctacaccgagcacgct

SEQ ID NO: 6627 - DNA, 313 bp, Zea mays
  Clone ID: LIB3279-031-P1-K1-D11
gtgttaaagctcaatctggagtcatgactgcagaaactggtacttaccgttggatggggccagaggtcatagagcataaaccctatgatcacaaggctgatgtttttagttttggaattttgatgtgggagctactcacagggaagattccttatgagtatctgactccactacaagcagctgttggcgtggtgcagaagggattacggcctacaattccgaaacatacttatgcaatgctttctgagcttcttcagaaatgttggcagcaagaccccgctcaaagaccagacttttccgaaatattaaaaac

SEQ ID NO: 6628 - DNA, 352 bp, Zea mays
  Clone ID: LIB3279-031-P1-K1-D12
ctttgctgacagacagcttgtcaccatattctcggctcccaattattgtggtgaatgggataatgctggcgcaatgatgagtgttgacgaaactttgatgtgttccttccaaattctgaaacctgctgagagaaaacaaatttatggggccaaacaaaatgtgagatagtgaacccattttgcttccagcagctctgaggctctcctgtggatgtatcaagacaacatcatgatggcgccaaacttgaggtcagcattgggcaagggcaaccaccagagcagagaaaccaaataatataccatacctaactgttcgcctggaagttactcttcatggcaagtgcttgaattt

SEQ ID NO: 6629 - DNA, 415 bp, Zea mays
  unsure (1)..(415): unsure at all n locations; Clone ID: LIB3279-031-P1-K1-D2
tcggggagtacgggacacggctgcttgcctgcgccccttggtcctttccccgcttgcctttgccgttttcgggtgggctcctcccctccacccccctctctctctctctctctctcatggcccgccccaggaaggcgaaaccgccgccgccgtcggctagggcggcggcgccgtccatcgccgaggcgctgctgatggccacgatctgcatggtgggtctgcccgtggaggtgcgggtccgcgacggatccacctacttcggcgtncttcacaccgcctgcgtcgatgccggttacggtgtcgtgctaaaggaagcaaagaagattgcaaacggaaagggagatgcgaatctgtcgctgggatcgtttgtggacacttttgttgttcattcagatgaccttgttcaagtgattgc

SEQ ID NO: 6630 - DNA, 445 bp, Zea mays
  Clone ID: LIB3279-031-P1-K1-D3
ggagcttctacttttgaagtctggataaccatgccaaaatgggcagcacaggttttgaaacatcttgcgccagaaatctcctacagaagcttggttgcacttggaattgcttgggtaaatggtacaccagtgtcctcatttgataggcaggatgcagaccggcttcttttcttttgctctaaccagtgcggagatcaagctattcaaaatggctcatatgctcatgtatccagctggtcagcaccccttaccaaggatagaaccactggaagtctcgagtcaaaacaaatgtcatttggtgcaaaaggagttgtaggggataatacgatctccctatcatcattgaaaccaaggctaaagcctgcaacaatgagacccctttcttactttcgcaagaacaaatgcattcctttatggggttttctcagtccatcattcacgatgc

SEQ ID NO: 6631 - DNA, 385 bp, Zea mays
  Clone ID: LIB3279-031-P1-K1-D4
cggacgcgtgggttgctacaccacgccggccttctactgctgacaggcgccctgccaccaaagatctaacaccaaagctatccaacattgctgccccacatcgaccttctactgctcacaggcgccctatatccaaagagtcggcaccaaagcatttcaatgttgctagcccacatagaccttctactgttgaaaggcacactagtggcagagatatgacatcgaagtatgttggtattgctacctcatatctgccatctgctgtcaaacagcgccctatcactggagagggtgcacataagcatgctgatgttgtcaccctgagctgttctactgctgataggcgccccattagagacgttgcaccaaagtatgccactttagc

SEQ ID NO: 6632 - DNA, 399 bp, Zea mays
  Clone ID: LIB3279-031-P1-K1-D5
gaaggacaccgactctgaggaagagctcaaggaggccttccgtgtgtttgacaaggaccagaacggcttcatctaggccgccgagctccgtcatgtcatgacaaatcttggtgagaagctaactgatgaggaggtggacgagatgatccgtgaggctgatgtcgatggtgatggccagatcaactacgaggagtttgtcaaggtcatgatggccaagtgagccacagaaccataatctgaaggcagagaagattatgcattgcatattagtcaagatgcaactttttattccatcgacttctagagaaacattctgctagttgtagttgctgaaaaaggcaatgtagttcctgctttgttcttccctccagtgtgttttcagaactgttgtttcatgtg

SEQ ID NO: 6633 - DNA, 330 bp, Zea mays
  Clone ID: LIB3279-031-P1-K1-D6
caacgtccaaaatccagaccgctggtaggagtatctcgtagacattgaacaacggctgcgtggcgagcgcctgcgccacctccatccccctcgtctcggcgccctctgcatgcccgtccaagaagaccaccgtcgccaggttccggcgccgcacggcgacgtgcagggccagcagcggcggtggcggtggccggggcggcaaaaatgatggcctcctttggctgccccggcgggacgtgatgctcaacggcctgtccagtgtcgccgccgggctcgcctggtacccgggcgtcgcgtccggcgcggatgcggtgtgcacccaggccggca

SEQ ID NO: 6634 - DNA, 445 bp, Zea mays
  Clone ID: LIB3279-031-P1-K1-D7
accaaattgagttgagactgctcaattgggcttgggcagacgagtgtgttttcaacctgtgtctacttcgactacacagtgctgttcatagcagcctagccaatgcttataaatcctggttgataacagtgattcaccgaacacacccaattggccaagatcatgtttggcataacgtggataggggtgtggtgtgtggaattaaggatagatgctgtgcaagattggcaaagctagttttatctgctacactgacacaagattctggcaagctttctcaacttgaattgcaccatccattgttgttgaatactcagtcaagcggcttgaggacaagccgcatttcaagcggtggggaatgtcagcatatcatcttctcctcaagtcaaagatggtaaacaatgctgctacgacgacgatgaccatacatggagtatatgaagat

SEQ ID NO: 6635 - DNA, 372 bp, Zea mays
  Clone ID: LIB3279-031-P1-K1-D8
cccacgcgtccgcagttagggatgtcaacatgaacacccagcagaggttcatcctccagtaaacaaaggcctctgcatcgatgggctgcttggccaatgcagaatcaaacagtttggccttcggagccttttgacatcacaacagttttggtctgtgcagacagtgactgaaggagctccaccgaaggtataacccacaactgtgaagtgactgaatgaaaacataagtggcgacccttcgcgtattggacgtttaaagttgagtgtgcaattttctagagttcattttgcgtgtacaagtaaaaacttttttagagtcgatgagaattataaactggcatatagcttaacttatggatatttattccttat

SEQ ID NO: 6636 - DNA, 333 bp, Zea mays
  Clone ID: LIB3279-031-P1-K1-D9
cgtacgcctcccctaccatctagggtttctagggttttcgaggaggaggaaatggcgtgtgatagggtgctcgggactgtgaagtggttcaacggaaccaagggcttcggtttcatcacccccgacgacggtagcgaggacctattcgtccaccagtcctccatcaagtccgacggctaccgcagtcttaacgacggcgatgccgtcgaatacaccgtcggcagcggcaacgacggccgcgccaaggccctcgatgtcaccgcgcccggcggcggcccgcttgccggcggggaacgtcccgacagctgcaacagcggtgggcgaggcggatac

SEQ ID NO: 6637 - DNA, 449 bp, Zea mays
  Clone ID: LIB3279-031-P1-K1-E11
cggacgcgtgggatttccctcacctcccgcagcagctagccgccagccaacaaccgaggcaaccaaccaacccacagcgagcgagtaaagcgtccaatggtagcgatggcggccgtgcagcagaagcagcagcagcagcgccgcgacgcggaggcggagctcaacctgcccccgggcttccggttccacccgacggacgaggagctggtggcgcactacctctgcgcgcgcgccgaggagcagccgccgccggtgttcatcatcgccgaggtcgacctgtaccgcttcgacccctgggacctggcggagcgcgccctctttgggcgccgtgagtggtacttcttcacgccgcgggacccgaaggaccccaaccggtcccggcccaaccgcgccgctgggtcgggctactggaaggtcaagggcgcggaccagcccgtggagcacggggg

SEQ ID NO: 6638 - DNA, 362 bp, Zea mays
  Clone ID: LIB3279-031-P1-K1-E12
cgctcccgctcaaatgcatcttctggcatgggagttgctcctaacattagggagaggggcgtcgagcttcaaatgaagaaggcattccgatatgttatcttcaaaatcgaagagaagcaaaagcaggtggttgtggagaagacaggggctactactgaaagctatgatgattttttggcctctctcccagagaatgactgccgatacgcgctgtatgattttgattttgttactggggagaatgtgcagaaaagcaagattttcttcattgcctggtccccatcgacatcccgcatacgtgctaagatgctgtactccacgtcgaaggaccgcatcaagtacgagcttgacgggttccacta

SEQ ID NO: 6639 - DNA, 429 bp, Zea mays
  Clone ID: LIB3279-031-P1-K1-E2
aacaatttcaacaagcaactcaatcagtccctctctggaaatcgatagtcaccaggggcggggtggaactaaagaggatatgcatgggccaaatttcatctaaaggaagcaataagcaccgcgcgcaaatagaacataatcatgaagtcaaggggatacagataatggtagaaattagaaagagataggatccacctgcataaggttgttgagagcatggaggagacagaattgcagcctctgcctctcatgatacaccttgccgctgccgctttcccccgcgccagatcctgcctcaccttgctttgctttcgatttggctcccggttccatgcctcgatgctcgatggggctgggtcgctgccacgcaaggacaaaacctgaaaccccacaggtatcttcggaattggatttacgagtatataagat

SEQ ID NO: 6640 - DNA, 420 bp, Zea mays
  Clone ID: LIB3279-031-P1-K1-E3
aggagttacatgggaggggttgacctttggaagaacgaggatgatgtctctgacacttagcgggcctcagtccatgcatgacaagaagctggaagttgttagcttcacaggaatgctgcatctcgggaaactgcaagttgggctttctcgtgcaaaaagattagcccaaggccatcatataaaggttgaagtcagtactacaatgccgatccaagttgatggagagccatggtcccaggagccgggaaccatagaggtttctcatcatagccaggccttcatgcttaagagagtctccgaagaaccgctgggtcatgccgcttcggtaatggccgacatcttggaaaacgctgagagcagtggcattatctcagccttgcagaagaggactttgctccaggagatagcgtctaggctttt

SEQ ID NO: 6641 - DNA, 297 bp, Zea mays
  Clone ID: LIB3279-031-P1-K1-E4
gcctcaccttcaagctaacctatcagctgagggttcacatgcaggctgccatccttggcggttacatggacttgaagactgcactgaatcctatactaaagtgagctattaagggagcttattattggaattgttgacatgctttaatacatgctatcatacaggctgctagcccaaactctaaccttaacttggctctatacatcactgcatattgcaaggctacttgatctgctcttagatcgactgttacgatgacggagtcgatattacaatgttcattacatgtatccttct

SEQ ID NO: 6642 - DNA, 354 bp, Zea mays
  Clone ID: LIB3279-031-P1-K1-E5
ctcctattcaccatgccgaccgaagagggttccgacggcggtggcggcgccggagccggagccggggagaagaagagctcgcaggcgcccgcaaagcctggagcgtgcggcgccgcaaagttcctcgcggggttgccgtcgcgcggcaacttctcttccggctccgccccctccaatctgggagggttcagggtttacgtctgcgagcacagcacagatcccccagaaggacaagttataaagacggattcaacgaatattttaatcaggcatctccagttgaacaagcataaaactgggggcaaagatgtggattccagaactgtcggcgaaaacaacaaagggaaaagatct

SEQ ID NO: 6643 - DNA, 359 bp, Zea mays
  Clone ID: LIB3279-031-P1-K1-E6
ggaaaggaacagagccagctcttaccaacattgcttattcagtactcccgtttcttatggggggccatcaaagacttggagaaggcaagggagatattaactgtgctgcatgagcagttaaatttaacaaaaccagtgcttgaggctgtcatccatctagagtcgatttttccatgcgaaaagcgtattgaatttttagactcacttgtggagaagtttgttacacctgaatcatcttagggagagttggcaagtctagttgacaaagaagaaatatcttccatatttttagagtttttggatctctttggtgatgcaaagtcaatcagggaggcttcaacttggcatacaactctttt

SEQ ID NO: 6644 - DNA, 457 bp, Zea mays
  Clone ID: LIB3279-031-P1-K1-E7
ggatgagaacaactttacggctgatgggttgcaaactctcaccaacaacttgtgttacgacgtatgctaggtgcacacgctcagtatcgattgttcctcctgcatactatgctcacctggcagccttccgagctcggttctacatggagccagatacgagtgacagtggatctatggcaagccgtggccctccaccaggggggcgcaacaccaaggctgccggtgttgggaatgttgctgtgaggccattacctgtcctcaaggaaaacgtgaagcgggtcatgttctactgctaagactgatgctgttaaggcagagctaccttttattattacagtatatcgtgaagactagagtttttttttccacgtacttgatgatgctgagctaccttttattatgtcgtacgatatatatgcgtggtattgtctaaaaaacaaaaacctgggtcttttat

SEQ ID NO: 6645 - DNA, 345 bp, Zea mays
  unsure (1)..(345): unsure at all n locations; Clone ID: LIB3279-031-P1-K1-E9
cgggaggagcaggcgctgctgtcgacggagatcgtgaaccgcggcgtggagccgtcgggcccggacgccggctcgccggccttctcggtgcgcgtgcgccgccgcctgccggacttcctgcagtcggtgaacctcaagtacgtgcgcctcgggtaccactacctcatcagccacggcgtgtacctggccaccatccccgtcatcgtgctggtgtgcggcgccgagctgggcagcctcagccgcgacgagctgtggcgcaaggggtggggggaggccacctacgacctcgccaccgtgctcgccttcctcgccgtcctcgccttcaccatctncgtctacatcatg

SEQ ID NO: 6646 - DNA, 346 bp, Zea mays
  unsure (1)..(346): unsure at all n locations; Clone ID: LIB3279-031-P1-K1-F1
atcagccacctcgtgtgctattgaacagtgcaagatacatccagaaagaaaaggattcagcgacaacaagacaagcatttctgcanctagcatggaagaatggcttgcctttattcatgctgtcttatggcgattctgatatcctggcaggcactgttagaaggaagggcatctctgaaaaggatgatcttgaaagcacatattctgtattcactgttgaagaacctaaaaaaaaaagtggagcttggatcaaggcagggggcaagaacaaggaacaccaccttttgtctagcatagtcggggaaataaaggttgcacgttcaaaatcaagatttcaccatacagc

SEQ ID NO: 6647 - DNA, 213 bp, Zea mays
  Clone ID: LIB3279-031-P1-K1-F10
tgcacctgttcaaaatcctgtcacctatctgtacagtctgcgtgaccctttaccgcagaggggacgcagaagggagccggcccctcctgaccgatgtctacctgataatctgccccgaggggactacgtgccgcgagccagttgtgctccgtttataggcgctggtcgcggagctgacggacgacatcctgccggtggacatggacaatcaga

SEQ ID NO: 6648 - DNA, 298 bp, Zea mays
  Clone ID: LIB3279-031-P1-K1-F11
tttgaattgtgcaaatagttttcatccatcgcttctgcaccatgaaaatctaattaagtgactcatatacgggaggctagccatgtttatgattgaccatgtatccatagttatctttctacctttctcatagataggttgtgcaacccatcatccaaaattaccaaacatcttgaataacaaactataatctagaaaagaactttacatattcattcaatggctaacccttagtaacatacattacaccttactttttatgcatcctactctttctgattacataatacattctaat

SEQ ID NO: 6649 - DNA, 373 bp, Zea mays
  Clone ID: LIB3279-031-P1-K1-F12
gtgaaatgtccgtgaatggtgaccatttttatatgctttcgtgaattgtgaattgtgcgtgttgtttcagtaacccagactacataatctttgaagcaccttgcaatttaacacataaccaatagagttaacgagtctacatgatctatttctcccgggggtggatccaggaccggagctggcagagccgcaaccccggtccagcaacccaattagtacttagtaccctgtagtaatttcagcatagtcatagaaagagggcccgcaattacaagacgcgggcgcatcacagcacgttgcagacccatcaggccatcacacatgtttgcaattcgcgcatcatcttcgcggaggcttcattcattcatattat

SEQ ID NO: 6650 - DNA, 414 bp, Zea mays
  Clone ID: LIB3279-031-P1-K1-F2
ggggaagaaatcaagatgccatattagccgcatgtctatatattgcttgtagacaagaagggggccctagaactgtgaaagaaatatgttcggttgctaatggggccacgaaaaaagaaattggcagagccaaagaatttatagtgaaacaactggaagttgagatggggcaatctatggagatgggaaccattcatgctggagattttctgaggcgtttctgttcaactcttggaatgaccaatcaagctgttaacgcagtcaaggaggcagttcatcgctcagaggagcttgatataaggaggagcccaatctcaattgcagcccccgtcatttacatgataacccaactctcagaggacaagaagccacttaaagatatatccttggctactggtgtggcaaaaggcacca

SEQ ID NO: 6651 - DNA, 466 bp, Zea mays
  Clone ID: LIB3279-031-P1-K1-F3
cggacgcgtggggcagggacagatttacgaggctgctgatttgatgcaagaagttgctggggaaacatttggctgtatggcaaatacggagaaaattgctttcattcttgagcaggtccggctatgcctggatcggcaagattttgtcagagcacaaattttatccaggaaaatcaatactagagtatttcacgcagatccatcaaaggaaaaaaaggaaccaaaggaaggtgacagtattgttcaggatgctcctgcagatattccttcccttctagaattgaagcgcgtctactacgaactgatgattcgttattactctcacaacaatgattacttggaaatctggcgttgtacaaggctatttatgatattccagcaataaaagaggatccaacaaagtggataccgattcttaagaagatctggtgggtactggtgctagcacctcatgatcctatgcaat

SEQ ID NO: 6652 - DNA, 367 bp, Zea mays
  Clone ID: LIB3279-031-P1-K1-F4
gctggaagtggaaagaagtgggttcttgcttgagctgagctctgcctcttgctgccctgggatctgtttgggagtggagaacgcagtatggggcgcggcaagatcaagatcaagaggatcgagaactctaccaaccggcaggtgaccttctccaagcgccgggccggactggtcaagaaggcacgggagatcggcgtgctctgcgaaaccgaggtcggcgtcgtcatcttctccagcggcggcaagctctacgactactgctcgcccaggacctcgctgtccaggatcttggagaagtaccagaccaactcggagaagatactgtggggtgagaagcacaagaacctgagtgcagagatcgacagag

SEQ ID NO: 6653 - DNA, 369 bp, Zea mays
  Clone ID: LIB3279-031-P1-K1-F5
cccacgcgtccgcccacgcgtccggctcattctgatcaagcgggcgaccacgatgggtgcgtcgttgcaatccaacggcggatgctgcgccgcaaggcgcaacttggcttatcagatatctccagcccgcgcgggcgctgcagtggcgcagcacagccacgccgcggcaacagcaacaccgcgcaccatggcgcttcttctccatccccgcctcccctcccatcctttccgcgcggcagcccaccaccaccacgccatcacggacgcctcttgcttccttaccctccgcggccccggaaggaagcgccgcatgatgctcgcggcggtcacgtgccgcgcagccagggtcaaagagcccactccgagccc

SEQ ID NO: 6654 - DNA, 448 bp, Zea mays
  Clone ID: LIB3279-031-P1-K1-F6
gccaaatcggcctatagatcaaacgctgcactgtagggagcgtgaagccagcggcgaatggaatccctagccgccacctccgtgttcgcgccctcccgcgtcgccgtcccggcggcgcgggccctggttagggcggggacggtggtaccaaccaggcggacgagcagccggagcggaaccagcggggtgaaatgctctgctgccgtgacgccgcaggcgagcccagtgattagcaggagcgctgcggcggcgaaggcggcggaggaggacaagaggcggttcttcgaggcggcggcgcgggggagcgggaaggggaacctggtgcccatgtgggagtgcatcgtgtcggaccatctcacccccgtgctcggctaccgctgcctcgtccccgaggacaacgtcgacgcccccagcttcctcttcgagtccgtcgagcaggggccccaag

SEQ ID NO: 6655 - DNA, 269 bp, Zea mays
  Clone ID: LIB3279-031-P1-K1-F7
cacgtgcagctgtcgggagcaggcaatggcgccggatctaagcgaactctccgtcgggggtgcagcccgtggcgcctacctcgccggcgtcggtgtcgcggtcctcctcgctgcctccttgctcccagtagccgagtcgtcctgcgtgcgagataactcattggtgagagacataagccaaatgccgcaaagcagctatgggattgaaggattgtcacatataacaggtgctggtgcgctcaatcatgggatgaaggagggggaagtgt

SEQ ID NO: 6656 - DNA, 310 bp, Zea mays
  Clone ID: LIB3279-031-P1-K1-F8
agaacttgaaagcaaggcgaaagagcaggacacaaacatgacggcagtggtggagtccggcgtcgtcgtcgcgactcctgtaaacgcgaaggtgatgagcgagaaggagaaccacgtcctgaggatctcaaactccctgaacaagcagctggctcacgtggagaacactcctgaggcccctgaagcggcttgcaacgagaggaagaggaaaggcgaggcgaggaacgcgtccatcggcggcggcgagcaagagaacactaacaacggtgggaggaagaggagcctgccagccgagcgcgaggcgaggctg

SEQ ID NO: 6657 - DNA, 437 bp, Zea mays
  Clone ID: LIB3279-031-P1-K1-F9
gctaccacggcaccgccagcccgggcggctataaagactaggcccatctctaaatcgggggcgatgaagaagaccagttcccctctcctgatcgttctgttcctcacagcagcagccatggcggccgagccggagaagcaggcggcccctgcggcacatgagacggccgtgcacatcgtgtacgttgaccggcccgaggacgccgaccctgaggagttccacatccgcacccttacccccgtgctcggcagcgaacagtaggccagggacgcagtgctctaccactacaagaacgccggcagcggcttctgcgagaagctcaccccccagcaggtcaaggatctcaaggagcaaccaggtgttctccaggttgtgccgagccagacttaccagctacatggtcctgggtttggcacttaccagggcacgacacacac

SEQ ID NO: 6658 - DNA, 333 bp, Zea mays
  Clone ID: LIB3279-031-P1-K1-G10
ggaggggccgggcctgagcagagcaagccggaccagctatctctcctctgaggcgtggaggggaggcggcgcccgagatgggggactccggcggctccgtcgtgtcggtcgacgtcgagcgcatctcctttggcggcaaggaacaccatatacaaacgaatcatggacctgtatctgttgcagtgtatggtgaccatgacaagcctgcccttgttacttatcccgatattgctttaaactatatgtcctgctttcaaggactattgttctgtcccgaagccgcttcgctggtgcttcataattttggcatttaccatattaaccccccaagac

SEQ ID NO: 6659 - DNA, 382 bp, Zea mays
  Clone ID: LIB3279-031-P1-K1-G11
gtccaactctccaagcggcaagcgccatgccttcttccgcgcaggttctgctctgcctggccgccgtgctcgcggcggcggcggccaccaccgccgaggcgcactcgcagtgcctggacaacccgccggaccggtccatccacggccgtcagctggccgaggccggcgaggtcgtccacgacctccccggtggcctcagggcctacgtcagcggcgccgcgagctcgagcagcgccgtcgtcctcgcctccgacgtcttcgggtacgaggcgccattgctcagacagatagcagacaaggttgcaaaggcagggtacttcgtcgtcgtgcccgatttcttggagggagactacttatacgacaagaaaaactttacagaatg

SEQ ID NO: 6660 - DNA, 415 bp, Zea mays
  unsure (1)..(415): unsure at all n locations; Clone ID: LIB3279-031-P1-K1-G12
cggacgcgtgggtttcaacaagatcagactatagtccagcctggatcactggagagagaggcatgcatatatgccctctcatatgacgtgagcggatcaaggcttgtgagctgtgaggcggataagactataaagatgtggaaagaggacttgacagcgacgccagagactcatcccatcaatttcaagcccccaaaggacatccgaagatattgatgctcaaatcccacaagtagcaagctagtggatggttggagcctccacaattgtgtgacccaaactcgcttcttccctgagcccaattgaaattttgctagggtttgctctattgataatctggtggctgtactncaaccatctgatgccttggtccaacgctttgaaacccttcttaaactggttctttgtgaacttt

SEQ ID NO: 6661 - DNA, 311 bp, Zea mays
  Clone ID: LIB3279-031-P1-K1-G2
tctccctctgtccttcgcctggcacacagggctctcgcgacgcagatcggctcatgtgcagcggggtgtgcgggttcttgaccggcgcgccctcctccttcttcaccggctgtggcgggcgacttctgcgaccacggcgagacctgctgtggtcacgactccactgggtccccccccaccagacccaaaccctagctgttgacgagatccagctgtagccggagaagccggctaccgccactgccttcgtgctgcacggactgctcagctgatctccggagttacggcttgctttttcacgcgctcctcgt

SEQ ID NO: 6662 - DNA, 436 bp, Zea mays
  Clone ID: LIB3279-031-P1-K1-G3
gctaagttcaagttccctggccgccaaaagatcattgagagcagaaagtggggcttcaggagagttcagccgcgctgactacctgaagtacaagagcgagggtagaattgttcctgatggtgtcaacgcaaagctgctcggcaaccacgggagacttgagaagcgtgctcctgggaaggctttcctcgatgccgttgcttaagtgctgatgcgaatcctgacgttttgctttagcgtatcttactttgtttcgtggaacatgaatttcaagtgttttgagggtattacagtgccttatgtgaacttgcctatcttgtgctgaacatcggaatctatcctccgagtatgtttaatcgcattaattttttttttcgttgaagcctaaggtttggcggctacacctcttttctagctagttggcgaccaccatttacgc

SEQ ID NO: 6663 - DNA, 251 bp, Zea mays
  Clone ID: LIB3279-031-P1-K1-G4
gaggaaagcctgtgcgccgtggagaagcgcgggcgggtgcacgtcatcaccctcaccggggcgggggagcaccgactcagcccggccctgctctccgacctccgctccgcggtcgcagccgcccgccgagcctcccccggtgcgctcggactggccggcgagggcaagttcttgaacaacggctacgacctcgcgtgggcgcgcgcggggcccgccccggccccggagcaccggctctacaccatgcgcgc

SEQ ID NO: 6664 - DNA, 454 bp, Zea mays
  Clone ID: LIB3279-031-P1-K1-G5
cgatccagccacacgagtcgacactcgacacaggcccgcgatcccctccccctcttcctggtccggattcgcggcgatctagccggcggcgggcggcgcatcgatggcggggcaaaaccagcggctcaacgtcgtgccgacggtgacgatgctcggcgtcatgaaggcgcggctcgtcggcgccacccgcggtcacgcgctgttgaagaagaagtccgacgcgctcacggtccagttccgcgccatcctcaagaagatcgtcgccgccaaggagtccatgggcgagacgatgcgcgcctcctccttctccctcgccgaggccaagtacgtcgccggcgacggcgtccgtcacgtcgtcctccagtccatccgcgccgcctccgtccgcgttcgatctcaccaggagaatgtcgccggggtcaagctccccaagttcactcacttcgtcgacccc

SEQ ID NO: 6665 - DNA, 461 bp, Zea mays
  Clone ID: LIB3279-031-P1-K1-G6
ccgagtggttttcccactggagcttaaacttcttaatacagttgataattcggacttggagtactccctttttgctgtggtagttcatgttggaagtgggccaaaccatggccactatatcagtttggttaagagccacaatcattggttattctttgatgacgagaacgttgagatgactgatgagtccatggtccaggcattctttggctcaccgcaggagttcagtggtaacactgataatggctacatactcttctatgaaagccttgctgaaagaagttgatgtccttctcataccatgtgattagttatacactttcctttcccttccatttctgctggggatatatagaatattcagtaaaaccagaataagctgaatgagaggccttcagcttcaattggtatggtacgatcaacgcttggcaataaaacaagttacctggaggggctatagg

SEQ ID NO: 6666 - DNA, 468 bp, Zea mays
  Clone ID: LIB3279-031-P1-K1-G7
atgacatatactatatcactggtgagagcaagaaggcagtggagaactcccccttccgggagaagctgaagaagaggggctatgaggttctgtacatggttgatgccattgacgagtatgctgttggtcagctcaaggagtttgagggcaagaagcttgtctctgccaccaaggagggtctgaagcttgatgagactgaggacgagaagaagaggaaggaggagctgaaggagaagtttgaggggctgtgcaaggtcatcaaggaggttctgggtgacaaagttgagaaggtggtggtgtctgatcgcgttgtggactcaccgtgctgccttgtgactggcgagtatggctggaccgccaacatggagaggatcatgaaggcacaggccctgagggactcgagcatggcgggctacatgtcgagcaaaaagacaatggagatcaacccagagaaccctatcatggatg

SEQ ID NO: 6667 - DNA, 229 bp, Zea mays
  Clone ID: LIB3279-031-P1-K1-G8
cgcaacggtgccgcggcttcggacagggctctcgcgacgcgatcggccatggcggcggggctgcgggcctcgtgctccctccgctcgcgcctcctctcgttctcctcggggtgttctctgtgtccggggcgtctactcctctcctcagctgtccactcggacgccccccaacagaccgaaacccttgctttcgaacaaaatcaactggcggccggagaagccggttacc

SEQ ID NO: 6668 - DNA, 287 bp, Zea mays
  Clone ID: LIB3279-031-P1-K1-G9
cacccagcgtgcaacctaggcgagaaccgcctccccctccgctccttccagctcgctctgtaatctgcatcagcctcgcccgccgccgtcgccgccatggggaggggaaagttcaaggggaagcccacaggccgccgcaacttctccacacccgaggagatcgctgctggtacttcaggtcggccacgcacctttaagaagaaggaggaagaggaagatgaggaagaggtagaaagagaagagtctgaggaagaatctgaagaggattctgatgaaaagactaaaca

SEQ ID NO: 6669 - DNA, 214 bp, Zea mays
  Clone ID: LIB3279-031-P1-K1-H1
gcctgatgggccagctggagttatgacaatccggtcgacatcagtcttatatgctgtggaggtagctttggatcgtagaaattctgaagatccacattgctcagcagtcagcacagaggatagagcagctacagcagctgctctttgagaacctcgacctgagcgagatggaggtgatgttttgggttttaaggatgggttgaatgcattagat

SEQ ID NO: 6670 - DNA, 333 bp, Zea mays
  unsure (1)..(333): unsure at all n locations; Clone ID: LIB3279-031-P1-K1-H10
cggacgcgtgggagcacccctctcctccgccgtcccatggccgcgccctgttcctgggacacttccttccacgaaaaaaagcagaagcagaagctctagctacctctactaccgacctggatccactcaacccgctacgctaagctccccttcccgttcgacaagtgaagagaagaggttattcatccatctgcgctgcagcctgcaaaggagaaggagaaggaggcgcttgacatgggcaagtacgtggagctgctggacatgggcgtgcgcatcggcgcgcgcttncactcccactgcccgcaaaccgcgcgcctctactaccaccccgcc

SEQ ID NO: 6671 - DNA, 334 bp, Zea mays
  Clone ID: LIB3279-031-P1-K1-H11
aaaaaccacaaatccaacaaaatctaatatgtacccgcacaaaaataattagccatatgtactttttaatttaggaacctagcgaggcgccacccatcgtgtttcctctgaggctctgcgatcgtcgttgtcttgttgcatgcactgaggctgaacgcgctgctgctgctcctctgcctgtgcgcgttccccgccccggcgcggtcgcagaacacgaccatggccacggccgcgccggtgtccatcgaggggttcaactgcaccgccaaccgcacgtacccatgccaggcgtacgcgctctaccgcgccggcttcgcgggcgtgccgctcgatc

SEQ ID NO: 6672 - DNA, 236 bp, Zea mays
  Clone ID: LIB3279-031-P1-K1-H12
gccaaaggttggacctcaccgatccgccaccacgccacgaaatcatctcctactccaggagttccgctcctcgccgccgtcgccgtcaccgtcaccgtcacgatgccggaagacgtgcagatgaacgactcggagccccagtctgcggccccagctcccgccgccgccgcggcgccggcgctctccacactacaccatctgaaggagatcgcgtccgtgatcgaggctggttctct

SEQ ID NO: 6673 - DNA, 364 bp, Zea mays
  unsure (1)..(364): unsure at all n locations; Clone ID: LIB3279-031-P1-K1-H2
cggacgcgtgggatgcgtcatgcgtatgttgacccaaacgatcctaccaagatcttcgagagcaacctgcgccagaatcgcagctgaggaggaggaactaccactgcccagctgatgcaaattagcgcttggctggattggcagaactgatgctcaattaagtgctgtgtccattttagcatttcacctatccttgtcggttaccacaactgacttccatattcgggtacccctgtttcctgtgaccttacatatataggacataatgttgcgagttctcgcaatatgtaatgtacataagtggcgtgttcatatattattgctggagcctggagggttcnaanaaattcaattagtttgtttc

SEQ ID NO: 6674 - DNA, 289 bp, Zea mays
  Clone ID: LIB3279-031-P1-K1-H3
gtgtgttgcactaactattcttaattgtcaggtcctgttggtgaggacatgttccattggcgggcgaccatcatggggccttcggacagcccatttgcaggtggggtattcttggtgaacattcacttcccaccggattaccctttcaagccaccaaaggtattttctctaatttttgatttctaatgccacctctacctgtatatttagattcctagagttacaattgtgcatatggtgacttttgaaacagttacaatgttttaatgtgcagatgatatgcttatct

SEQ ID NO: 6675 - DNA, 461 bp, Zea mays
  Clone ID: LIB3279-031-P1-K1-H4
ccgccgcctccgacatcgtcccttcgtccccacgagcaaccgataatccgccggcgtagagaggttggtttatcaggatctcctatctggcgacgagctcctgtcggattcattcacctacaaggagctcgagaacggcgtcctgtgggaggtcgagggaaagtgggtcacccaaggtcctgttgatgtggacattggtgccaatccatccgccgagggtggtgaggacgaaagcgttgatgacacagctgtgaaggtggttgatattgttgacacattccgtctacaggagcaacctccttttgacaagaaatcatttgtgtcttacatcaaaaaatacatcaagaatctcactgctgtgttggagccagagaaagcgggtgagttcaaaaagggtgtcgagggtgcaaccaagtttcttcttagcaagctgaaggacctccaatttttttgtggtgagt

SEQ ID NO: 6676 - DNA, 378 bp, Zea mays
  Clone ID: LIB3279-031-P1-K1-H5
cccacgcgtccgggccgccgaggtgctggagctggccggcaacgctgccaaggacaacaagaagacccgcatcatcccgcgccacgtgctcctggccatccgcaacgacgaggagctcggcaagctgctgtccggcgtcaccatcgcccacggcggcgtcctccccaacatcaacccggtgctcctgcccaagaagaccgctgagaaggcggcggccaaggaggccaagtcgcccaagaaggccgctaagtcccccaagaaggcatagaggggcgcctttaccgctgtgatgttgaatgctcgtgttcagtagatctttacttctgtagtgtcgtcgttgttattggaactggttagtagatctgtgcattggggttg

SEQ ID NO: 6677 - DNA, 391 bp, Zea mays
  Clone ID: LIB3279-031-P1-K1-H6
gtgctcagcgccgtcaacgacctcgccatcttcaatggatgcacaacgaaagcaattgagcatgctgctgacaaccctgctgttgtggaagcaattggagtgcctatagtcagaggaccgtggtatgatgcttctcttgaggtgggccatcgacggcggtctgtgtcatgcacattccctgtatctgggccacatgggtcaggatttctccagattaaggcaacccgagatggaggtttgttttcagttttctcctttgctgtgccctgaatagtcacattatacaaaaacgatggtgttgtgtagaggatggtctgctttcgtttctgcggcatcacgactggaagatcctattgctggaggctcatcttgaagcaccatcagatgatga

SEQ ID NO: 6678 - DNA, 374 bp, Zea mays
  Clone ID: LIB3279-031-P1-K1-H7
cccacgcgtccgctcggatggagattcgagcagccatgtgggcttcttatgcggctcgcctcctatacgcgctaacaaccctgttatccatgatccacagtttggtaaaagactgccatccttttctcctctaggagggagctcctatggcaaaatgccagcagtaagagttgaagtaggctcgccatcttgcggcgttagcagcagcccaaaagtaaggatcgaaggtttcgcctgtggcaactccgagacccattatgcagttacctttgtctgagcatttcgttgatatgttcctgattttgccctccgaccgaccgaccgctccttgtgaatcaccgtggtggtgtgcaagatattaagtagtgcattta

SEQ ID NO: 6679 - DNA, 276 bp, Zea mays
  Clone ID: LIB3279-031-P1-K1-H8
cccagatcaacccagactctgcaaaaggctataaaactcgtggaatggcatatgccaggcttggcaaatgggaggaagctgctcatgatctgcacacagcatctaacatggattacgacgaggagatcaatgctgtgctcaagaaggtggagcctaatgctcacaagatagtggaacatcgcatgaagtatgagaggttgagaaaagagagggaggaaaagagagcgcatcgtgatcggcttcctcaacgtgcagaggcgcaggctgcttacgaca

SEQ ID NO: 6680 - DNA, 435 bp, Zea mays
  Clone ID: LIB3279-031-P1-K1-H9
cccacgcgtccgcccacgcgtccgcggacgcgtgggcgcgcggcgaccacccgattcgaagcgtgcggagagaccgaagaagcgggagagatggctcgtaccaagcagactgctcgcaagtccacgggagggaaggctcccaggaagcagcttgccaccaaggctgcccgtaagtctgcccccaccactggtggagtgaagaagcctcaccgctaccgccctggaactgttgccctccgtgagatccgcaagtatcagaagagcactgagctgctgatcaggaagctgcccttccagaggctcgtcagggaaattgcacaggacttcaaaactgatttgcgtttccagagccatgcggtgcttgccctccaggaggctgctgaggcataccttgttggcctgtttgaggacaccaacctgtgcgccatccatgct

SEQ ID NO: 6681 - DNA, 438 bp, Zea mays
  Clone ID: LIB3279-033-P1-K1-A1
gttgagtcatgcagtaggcgcaaaataaataatagtcttccgcagatataaattttacgggtaccaggattacacgcttaaaattattatttgtgttcgatatggggaaaggagacgattcaacggctttttaactgttgtagcttgggtatgtttaatttggttacccggaactataaatttttattgaattgttactggtctgttgtcaccattctgattagttttccaccattcttagtgattggtaactgaaatgtgccctacgacttcagtgaagttattgttatcatacttaatgcacatcataagttaataatgacaatcccttgtagtgaaggcatatgttactatgttgttgtttgtatcaagggtcatttggagttaaatatttttttataaccacagtaatgaccaaaataatttctatatcaactt

SEQ ID NO: 6682 - DNA, 388 bp, Zea mays
  Clone ID: LIB3279-033-P1-K1-A10
cgctccgcctcagcgcgtcgcccgccgccacatcctacagcgacctcatcgatcaccttcaactttcaatcatggcggacgtcgatgtcgaaccggaggttgccgccggcgctcccaagaagaggacgttccgcaagtacagctaccgcggcgtcgacctagatgcgcttctcgacatgtccacggacgacctcgtccagctcttccccgcgcgcgccaggagaaggttccagaggggtctgaagaggaagcccatggcactcgtcaagaagctgcgcaaggcgaaaaaggatgctcctgctggtgagaagccagagccagtcaagacacatctccgtaacatgatcattgtccctgagatgattggaagcattggtggggtctacaa

SEQ ID NO: 6683 - DNA, 409 bp, Zea mays
  Clone ID: LIB3279-033-P1-K1-A11
cgcggcagcgaggaggaagcaaaggaaaggggatatgtcgaggccgcccaacaggagcgacgcgcacctctccgccgaggacgaggcggcgctggaggccgaggtgcgggagtactacgacgacgcggcgccaaagcgccacaccaagccctcccgcagcgagcactccgccgtgtacgtcgacgcgctcgtcccggacgtcggcggcaactcccacccggagctggacaagttccaagagctggaagcacacaccgagaggttggtgtacgagggcgccaatgtgggagatgagttcgtggagacggagtactacaaggacctcggcggcgtcggcgagcagcaccacacgtgcgtgctaatatctggcgcgtgcgagcagaccggaacgggtttcatcaagatggac

SEQ ID NO: 6684 - DNA, 401 bp, Zea mays
  unsure (1)..(401): unsure at all n locations; Clone ID: LIB3279-033-P1-K1-A12
gaaaagtggaaagaaatgagactggtcacccgtctccaatacctagaggatgataaggcagctgtctatctgtgttgcgcttcactaagtgtgattgtaacagtggtacctcttgtgttctgtgttccgcgatgttgcagttggttgcttgatcgaaagatgtttcaacctcccatctgctagctatgatacagatggtcccctgataataatgatgacatattctgtgaaaaaaaaaaaaaaaaaaaaaaaaaaaaaaaaaaaaaaaaaaaaaaaaaaaaaaaaaaaaaaaaaataaaaaaaaacaaagaaatacaaaaaaataaaaaaaaantataaagggggggccgttttaaaggacccaattttatttccccgtgcatgcaaagataagttttttt

SEQ ID NO: 6685 - DNA, 352 bp, Zea mays
  Clone ID: LIB3279-033-P1-K1-A3
gtacactttaattgtatcaccacttaaacatatttatgcggacttgaataattgtgggttaacgggagagggcgttgagagataacgtgactcccaactttgaccttgtcattgtggctttttatatctttttaaatgtcaagatagtgaatcagaaaccttctactagtctggttcattcttgatcacgtcacatgtattggtatttctcgacctattatgtgaccaatgtagcaaaaaaatgtctactaagagactgatgattgatgtaggtacaataggaaagatcaaatctagagacatcagtgtaattaattatttcttttaatttttatattgatgccaatatatg

SEQ ID NO: 6686 - DNA, 374 bp, Zea mays
  Clone ID: LIB3279-033-P1-K1-A4
gcgcgctcaaataaaaaaaccacatatacatatttattctgactgcaataatcctacatcggagtgctgatctccttgtgagataacgttactcccaactttgaccttgccattgctcctattatatatcttgtataaatgtaatgatagttactcacaaacctattactagtcagcttaattcttgatcacctaacatgtatacgtattcaccgtctcattatgtaaccaacgtatcaaaaaattgtctactaacagactgttctatcgttgttactacaataggacagttcaaatctagctacaccagggtgctctattattcctttaaatttttaaatttcaagccactttttaataaaataataataaat

SEQ ID NO: 6687 - DNA, 449 bp, Zea mays
  Clone ID: LIB3279-033-P1-K1-A5
cccacgcgtccgagcgaatccctcgcatcgcattcgcagcctttgctgcatcacaccaccgggaaaccccagcagccgcatcgatggcgcccaaggcggagaagaagccggctgcgaagaagccagcggaggaggagcccgctgccgcgaaggccccggcggggaagaagcccaaggccgagaagcgcctcccggcggccaagtcgtccggcaaagaaggcggcgacaagaagggtaagaagaaggcgaagaagtcggtggagacctacaagatctacatcttcaaggtgctgaagcaggtccaccccgacatcggcatctcttccaaggccatgtccatcatgaactccttcatcaacgacatcttcgagaagctcgccggcgaggctgccaagcttgcgcgctacaacaagaagcccaccatcacctctcgggagattcaaacctct

SEQ ID NO: 6688 - DNA, 410 bp, Zea mays
  Clone ID: LIB3279-033-P1-K1-A6
cccacgcgtccgcccacgcgtccgctgtggcaacaatgtcggcgggcgagaagaaagtggtagtggagggtccactgtgcagtgcctcaaaggtcgtcggttggttctcaagggacttcaacgacgggaccacccgttcagtgacgtataacacggaagctgacctgaatcctgctggtgccgctggtacacgagcccacacgatcgacgtctcaggttttgcgttcaatagctctattttgtgggatcctgagcggtggggacggccaacgtcattaccagacacttcacaggactcgatcaagttcgtgcaagaagtgctacttgaagaccgagctaagctgaaggggatcccctccgactgctcccagatcatggtgtggcagtacagcgtgcccagctcgcgatag

SEQ ID NO: 6689 - DNA, 117 bp, Zea mays
  Clone ID: LIB3279-033-P1-K1-A7
aaaacgggggggagccacgcgtccgcccacgcgtacgaccacacatccagtaacgcatcaatgatgacgggccaaaagaaggtgggggcaaaggaagcactgggcagagccttaaaa

SEQ ID NO: 6690 - DNA, 445 bp, Zea mays
  Clone ID: LIB3279-033-P1-K1-A8
cgagacgaagcctctccccacggcgcctccccctccacatggcctgggctcgccttgcctgccgctcccgtctgcgccccgcggcctccgccgccggccgatcccgacacgcctcaacaccggctccgcctccgcctccgtccccacctaccacacgcacggtacctgcggccacctccgcgccaccgctccggcgtctcctcctgcttccgcggcaccggtttgctgacgccacgccctcagcatcgaccgcgtggctgctcggtgcccgctggcgccaggggcacggcaggaggtgctttgcgagcgccgcctacccggcgcaggcgacgccgggggaggcgtctgaactggtggatgtgccactggcgcatactggggaaggcatcgccgagtgcgagcttttgcgctggttcgtcggcgagggtgaccaagtagatgaatt

SEQ ID NO: 6691 - DNA, 421 bp, Zea mays
  Clone ID: LIB3279-033-P1-K1-A9
cggacgcgtgggcggacgcgtggggttcggagcgcacacacacacaaccagatctcccccaaatccacccgtcggcacctccgcttcaagatgcagatctttgtgaaaaccctgaccggcaagactatcaccctcgaggtggagtcgtctgacaccattgacaacgttaaggccaagatccaggacaaggagggcatccccccagaccagcagcggctcatcttcgctggcaaacagcttgaggacgggcgcacgcttgctgactacaacatccagaaggagagcaccctccaccttgtgctccgcctcaggggaggcatgcagatctttgtgaaaaccctgaccggcaagactatcaccctcgaggtggagtcctctgacaccattgacaacgtcaaggccaagatccaagacaaggggg

SEQ ID NO: 6692 - DNA, 457 bp, Zea mays
  Clone ID: LIB3279-033-P1-K1-B1
ggcccacctgccattgttagaggcggaagcccacaggcggacccgaatccagaattcctgagatcgctgtcactgctcgaaaatcgaaatcgatccgatctccgcttgcgctgaagcctgatctccaccgggttcgcagcaggggcgcaggacctcgatcacgaggaggcaggggagcagcatccacaaccacaagccatggcggggagggccaacatccccactaacaactccgccctcatcgcaatcatcgccgacgaggacaccgtcactggcttcttgatggccggcgttggcaatgttgatctgcgcaagaaaaccaactacctcctcgtcgacaacaagacgacagttaaacaaatcgaggatgcgttcaaagaatttactacgagggaggatattgctattgtgctcatcagtcagtatattgccaacatgataaggtttctggtggata

SEQ ID NO: 6693 - DNA, 442 bp, Zea mays
  Clone ID: LIB3279-033-P1-K1-B10
cgctcgctcctacgccccttccccaggcgaccagccgccgctaggacaggcgcaccgtcgatccggatatccgccgtgccgccgcggggcctcgggctcgcgctcgtacaccgccgctgcccgccagcggcgcgcgcgaatgttgagcgcgacggcgacggcgcctccgggaacggcgagccgtcgtcctcgtctggggatggcgaccgcgacgcggcttcggagtcggggggcgatagcaccagcaccagcacgagcaccacgagcacggccgcgacaccgccgccgccctcgtcggagaggaacgaaaataagtggcggcggaggctgactaagggaggcggcgtggggcggtggctatgggagcccatagtccagggacgggagatgggcttcctcctgctccagctgggcttcgccatatttgcgctacgcatgcttc

SEQ ID NO: 6694 - DNA, 443 bp, Zea mays
  Clone ID: LIB3279-033-P1-K1-B11
cccacgcgtccgtgctttggcatcaagtggcattgtgccagcatttacggaggatgtcggtcgatctgtaaacgttgtacatgtcgtcgataccacaggagtacatggcgggcatatagaaccagtatcctatatctctttgttttccaatacacctggaaagctgacgaatgaattagtggaccttggaggcgaagaattttcttgcggaaggaacatgactactgacttggtaacatttacagtgaagtatggctgttggagttacaaagagagcagtaccggatggagcaggtctgaggttcctgtgctccttgtagaaagtgattcggttataggtggtgctcgacagacagtagtatcagtggataccaagtcatcgacgcgttggacgcttggaatcaacaaagatggaatcgatgacttcacagttcaagtggatt

SEQ ID NO: 6695 - DNA, 438 bp, Zea mays
  Clone ID: LIB3279-033-P1-K1-B12
cccacgcgtccgcggacgcgtgggcggacgcgtgggcggacgcgtgggaagtgagtgagagagagagagagaggagggaaaatgctgcgccacgccgcccgccgcctcgtttcccgcgccgtcgctccgcccaccgcgcgccgggcgctcgccacggcggaggtgcccgcggaggccgtcgaggactccacgttcgtcgaggcctggaaaaaggtcgcccccaacatcgagcccccagcgacgcccctctacctcatgcagccgcgcccgcccacgccagctaccatccctaccaagctcaccgtcaacttcgtcctcccctacaagtccgagatcgccaacaaggaggttgacatggtaattgtaccagctacaactggtcagatgggtgttttgccaggccatgttgccacaattgcagagcttaagcctggtgtt

SEQ ID NO: 6696 - DNA, 367 bp, Zea mays
  Clone ID: LIB3279-033-P1-K1-B2
cgtccggtcccacctgccattgtcagaggcggaagcctacattcggacccgaatccagaattcctgagggtgtgtcactgctcgaaaatcgaaatcgatcctatctccgcttgcgctgaagcctgatctctaccgggttcgtagcaggggcgcaggaccttgatcacgaggaggcaggggagcagcatccacaaccacaagccatggcggggagggccaacatccccactaacaactccgccctcatcgcaatcattgccgacgaggacaccttcactggcttgtcgatggccggtgttggcaatgttgatctgcgcacgaaaacacaactacctcctgggggacaacaagactacggtcaaacaaa

SEQ ID NO: 6697 - DNA, 170 bp, Zea mays
  Clone ID: LIB3279-033-P1-K1-B3
atgatctctctctcattgggttgttgtcctgtacttacacatgtgttggttgatggatagatggcgattgcgtggtgcggatgtttcggtttggcggtgtcaattctgatatgcgcgtcggtgctgttctgatactgactatatacggaaataaaaatctgatttgcatt

SEQ ID NO: 6698 - DNA, 450 bp, Zea mays
  Clone ID: LIB3279-033-P1-K1-B4
cctcactcttcactagccctctgctcctctgaaatggcggcggcgacttcctcttccacctacgctcgccatcggccgcaaaaccctaaaccccgccccctccgtagccacagccgccacctccgtctccttccccgccacgcagcatccatgcctcgtcgccgcctccgcggaccgccgccgcgccgtggctgcgaaggtctcgtcgccgtcggtcatcggcaccgccatgccgtcgctcgacttcgagacctccgtcttcaagaaggaaaaggtgtccctggccggccatgaggagtatattgtgaggggtgggagggatctgttcccgctgttaccggaggccttcaagggaatcaaacagatcggcgtaatcggctggggctcgcagggtcctgcgcaagctcagaacttgagagactcacttgttgaggcaaagtcagatattgg

SEQ ID NO: 6699 - DNA, 446 bp, Zea mays
  Clone ID: LIB3279-033-P1-K1-B5
cttctcctccccctcttaccaagtcctcttcgggttagggttacttagggttttgtggaggggcgatggcggcggctgatgtggagtaccgttgcttcgtcggcgggcttgcctgggccaccagcaacgagtcgctggagaatgccttcgcctcctacggcgagatcctcgactccaaggtcatcaccgaccgggagacggggaggtctcgcggcttcggcttcgttaccttctcctccgagaactccatgctcgacgctatcgagaacatgaacggcaaggagctcgacggccgtaacatcaccgttaaccaggcccagtcccgtggcggtggcggtggcggcggtggctacggcggcggtcgcggcggcggcggctatggtggcgggcgccgtgacggtggttatggcggcggaggcggctactgcggtctgcacgaggtttgt

SEQ ID NO: 6700 - DNA, 442 bp, Zea mays
  Clone ID: LIB3279-033-P1-K1-B6
cacgtccatcggagttgcacatccatgtgagttggcagaggtgtttgatgtgatgtgggcatttgtgttttatgtaatagatagcatcatcctcgctcgttgtgccgccttcgtccacacaagcgacggagctaaggttacgagaactagcccggtggcaccatgttggtctaccaggatctgctatctgacgacgacctccagtaggactccctcccctacaggcaactcaggaacggcgtcacagacgtcgaggacaagtgcactatcaaatacgcgatctttgccgagtgcatataatcttgccgagagcaaaataaagcaaaaggctatcggtaaggaggcagtattctgagtgtcgtcctctcggcagagatagacacctggtaaccggtggtggcacacggtgtgatcgcgaagggtgcatcaaggcgaagcaact

SEQ ID NO: 6701 - DNA, 402 bp, Zea mays
  Clone ID: LIB3279-033-P1-K1-B7
gactgactggtggaagaaggccctggagagcgagaacgtggactcggtgaagatcagcaaccggctgcatgacaccccctgcgtcgtggtcacctccaagtacgggtggagcgccaacatggagaagatcatgcaggcgcagaccctgtcggactcgagcaagcaggcgtacatgcgcggcaagagggtgctcgagatcaaccccaggcaccccatcatcaaggagctccgcgacaaggtcgcccaggacaacgaggtaccttaccttaccttacctgcattttgatttgctcgtaaggggcacacgaacgtgggaggatgttgattcgtttgttcgtgttgattgcaacgtaaaacaacaacagagcgaggagctgaagcacacggcgaggctggtgtacc

SEQ ID NO: 6702 - DNA, 451 bp, Zea mays
  Clone ID: LIB3279-033-P1-K1-B8
gaccaacctggtaccctacccgaggatccacttcatgctttcttcgtacgctccagtcatctctgctgagaaggcctaccacgagcagctctctgtggctgagatcaccaacagtgccttcgagccatcttccatgatggccaagtgcgacccacgccatggcaagtacatggcctgctgcctcatgtaccgtggtgatgtggtccccacggatgtgaatgctgctgtggccaccatcaagaccaaacgcaccatgcagttcgcggattggtgcccgactggcttcaagtgcggcatgaactaccagcctcctagcgttgtgcctggtggcgacctggccaaggtgcaccgtgccgtgtgcatgatctccaacttcaccagtgttgtggaggtgttctcccgcatcgaccacaagttcgacctcatgtacgccaagcgtgccttcgtgcac

SEQ ID NO: 6703 - DNA, 445 bp, Zea mays
  Clone ID: LIB3279-033-P1-K1-B9
ccgatccgccacctctcttatctgaaaacctccagagtccagcctcccttccgattccacctccaagctcccagtcccagccatggcgtctcatgatcatcaccactcccactcccacgacgaccaccaccaccattcccacggggacggcggtggccatgcggctgggggatcgtgggtaggggaggacggacgcgtgtggcactcccacgacggcctcgcgccccactcccacgagcccatctactcccccggcgacttcaccaagcgcgcgccgccgctcgcctcgcgcgacttcgctgaccgcgccttcaccgtcggcattggcggccccgtaggcaccgggaaaactgccctcatgctagcattgtgcagatttctacgcgacaagtatagtcttgcagctgtcacaaatgatatattcacaaaagaagatggagaattc

SEQ ID NO: 6704 - DNA, 332 bp, Zea mays
  Clone ID: LIB3279-033-P1-K1-C1
cgcacgcgtgccagagcccgctgatcacggtactgatccatccactctttatgatactgggggggtgcccatagctgatactgcccacaatttcgctctacctgtacatgaaaggggtgtgggactacaggtggctgcacgggcactcaccctacatgaacacccggactgtcccacactctgacgcgcccaaccggactagcttgacgaggagataaacacattacacactctctccacaacggaatggttgcagatgctatgtcgacaagttgctcatcgaagccaggaggatccaaattttgtactgcgaccttaacaaacaatgtgag

SEQ ID NO: 6705 - DNA, 404 bp, Zea mays
  Clone ID: LIB3279-033-P1-K1-C10
gacacatcaacctttttcacaaatgtataatgaaaatatcctgaatcaaaaaaaccgggtgctctgaatatcgataaagcttccctaaatcatcttagtgcattgtcacttgtttttatgctgttatatgacattgttgcagaagctgtatatcatgcaatggcaatacacacagtaaaacatatcacattaccaccctttgtctcgctcgaagccaaggaacccttatgtgggcaaggtaagggtgccaaactatatgctatgccatttgagggcttgaggcaagagacccaaacatggcaaggttgactataactaaataaacttactttaacaatcgagtatgtcaaatataacatgtgtttggttacaagctaaaacttggattttattttaatacaatt

SEQ ID NO: 6706 - DNA, 402 bp, Zea mays
  Clone ID: LIB3279-033-P1-K1-C11
cgctcggtgatgaagctacgaggcgccaatagcacggagttcgatccagctacgacgtcgccctgtgtcatcttcatgccagagggctcaaaaacccaaatgggagccacgatgaggcttgggtcgaggaggacctatttccatgtcagtggctgcaaatctgcgaagctgtacggcaacgccagctctgtagatgaaagacatcgccacagatacgaggtgaaccctgacatggtcccagactttgagaaggccgggcttcagttcgtgggcaaagatgagagtgggaaacgcatggggatcgttgagcttccctctcacaagttcttcatcggtgcacagttccatcctgaattcaagtcgagaccagggaagccatctccgcttttcttagggctgata

SEQ ID NO: 6707 - DNA, 443 bp, Zea mays
  unsure (1)..(443): unsure at all n locations; Clone ID: LIB3279-033-P1-K1-C12
cccacgcgtccgctcaaagttcacagctccaatcctggtgcaagcgcacagtancggagcaagatgcggggaggagaccggccatcggcgtcgctccagctcctctcgctgggcctcgtgctcctctacttcttcacctcaggcagcaccgttggtctcgtggagggacagaagacgtggtgcatcgcgaagccgtcggcgtcgaacgagatcctggcgcagaacctggactacgcgtgctcccaggtgagctgcgccgtgatccagaagggcgggccgtgctactacccggacagccccgtgtcccgcgccgccgtcgccatgaacctctactacgcctacagcggcaggcacccctggaactgctacttcaacaactccgcgctcgtcgtgcagtccgacccaagctatggctcctgcacatactactgaggaggaatgtg

SEQ ID NO: 6708 - DNA, 327 bp, Zea mays
  Clone ID: LIB3279-033-P1-K1-C2
ccagcctgcgctggccgccgacgttcttctggcggcgtgatcagcttccacctccggttctcctcctccgtatattactcaaaaccaactggtagaagagaggagagaactccagaggcccaactggaagaagagaggaggcaacgtttggagttggatgcgaggatgaggtccgagcagcagaggacggaggacattcttcgttacatacagtccgcaacgggtgtagctccaccacctttgctattcactccaaatccacctccatctaatttttccactcctggggttggaactactgtgattcaggatgagaaggaatctttg

SEQ ID NO: 6709 - DNA, 299 bp, Zea mays
  Clone ID: LIB3279-033-P1-K1-C3
ggcgagcctatcataacataccgactaagcttacgcaagcatgcgccggccatttgacgggggggtcttcacagaggtgagggattacacctacgttgataacttaaaaacaacagtgcaagaagaggagggaactccacaggacacggtgaaataaaagaggaggcataattccgagtcgaatgcgatgaattagctcaagcatcttaaggcgaaggacaaatttaattccatgcaaaacgtagcgggtgcaaaccataaacctttccaatccagtcctaggtgaaatataaaataat

SEQ ID NO: 6710 - DNA, 356 bp, Zea mays
  Clone ID: LIB3279-033-P1-K1-C4
gcccccaaggccccaactacccccagtctcgtatgataactatccagaagctcaagactcgaaggccgtcgccttcctatccatcccttccttgccacgggggttgcctgagatcacataaacaatggtgaaggctgttgctgtgcttggtagcagcgatggtgacaagggcaccatctttttcacccatgtgggagatggccctaccactgacaccggaagtgtttctggccttaagcctggcctccatgggtttcatgtgcatgcgcttggtgacaccaccaatggctgcatgtaaactggaccacactacaatgctgcgagcaaggaacatggctgcacctgaagatgagaac

SEQ ID NO: 6711 - DNA, 371 bp, Zea mays
  Clone ID: LIB3279-033-P1-K1-C5
cccacgcgttcgaggacgcgtgggcggacgcgtggtcaaaagatacccatggataccttggggctgatctttctgccctttgcactgaagctactcttcagtgcatacgcccgatgatgctcgtgatagagctgacctattacactgtcagtgcatacatatctacctaactggacgtcacccactactatgtaaatgactgcacatcgccacaagcacccaatgtgctcttacagaaactcgagccttgagaaggccgggcttcagttcgtgggcaaagatgatagtgggaaacgcatggggatcgttgagcttccctctcacaagttcttcatcggtgcacaattccattctgaattcaagtctagacc

SEQ ID NO: 6712 - DNA, 449 bp, Zea mays
  Clone ID: LIB3279-033-P1-K1-C6
ggcatcctccgtctcgtaccgacccccgcaccgccaaaccctagtccggcgaggcgaccttgcgacctccgttcctctgcgctccggctgagtttctgatttgggataatcctgttctctctgagtgaatcaacatgtctgggaatgatgataagccacatgctgctgcagacagaataaaggcagccacgttatcagtggctaagggattgagcagggctcaagctgaacgcgctgcgactgctgctgcccgcaatgtgaatgcctatgggcagaaggaagagggaccaagccgctggcaggagaggaaggaagccaagagacagatgtatctgatgagtacagagaaggctgcgaagctgggcactgtgaagccaaaagcttcagaaacttcttctgttggcgcatatacccaatgccagaagtgtttccagcatggtcactggaca

SEQ ID NO: 6713 - DNA, 436 bp, Zea mays
  Clone ID: LIB3279-033-P1-K1-C7
gttggaatcagcacaagctaagaatcaggcactaagggaagctggtgcagttgtgcctacatcatatgaagctctagagagtgcaattaaggaggtatttgacaaactggttgaggaaggaaaaatttctcctgtgactgaaattacacctcctcccattcccgaggaccttaaaactgcaattaagagtgggaaggtccgagctcctacccacatcatttccaccatctccgatgacagaggtgatgaaccgtgctatgctggtgtgcctatgtctacaattattgaacagggttatggagttggtgatgttatctctcttttggggttcaagcgcagccttcctcgctattgcactcagtttattgagatatgcattatgctttgtgcggaccatggtccctgtgtatctggtgctcataactctataagtact

SEQ ID NO: 6714 - DNA, 367 bp, Zea mays
  Clone ID: LIB3279-033-P1-K1-C8
gataattccagcaagcccatcgcctgaacattagaatcttgcaatatacattctggatcccattgccacatagctttttcatcgagcttgctccatggactgaaaccaccatatttctactacattggatcctcaataaattcacatactgaacatggaaggaactcctcttcagtgttttcttagggattgtggttgctcatcagatatggttctaaggcacgatcaacattctcagtgctccagaataatagcatattcctgccatcttttctcttgctgataatatcttcactttcccaataattctgttgatcacttgtagcagccctggaaatgaacccaacagaataacatttcgttttat

SEQ ID NO: 6715 - DNA, 406 bp, Zea mays
  unsure (1)..(406): unsure at all n locations; Clone ID: LIB3279-033-P1-K1-C9
gtcacatcagcctttttcacaaatgtataaggaaaatatcctgaatcaggaaaactaaatactctggatgtggataaagctgtcctgaatcatcttagtgcattgtaaattgttattatgcttttatatgacatttttgcagtagctttgaatcatgcaatagcaatacacagagtaaaacatatcacatcaccaccctttgtctcgctcgaagtcaaggaactcttaggtgggcaaggtaaggtagccaaactttatgctagaccagtagagggcttgaggcaagagagccaaacatggcaaggtgatccataactaaataaacttacttaaacaatcatctatgtaaaatatagcatgtgtatggtttcaggtttgcacttgcattntatgggaatccaactcg

SEQ ID NO: 6716 - DNA, 451 bp, Zea mays
  Clone ID: LIB3279-033-P1-K1-D1
cacctgtacacgcctccgccaccctaccaactactcaataaccctagctaaaccccacgccggcgcggcgacctcctccgccggcaggatggacagcctcaggggagccaagttgccgggcgtgccgaagggcgggagtgcgctcgtgaaggtggcgctgctcggcggcgcggggctctacgccgtcctcaacagcttctacaacgtcgagggcggacaccgcgccatcgtcttcaaccgcctcgaggggatcaaggacaaggtgtaccccgaaggaactcacctgatgatcccgtggatcgaaaggccgatcatctacgacgtccgcgcccgacccaacctcgtcgagagcaccttcggaagccgcgacctccagatggggagaattggtcttcgtgttcttactcgacccatgccagatcagctacctaaaatctacaggaacttgggg

SEQ ID NO: 6717 - DNA, 449 bp, Zea mays
  Clone ID: LIB3279-033-P1-K1-D10
gctgggagatcttgaggggcaattgaaagatgagaagtatgtcttggtatccaaaccgtacatgattcttaatgataaactacaacatttgaatgctgagatagagcgttatagagggttggttgaagttttacagaatgacaaggaccagctcatgcaaagggagaaagaaatttctgcaaaagcagaatcgctcgacagtgttaaacaaaccattatcacatatgagaaaaaaattgaagaactggaaactcaaattcagatactcttttctgaaaagaatgatcttgaaaccaaggttgaggagactttgcaagattcagcactctccaatgaactgggtatgatggagaatcagttgagtcgatcaaaggatgcagcttttgaagcacttgcattgcgtgagcaagctgaatcattaagatcattggtagctaaaaagattgagg

SEQ ID NO: 6718 - DNA, 424 bp, Zea mays
  Clone ID: LIB3279-033-P1-K1-D11
cggacgcgtgggcgagcgcaacaccatccacccaccagttcgaagcggaggcgaccggcaacctgcggcggagatgtcaggcaggggcaagggcggcaaggggctcgggaagggcggcgcgaagcgtcaccggaaggtgctgcgcgacaacatccaggggatcacgaagccggcgatccggaggctggcgaggaggggtggcgtgaagcgcatctccgggctgatctacgaggagacccgcggcgtgctcaagatctttctcgagaatgtcatccgcgacgctgtgacctacacggagcacgcccgtcgcaaaaccgtcaccgctatggacgtcgtgtacgccctcaaacgccagggccgcactctctatggcttcggcggctaggttaggtgtgggtaattgcctgtccaggtgtctcggatc

SEQ ID NO: 6719 - DNA, 448 bp, Zea mays
  Clone ID: LIB3279-033-P1-K1-D12
cgttcactcgcactcgcgcaaccccgcggccccgcgcctaatggcatcctgtggcgccggcgacgccgcgtcagcgcagccgagggccagtatctcgcacgtcatcttcgatatggacggccttctcctcgacacggagggcttctacacggaggtgcaggagaagatcctagcgaggtacgacaaggtgttcgactggtcgctcaaggccaagatgatgggcaagaaggcggccgagtctgcccgcatcttcgtcgacgagtgcggcctcaacggcctcctcacccccgagcagttcctcgaggagcgcgagagcatgctccaagcgctcttcccatcctgtaccaggctgccaggagtactacgtttggtccatcatcttcatgccaacggagtaccgatggctgttgcgacaggatcccataaacgccattttgcactgaagacc

SEQ ID NO: 6720 - DNA, 406 bp, Zea mays
  Clone ID: LIB3279-033-P1-K1-D2
ggtgatagtgcggtgattgctgagactggtgactcctggttcaactgccagaagcttaagctgccagaaggctgtgggtatgaattccaaatgcagtatggttcgattggatggtcagtgggtgcattgctcggatatgctcagggtgcgaaccacaagcgtgtgattgccttcattggtgatgggagcttccaggttacagcacaggatgtgtcaactatgctgcgatgtgagcagaacagcataatcttcctgatcaacaacggtgggtacacgattgaggtggaaatccatgacgggccatacaacgtcatcaagaactggaactacactggctttgtggacgccatccacaatggcttgggcaagtgctggaccttcaaagtgaagagcgaggaggagctga

SEQ ID NO: 6721 - DNA, 431 bp, Zea mays
  Clone ID: LIB3279-033-P1-K1-D3
ttccactccgacattcacgtgcagctgtcgggagcaggcaatggcgccggatctaagcgaactcgccgccgccgctgcagcccgtggcgcctacctcgccggcgtcggtgtcgcggtcctcctcgctgcctccttcctcccagtagccgagtcgtcctgcgtgcgagataactcattggtgagagacataagccaaatgccgcaaagcagctatgggattgaaggattgtcacatataacagttgctggtgcgctcaatcatgggatgaaggaggtggaagtgtggcttcagacaataagtccaggtcaaaggacgccgatccacaggcattcctgtgaagaagttttcactgtcctcaaagggaagggtacgctcttgatgggatcaagctcactaaagtacccagggcagccacaggaaattcctttct

SEQ ID NO: 6722 - DNA, 383 bp, Zea mays
  Clone ID: LIB3279-033-P1-K1-D4
gatgaatcaaagcactgaatcacattcataacagccaaactgatttgcctagaacatcagtacacgattgcaggacaagaagcgatagattccatcccctagttcagacactacagaaacaggaagacagagcagcaatcaggccctctcgcccctgatgcggcgcgcgagctggatgtccttaggcatgatggtgaccctcttggcatggatggcgcagaggttggtgtcctcgaagagacccaccaggtacgcctgggcggcctcctgcagcgcggcgacggcggaggactggaaccggaggtcggtcttgaagtcctgcgcgatctcccgcaccagccgctggaagggcagcttccggatgagcagctccgtgctcttct

SEQ ID NO: 6723 - DNA, 447 bp, Zea mays
  Clone ID: LIB3279-033-P1-K1-D5
cgtcgtcttcgctctcacgatccctcggcagtcggcgacggctgggcgaccgccacttccgccttctcttcctactgagcgtctccaggcacgcttctgaattcggagttgccagcattcgctcgaggtgccggaccagatctcaccatcatgcaggctagcgatagattcaacataaactctcagcttgagcatcttcaagccaaatatgttggtacagggcatgctgatttgtctagatttgaatgggctgtaaacatccagagagacagctatgcctcttatattgggcactatccaatgctagcatattttgccattgctgagaatgaatcgatcggaagagaacgttacaatttcatgcagaaaatgctgcttccttgtggcctccctcctgagagagatgaagattgaggagctgttgcatagtttcagtgtttccaatga

SEQ ID NO: 6724 - DNA, 435 bp, Zea mays
  Clone ID: LIB3279-033-P1-K1-D7
agcaattggtggacgtgtgtagagaagattgcaaaactgcagtatgatggattccactattcatcaaccgagatcatggcgcgcttcaatcgtggctacgctgatggggaattgatccgttatggctcgtggctgtggagatgtggaactcattggttatagtgtgcttcaatcatgggtcatggcgatgctgatggaactgatttgttaccaaggtttaagttttcgctaccgttggacggcctgactggtactttgccctgttgactgtttgagaacgtactgcccaggtttacttaatacttgctgctttttgacggtactgtacatattgttcgacaatttatttcttggcagttcaattcgtccatttagaatttctaggggcacgagagcatgtgttaccctggagatcaaattcatgctgttttttgt

SEQ ID NO: 6725 - DNA, 378 bp, Zea mays
  Clone ID: LIB3279-033-P1-K1-D8
cgagaacgcacccgctcgcctcctcctcccgtccccatccagatgatgcttagggtttcctcgtctccggccgccgcggtggccaaccatctctctggtggggccgcggcgaccacggctcctgccagggtgacggcgcaacgcagcggcgtctcgctgtccgccgccgccgccgtcggcaaggggaaggaggtgctcagcggggtggtgttccagcccttcgaggagatcaagggggagctcgccctcgtgccccagtcccccgacaggtcgctcgcgcgccacaagttcgtcgaccactgcgaggcagccatcaacgagcagatcaatgtggaggtcaacgcctctgatgcgtaccactcccttttcgcctacttt

SEQ ID NO: 6726 - DNA, 221 bp, Zea mays
  Clone ID: LIB3279-033-P1-K1-D9
cgagaacgcaccccctcgcctcctactaccgtacccatccagatgatgcttactgaggcgtcgtcattctccgtcatggtgtccaaccatctcttttatggtgccgaggtaaccacggttcctgccagggtgacggcgcatcgcagcgttgtttctctgtacgtcgtcttcatcatctgctaggggaaggaggtactcaactgttttgtttcccagcccta

SEQ ID NO: 6727 - DNA, 404 bp, Zea mays
  Clone ID: LIB3279-033-P1-K1-E1
cacgatttgcatcgcctgaggactcaaaaaataaacagaagtcttctgttgagtctccaatggagataatttctgaaaataagttgcctgtagggcttggtagaaggcctcctgaaaagctaaaagaaggttttgttattgctctaaagacaagagacaattcaggtttttatgtttcaagagagagggtcactggcggtggatggtatcttgatgtgataccaaatgccacaaagagggatcctgctgctcagtttttagtcactttcagaaacaaggacactatgggactgcgatcttttgttgctggaggcaaactattacaggctaataataagatggagttcgtcttcgcaagtcattcttttgatgtttgtgagagctggatgctggaagggtgcctt

SEQ ID NO: 6728 - DNA, 441 bp, Zea mays
  Clone ID: LIB3279-033-P1-K1-E10
gttgaaagaggaagagatatcagctccgtgcttgaccaatatgggaggtttgtgaagccagcgttcgatgattttgttttgccttcaaagaagtatgctgacgtgatcattcctcgaggtggtgataaccatgtagcagttgatctgattgttcaacatatccgtacaaaacttggtcagcatgacttgtgcaaaatctatccaaatgttcatgttgttcaatcaacttttcagatccgaggaatgcatactcttatccgtgatagggacatcaccacacctgactttgtattttattcagatcgattgatccgtttggtagtggagcatggtcttggacatttgccatttacagaaaagcaggttattaccccaacaggatctgtttatatgggagttgacttttgtaagaagctctgtggagtctctattgtgcgaagt

SEQ ID NO: 6729 - DNA, 437 bp, Zea mays
  Clone ID: LIB3279-033-P1-K1-E11
atttgatcacctgatctctgcccacgtggtctttttcaaaaccccggatataatccctggggagagcctgaatctggacgacatcgaggcggggatatacatgctgcactgtctacctctcaggctggtcggagccgagggtgcaccgaccagatgcatcctcatcaagtgatcgttcctcggccgtcctgctcttgctgccttgctggaggtggcgacactggaccatgccagctgagctggtgctccgtcgtgggtcgtggccaatatttggctcgcatgcagtcgtcgatctatatggaacagaacactgcatgcctatgtagatacgcttgtatggacaataaaggaaccgcagtacttctgtcgatgaaatacttttgggtgagctggtaatctaagacaccaggcctacaggttacttgtaactgtaagct

SEQ ID NO: 6730 - DNA, 442 bp, Zea mays
  Clone ID: LIB3279-033-P1-K1-E12
gcggagcggaagccccagtggccagtgcccaccaccttgacgcctgcttgcgtcgtggcagccgaagatctggccaacggccccagaccgatcgacccccctccccctcggcgcggagaggcgcagtcaaatttgtcaagctactgaagatgctccagatatagtcaaaaaccatgggagaagttagtgatgataattccaacatgtccttactaaaaagaatcgttacaggtgacgagccgctgttgaaagagtatggtgtgaacggagttgttgacgccctgctattggctgaagatactcctgtcctgcttaccatgatgtgtggtaagaagacaaagcatagggcggtgcgagctgatgtgggtggagaggagggatttgcaatgcggaacaacgagctgttctccttagttgaagtcccatgggagggcgccacgac

SEQ ID NO: 6731 - DNA, 441 bp, Zea mays
  Clone ID: LIB3279-033-P1-K1-E2
accaccgccctccccttgccatttttggtgagtgccccctttcccttccctagaccagatcctcgccccgttttccacttttgcctccaccgccggcccaattcggataacaagctccctccgcctcgccgcgtctcctcccagccgcaggagccgccgccatccgatccggaagagggaggaggggggagggaggaggatctgtgtcccgattcgattggagctctcgtccccggcggtccaggatggtgcggggcaagacgcatatgaagcggatagagaacccggccagtcgccaggtcaccttctccaagcgccgcaacggcctgctcaagaaggcgttcgagctctccgtcctctgcgacgccgaggtcgcgctcgtcgtcttctccccgcgcggcaagctctacgaattcgccagcggaagtgcccagaaaacaa

SEQ ID NO: 6732 - DNA, 453 bp, Zea mays
  Clone ID: LIB3279-033-P1-K1-E3
ctctgaagccaagggttgtagaaaactgccgctatcagtagccgccactgcaaaatcaagcggagtactcctacatggattagagtaagatacttagcttggccaaggagggaactccgagctaaaacttgggcaattgaatttgagaaatggatggaaccaaatttgattgagaaagaaaaggcaatacttggtttcctccaattttctcatgttcggttgatcggatgtgtaggtggcagtgcagcaagatgagacctgtctgaagaatttggaagctgaaggtgagcgttggcggaaaccaagtctccaactgcacgcaaagcacaagatttagttccctccaatgtctcatcttcaaatgtctcaaatcaatgcaaatctcgaggcgttagtaggatcattattatcctccaaatacggtgttcctagttaagcaaagtaatgggcttt

SEQ ID NO: 6733 - DNA, 448 bp, Zea mays
  Clone ID: LIB3279-033-P1-K1-E4
cccacgcgtccgatttggacagcaaaggagaaagaatatgtagaagctaatcatagattgaacatctgccttgatgagaaccacaaactttcagaagatttgatgaaggtgatgcaagagctagggtgttgtagagaacaatgcaaaacaatggaggataaactggtgctttccatgaagagtgacatgaatgagaaagtaacggaatgcagcgaggcttgtaaagcatccgaccaaattgtggagaatggaggaaccattcctggtgctgcgtgtgaaaatatgagatccatggtcgctgaagcagaggttttgaaagagaattgtaacagaaagttaatacatgccaaagatacaatagatgagttgagctctaggatatctgtcatggaagccaatctgaaaaatgatactgcgtctaataacaaagagaagacaaagcttcgca

SEQ ID NO: 6734 - DNA, 448 bp, Zea mays
  Clone ID: LIB3279-033-P1-K1-E5
cggacgcgtgggccgcgaaatagccgtcgccgcactgccgcagctccggctatgtcaatcttcgagtacaatgggtccgccgtggtggcgatggtggggaagaactgcttcgcgattgccagcgaccggcggctcggcgtgcagcttcagaccatcgcgacagacttccagagggtgttcaagatccacgacaagctctacatcggcctctcagggctcgccaccgacgcccagacgctgtaccagcggttggtcttcaggcacaagctgtatcagctgcgcgaggagagggacatgaagcctgagacctttgccagccttgtctctgcgctcctctacgagaagagatttgggccatatttctgccagccagtcattgctggacttggagatgacaacgtaccattcatttgtaccatggactgcctcggtgcaaaggagctggcca

SEQ ID NO: 6735 - DNA, 448 bp, Zea mays
  Clone ID: LIB3279-033-P1-K1-E6
cggacgcgtgggtgcctctcctcctccagagctcgtcgccaccggccaccgccaccctcgatcacgccgtccgtcgaggtaaggtcagcatggtgagggtcagtgtgctcaacgatgcgctcaagtccatgtacaacgctgagaagattggcaagaggcaggtcatgatcaggccgtcatccaaggtcatcatcaagttcctgacggtcatgcagcgccatggctacattggagagttcgagtacgttgatgaccaccgatcgggcaagattgtggtcgaactcaacgggaggctgaacaagtgcggcgtcatcagccctcgctttgatattggcgtgaaagacatcgagggatggactgcaaggctgctcccgtccaggcagttcggatacatcgtcctcacgacttcggcaggcatcatggaccacgaggaggcccgccggaagag

SEQ ID NO: 6736 - DNA, 358 bp, Zea mays
  Clone ID: LIB3279-033-P1-K1-E7
cgcacgcgtgggtgcctctcctcctacagaattaatcctctcctaccttctcttccaggggtcacctcttctgctgagattaggatactatgataaggttcactgaacttaacgctgcgctcaagttcttgtacaacactttgaatattactacgagattatctattttctttcctgcatcaagggttattataaattttcactcggtccttcaaggctttaccttcatcccagcgtgtctgtactgttcggtgcacgactcatattaaattgatagagaacctctccagtctctaggttatcttcttcaatcgccacaactgtcttgtttaaaaaagcgtatgaactcttcgttctc

SEQ ID NO: 6737 - DNA, 438 bp, Zea mays
  Clone ID: LIB3279-033-P1-K1-E8
cccacgcgtccgggggagaccctgctgcatgacccccgggtctggatggctggggcgctcttcgtctatttcttcagcgtctcggggggcatgtatgggattatcaggcacacgcccatgttcctcaccgaccgcgcggatcccaacaagctcgtgttcttctaccagcggtcagggatgcaggtgggggctgaggggtttactgtcgggttcttgtacacactcgtgggtctcatgatcgctgtggtgacacacttgttggtgaaggtggcgagcctgcatacacagcgccttgcgatgctcgctggcatggtggtcgggtggtgggctgttaggaaggtgatctacttagataactggaagactggctctagcattcataccttcttcccgagcaactggaggtgaaattcttgctgggtggggtggatgcttctc

SEQ ID NO: 6738 - DNA, 447 bp, Zea mays
  Clone ID: LIB3279-033-P1-K1-E9
cccacgcgtccgagaagatgaagagcagcactctgttggcgatcctagttctccaggcccttctggtctctgcggccgtggccaaaggacctgcagggccgacgacgaagaagcagtgctggtgcggcgagtgcaccagctggtcgggcgtgtggacctgcgacgacctcctcaccaagtgcgccgccacctgcaagaactgcgtccccgtgtccacggacaagggcaccaccaagtacagatgccgcgacttcctccccgaaaactgcggctgcaagatccactagactcatccacagcggcacagccgatggatccttccatgctcctccgtccgtccgccttgctacaagcaggcagccaccaataagctagctcttgttgttgttttgcatgtatgattgggtgtccctttccagtccagatggaataatgtcaggcgcacgt

SEQ ID NO: 6739 - DNA, 419 bp, Zea mays
  Clone ID: LIB3279-033-P1-K1-F1
cgcatggcactcaagtaccatccagataagaattcagacgaccctgttgcctcagagaagttgcaagaggccacattctcctataatatcctgtcagatccagacaagaggcgccagtatgatgcatcagggtttgaggccattgaagcagatagtcaggaactggagctggacctatcaagtctcaatactgtaaatacagtgtttgctgctctgtttagcaaactaggtgttccaatcaagaccactgtctcggcaacagttttagaggaggcattgaacgggtcagtagagatttctcagcttcagctgggcaaatctctatgtaggaaggtagaaaagcagtcagctcacttttattctgtggacataacagataaagaagccaaaatgggcttagtttgtagagttcattcaac

SEQ ID NO: 6740 - DNA, 448 bp, Zea mays
  Clone ID: LIB3279-033-P1-K1-F10
cgcgctcgccgctatcattcgtttctggagacccttctagccccgccgccaccacaccaccaatggcaggactcggatcaaaggccctcgccgtggtcgccgtcctggcggccgtcgtcctctcggtggcctccgcggccgaggcgcccgcgcccagccccgtctccgccgccgccggcgcgtcggcgccgttcgccgcggccctcgtcgcctcctccgccgccttcctcttcgccgccgtccgccactgagccgatggggccctttcaccgccgccgccgcctagatctatttattggagtggtattcagtagtactggtactagggagatttcttcgttggtgtcgtgtcgtcgtcgcattttggtcggatctggtgtccttggtgggtgcggagggtttgtaccgcggtcgggtgtacgttgtgtgatctgattctgatcccctt

SEQ ID NO: 6741 - DNA, 448 bp, Zea mays
  Clone ID: LIB3279-033-P1-K1-F11
attccagaaaactctcaaaatactcttgtcccatattctgcctataactctcctgtggatactaagtcagacgattcattcgtcactattctcaccaacagtgaacttcactgtgctacaccacatacacccagctataaatacacccagctaccctctccctctccacacacactcaacaccctcagccaaggcaaacaccccacccacttagttactctgctctgccggctacacacatagtgtcgcttcgcctgcagtccaccctcctgttatcggagcgttcgtgccgtctcgtggaggccagatctgcaagtctacgctaggcggtggagccagaagccagttccgcgagctccccttccctcttcaccgaataagcacgaaaaaggagatcgggtaagagttacgactgttcccaaccttgcctgtggctgttggaccgctg

SEQ ID NO: 6742 - DNA, 439 bp, Zea mays
  Clone ID: LIB3279-033-P1-K1-F12
aaaattaacctgtccagaaaccccttccgtcaatgcgagtcttttgagttcctcaaggtatccaacattttccttgagacgcttatcatagccacctaaataatgggcatggtaggaaatcagcagtcaatatttcatatagtctaaaaccggtggtgttgtaacattgaacatgcaactagaaggaaaaataaaatataaacacctgccactgataatgttgcttcttgtagagcatcaccaggtagagtccaagcagcagaacggagcaaagcaaatgctgaaatggcaagatcaagattctttttcctctcaaaccggttgatggataggaaactcaacctgtacaaaagattgctgtctactttagctaagtcttaatatgataatggtaaaaagatctgtttagtctatgaactgaatcagttagacctaaatg

SEQ ID NO: 6743 - DNA, 345 bp, Zea mays
  Clone ID: LIB3279-033-P1-K1-F2
gttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggc

SEQ ID NO: 6744 - DNA, 406 bp, Zea mays
  Clone ID: LIB3279-033-P1-K1-F3
ctccactcgacgcttctcccgctcctaacccctagtaccttcgctcgctctgccgcctccgccgacgacgcgccagatccgcgcagcagtggtgtcctccgccgcggatcgagctcccgatccgcgcagtgggagtggcggcgagcgcaggagcgctcggccgggggttccgcgaggctggagacggaggaggaagggagcggtagttccgcggtggtagatccgccggtcctgtcgccggagatggactcatctgtcgagaaggggagcgtggcgctggatccggacgagcgcgcgccggcgtccggcgaaaccaaggcctgcaccgagtgccacaccaccaagaccccgctctggcgcggggggccctgcggacccatgtcgctgtgcaacgcgtgcgggatcc

SEQ ID NO: 6745 - DNA, 427 bp, Zea mays
  Clone ID: LIB3279-033-P1-K1-F4
gtcacacatactcaccatgtggtgtgtcagctggtttccttctgtttcgtactacactagtaggagttgtgccagtttgccgatgcatccgcatgtgcgagtcagcagttggaagcatccatattctcttctggaaacgaggaagaaaaaataattcacgactagagtacacgactaagtagtactagtattattatttggaaatttgacgtgggaatctgttcctgcccatacagtagtagtaggtagtaggagtagcgagcgaccgtagacaagtcacaagtgccgccggtagcaattttttttttttttttgcattcccaaaagaaagctctttcctttcttcgatgtacactctcggtggcaccgtttccttttctttgtcgcgcttcaactttgcgcaaaagttttactattttttgcgaag

SEQ ID NO: 6746 - DNA, 337 bp, Zea mays
  Clone ID: LIB3279-033-P1-K1-F5
gtcacacatactcaccatgtggtgtgtcagcttgtttcctttggttccgcactacactaggaggagttcttccagtttgccgatgcatccttatatgccagtcaccacttggtatcatccatatttcatactgtaaacgagtaagaaaaaataatccactactagagttcactactaattaatactaatcttattatttgaaaatttgacatcgaaatttgttcctttctatacattatttgtacgaagtattagctactagcgacactaaacaattcacaagtgctcacgcatagcatatattctattttttagcattcacaaaagaaagctcttt

SEQ ID NO: 6747 - DNA, 450 bp, Zea mays
  Clone ID: LIB3279-033-P1-K1-F6
cttaatctgaccaaactggatgttctgtccgggttgtcagaaattaaggtgggtgtttcttatacccagactgatggacagaagctgcaatccttccctggggatcttgatacccttgagcaagtacaggtcaactatgaggttctgcctgggtggcaaagtgacatttcttctgttcgaagatacgatgaacttccccaagctgcccgcctctatgtggagaggatagaagaacttgttggtgttcccgtgcactacattggtgttggacctggcagagatgctctcatatacaagtaaaagcaactgtatttggtccttggttgggcggaaacctggccgggactcgggagcatttgcattttcttggcgtggtagcttttgatacggcgaagtcactgactcgtggagtgatgttgctcaataatcagaaccttgttctaatacagc

SEQ ID NO: 6748 - DNA, 429 bp, Zea mays
  Clone ID: LIB3279-033-P1-K1-F7
gcaggatcaagtttcacacatatggtgacttgtacagaaaacaatgtcacatttttattatataataattatatacaaaatagctaaataaatacacatgtgttgagtgtgtgggggtcggtggagtgtttgtatgtgttcttgcctcttttttcctctctcttattataaagatgcacatgtgtgtttgagaaaaaaatttgcaggtgcacagaaaaccactcgaactgaataatgattggcattcaaagtctgctttggcccagctctgactgcgatgaacagtctaggaagacaacacagagctggtaatttgggccttcacgttacggcgtactactagcttctcatctccaactacgcaccaggtggcgataagaccttatcctgcgcgaccacttggcgccaaaggtgttcattcacgtggga

SEQ ID NO: 6749 - DNA, 436 bp, Zea mays
  Clone ID: LIB3279-033-P1-K1-F8
ttttgggccaaagatggggtagaggatgattgatctgtcggcagtctgatggcgatgaattaatacgaggtcttcaatgctgacagaaagggttaatgaaacaaacttgaatccagtgattataggcactccgcacggaccacatgattcatctctcactggacatattgctaccacaagaagcggacggttgctgccgcaactaaaacatgccgtgtggatgtcagttttcagttggcctatgccatccagagagtaaaaagtgaggatcaacgagcatgttgccgagtagtttctcaagtataaattactgcgtctacttgctccttcgctttgggaacaatgtatcaggttgtaagtcgcaattaaatgtttggaacaagttgtcatggtaattgtgtgggtcctatattgctatattgctctctgaattgga

SEQ ID NO: 6750 - DNA, 431 bp, Zea mays
  Clone ID: LIB3279-033-P1-K1-F9
cccacgcgtccgcggacgcgtggggaccgccgtcgtcgccgcctcctctccccagcacccggagctcgaccgaacgccgctcaccatgatcatccccaagaagaaccgcaatgagatctgcaagtacctcttcaaggagggcgtgctgtatgccaagaaggactacaacctggcgaagcacccgcagatcgatgtgcccaacctccaggtgatcaagctcatgcagagctttaagtccaaggagtatgttagggagaccttctcctggcagtactactactggtatctcaccaacgatggcattgagcacctacgcaactacctgaacctcccgtctgagatcgtgcctgccacgctcaagaagtctgccaagccacctggccctccatttggctctggcccttctggtgacccgccaaggggcccatgcc

SEQ ID NO: 6751 - DNA, 397 bp, Zea mays
  Clone ID: LIB3279-033-P1-K1-G1
ctaggttttcggttcctccacaggatggccgatcccgccgccggaggcgccatggtccccgctgccggaggcggcagcgtgtgggcgaacggcgccccccgcttcggcgacatggtctgggccaaggtgaagtcgcacccgtggtggccgggccacatctacagcgtcagcctcaccgacgacgaggaggtgcaccgcggctaccgctacgggctggtcctggtcgccttcttcggcgacaaaagctacgggtggttcgagcccagcgagctcgtccccttcgaggagcacttcaccgagaaggcggcccagggcggcagcacccgcagtagtttcgccggcgccgtggcggaggccgtcgacgaggtagcccgtcgcagcgcgctagcgctgctct

SEQ ID NO: 6752 - DNA, 447 bp, Zea mays
  Clone ID: LIB3279-033-P1-K1-G10
ctcacatctttccctcccgtcggccagcagccttccggttcaggccccgtcgcatctctcctcgtcggccagctgcagggcacctagcgcgtggtcggcgagcgcgcgggcgggcggcagggggcgccgcggcggcgagcgcgcaggcccccactcacagacgactgggccggccttcactgctacttcggccccttcgtcgccgacgagaaccaccgcgtgctggttggaatggcaagtacagcatgctttgtgattgtcagtaagaatgacatcccaatctatgaggcagaagttggatctgcacccaaaaaagaagatttgtcttatcaccatcagtttattctgcatgctgcattagatgttgttcaggatctagcatggacaacaaatgcaatgttcctgaagtcagttgatagattcaatgaccttgtggtgtctgtttat

SEQ ID NO: 6753 - DNA, 377 bp, Zea mays
  Clone ID: LIB3279-033-P1-K1-G11
ctcacacactgcactaagaattgacatcatagctaccgtgacatgattgtcctcacgtgaatggacctgttagtctaggccttaatctcaactcgagcactaggtgttcttcctctgaaaacggacaacggtgtaccttgcactgcactctctaggctatgccagactgcacagtgtccactgccagaatttgaacttatgccacaaccgtaaaggccacgatccgacccttggatcacgccgtgtatgagaagaatcatctgatcttatggactcctattgttatggatggggtgacaactactgacttgaatagcttagtttctactatcacctatgcacatcccttgagcgaccgtcattacccttccaggtga

SEQ ID NO: 6754 - DNA, 413 bp, Zea mays
  Clone ID: LIB3279-033-P1-K1-G12
cggacgcgtgggcggctccaccgagctccccgatccctccgccccaaatcccacacacccggttggccaccgcctcgctatggatttggatctgtggatctccaaggtcaaggagggtcagcacctcgcggagcacgagcttcagtccctctgcgaatatgtgaaggagatcctcatcgaagagtcgaacgtgcaaccagtgaacagccccgtgacggtttgcggtgatatccatgggcagttccatgacctaatgaagctcttcgcgacggggggccacgtcccagagacgaactatattttcatgggtgattttgtggaccgtggcttcaatagtctagaggttttcaccatcctattgctactaaaagcgaggtatcctgcacacattacccttgtgcgtggaaatcatg

SEQ ID NO: 6755 - DNA, 202 bp, Zea mays
  Clone ID: LIB3279-033-P1-K1-G2
tagggtttacccaagttctaccaaaaacattatgataatcaaacattctcaatatctcatgctgagcttggaaatactatataagaaaactgaacccccactttctacacaatagttctttcattgatcatatcacacgcctgataaattatctaaatcaacttataactccttaccgtccacaagtacttgcaccaatgat

SEQ ID NO: 6756 - DNA, 449 bp, Zea mays
  unsure (1)..(449): unsure at all n locations; Clone ID: LIB3279-033-P1-K1-G3
ggactgcatttcatcgggaggaatttctctgttgctatggacgagcagttcacttctcctataggtttcaacttcacctttcctggtttgcttagcctcggcattgatatgggtttagaatttcctgtaagacaaactgatgtctgtggcattcttcaccgccgggagatggaattgaaaaggctggctgtggatagttcttttggaagaaaagcatatatggcttttatcccagaaggattcggaaatatgctggactgggatcaagttatgaagtttcagaggaagaatggatcattgttcagcactccttccacaactgctgttgcattaatccacaaatacaacgaccaagcccttcaatacctaaattngcttgtcagtgaatttggcagtgcaggcttttgcagtaccagcaatgtatccttcaatggtacattgtcagcttt

SEQ ID NO: 6757 - DNA, 396 bp, Zea mays
  Clone ID: LIB3279-033-P1-K1-G4
gcccaaaatacaggaaccagaacggcttgtaggactacctgagcaaatttaagaagtgcgtggccttccatgatctacgacacattctctttttatgcattgtctaacatgttcggtacaaggtccctgttatggcaagccatcttatgttgcatccagccagcgcggttctgaactatagcgatcagggctggaggatggatatggagtactcactatctgtatcggctcttaaaactactaccatgcatctggcataagctattactatctgttgtatggaaactgtatagatctacgcagactaggttgtgatgctgtcactcactgatcacatgcgaggcatgactgttatattaccttgaggttcctgcaactacactaaaatgacatctg

SEQ ID NO: 6758 - DNA, 452 bp, Zea mays
  Clone ID: LIB3279-033-P1-K1-G5
gaattgaaggacttctttttatcgactgggagacttcaagatgccgcctttcttttgttgaaggaatcatgggaattggagaagaaccccatggcaagcaaggggtctcctctccatggtccacaagtgaggctcattgagcaggcccatagactttttgctgaaaccaaggaacatgtttttgagtccaaagcttctgaagagcatgccaaattgctaagatcacagcatgaacttgaagtttccacaaagcagccaatatttgtgggttctagtgttagtgatacaataaaaacctgtattgcaatgggaaacgagcgtgctgcactcagagtgaagtccgaattcaaggttcctgataagaggtggtactggcttaaaacgtgcgctttagccacagttggaaactgggatggtttggaaaaattttcaagggagaaaaggccaccggg

SEQ ID NO: 6759 - DNA, 451 bp, Zea mays
  Clone ID: LIB3279-033-P1-K1-G6
gtcctgacaatttctctttaaccaagtcaatcttcatttgattcaaaagtaaagaacgtatctgggttttcagctttcacggacaattttgtagccatgtaatgctcaacacttccttcaagtgcaccacattctttaaccaaattcatcgccttcttgattgactttatctttaattctccctctaggaccctttttgcagcatcactattagactgcaaagttccccacatgcccctcataagcttcaacatagggctttgtcctctctttaatggacttgttgcagtactagtgatgcatgtccgcttctttcttgctccactagctggactgacaatatcctcatccaagtcatcaccttcgtcaccttcattcatatgctctacaggaatacaagacgatgaaccaacaacaacattgtgctcatacatttgttgaagttgatcat

SEQ ID NO: 6760 - DNA, 433 bp, Zea mays
  Clone ID: LIB3279-033-P1-K1-G7
cccacgcgtccgattgcctgcaacaagtacatgaccaagtctgcaggaaaggatgccttcgaccttcgggtccgggttcaccccttccatgtccttcgtatcaacaagatgctttcgtgtgctggggctgataggctccagactggaatgaggggtgcctttggcaagcctcagggcacctgtgctagggtggacattggtcaggtcctcctttctgttcgatgcaaggacaacaatgctgcacatgccagtgaagctctgcgtcgcgccaagttcaagttccctggccgccaaaagattattgagagcagaaagtggggcttcaccaagttcagccgtgccgactacctgaagtacaagagtgagggtagaattgttcctgatggtgtcaacgcaaagctgctcggtaaccatggaagacttgagaagcgtg

SEQ ID NO: 6761 - DNA, 433 bp, Zea mays
  Clone ID: LIB3279-033-P1-K1-G8
ggaaaacctgtccagcctgaagatctgaggaaaatcgagttcatagtgaaccagcaaataaaggacgagctgggtgtgtatgcacttgaaataaaactagaggatgcgaagcgcataaatggtcttcgtgctgtgtttggtgaaatctaccctgatccagtaagagttgtatcagttggtcgcaaagttgaagatctgcttgcagatcctgatagcaaagagtggctatccatatcgactgaactatgtggaggtacacatatcacaaacacaagagatgctaaagcatttgcactcttatctgaggagggtattgcaaaaggagttaggaggataacagccgtgactgctggatgtgccacccaggctatggagttggcgtcatctatcgattctgatatcaataaagcatcttaattggagggagctttgt

SEQ ID NO: 6762 - DNA, 377 bp, Zea mays
  Clone ID: LIB3279-033-P1-K1-G9
ctcgccgccgccgctgccaacgccgcctgctgccgcagccgccatgggggcgtacaagtatgtgtcggaactatggaggaggaagcagtcggacgtgatgcgcttcgtgcagcgcgtgcgctgctgggagtacaggcagcagccgtccatcgtccgcctcaccaggcccacccgccccgacaaggcccgtcgtctcggctacaaggccaagcagggatatgttgtctaccgtgtccgtgtgaagcgtggtggcaggaagaggcctgtgcccaagggtattgtctatggcaaggccaagcaccagggtatcacccagctcaagttccaaaggaacaagaggtctgtcgctgaggagagagctggacataagcttgggg

SEQ ID NO: 6763 - DNA, 427 bp, Zea mays
  Clone ID: LIB3279-033-P1-K1-H1
aaatcgacgaggctgcactgagagaagggctgtcgctccgcaaggctgagcatgcattctacttggactgggctgtccactccttcagaattaccaactgcgagatccaggacaccacccagatccacacccacatgtgctactccaacttcaacgacatcatccactcgatcatcgacatggacgcggacgtgatcaccattgagaactcgcggtccgacgagaagctgctctccgtgttccgcgagggcgtcaagtacggcgcgggcatcggccccggtgtctacgacatccactcccccaggatcccgtcggctgaggagatcgccgaccgcatcgacaagatgctggcggtgctggacaccaacatcctctgggtgaaccccgactgcggcctcaagacccgcaagtacacgggggtcaagcc

SEQ ID NO: 6764 - DNA, 379 bp, Zea mays
  Clone ID: LIB3279-033-P1-K1-H10
gcggaggtggagcagccccaggacgcggtgaagctcttcaaccgctggaccttcgacgatgtccaggtgaacgatatctcgctgaacgactacctggctgtgactgcggcgaagcacgcgacattcctgccgcactccgcggggcgctactccaagaagcggttccgcaaggcgcagtgcgccatcgtcgagcgcctcaccaactcgctcatgatgcacgggcgcaacaacggcaagaaggtcatggccgtccgcatcatgaagcacaccctggagatcatccacctgctcactgacgccaatcccatccaggtggtcgtggacgccattatcaacagtggaccacgtgaggatgccacccgtattggttcaactggtg

SEQ ID NO: 6765 - DNA, 440 bp, Zea mays
  Clone ID: LIB3279-033-P1-K1-H2
accacgcgtccgcccacgcgtccgcccacgcgtccgcccacgcgtccgcccacgcgtccggagatatcaacagtttcatagtttcattagatattggagacaaacaaataatgatattattgtcgcaaaaaatcgactgatagtcaaacaacaacgattagtcagaaggagtcggagggctgctaccgctcacaagctctatcttatccaactatctcacgtcggtgctcacgtaccgtgatacaaccatcttcaccttcgagtccgttgaatagggttatgagggcattaatgttgtgattcagattaacctagcttttaattagctttcggccaagatctactagctgaatggttcaccccatcgatgacggtgtcgatcgcttacaaggaagatatagcgtgttacgatcgcccgtttgtaggcgaggtactatgtg

SEQ ID NO: 6766 - DNA, 450 bp, Zea mays
  Clone ID: LIB3279-033-P1-K1-H4
cccacgcgtccgcggacgcgtgggctctacctctgcactccaatcagatcatcagatagatcactggccccgtgctgattaccgcgcttcccatctgagcagccagcctcccaggctacagggagagacgcagaggagacagctgctgcctggctgagacgatggccggaggcggcgaccactcccagacgaacggaggccacgtcgaccagagggccttggaggagggcaggaaggaggagttcgctgaccagggctgcgccgccatggtcgtctccgtcccatttatccagaagatcatcgcggagatcttcggcacctacttcctgatgttcgcggggtgcggcgcggtgacgatcaacgcgagcaagaacgggcagatcacgttcccgggcgtggcgatcgtgtgggggctagcggtgatggtgatggtgtacgccgtgggccaca

SEQ ID NO: 6767 - DNA, 410 bp, Zea mays
  unsure (1)..(410): unsure at all n locations; Clone ID: LIB3279-033-P1-K1-H5
actcttcctttccagacccgagagccagagaccaaccatctgcggcggcgatggggatcggtgagcacttcgagggcgtgaagcagcactgggcgagcaacttcgccttcctcgactattacaagaaggtctacggccgcgccgagcccctccccaagtggtccgacgccgacgtcgacgagttcatcgcctccgacccggtctacgggccccagctcaaggccctgcgggagtcgaggaagttcgcgcttgtcggggccttcgccggcgccgcccacctcggcggcgtcgcgctcaagtactccaaggcgccgcacggcgtcgtgctggcgaccgggttcggggcgatcacgggcgccgtgctggggtncgaggtggcggagcactggtaccagctctacaagatggac

SEQ ID NO: 6768 - DNA, 417 bp, Zea mays
  Clone ID: LIB3279-033-P1-K1-H7
gcccaatcggtgatccaccgcttgcccgtcagtaccatgtccgctggaagcgagaggccggacgccttctcgcccccgtcggcggtcccgggccccttctcccgcggctccggctccgctcccaccacggccgcgacagatagcactgggaggagctcgtcctccgtggcgccgacgaagagccgaaagccaccgttccggcccgccgtggacgacacaaagcccgtcctccgcgatccgatatcacgctcggacctggcggtcaccgagcaggtcgtgctgcggctgccgccgttcccctaagttcgcgccacccaatgttctttgctcaaccatattaatctaaagatggtgccctttctgcgcatgttcgtcaactccacagtttgtcaattggaaactttggccgctaattat

SEQ ID NO: 6769 - DNA, 336 bp, Zea mays
  Clone ID: LIB3279-033-P1-K1-H8
tgtttgctggaatggttctacgtactcgtcattatcattaccatctgagatgcaacaactgaattacggtcgcatacaaccacggtcttaagcttggtctgcaccaacgcatgcatagatcgatcgaactcacgggtcaggctgaacaaaaaatacagtagctaggaataatcgacggatgagttcagagcgagaggccggagtcctcgtcctcgtcaagcgtggaggtgtagactgtgtaaagggaccagatgaggccgaagactcccaacaggatccaccccagcaggttgttgctgagccccaggctgagcccggtgccctccgttgacattc

SEQ ID NO: 6770 - DNA, 420 bp, Zea mays
  Clone ID: LIB3279-033-P1-K1-H9
ctcgctcggagatatgctactcatggataagatttgaagaggagaatggcaccttggatgattatgatcttgctgtaaagaaggttacccctcggctaaaggagcttatgacattcaagtctcaagaggaggctaaagttgaggcttaccctaacctcaatgataattctaatgcaaatgattcctctcagaaaagaaaaccaagtaacaataaacagcagccccctgctaagaaaagaaaagagaatccaccaaaaagtaccatgccatcagatgaccaaggatcaaatgtgcaaagtgggcacagtggtgctgttactgatgtagaagtcggaggggccagcagggagaaggtcatggcatctatcgagatgaaagtggacagtgacagccgaacagggaaatcaagttcaaatgaac

SEQ ID NO: 6771 - DNA, 376 bp, Zea mays
  Clone ID: LIB3279-034-P1-K1-A10
cgacattggcgccaacgatccttagttcgttttatgtttatctttattttgtaaaagacttgcgctatgtaataaatactctgatgatttatgacatttatctctatacactctgttattataaaacaaaacaactgaaaaaaataagatggacaagacagacataaaaaaataatgaagtataaaacacactgagatgggctgataaactcgtttcatcaaacaaatttatggcccaacaaacataagggggtatgcacaggcaggggggggggagcttcaggagtaccaagatgggtttccggctttgaccttgtatattatgtttttgggcatccacaagaacaatgatctgggcgacctttatcatacatca

SEQ ID NO: 6772 - DNA, 370 bp, Zea mays
  Clone ID: LIB3279-034-P1-K1-A11
aaatatttcaatccagtggttccgtatacatccaaaagaaagcaacaaagagattatttcaggtgccacaagaccagtatatgctctagagccacatgacgtaggacgctatttgcaagctgaaatcgacgttggcggcgaaatcgcagtagcaaagactgctgggccagtagaccctgatgctggattggttgattatgtggagacgctcgtaaggaaacctgaaactgaattcaatgttgttgtgcttcaatccaatggcgtcgaccagccaaaagagtcggttcatgtactaaatgtcgggaggctgcggatgaagcttactaaagggaagtcggtagtcgccaaagaattctattcctcatcgatg

SEQ ID NO: 6773 - DNA, 431 bp, Zea mays
  Clone ID: LIB3279-034-P1-K1-A2
caactacctcatgtccatgtccacgcagatcttctcgggacacctctcacgctcgagctcgccggcgcgtcgctcggcaacaccggcatccaggtcttcgcctatggcctcatgctgggcatggggagcgcggtggagacgctgtgcgggcaggcgtacggcgcgcacaagtacgacatgctgggcatctacttgcagcgctccaccatcctgctgatggccacgggggtgcctctgaccgtgctctacgccttctcccgccccatcctggtcctcctcggggagtcccccgagatcgcctccgccgccggcgtcttcgtgtacggcctcatcccgcagatcttcgcgtacgccggcaacttccccatccagaaagtcatgcaggcgcagagcatcatggcccccagtgcgtacatctccggcggcacgct

SEQ ID NO: 6774 - DNA, 429 bp, Zea mays
  Clone ID: LIB3279-034-P1-K1-A3
gcagttgatgagtacatccctgatcctgtgaggcagcttgataagcctttcttgatgccgatagaagatgtgttttctattcagggtcgtggaactgttgttactgggcgtgttgaacagggaacaatcaaaactggtgaagatgttgagatcttgggtttggcacagactggtcccttgaagactacagttactggtgttgagatgttcaaaaagatactggaccatggagaggctggtgacaacgttggccttcttctccgtggtcttaagcgtggtgatgttgagcgtggccaggtggtgtgcaaacctggtagtctgaagacatgcaaaaagttcgaggcggaaatatatgtcctgacaaaggatgaaagtggccggcacactggctttgtcacaaattacagcccccaattctacttcaggaca

SEQ ID NO: 6775 - DNA, 367 bp, Zea mays
  Clone ID: LIB3279-034-P1-K1-A4
ctttgttcaacggtggagatggcaaatgcattgctgattctgatgtaatcacccaagtcattgaggagaagttcccgactccttctctggtcacccctccagaatatgcatcagtgggatcaaagattttcccagcctttgtcaagttcttgaagaacaaggatgctagtgatgggtcagagaaggcgcttctggatgagctgcaggcactggatgatcatctcaaagctcatggcccctacataaatggggagaacgtgtcagcgactgatcttagcctggggccaaagcttttccacctacagatcgcactggagcatttcaaaagctggaagatcccagaaacctaaccaatgtccatgcctac

SEQ ID NO: 6776 - DNA, 425 bp, Zea mays
  Clone ID: LIB3279-034-P1-K1-A5
caacgaaccaactaaccaacggacggaagtggcgtggcgaggcaaggccgccgcgaagccgagcagatccaagcctccctcctctacccgttcctctcctgccttctcgggatctgcccgcccgccttgtgtgatcttgccgcctcgccccccgcggttggagctccggctgcacgacaccatgagcccccgcgcgtagaggctgggagagaggtagcggtgaacaaagttaggcaccaacaaagttaagtggggaggccagagctggccagctgggtcgctgttctaccagagggatggacgggagcgccggctccttcgtcgccgtccgccggctctccggatacgaccgcgccgtcgacttccaccactactcttcggcggaagtcgtgacggggtcgacggcgtggatcgggagggggctc

SEQ ID NO: 6777 - DNA, 150 bp, Zea mays
  Clone ID: LIB3279-034-P1-K1-A6
gcgttgcctctagcatggcattcaggctgatggtcacatgcccggcgacatgaccattgggggaggggctgatgctcaaaacaccttcttcactgctactggcgctcagaagcacatcccccgtgctgttaacattgaccacacccactc

SEQ ID NO: 6778 - DNA, 352 bp, Zea mays
  unsure (1)..(352): unsure at all n locations; Clone ID: LIB3279-034-P1-K1-A7
cccacgcgtccgattcgacagtgagcaactagaggtccatgaagttccccaggaggttgtagacaagggtagtgtttgggtgagggctgatactgtagctttggggcagctaacacatcagtagacagtagtctcaggactcaggaggttaggctgctcaatcttcacaatgggtgcgaatgtaacaaaaaaactaatctgagccatgtatctggatcgttctatcttttaatatagtgtttntaaatatagtgatgtgcagctctcttgcatattcgagaaaaaaatcaagaggagtttgaaaagaaaaacaagtatggagctgtttcatcttcacggggcttttgatcga

SEQ ID NO: 6779 - DNA, 448 bp, Zea mays
  Clone ID: LIB3279-034-P1-K1-A8
cccacgcgtccgccaaattcaaatttcagacaatgagtgatgcagacaagctagctgctggcattgcagcacctgtgggtggagtgatgacagagtgtggtaccaatcctcctgtcgaacatattctctcagctgaggatgcagagtgctgtatctgcctatgcccgtatgaagatggcgtggaactacgtgagcttccttgcaaccaccattttcactgcagctgcattgacaagtggcttcacataaatgctacatgcccattgtgcaagttcgacatcatcaagagcaaccgtgacatagaagaggtctaggtcactaaggaaaaaacgccgcaaaacttttcgtcatgtctctgctgtgttcttcagtactaccgctaccacatttgcgatcctgagttgtgattaccggtcctttaggtgatgcacaaatggtactcgtgaat

SEQ ID NO: 6780 - DNA, 438 bp, Zea mays
  Clone ID: LIB3279-034-P1-K1-A9
gcggtctgtgtccatgaatggatggggccttgcattcagggcatgtggtgagaggcttattgtcattggtggcccaagaacaccagttgggggcatgattgagctgacctcatggactcctgatgacaagccacctgtgtggaatttgatggacagacggccatctggaaattttgtgtataattgcgctgtgatgggctgctgagctcgcttcatcaagggtctgcatagtgatgtttacaaagagaggtatgcacaggcaggcttgtttagcttcagcactccttgatgggtttctgcctttgaccttgtagctgatgtagttggcatccacaggaacaggatctttgtaacctttttcatacatcagtttctgccccagctaatccatttctttcatttacatttggatcagtcttatgatctagaagatgatac

SEQ ID NO: 6781 - DNA, 293 bp, Zea mays
  Clone ID: LIB3279-034-P1-K1-B1
gctcgacggacgcgtccgatagcgcttgctctcctattacattacattacatgatgcatttagcactaattagtagtgggtggtattaccagcccatctaggtagctgctcctccatgaccatgatatgcacagcagtactaggggggaggaggggtgtgtgatgcacaagaagatgctgctgctacccacatgggactacactggatgcagacagacgtgacagaccagctggtccagcgtgaagatctcacaggattagaaaaaacaaacgagtcccggtcccaccagtgt

SEQ ID NO: 6782 - DNA, 326 bp, Zea mays
  unsure (1)..(326): unsure at all n locations; Clone ID: LIB3279-034-P1-K1-B11
gccggctgcggcctgtgaaaattgcggcacgctgatattggacaccgaatgagcagcgagcaccagtttaggcaagtgagcagctcgccagttgtcggtcgcggcctcctgcgctcagcgcttcgctcgcggtgccggtgcgtgaggtgaggttgatgggcgcggagggatgagcgagagcgccttgaccataaggcggctgagcgggccgtcgaacggcggcggcggcaatgcgggagctagctcttgcgcggtcggcacctggggaggaagaggcggccgcngcggccgcaatgcggccagcattcggggcgtcaacgtggggc

SEQ ID NO: 6783 - DNA, 433 bp, Zea mays
  Clone ID: LIB3279-034-P1-K1-B12
aacgcttagctagctctttgtgtcagcgcctgagcatcgagctattggcatggcgcactccaccaccttggccctggtgattgtcgttgtgctggcgctcacctttggtgccacggtcagtgtctccgctcccgtgaacaagtcgtgcgtcagcggtagcgccggcgccagcgtgagcattggctacggcggggcaagagccagcgccggcgctggcgtgtcccttggcgccgacgcgtaccggagcacgtgcccccgtgccgaggagatcatccgtgcggccgttgagagggccgtcgctgccgacccacgcatggcagcgtctctcctgcgcctccatttccatgactgcttcgtcaacggctgtgacggctccgttcttctggacgacaagccgttcttcatcggcgagaagacggctgtgcccaacgcc

SEQ ID NO: 6784 - DNA, 414 bp, Zea mays
  Clone ID: LIB3279-034-P1-K1-B2
aactacctcatgtccatgtccacgcagatcttctcgggacacctctcacgctcgagctgggcggcgcgtcgctcggcaacaccggcatccaggtcttcgcctatggcctcatgctgggcatggggagcgcggtggagacgctgtgcgggcaggcgtacggcgcgcacaagtactacatgctcggcatctacttgcagcgctccaccatcctgctgatggccacgggggtgcctctgaccgtgctctacgccttctcccgccccatcctggtcctcctcggggagtaccccgagatcgcctacgccgccgtcgtcttcgtgtacggcctcattccgcagatcttcgcgtacgccggcaactttccaatccagaagttcatgcaggcgcagatcattatggaccacaatgcggaca

SEQ ID NO: 6785 - DNA, 451 bp, Zea mays
  Clone ID: LIB3279-034-P1-K1-B3
caacaatcatctttggcgcagatgtcacacaccccccaccaggagaggactctgcatcatccattgctgctgtggtggcatcaatggactggcctgaaatcaccaagtacagaggtctggtttctgctcaaccacaccgacaagagataatagaagatttatttactgttagtaaagatccacagatggggcacaacgttaatggtggcatgatcagggaactactgattgctttccgcaagaagacaaacagaaagcctgagaggataatattctatagggacggtgtaagtgaaggtcaattcagccatgttctccttcatgaaatggatgctatcagaaaggcttgtgcttctttggaggagggatatctacccccagtgacgtttgtggttgttcagaaaaggcatcacacaaggcttttccctgaggttcacggaaggcgtgatat

SEQ ID NO: 6786 - DNA, 438 bp, Zea mays
  Clone ID: LIB3279-034-P1-K1-B4
gcgtactgtctgtgcgaaggcgaccattccttcttcgctccttcgccgccgctatggttaagtactcgcaggagccgggcaaccctaccaaatcggccaaggccatgggaagggacctgagggtccacttcaagaacacaagggagacagcttttgcgcttcgcaagctgcctttgaccaaggctaagcgataccttgaggatgttattgctcacaagcaggcaattcccttccggagatactgtggaggtgttggtcgcaccgcacaagcaaagtctcgccactccaatgggcagggtcgctggcctgttaagtcagccaggttcatattggatttgctgaagaatgctgagagtaacgctgatgtgaaaggcttggacgtggacaacctctatgtttcacacatccaggtgaaccaagcccagaagcagaggcgcc

SEQ ID NO: 6787 - DNA, 238 bp, Zea mays
  Clone ID: LIB3279-034-P1-K1-B5
ctcgggcaagtagtgctggagtacatggcttctggagttccagtcgtcgctgttcgtgctggagggatacctgatataatacccatggacaaggaggctaagacatgctatgtgtttacaccgtgagatctagatgagtgcgtgaggaagatagagcacgtcctcagttcaaaggatctaagggaaaccgatgcaaaggctgtcaggtaagagatggacaagtgtgactgtagagctg

SEQ ID NO: 6788 - DNA, 439 bp, Zea mays
  Clone ID: LIB3279-034-P1-K1-B6
cccaccaagccaccctctgttctcctcttccgtggcggactagcggcgcactggtgtggtgctgctccaagctctgctccgctccccgcctccccgtcgaccggcgactttggccccggcccccgggctaggaagcgagttcaccggtggatccgcgcgtggccctccctgttgcctgcgggcgctggccgttggccaggtcgccccagccggccaccccccggctctgcaccctgctgacttgggcttgctgtatagcacggaccagatcaagggtcgccatcgaccacatttgaggcttggccatgcctttaaatatagatattgatctgttcaagctggatattgatgagcttgtagctgattattcccaggagaactgtacgtcactctttgaattcaaacgagtatgggtgggcaagaaattttcttatatcta

SEQ ID NO: 6789 - DNA, 440 bp, Zea mays
  Clone ID: LIB3279-034-P1-K1-B7
ctgatttgaaagtgccaaagtttgagttcctgtcacatgctaaaccgtctctgttggagtgtgccaaaccgacaacttagcagactactacttcgacagtgaaactgccaacagccattttgtcaacttatgcgaaggcaaaatctagggcaaagaaggacgcagaaagcaaagctaaccaggagaaagcaacagaggaggcttctggttctacctcaagcaaggcggctaaagctcaagagaaggatgctgatgtcatgcaggttgataatgccactgaaaagaaagctcctgaaccagaagcaacgtatcaactcctgacgaacccagctcgggtgatccctgcacaggagaagttcatcaagtttcttgaaaacagccgatacgtccctgggaaaccagcgccttctggattcattctccttcgagacctttagccc

SEQ ID NO: 6790 - DNA, 444 bp, Zea mays
  Clone ID: LIB3279-034-P1-K1-B8
gcggcctcaaggtgctgttcccgggcctgctggccaacgtggccagcggcggcgagaagctccacgagcggctggtggccgagatccgcggcgccgtggccgacgccggcggcaaggtcaccctcgcggcggtggagaggatggagctggccaagtcggtggtgtgggagtcgctgcgcctggacccgcccgtcaagttccagtacgggcacgccaagaaggacctgctggtggagagccacgacgcggtgttccaggtgaggaagggcgagatgctgttcggctaccagccgtgcgccaccaaagacccccgcgtgttcggcgacaccgccggggacttcgtgcccgaccgcttcctcggcgaggagggcagcaagctgctgcagtacgtgtactggtccaacggccgtgagaccgagaaccccagcgtcgacaacaagcagt

SEQ ID NO: 6791 - DNA, 442 bp, Zea mays
  Clone ID: LIB3279-034-P1-K1-B9
attctgcctgaaccacttctcgtccgacgtgtatgtcgggccacccaagggcaatgactggtttgagaagcagacggcaggcacgctcgacatcctgtgctctccttggatggattggttccacggtggcctgcagttccagattgagcaccatctgtttccccgcctacctcggtgccaccttcgcaaggttgcaccggccgtccgcgacctttgcaagaagcatgggctcacttattctgcagccacattctggggtgcaaatgtgcttacatggaagacactcagggctgctgcattgcaggccaggaccgctacaagtggtggtgctccgaagaatttggtatgggaggctgtgaacacccatggataaatgggatgaagatacgggctaatggcaacttctggtgttcagcttggtgcccatgtgattgtctggatg

SEQ ID NO: 6792 - DNA, 406 bp, Zea mays
  Clone ID: LIB3279-034-P1-K1-C10
cagctcgcaaagctttgcaagagatggagaaaactgttgacatcaatgaagggagccattttttgaaagatcttgaaatgctcggaagtgtcacaggtgaacagatacccaacttggttggtgaaacaagtcctgggtttcaaatgggaagcaacacactagaaaagctcgggctgtacatgaaaaacgatgaggatgatgaggatggtgatttcacagatgaaccagcggctgatgttgaagagggagaaatagattaactgcgtttctggaccatttttgatacgttacaggagacctgttggcatgactgatctgcatagctttccttttgttataacaaagtgacctgacgaaaagaacgtgtcgcatccaacctgaaagtctggtattcatttttggaact

SEQ ID NO: 6793 - DNA, 412 bp, Zea mays
  Clone ID: LIB3279-034-P1-K1-C11
gtcggcaaggaaggaaaaagagagcagagaaccctagctagagtttggcgagtggtgcggaggcgcggctgctcctgctcgtcgcgacgtcgaatttcagcgccgcccgcgcgatccttggtctcttcgcccgagaggcgcgacaatggctgggaaaggcgggccgaccaacctggagaaggagcagatgtttgggatggcggagaaggagatggagtacagggttgatcttttcaacaggcttacaaagacctgttttgagaagtgcgttgaaaaaaggtataaagaagctgagctcaatatgggtgagaacagttgcattgatcgatgtgtttcaaagtattggcaggtgactaatttaataggtcagatgcttgggaaccagcctcagatgtgaaccgagatgccacta

SEQ ID NO: 6794 - DNA, 437 bp, Zea mays
  unsure (1)..(437): unsure at all n locations; Clone ID: LIB3279-034-P1-K1-C12
cactttcatctgtggcctctgcgttcgagatcgatctgagctggcaccgtcccacttcgccatggcggaggaccggagccccaagcccatccactgcaaagcggcggtgtgcagagccgccggcgagccactcaccatcgaggagatcgtcgtcgacccgccgaaagcgtacgagatccgcatccgggtcgtctgcacctcactctgccacaccgatatcaccttctggaaagctaaggtggcaccggtgtttccaagaatactagggcatgaggcgtacggngtagtggagagcgtgggggagcacgtggagggcttcgcggcgggggacaccgtggtgccgacgttcctggggcagtgcgagcgctgcgccagctgcgcgtcggagcacagcaacgtgtgcgacgcggtgccgttcgtcatcggccccgggatgc

SEQ ID NO: 6795 - DNA, 154 bp, Zea mays
  unsure (1)..(154): unsure at all n locations; Clone ID: LIB3279-034-P1-K1-C2
gttgaagngtgttatgttgtactgtgttcatgcgttctgcttctgtgtttctccacagtgtagcttatttattcccatggcaacaaataagctacactgtggagaaacacagaagcagaacgcatgaacacagttcatcatatcactttttaac

SEQ ID NO: 6796 - DNA, 444 bp, Zea mays
  Clone ID: LIB3279-034-P1-K1-C3
ggagagcctcttgcaacagacgggctatccttctgcaattaggcacgtgccatctgttgagcagtcactagcggaggtgtcagctcagatagaggctgtgacggagaagatgataatggaggaagagaaggtgaagacgtggaagacggagaacttgagaaggaagcataattacgttcccttcctgttcaatttcctcaagattcttgaggagaagcagcaattgaatcccctgatagagaaggcaaaggcgaagcataagtcgcactgccccagtcctaggtgaaagatgcaatgatgccatttcattcacatattagtaacgtaatgggtaatcaacaacattaaattatgtttgtttaagtaacgtaatgggtaatgcaatgattcgtagttgggtccttgttttcttgaccagtatttgaccttatgtttatctctact

SEQ ID NO: 6797 - DNA, 444 bp, Zea mays
  Clone ID: LIB3279-034-P1-K1-C4
gcccccaaggccccaactacccccagtctcggaagagaactatccagaagcgcaagactccaaagccgtcgccttcctatccatcccttcctcgccacgggggtcgcctgagatcacataaacaatggtgaaggctgttgctgtgcttggtagcagcgatggtgtcaagggcaccatctttttcacccaagtgggagatggccctaccactgtcaccggaagtgtctctggcctcaagcctggcctccatgggtttcatgtgcatgcgcttggtgacaccaccaatggctgcatgtcaactggaccacactacaatcctgcgagcaaggaacatggagcaccagaagatgagaaccgccatgccggtgatcttggaaatgtgacagctggagcagatggtgttgcaaacattaatgttaccgacagccagatcccactgactgg

SEQ ID NO: 6798 - DNA, 373 bp, Zea mays
  Clone ID: LIB3279-034-P1-K1-C5
ctcccatctgccaagacctcctcagacccgagaagcgcagctgcggccatggacgccaccggcactggagctggagggaaggcgaagaagggagcggccggtcgcaaggccggcgggccgaggaagaagtcggtgacgaggtccgtgaaggccgggctccagttccccgtcggccgcatcgggcgctacctcaagaagggccgctacgcgcagcgcgtcggcagcggtgcccccgtctacctcgcggccgtcctggagtacctcgccgctgaggtcctggagctcgccggcaacgctgccaaggacaacaagaagacgcgcatcgtcccgcgccacgtgctgctggcgatcccgaacgacgaggagctcggga

SEQ ID NO: 6799 - DNA, 442 bp, Zea mays
  Clone ID: LIB3279-034-P1-K1-C6
caaaacattattgaggactcactcgttcgagcagtttcatccccacccccatgtgtgtgacgatggaagatcgagcaatgcggcgacgaaaggggggaaagaaagcccagaggaggcccgaggaagagaggatggctagactactagatgatgcatttgcatgccctgcgcgagatttgtacctgtatgtatttataaaggagaagagtgaggaagggcggggccggttgtgttgttacttacaggatcggatgaggctagctaggggtagtcgtcttgctcaagacgagaaccaatccacgcggtgatgggtgatgggcctggtggggcccgggcagaacaagggaccccgtcggtcgaaagcgacgcccgccgcgcgcactgtttcttgacggcagcgcgaacactcctctgtctcccacctaatctaatcaaagcccta

SEQ ID NO: 6800 - DNA, 431 bp, Zea mays
  Clone ID: LIB3279-034-P1-K1-C7
ctccgctgcagcagcgcccggagcctccgttttcctttttctgcctccctatggaagggggccgacagaggcagatatcgccctcgattctaccgcgattcgttcgaccacgagcgggattccctccgccaagcgcggatctgaacgctgcactccgtgtcgtcgctcgaatacgacatgaagggggccaaatacaagggcgccgtcaaggtcgatgccaagctggcggtgaagagcaagggggcggagaagcccgccatgggcaggaaggggaaggccggctaggaccccaacaagcctaagagggcttccagcgctttcttcgtgttcatgcgggaatatcgcaaggagttcaagggagaaaaaccctaacaacaagtctgtcgcttgggtgggaaaagctgatggcgacaggttgaaatccctgaacg

SEQ ID NO: 6801 - DNA, 445 bp, Zea mays
  Clone ID: LIB3279-034-P1-K1-C8
ggggaatcatccagtatggacattgacaaagctgagtcttctctaccaaagaaacaattaactggcgtctatgatttggttgctgtcttgacacacaagggaagaagtgcagactctggccactatgttggctgggtaaagcaagatgacggaaaatggatcgagtttgatgatgacaatccaaacatccgcaaggaggaagacattttgaaactatctggtggaggtgactggcacatggcttatatctgcctatacaaagcccgcatggcggagttgaagagttaggccggagtggttctacatttctgtgccgcgaacgcaacactagtttttctgcccatgagtgatcatggtaattattttttcccgttcgtaaagtggttactgtcgaatttgcttcaatgcggttggccattattcactgggatatgtatttttagga

SEQ ID NO: 6802 - DNA, 436 bp, Zea mays
  Clone ID: LIB3279-034-P1-K1-C9
gtcgctggtgccccacggcaaggacagcccgccgaggtcatcgtcggcgaggaaggcggcggcgccggtgttcccgctcgccctgaccaagggccaggtggtggaggtgccggccgtgcctgtgccggccaaggacccggggaaggagcagctgctggtgatcgagggcatcgagtacgacccccaggcgaacaataagttcgacgtcgccatcaacctgcccgcggacaaagcgttgcaggtaggcccacagtacaaggagtacgccggaagcttcgccgtcgtgccgggctccggcgccgggaagacgcggaaagtgaagctctccctgtgcatcaccgaagtgctgttcgatatcgacgctgacggcgataaaaccgtcgacgtcgttatcgtgccgcgcacaaatgctaagatcacgctcaacgctcgcccc

SEQ ID NO: 6803 - DNA, 387 bp, Zea mays
  Clone ID: LIB3279-034-P1-K1-D1
atgtactttatctgttccttatcagggggtaaggggggggggggagcggccgggcgcaaggtcggcggtccaaggaagaagtcggtgtcgaggtccgtgaaggccggtctccagttccccgtcggccgcatcgggcgctacttgaagaagggcctctacgcgcagcgtgttggcaccggcgcccccgtctacctcgccgctgtcctcgaatacctcgccgctgaggttctggagctcgtcggtaatgctgccagggacaacaagaagactcgtattattccgcgccacgtgcttttggcgatccggaacgactaggagcttgttaagctgttgggcggggtgaccatcgctcacggcggtgtgcttccaatatcaaccctgttctgc

SEQ ID NO: 6804 - DNA, 428 bp, Zea mays
  Clone ID: LIB3279-034-P1-K1-D11
atttggagcacaccagtttccggcaagtggagtattcgaggtggaaccgaaaagctgtcctggtttcatctacagaagatctgtgtggatgggcacaactgacttgtctagagcagagttccgctcgttcattgaaaatcttgctggaaagtacaacggcaacacgtatcatttgatttcgaagaactgcaaccattttacagatgatgtctgtaagagcttgaccaagaaatcaatccctgggtgggtgaataggctagcaagagtgggttcattttttaattgtcttctaccaaatagcatccaaggttccacatgtagacacgttcctactcaatctgcattttctgatgatgatatggatttggtgtcaacatcggttcttgtaaactgttatcttggagagttagaccaacatcttctgccat

SEQ ID NO: 6805 - DNA, 430 bp, Zea mays
  Clone ID: LIB3279-034-P1-K1-D12
gcacgtcgtttgggaatgggtactaatatgtacccttcttctgctttactcggacagaataaggatgagtcaattgcttccttgccaattgatgatttgattgagaaggctgatggctttgctggtgtctttccagaacacaagtatgagatcgtgaaacgcttgcaagcaagaaaacatatatgtggcatgactggggatggtgtaaatgatgcaccagctttgaagaaggctgatattggtattgcagtagcagattctactgacgcagctcgtagtgcttctgacattgtcctaactgaacctggccttagtgtgattattagtgctgtgctgacgagtcgggcaattttccaaaggatgaagaattacacgatctatgctgtatcgattaccatccgtattgtgcttggttatatgcttcttgcgc

SEQ ID NO: 6806 - DNA, 433 bp, Zea mays
  Clone ID: LIB3279-034-P1-K1-D2
caaatcttacccgccggagttcgtctcatatttccactattgtcgctccctgcgatttgaagacaggccagattactcttcaatgaagaagctctttcgtgatgtatttatacgggaaggtacacacctttcttctgagtgaccccgctaatgtgaccattgttctcgcctgcactatgatctggtgttaggaaactgggtctcattatagattaacactgtaggataccaatttgattacgtatttgactggactgcactcaagtaccctcaaatgggctccaacaacaagcttgttcaacaaccaagtgcaagaatggctggggttggaccatcagttgagagaacagacaaagcttccagtatgtgtcctggtagttaattgcatttggaccattcctatgtgtgaaaattgaccgattgacctaattag

SEQ ID NO: 6807 - DNA, 443 bp, Zea mays
  Clone ID: LIB3279-034-P1-K1-D3
cccacgcgtccgcaagggtcgccttaacaggcttccttctgcctgtgttggtgacatggttatggcgaccgtgaagaagggaaagcctgaccttagaaagaaggtgatgccagctgttattgtgaggcagcgcaagccatggcgccgaaaggatggtgtctacatgtactttgaagacaatgctggagtgattgtgaacccaaagggagagatgaaaggttctgccatcactgggcccatcggaaaggagtgcgctgatctctggcccaggattgctagcgcggcaaatgcgatcgtctaaaggaagcagtttgtcgaagtttcatttaaaatggggactttagaagggagttcttagttagacgagcttttgattgccctgaatatgtttccccggctaatgcttgtgctgctggaccgtttcctgatagctttgctttgat

SEQ ID NO: 6808 - DNA, 255 bp, Zea mays
  unsure (1)..(255): unsure at all n locations; Clone ID: LIB3279-034-P1-K1-D4
gtttgaggtactagatgatttacaattctttcgctgatgtgctccattcacatcgtgaggttccaagattagttaataatgctaaactgagtggacttgtctggtttgttcacgaaggtggtgttgtccattgttccgaagctctggtatttgagaaatttgcatatttaacactataaagatgtgactccacagatttgccattttcaagatgggctacgcaaaattgccacctgtttcattgtcatgttgntt

SEQ ID NO: 6809 - DNA, 428 bp, Zea mays
  Clone ID: LIB3279-034-P1-K1-D5
tcctgagcactttctcctcgtaccagacaagccaatcgaagccgagatacgaccatggactccaccggcaccggagcagggggtaaggggaagaagggagcggccggtcgcaaggtacgcgggccaaggaagaagtcggtgtctaggtccgtgaaggccggtctccagttccccgtcggccgcatcgggcgctacttgaagaagggccgctacacgcagtgtgtcggcaccggcgcccccgtatacctaggcggtgtcctcgaatacctcgccgctgaggttctggagctcgccggtaatgctgccagggacaacaagaagactcgcattattccgcgccacgtgcttgtggcgatccggaacgacgaggagcttgggaagctgttgggcggcgtgaccatcgctcacggcggtgtgctccccaatat

SEQ ID NO: 6810 - DNA, 436 bp, Zea mays
  Clone ID: LIB3279-034-P1-K1-D6
gtctcggccatgcatgaagagaaaagagccattataacatttgctgttaaaccgatgcaacatgtaccaagagctggcagcgagatcaatgttgatgggccaagtgttggcaacgagactaatgtaggtggactaatgttggatcaagaggcttgtgaagttcattctgcaccttgtgttacatctgtatatagaagtgggaaaaagcgaaagaaaagtcaagttgaacgtgttcttgatgactatatggagcacatgaagaatcaaacacataatattatggaggtgctacttgagaagaaaagtcgtgaagaggagtactctattgagaggtgtctccacacaagtgatgttatggacgacttgacggatgaggagaaggcccttgcgtcagaggtgttcaaaaatgaaatgaattctgagaagttttgcatgc

SEQ ID NO: 6811 - DNA, 429 bp, Zea mays
  Clone ID: LIB3279-034-P1-K1-D7
gccggagcaaaggtggtgaagaaggccgcggcggggcgtcgcggcgggggcggccccaagaagaagccggtctctcgctccgtgaaggccggcctccagttccccgtaggccgtatcggccgctacctcaagcagggtcgctactcccagcgtgtcggcaccggcgcccccgtctacctcgctgccgtcctcgagtacctcgccgccgagctcctcgagttggcggggaacgcagcgcgggacaacaagaagaaccggatcatcccgcgacacgtactgctggcgatccgcaacgatgaggagctcgggaagctactggccggcgtcaccatcgcacacggcggggttctgcccaacatcaaccctgtgctgctccccaagaaaaccgctgtcgctgctgccaaggaaggcaaagaagaagagtcaccc

SEQ ID NO: 6812 - DNA, 440 bp, Zea mays
  Clone ID: LIB3279-034-P1-K1-D8
cccctggttggctgttcttcgattaaagcaccacttggtgcggccttcacaggaggccagattcgggacgggggatcgacccccagccggccggcttctcccttggagcagtcactctggttggctgtagggcttataatgtctgtttttttttctggctttgatcgagcatggcgctcgaagggcacatgtagataatggtgtatttttggatcgtttagggcttgtgttctttcccaccgtttgcttgcaatagactcactgaatcgctagtttgccttgtgccagtgagaaaactggtaccagttttgtgatgataggtttagaggaatcgagtcaattttgggtttctcgtgttacagcgctttcagcaatagtacctaccggtaggggtggtagtaggggtgataatggatgaccattcaaatgtttcttcacgg

SEQ ID NO: 6813 - DNA, 438 bp, Zea mays
  Clone ID: LIB3279-034-P1-K1-D9
agatcatccatggctagttctatacttcagcagctgctgtctctctgctgctgctcctgctgccctctcctcttcgtctccgggagcatctatcaggaaacaatgctgtcagcgccaacaacttccaccccatctttctggtagctgggatgagctgcatcgacctggaggcacgtctcaccgaggagtaccggccgtcggtgccgcattgcggcgccatgaagggcaagcggtggttcggtctgtggaagaacagtacggagctgctgtctcgtgactacatgcagtgcttcgaggagcagatgagcctcgtctacgaccctgacatcaacgagtaccggaacctcgccggcgtcgagacacgagtgcccaacttcggctccacaagagccttcagctacaagaaccctctcaagtcagactggtgcctcggaaagc

SEQ ID NO: 6814 - DNA, 334 bp, Zea mays
  Clone ID: LIB3279-034-P1-K1-E1
ctggtacttcagtcattgccttgaaatacaaggatggtgtgatcatggcatgtgacactggaggctcctacggatcaactttgagatacaagagtgtggaacgcattaaggctgttggcaagcatagcatcattggagcaagcggagagttcagcgatttccaggagatcctgcgctatctggatgaactaactctttctgatcatatgtgggatgatggaaattctctgggccccaaagagatccacagttatttgacaagagtgatgtacaacagacgcaacatgttttgatcctctctggaacttacttcgtcttgggtggaattgaaaaa

SEQ ID NO: 6815 - DNA, 435 bp, Zea mays
  Clone ID: LIB3279-034-P1-K1-E11
gcaaataataaaacaaataagtcgttattaaagtatctctaatgataaaataagtcataacaaattaaataatatttatacagtttttttttcgaataagaggaactttcaaacaggatgtctcagttaaaaacgtcatgtattttgggatggagtagtatgcttgtatggttgtctcattttgttcgatgttggaatgggtggcagagtccaattttgccgttgaggttgcttgttcctgctagctacccgaaatgctccccggtgcttctagacaagtttcctgatgaacaatgcaggaactcagacgacctgtctaccaaggccaagacaaagttcagcgtattgctccggggtctagctgagcccatgtcactgcgagaaatcgcaaggacatgggatgcttgcgctcgcaaagtgatcacagagtatgcc

SEQ ID NO: 6816 - DNA, 441 bp, Zea mays
  Clone ID: LIB3279-034-P1-K1-E12
cggacgcgtgggcgcccccggtcatgacgacctcgccgccgcccgccgaggaacagcaggaggaagaggaggtgctggtgccgcatggcccgcaccaggagctgcccaatggagcgcagccaatggaagttgtgcctgctgagccagctgctaccgtggagaaccaacagatagaggatccaccaatctcgagatttacttggaccattgagaatttatcaagagttagcacaaagaagctctactctgaaatttttgttgttggaggctacaagtggcgaattttgattttccctcgggggaataatgttgaattcttatctatgtatttggatgtagctgattctggagtcttgccatatggatggactagatacgcacaattcagcctctctgtggttaatcagattcacaacaagttcacaataagaaaagaaacac

SEQ ID NO: 6817 - DNA, 357 bp, Zea mays
  Clone ID: LIB3279-034-P1-K1-E2
gttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctacacaacgccttcagcacctacggcgaggtcctcgagtccaagatcatcctcgatcgggagacgcataggtcccgcggcttcggcttcgtcaccttctacacggaggaggcgatgcggaacgccatcgatggcatgaacggcaaggagctggacggccgacacatcaccgtcaacgaggcccagtcccgccgctgccgtggaggc

SEQ ID NO: 6818 - DNA, 429 bp, Zea mays
  Clone ID: LIB3279-034-P1-K1-E3
catgatccgctcgtcataccctggaggccccgatccctctttcattacaactcgcatctccggcgccgcgcctgcccagcccggcagcccccatggacctgccagcggtagatatcacgccgaatctaggggccacagccaggggcccggccgcgttaggcgttgaggaactgcccgcgctgtgctccacagtgagctctagtttgcgtgacacgggggcgctgcatggtgatggacccgcgctgctccggcgcagacaacgaccgattactcgacgtagagcagcgcttcttgttccgatcgcgcgacacagagcgcctacaggaactggcccacctccactaccagggtggtgtcacacctgtaggagtgggtgtgcctcgcagtctggtcgactagaacatgcaggaaacgatcaggagcatttct

SEQ ID NO: 6819 - DNA, 417 bp, Zea mays
  Clone ID: LIB3279-034-P1-K1-E4
cccacgcgtccgcgcccgtccacagccgccgcagttccagtgagatcgagcgaggtaagcttagatctgagcgatttctctcgcgcgtcgcaggtaaagttcactcgacttcgactctctcatcctcttctgttcttcctggttccgtcttcttcctcgagcagacagcgagagacccgtggccttttagatcccgggcttcagatctgctgtttcttcttcggtttggttctagttctagcagtgtactagtactagtcgttaggttggtagccaagagaggttctttttccacacctcccttgcgcaagtgagtcctgtcctgagtggatctacccaccactgccatctgtttttactggggctgttgggttccgccagtttctttcgttggtcttggtttgctagagagagagg

SEQ ID NO: 6820 - DNA, 411 bp, Zea mays
  Clone ID: LIB3279-034-P1-K1-E5
cggacgcgtgggcgacggcacagacctggtgctgaccggtgcgaacggctccggcaagaccacgctcctacgcatgctggcgggcttctcgcgttcctgggcgggggagatcctatgtaatggccacgacatcacctcttggggcgtttttcagcagtacacgctgcagctgagctggatgtcgttcaaggacgccgtctaagagaaggtcacggtgctcgagaacgtgcagtggttctagctcctcgaggggaaggacggcagcaggttcggcccagccatcgagctcatgggcctcggcaggctcatgaacgagaaggccaggatgctctacatggggcacaaggagctgcttgaggtcggcaggctggtcgctatcgaccgacccaattggcttctggacgagccctt

SEQ ID NO: 6821 - DNA, 446 bp, Zea mays
  Clone ID: LIB3279-034-P1-K1-E6
aaataggcttgcccagctacagaaacttgggaaggttggtaaaggtactgacaggaggaagcgattgaaaggaggactggagctggagccatgcatggacacagtgaataatggttggagaaaggacatgctgcttgaggatgtggtggatattgacgttggctatgatgcacctccaccatcgtttactgctggtttggagttgcagaagcagaggagagcacgtattgaagctgctaagcagcgaattgatgcaactaggaaggctcctgctgctccagctgcaaaagcaaataactcacaagacgttgtaagaaaaaaattgaccatgaagaatcgagggggaaagaagaaggatgatatcgatcatatccttcccagtgacaatatgacaggttgttcaggtgctaggaaaaagagacgaagaggttcctgtgacagtattg

SEQ ID NO: 6822 - DNA, 441 bp, Zea mays
  Clone ID: LIB3279-034-P1-K1-E7
cgctcatccgcccgcccccgcccccgaggaaggaaccctagcctagccttgctccgagcggtcgccgcggcgactgcgacgatgatggactgcgctggaggccgagaccccgtggaggacttcctcctcggcggcgccggcgccggctacgacggagatctcgtcgccgtcttctgcgacggcggggccggcgacggaggacttgggattgagggtatccatggagatgcttgtggatttgagcaatctaatttggggaaaaggggtagagatgaaccatgttcatctggcccaacatccaaagcttgtcgtgaaaaaatgaggagggacaagctgaatgacaggttcctggaattaagttcagttatgaatcctggtaaggaagcaaagttagataaagtaaatatattgagtgatgcagcccgtatggtggcacaactt

SEQ ID NO: 6823 - DNA, 435 bp, Zea mays
  Clone ID: LIB3279-034-P1-K1-E8
ctctcttcctaggttcatcgttcctcctccgcgtccttccttccctccgcatcgcggcgcggcgcgatgatacagctgctcttcacgctgctagcggcggagggcgccgtggcggcggtgctactcttcaagacgccgctgcggaggctggccgtgctcgcgctcgaccacctcaagcggggccgcgggcctgtcatggtgcgcaccatcgcggccaccgtgcttgtcgtgctcgcatccagtctccacagcatggccaagatccgcggccacgccgaaggggagctcgacggctccggggtcgtggggctcacccccaccgaccaggtccttcttgcgcgacacctcctcgaggcgtcactcatgggatactccttattccttgctttagtcattgaccggctgcacaactatgtcaaagaaaatcgaaggctc

SEQ ID NO: 6824 - DNA, 437 bp, Zea mays
  Clone ID: LIB3279-034-P1-K1-E9
cacgggaggacccagggcgccgccgtcggcgacatgacccagcgccttctcctcgccctctcgctcatcgcatcagcgaccgccgtgcccgctgtcatccgcacggtcccggacgaccccaccgcgggctcctctggcgcggcagacgccgcggacgcgctcttctgcgacagctggaggctgtcggtggagacggccaacgcgggcccctggagcgccgtgccctcgcgctgtggggctttcgtgcgggactatatggagggacctcgctacgcgtctgactccgccgtcgccgccgccgccgccctagccttcgcctccgaagccctggccgccgccgagtggggcggctcggcgagcgcgaggcctgcgtgggtgttcgacgtcgacgagacgctgctctctaacgcgccgtactacgcggtcaacggatgggg

SEQ ID NO: 6825 - DNA, 236 bp, Zea mays
  Clone ID: LIB3279-034-P1-K1-F1
cggacgcgtgggcgccgccgcatcggcctcccaggtaagcagtagcgtccaccccagccgccgccatgaagcgcaacccccgcgtcacgagctcccgccggaagtgccgaagggcgcacttaacggccccgtcctccgtccgccgggtgctcatgtccgcggcgctatcgacggagctccgccacaggtccaatgtgcgttccatcccgatccgaagggacaacaaggtgcaggtc

SEQ ID NO: 6826 - DNA, 441 bp, Zea mays
  Clone ID: LIB3279-034-P1-K1-F10
cccacgcgtccgcccacgcgtgcgtatagaatagcttgcttgtccatcaatattgaattggtacagtactgaatgagtcctcagagtgcatagtgttgttctctttttatgtgcctgatagtcggtcctcttgtatttcagttgctcttgcggttgttcccccaactgtcaccatgcagaacgaggagggtaagactgaggacctgtatgtacccaggaagtgctcggccacaaacaggatcatgactgccaaggaccatgcctgtgtccagatcaacattggccacttggatgcgaatggcctgtatgatggtcacttcacaacgttcgctttctctgggttcgtccgtgctcagggtgacgcatacagctccttggacaggctgtggcaaaagaagatggctggtatcaagcaactgaatttacatctagtgtaccaag

SEQ ID NO: 6827 - DNA, 445 bp, Zea mays
  Clone ID: LIB3279-034-P1-K1-F11
ctctctctgaggggaaatcaaacatccttccttcagatttggtagtgcctttccggccatgctctgttcccacagttaatgcaggtgctgaggaaactgagagctggaggtggtttttgaccacagtaaggtctcttcctcagtccactgaacctgaaacttaccatatgattcaggatgaaatggtcagtgccatgcgtgatgataggagcttgggttgttctgaacttagcagatggctaacaatggcacaaataatggcctccagctttggcgagaagagtctttctttggagcactggcagatggtgaaggagcttgagaggcttagaaagcagaggatgcaatgagaatgactcatcattagcatgtgtttttgcactctaattgtttatgttggtatgctgttatgtgtatagtactagacgtttgaatcaagacatgg

SEQ ID NO: 6828 - DNA, 436 bp, Zea mays
  Clone ID: LIB3279-034-P1-K1-F12
cggacgcgtgggcggtctgctagccccaacgccgccgcccgccgctcggggatcgcctgcggtcccctgccgaccacatctacaccgcaccaccggtccttccaagtgagcttcaaccccctgcgtgtagatggagagggttctcaaggatgacgccgtcgaggagaatggcgagcgcgccagaatggcatcgtttgttggggccatggcaatctcggatttggccaaagaccacattgggtccaaaaggaatggacaagatcctgcaatcaactggtagagggcgtaatgttactgttacaaatgatggggctactcatttgaagtcacttcacattgacaatcctgctgcaaaggtccttgttgacatctcaaaagttcaagatgatgaagttggtgatgggacaacttctgttgttgttctagcttgagaact

SEQ ID NO: 6829 - DNA, 441 bp, Zea mays
  Clone ID: LIB3279-034-P1-K1-F2
ctagcagtgttatgtgcgctgatggaccttgcgcgcaatgctgtggccgatttgttcgttaatgtaaagaattgtgttacagtgcgtgtgaaaaaaaaaaaagaaaaaaaaaggaacactaaacggaccaaaactaaaaccgaaaaaaagctaatgtacaaaagaaacaaaaaacagaaactacaacaaaagtggggggggcgttttaaaggatacaagctaagacacccaggcttgcgatagtatactttttctataggggcccctaaatcaaattgattgcccgggtattaacaacgttgggacagggaaaaccaggggatcacccaattaaaggggatcggatcaaatgccaatttgggcagctagcgtaataaggaaaaggccacaaaggataagctttacaaaaatttgaacaacctaattgacaaaagggacccc

SEQ ID NO: 6830 - DNA, 395 bp, Zea mays
  Clone ID: LIB3279-034-P1-K1-F3
ttccttgttttttagtcatataaacatttccaccaaaacagggaacaaggaccatcaaggtggctttaattatttattccccaaaggtaaccacatgctacatagtggtcatgcaacgcaggcgaatgaaaattatcatgcaccaagttcacggtttaagtagtcgacaaacattctctttgcgctgtcagcatctgtcggtggtggtggcccactcagactgtactgtcctgccagcttgatgaaagttcttcgcaggcttctgaactcaggtgggccaacagatctctcaagcttgatagaaggcaaggtgggtcccatggagatcttattcacagcaagcccaagatcggatgtctgtctactacttaaacggcgcacttggtgcatgatta

SEQ ID NO: 6831 - DNA, 226 bp, Zea mays
  Clone ID: LIB3279-034-P1-K1-F4
ggacaaccttaatctcttctctatcattacagtgatgtcatttttccttttggcccctgttaccttctttacagaaggtgtcaaaattactcctacatttttgcaatctgctggtctgaatgtaaaccaagtccttacaaggtgtcttttcgctggactgtgtttccatgcataccaacaggtgtcttacatgattttggcgatggtgtcttctgtcactcattct

SEQ ID NO: 6832 - DNA, 438 bp, Zea mays
  Clone ID: LIB3279-034-P1-K1-F5
cctcctcgtccgcgtccgtccccagtcttcggcgagctccttgcccccaccgttggccctgcttcttccctctcccctacgtgtgatgcgctcaacgccgtcgccctctcttcttcaccatcgcctcgctcgcctcctccgtcgctgagagccggcccttctccgtatccgtcgccatcacaggcggatctgcctcccccatgaccgacgaccaacgagagcggcgtgcgacggctttaggcgacgaaggcggcccacaccatgtcaacgacgcgcagcggtggaagcacgcaatggcagccgacgacgcccttcctcggacggtcgcaagtgccgcctcccctctcgcatcctccaccgaaggcctcgggtccgtttgccactgcactcttctctgctcttccatccaagcatgtatgcctactcccaatcaggtca

SEQ ID NO: 6833 - DNA, 442 bp, Zea mays
  Clone ID: LIB3279-034-P1-K1-F6
ggacctccttaatctattctctatcacttcagcgatctcatttttccttttggcccctgttaggtgttttacagaaggtgtcaaaattactccatacatttttgcaatctgctgttatgaatgtaaaccaagtccttacaaggcgtcttttccctgcactgtgtttccatgcataccaacaggtgttttacatgattttggcgatggtgtctcctgtcactcattctgcgagcaactgtgttaaacgtgttgtgctcattgaaacataagtgctgctctataggacacctgattgtcctatcaactactctctgtactgcgattgcacttgccggagttttactgtactctcagcttaagcgacttaagcccaagccgacaactgcttaaatagggattgtattttccatctttttttgttaatggaaataaacacttctat

SEQ ID NO: 6834 - DNA, 397 bp, Zea mays
  Clone ID: LIB3279-034-P1-K1-F7
cccacgcgtccgcccacgcgtccgcccacgcgtccgcggacgcgtgggctgagcggctacagaagcagctgctgggccttctgcggtctgcacactaacaagcatcaaatctctctaacggaacgatctggtgacgtttttattgtcctcgtcaaagcaagggggcagaggcccaattaaattggttctccacgtcttctcgctgggtcagttgagctgtgcctgtgaccattcaatatttcctcttagatgctggtcctcgtctggtgtttgtagcatgtttttggtcagtttgtcaagtccctgaaagaacagaactgtgtgcattgcttggtttggtttattggtttctgaagtttggtgaagaggccgtaatcctggcgccctttccctttcc

SEQ ID NO: 6835 - DNA, 437 bp, Zea mays
  Clone ID: LIB3279-034-P1-K1-F8
actccgcgctcctccaaaccaaactgaaccctatcctagcacgagtgcacgacggtggcagcaggagatggtggggacggcggaaggcggcgcggagagggcggtgcggcggtgggtggacgccgccggcgggcgcctggtcctggacggcgggctggccacggagctcgaggccaacggcgccgacctcaacgacccgctctggagcgccaagtgcctcctctcctccccgcacctcatccgcaaggtccatatggactacctagaagccggggcgaacattataatcacagcatcgtatcaggctactatccaagggtttgaatcaaagggcttttcaaaagaacaaagtgaaaacttgttaacaaagagtgttcagattgcactggaagcccgtgagatgttcttgaaggaacatttggagaaatccactccta

SEQ ID NO: 6836 - DNA, 437 bp, Zea mays
  Clone ID: LIB3279-034-P1-K1-F9
cccacgcgtccgcggacgcgtgggtttatttacaagaacttgggatggaagaaatacggagaagggctggtgctgatgacaagccattgagaatggtcaaaactgtcttgcatgaacttgtgaagcttcggggaacggcaataaagggtcacctttcaatggttcctatagatgctgaacctcagccaataattctagcatacattgatctcaatctccagacccttgcagccgctagaatgttgacgccatcggggcctatgggtcaaactcactggggtgatgctgcatcgaacaatccaaatccatctactcactcagctgacgcgcaattgaagcaagagcttgctgccattttcaagaaaattggtgacaagcaaacatgtaccattggcctttatgaactgtatcggataactcagctctacccaaaggtt

SEQ ID NO: 6837 - DNA, 74 bp, Zea mays
  Clone ID: LIB3279-034-P1-K1-G1
gggagggtccgtccacgcgtttcgaaaaaaaaattaataataaagataatataaataaatgatatttataaaaa

SEQ ID NO: 6838 - DNA, 329 bp, Zea mays
  Clone ID: LIB3279-034-P1-K1-G10
ccggaccggaactgaattctcgactcgagcgacgcgttacacactacctaatgtcgatcggagacctataagatcttaagacgctggaccactgtgcacgggagtcctttgttgatgagagcgtaaagagacacaagcactcttaattttcgtcatgctagtgactgtcacaaagaaaaacagaacacccattttcttttcttttcagtgctatggatacctcgcacattagagaaacctaatgaccacgatttactttgaacaatttggtgctttaccctggacaagttacagtgctttctgaacctatgctcaacagtgttacatca

SEQ ID NO: 6839 - DNA, 483 bp, Zea mays
  Clone ID: LIB3279-034-P1-K1-G11
cggaccggaacggaatgcccgacccgagcgacgcgttcgagagcagaggccgtcacgcgctctcgtacattatcaacctctacttctactccgatgcacgcgcgcggtgcggaagagagaccaaaggggaccgcagccacgaaggaagaggaggcttcgagatttttgcggaaccgccacgccaacccactatgcacaccaccacaacctttttctgatagcctgcctctagcgtaaggtttgcgcgcgccaccgtcttcactccaatcccagcaccacccgttctaccggcgacggattccgagctctgcatctgcctgcagcccgattcgacaatcggcaccgagcctagagaagcctcgccgtaccggttaggggatttctggcttccctttctcactgttactgttgctgggatctgacgagtgattgtattggcgctaatctgctctgccgagtttggcgtgattatccaagctgagt

SEQ ID NO: 6840 - DNA, 316 bp, Zea mays
  Clone ID: LIB3279-034-P1-K1-G12
cccacgcgttcgggctacagaagaaggatacatatgctgtattttcgcagcctgttgatcctgaatagagggaagctgaaccttgttcttctgccatcatctatcatgccgcttacctttgtttgtgatgatggttatacagagcaactagctctcttgagcaacgacttttaatttttggaagttatgattgaagaaatatcagctgataattctggacgctcttttctaataagaatttcagaatgtaaagtgtgttactactggtgtgctcagaagtcgaaagaagattgaatggcacttcttgcaaaggtgt

SEQ ID NO: 6841 - DNA, 437 bp, Zea mays
  Clone ID: LIB3279-034-P1-K1-G3
gccggaggctctggatccctgtgataataataaactgatataagcagaggaagcggggaggaagctgcgagttggagggggccgggagaggcgtctctggttattgcttgtccctgcttcccggtgagctgctgggagtggacgggccgggaaggagacgagaagataagggcgccgcgcgcggccatggctggaagtgcgccggcgacggcgatggacaagaccagctttgccaccacgtgcagcctgctgagccagtacgtcaaggagaagaagggcggcctgctgcagggccttggtgccctcgccatggcgccggcagctggaggagaaggagctttccgaccgccgaccaccatgaacttgctgtcagcgctcgacgacgcgccggccgaggagcgcagcgagaaagccaccgccggggagccaaaacacca

SEQ ID NO: 6842 - DNA, 410 bp, Zea mays
  Clone ID: LIB3279-034-P1-K1-G4
gcgacggcggagatgatggggtggggagaggaggtggtggctctgtccctgcgaggctacggctatggcaacgaggaggacgaccggccggagaagccgcggcggtacggggtgacggagatgcggagccccttctactccttccgccccgcaaaccaggcgctccaggaaatattggattctcttagtccattcgttgatggtttgaagttctctggcggatgccatagtttgatgggaaaggagttggttagagagatcactgatctagcacacaggcatgacatttatgtgagcacaggtgattgggcagagcatttgctgcgccaaggaccctcttctttcaagcaatatgtagaggaatgcaaggccttagggtttgacacaattgagctgaatgctgggtctct

SEQ ID NO: 6843 - DNA, 315 bp, Zea mays
  Clone ID: LIB3279-034-P1-K1-G5
tcggttacacactacctgctttcgatcggagacctagaagatctcagcaagcttgaccacggggaatgggagtcctttgtagatgagagcgtaaagagacccaagcgctcttagtttccgtcagtatagtgactgtcagaaagaaaaacacaacacccattttctttttttttcagagctatggatacctcgcagattatgagtaacccaatgaccacgatttacttttaacaatttggggcttcaaccttctcaaaatacaaggctttctgaacctatgctcaaataaaaaataataaaaaaaaatatttttat

SEQ ID NO: 6844 - DNA, 379 bp, Zea mays
  Clone ID: LIB3279-034-P1-K1-G6
agtcgctcccccgcggctcgcgcaggcgggcgacacaacgaggctaaatccctatcgcgaggaggcgtgtgaggccagcggctttgcgatgacagcaccagcggacaaggggaagaaggccaagactgatgccgacggcggcgaggagaacgaacagatcgacggcgtcctcgtcctctccatcgagaagctccaggagatacaggacgagctcgagaaggtaaatgaggaagcaagtgacaaggttatggaggtggagcagaaatacagtgagatccgcagacctgtctatctcaagaggggtgacattatcaagaccatcccggacttttggctcacagcgtttatgaaccatcctctattaagtgagcttctgact

SEQ ID NO: 6845 - DNA, 431 bp, Zea mays
  Clone ID: LIB3279-034-P1-K1-G7
gaggccttcagcctcttcgataaggatggcgacggctgcatcactaccaaggagcttggaacggtgatgcgctcccttggccagaaccctaccgaggcagagctgcaggacatgatcaacgaggtcgatgcggatggcaatgggaccatcgacttcccggagttcctgaacctgatggcgaggaagatgaaggacacggactcagaggaggagctcaaggaggccttccgcgtcttcgacaaggaccagaacggtttcatctcggctgccgagctccgccatgtcatgaccaaccttggcgagaagctgaccgacgaggaggtcgacgagatgatccgtgaggccgacgtcgacggcgacggccagatcaactacgaggagttcgtcaaggttatgatggccaagtgaggagcggtccccgtgaaataagt

SEQ ID NO: 6846 - DNA, 398 bp, Zea mays
  Clone ID: LIB3279-034-P1-K1-G8
ggagaagagggacctgttcacgggcacctacatgccctccaccttcctcaccggcgggcagcgcgtctgcgcctacctcgacccctccgagcccacccacgccaaggtgaagcagctgctcttctccctcctgctctcccgcaaggacgacgtcatccccgtcttccgctccaacttctcctcgctgctcgccaccgtcgagtcggacctcgccgagggcggcaaggccgagttcaacaagctcaacgacgtcacctccttcgacttcatcggcgaggcctacttcggcgtgcgcccctcggcgacggacctcggcaagggcgggcccaccaaggcggccaagtggctcatctggcaactccacccgctcctcaagctcgggctccccatggtccttg

SEQ ID NO: 6847 - DNA, 434 bp, Zea mays
  Clone ID: LIB3279-034-P1-K1-G9
gccctggtgattgtcgttgtgctggcgctcacctttggtgccacggtcagcgtatccgctggcgtgaacaagtcgtgcgtcagcggtagcgccggcgccagcgtgagcattggctacggcggggcaagagccagcgccggcgctggcgtgtcccttggcgccgacgcgtaccggagcacgtgcccccgtgccgaggagatcatccgtgcggccgttgagagggccgtcgctgccgacccacgcatggcagcgtctctcctgcgcctccatttccatgactgcttcgtcaacggctgtgacggctccgttcttctggacgacaagccgttcttcatcggcgagaagacggctgtgcccaacgccaactcaatcaggggcttcgaggtcattgacgccatcaagaccgagctggagcgggagtgcccagatacagt

SEQ ID NO: 6848 - DNA, 436 bp, Zea mays
  Clone ID: LIB3279-034-P1-K1-H1
aacgtgaagtcgagtgtgtgtgacattccaccaattggcctgaagatgtcctccacattcgttggcaactcaacctccatccaagagatgttccgccgcgtcagcgagcagttcacggccatgttcaggaggaaggctttcttgcactggtacacaggcgagggtatggatgagatggagttcaccgaggcagagagtaacatgaacgacctggtggccgagtatcagcagtaccaggacgccactgccgaggatgaggagtacgaggaggaggaggaagaagaggaagagacctaagtcattctccgcagtgcttggtacagatatgatattccttgtatcgctgttagtactcgtcagtttgaggttcgtgtggtgatgcttgctaggtactagatgggtggtattgcttatgaatgcgatgttgtcgtgacag

SEQ ID NO: 6849 - DNA, 439 bp, Zea mays
  Clone ID: LIB3279-034-P1-K1-H11
ttgcgctgcgcggagcgagagtaaacatgccggaccaccgaaaaccgagccgtgcgggggctcgggactggaacggcacaggaccctaaaatctcaaatcctttctgcccgcccgtccgagcgcgttgacgctgttatttttgtacggccgcgcacgcacctatcgcttctccttctgcagggggatcgggtacaccacaagctgcacgatggtgctgttggtctttagataaccgctcctaatatggaaccccgggttctactttgacgacaaaatcctctgttttatcaagggcgtcaagcgcacctttaatcttgcttgattgaccacaaaagcacaacggagcattcggcgaggacctgcccgcttgaaacccacgacgagggcatatgctgaggaattgtatattgtgtccagggtggtacacacaaagagcta

SEQ ID NO: 6850 - DNA, 378 bp, Zea mays
  Clone ID: LIB3279-034-P1-K1-H12
cggaccggaatcggcatgctcggcgtcgagcgacgcgtccgtgaagttgaagccttcaattcttgatgaatatgccaaagagaggtctgcaattccccttgtcaaaccacataatgtcatgcatcctgatgatcatctcattctggaagatgaaagcggcagagttacactggcaggagccatacctccagcagcattcgtgactggggttgtagtggctctccatgggaaggaaacaagtgctggcaattttgttgtggaagatgttcttgggggtggtcttccaccccaaactgcatttgttagcgcagaagaagacaagtatgtagtattcatatcagggcttactgttagaagtgacacattccattctctaca

SEQ ID NO: 6851 - DNA, 436 bp, Zea mays
  Clone ID: LIB3279-034-P1-K1-H2
aggagatcctcgtcccctcccgcccccgtacgtctcccctccatcttccattcttccacatatgcccacacaattgccgtctcgctccacattcccttcgcaccacctttcccctctctctccctctctctccctctctcactcgctctttctccggggccgccattcctgctccgtccactcccaccacatgcggcggcgcgggcgcctccccgcggcgctgtggctcgttgtcgtgacgttggcggcgctggtggcgcgacctgcgtgtgcggcgtggtgcatcgcgcggagcgaggcctcggacaaggcgctgcagtcggcgctggactatgcgtgcggccccgcgaggggtgccgactgcgcgcccatccaggccagcggcctctgctacctggccaacaccctcgccgcgcatgcctgttacgccttcaac

SEQ ID NO: 6852 - DNA, 371 bp, Zea mays
  Clone ID: LIB3279-034-P1-K1-H3
ggaaatggctaccgcggcgcgcctcctcctcgtcgtggtgcttctctccgcggcgataccgatcccgtccttcgcgacaagcttcgtcgtcggcgacaagaggcatcgctgggctcccaacgtcaactatacagactgggcggaccgtcaccagttccacgtcggcgactggctcgaattcaggtacgagagggacaggttcgatgtggtgcaggtgaacgagacggcatacgcggcgtgcgacgccagcagccccatcctcagctacagccgcggccacaacttcgtcttccggctcaaccacacgggccggttctacttcatctgcagccgcggctactgctggagtggcatgaaggtctccgtgctcg

SEQ ID NO: 6853 - DNA, 63 bp, Zea mays
  Clone ID: LIB3279-034-P1-K1-H4
tcgctcacacgttcgccgtgggattccataccactattacccattttttcttccgccgatttg

SEQ ID NO: 6854 - DNA, 447 bp, Zea mays
  Clone ID: LIB3279-034-P1-K1-H5
ccgaattcccaggcaggcaggtcggcgaggagggcaggaagaccgaagaccgagccgtgcgggggctcgggacgggaacgggacaggaccccaaaatctcagatccttcctgcccgcccgcccgtgcccgtcgacgcgttgtttttgccggccgcgccccacctccgccctttccttctgcagggggatcggatacgccacaggctgcgcgatggtgctgtgggtcttcggctacggctccctcatctggaaccccggcttcgacttcgacgacaaaatcctcggcttcataaagggctacaagcgcacctttaatctcgcttgcattgaccacagaggcacaccggagcatccggcgaggacctgcacgcttgaaaccgacgacgaggccatatgctggggaattgcatattgtgtcaagggtggtccagaaaaagagctaaaagc

SEQ ID NO: 6855 - DNA, 430 bp, Zea mays
  Clone ID: LIB3279-034-P1-K1-H6
cccggttccatcgcgcggtgcggaatttaacatggccgtgccggaggtggtggtcgacggcgtcgtcttcccgccggtggcccgcccgccgggctccgccggctcgcacttcctcggcggcgcaggcgtgcgaggcctcgagatcggaggcaacttcatcaagttcacggccatcggcgtgtacctggaggacgcggccgtgcccgcgctggccaagaagtggggcggcaagacggccgacgagctcggctccgacgccgtcttcttccgcgacgtcgtcacgggcgacttcgagaagttcacgagggtgacgatgatcctcccgctgacgggcgagcagtacgcggagaaagtgacggagaactgcgtggcgttctggaaggccgccggcctgtacacggacgccgagggcgtcgccgtggagaagttc

SEQ ID NO: 6856 - DNA, 427 bp, Zea mays
  Clone ID: LIB3279-034-P1-K1-H7
ctcgtcccagcagccgcaagccaaaaccctagcaagcaaaccaccggagcagcggcgctcgcgcgggcggagccatggcggacgacgattacaacgaaatcgacatgggctatgaggatgagcctccagaacctgagattgaggaaggggccgaagaagagcttgagaacaacgaagatgcccctgatgatgtcataggtggagagggtgaagataaggaacaggaaaagaccaagcgtgagcgcaaaacaacaaaatatatgacgaagtatgaacgtgcgcgcattcttggtacacgagccttgcagataagcatgaatgctccagtcatggttgagcttgagggagaaactgaccctcttgagattgcgatgaaagagcttagagcgcgcaagatacccttcacgatcagacggtacctacctga

SEQ ID NO: 6857 - DNA, 392 bp, Zea mays
  Clone ID: LIB3279-034-P1-K1-H8
aacacaaaaggtcaagcaaaaactgaaaggacacaaaggcagagatgagcaacagatttatggcctgaaactgggattcggtaacaaagttgctacacgggaaaatctcatcacaggatttggggacatgaatccggcagagaaatctgtgatgctccaaaagggatccggctgttgcagccgcgtcgcagactgcctctgctgcatgtgctgcatcaaggcgtgcaacaggatgaacgaccagtgcgccgttctgatggcacagatctgcgcggctctagcgtgcctcggctgctacgagtgttgtgcagaggtgtgctgtggagggtcggagtcgtagtaggaagtgttttgtatatttgtatggaagataggagaattggagtgtacat

SEQ ID NO: 6858 - DNA, 432 bp, Zea mays
  Clone ID: LIB3279-034-P1-K1-H9
gagcaggaggcggacaaggtaagcagcaatcgcaggaaccctagcgccgccgcacccgcaggaatgggtatcgacctcgtcgccggtgggaggaataagaagaccaagcgcactgcgcccaagtctgacgatgtctacctcaagctcctcgtcaagctctaccgtttcttggtcaggaggaccaagagcaatttcaacgctgtcattctcaagaggcttttcatgagtaaaaccaaccgaccaccaatctccatgcgccgccttgtcaagtttatggaaggaaaggagaagaacattgctgtcattgttggcacagtcacagatgacaaaaggatccaggaggttccagcaatgaaagttactgccctgaggttcacggagacagcaagggccaggattgtcaatgctggtggcgagtgcctcacatttgac

SEQ ID NO: 6859 - DNA, 370 bp, Zea mays
  Clone ID: LIB3279-035-P1-K1-A1
cccacgcgtccgcaaaaatcaccaatcttggaaacccctgctacacttgtattcccaaactacattcatggttggaggcaacgagggaggcaggcattggtgctgatgatgctgataggccaagcccaacggaaaaaaatttggtgcagcactgctgcaaaccagagtgtttgcagcccctcacataaaggagtatagaccccactcgcagcagcaataattcaactaaaacgttatctggtggacctgcaagtggggtctatcccctttttgtgaggagctgcaaaacgtcggatcaccggttggcctagtaagcaaacatatgggccggattgaggatgcattatttttatcattattcattcaaaaa

SEQ ID NO: 6860 - DNA, 371 bp, Zea mays
  Clone ID: LIB3279-035-P1-K1-A10
ggcagaagaacaagatcacaatcaccaacgacaagggccgtctctccaaggaggagatcgagaagatggttcaggacgctgagaagtacaagtctgaggatgaggagcacaagaagaaggtggaggccaagaactcgctggagaactactcctacaacatgcgcaacacgatcaaggacgagaagattgcgtccaagctgccggccgatgacaagaagaagatcgaggacgccatcgacgcggccatcagctggctggacgccaaccagctcgccgaggcggacgagttcgaggacaagatgaaggagctggagagcctctgcaaccccatcatcgccaagatgtaccagggcgcgggtgaagacatgggc

SEQ ID NO: 6861 - DNA, 464 bp, Zea mays
  Clone ID: LIB3279-035-P1-K1-A11
cctcgccgccgatcggtttcggagaagagaagcaaatcaagatgtttctcggctcgctcccgcggcgcccgagcaaggaggctgcgtacaagcagctgcggtcgcacatcatcatcatggcctcctgcgccgccgtcatccgcgccaccccttacatcctccatttcctcgcccgcgacggcgacatccaggaactcaagctcgatctgtaggcccgtccgttgcttccccacctccagaggtgctacaaaggcaaccgttagttcgaggccactgcaaggtactatggagttagtggctacagtgcctgcttaagtttctttgttgttccaagtttagtgacaaaactgacaatggtgtagcaactgggttgtgctgcgaccagtatttcgtttttgcctacctgtatggtctagtctttgtttgcactggtggatttgcagagatgttatcattcaacaatt

SEQ ID NO: 6862 - DNA, 442 bp, Zea mays
  Clone ID: LIB3279-035-P1-K1-A12
cgcgtgcgcattgagacgacgagtttctagagcgtcgtaccgcgcacggctcccgagccccaccgcaaagcgccggaatcgtgagcgcgtccggcctcgcctgctccgcggcgagaggcggccgaggaggacgggcgatgtacccggtggtgacgggcacgccgccggcgcggctgccggcggcgtcgcgggtggacaaggccacgagccacctgctgcagggccccgactgggccgtcaacctcgaaatctgcgacaccctcaacgccgaccgctggcaaacgaaggatgtagtaaaagctgtgaagaagcgattgcagcataaggatccaaaagttaaattctttactttgacgttattggagacaatgatgaagaactggggggaatatgttcattttgaagttgctgatcagcatggtttacaagaaattgttaaaat

SEQ ID NO: 6863 - DNA, 162 bp, Zea mays
  Clone ID: LIB3279-035-P1-K1-A2
accgactgcgacccgatttattattagtattcattactcgcatgtcgcatgatacacatagccatgaccgcattttgcatccaagttccgatgtggaaagcacgaatttgaggtcaacataaaaaactaaaacgccaataaaaacaaaaaaaaaaaaattat

SEQ ID NO: 6864 - DNA, 341 bp, Zea mays
  Clone ID: LIB3279-035-P1-K1-A3
cggacgcgtgggatcaaccaggcactacctccccaataagttcaagaagtttgtggtgcacaatgtcgtgtgagctggagttgctcatgatgcacaacagaacctactgtgccgagatcgcccacaacgtttcaaccaagaagcgcaaggagattgttgaacgtgccgcgcagctcgacattgtggtcaccaacaagctcgtcaggctccgcagccaggaggatgagtaggctgggttcttgtcataacggccaactagatcctgccattcccgggtgtaggaaactactctgctttgtgccttgttgggtcttagaataccagtcattttctacattttt

SEQ ID NO: 6865 - DNA, 422 bp, Zea mays
  Clone ID: LIB3279-035-P1-K1-A4
gtttagtgcttaaggtccaggacctgatcctaaggtggattatgcttgcaccccagaagagagtgcagcagcatttccaagcttgtggaactgtcaacagggtcacaatcttgactgacaagtttggacagccaaaaggttttgcttatgttgaatttctggaacaggaaggtgttcaggaagctcttaacttgaatgaatctgaattgcatggtcgccagattaaggtcgcgccaaagaggactaatgttcctgggatgaagcagcgtccaccacgtggatataatccataccatggctacccttatagatcatacggggcaccgtatttccccccatatggttatgggagggctcctagattccggcgccctatgcgctacagaccttacttctgaagtacggggtaatgagtttaatgc

SEQ ID NO: 6866 - DNA, 469 bp, Zea mays
  Clone ID: LIB3279-035-P1-K1-A5
cggacgcgtgggcgcgaatcacagacgcgtctatctcagcttgctgcgctgcactaccctgccctgcgcatcatatcgtacgtgagcccggccgagcgagagcgagggagaggcatggctgctccgaagctcgcgacgctggcgctggccgtgctcctggcggcgaccgtggtggctcccccggccgcggtgcgcgcggcgatgtcgtgttccaccgtgtacagcacgctgatgccgtgcctgccgttcgtccagatgggcggggccatgccgccccagccgtgctgcggcggcatccgcagcctgctgcagcaggccaacaacacccccgaccgccgcaccatctgcggctgcctcaagaacgtcgccaacggcgccaacgggagcggcacctacatcagccgcgccgccgcgctgcccagcaagtgcggcgtcgccctgccgtacaagatcagcaccaacgttaact

SEQ ID NO: 6867 - DNA, 390 bp, Zea mays
  Clone ID: LIB3279-035-P1-K1-A6
ggaacttcttgcaaaggtcttcaagggagaagcggcttaaaatgtgtgagcaggtattttcggactcgtaccagaaagggaaaagctacaaaggttgacacagcgccgaagctgtgaagcaggaaagcttcggcatgttcgcagaaaagggaaccgacttaaagatgaaaaggccatttagacctcgatagagtgctatagaattatcaccaaatgtaaagggcatgtatgtaattttgtatgggttgtaccccgtgcctataaataggtgaacagtacccccgtactgttcacgttgacttggcatttgcttttgcgtcacacttgtattttcatctccttccaaaccgaaggtacatttataattggatattgtctctatttctctat

SEQ ID NO: 6868 - DNA, 344 bp, Zea mays
  Clone ID: LIB3279-035-P1-K1-A7
cggacgcgtgggtccgtctctcctgttgtgcgtgttgctgttcagtgcaaggttgcctctgaccttcccaagctagtcgaaggtttgaagcgtctagcaaagtccgatcctatggttctctgtacaatggaagaatctggtgagcatatcattgctggagctggtgagcttcatcttgagatttgcctgaaggatctgcaggaggacttcatgggtggtgctgaaattattgtttccccacccgtcgtctccttccgtgaaacggttcttgagaagtcctgccgtactgtcatgagcaagtctcccaacaagcacaaccgtctgtacatggaagcgcgcccctt

SEQ ID NO: 6869 - DNA, 298 bp, Zea mays
  Clone ID: LIB3279-035-P1-K1-A8
aaagcaggccaggtaatgtcggagccaaagccagtatttgcaaggatagaaaccgaggtggaagaggaagcccaagcaagttcaaaagcagcaaaaggtgggaagaaagcacgcaggaaaggacttgtggaggcatagtttctgttggaacagtgtatcagcatcgttaaaaggagaatatttcatcttctcttttttttggaaaaaaatctttagcctatctgttcctgaaatttgttctttgctaacgtgtcacattgtatcatgtagatagccaaaaaaagaccactattgattc

SEQ ID NO: 6870 - DNA, 348 bp, Zea mays
  unsure (1)..(348): unsure at all n locations; Clone ID: LIB3279-035-P1-K1-A9
gtaaatatgggttgacagaaattatagcttctggcttgagctgggtggtttcagatcttgtccagtgccaaccagtgtgtatatatacatttttaaggtcttgtaacctagataattagtgtcaacttcgaggctgcgagtccacaccttatctaccgngcttgtctctttttctttatttacacatgcatttattttgcctcttattgcattatgcccctttcaggatgaaagatgctcgaagttgaaaatatacccaatactgcagaaggtttaccttgaaagaattttgaggaaaccagaaattgatgcatttgcagaggagcttatgccgcataaaagaagctt

SEQ ID NO: 6871 - DNA, 383 bp, Zea mays
  Clone ID: LIB3279-035-P1-K1-B1
ccgggtcgacccacacgcgcgcgtcaggagcacatactttcagcggctgtcgctgttcctgttccaccttccgctgatcataagcaagcggcttctgtgatgctcaagggcatgaccgcccatgttctgcttctccgggtattcaaggtggagagtggccatactatcctggtccatgctgctgctggtggtgtcggctcactcctttgtcaatgggcaaacacccttggtgccactgtcatcgggactgtttgcaatcaagaaaaagccgctcaggcagctcatgatggatgccaccatcccatcatttacactatcgaggatgtccccgcaagagtgacggatgtttcatcacgaaaaggtggctgatgagtctttgattc

SEQ ID NO: 6872 - DNA, 342 bp, Zea mays
  Clone ID: LIB3279-035-P1-K1-B10
cggacgcgtgggcggacgcgtgggcggacacgtgggcgctgaggaagatcgtggcggctgatggggtgaagggcctgtataaggggttcggacccgccatggcacgcagcgttccggccaatgccgcgacgttcgtggcctacgagatcacgagatcggcgctaggttgatttgattggtgctggcctttgccatggccctttgcagtttattcattctccttgcgcggctggagcaacgcgaacaatgccagacaatttttagggaggaaagagagagagaaacttttcacttcaatgatgagattctttaatgaagcaaagcttacttaaaagtttgttc

SEQ ID NO: 6873 - DNA, 432 bp, Zea mays
  unsure (1)..(432): unsure at all n locations; Clone ID: LIB3279-035-P1-K1-B11
ctttcattcgccgccgccgcctgctctctgctgccgtcgccatggggagaaggggggcgagatgctatcgccagatcaagaacaagccataccccaagtccaggtactgccgtggtgtccctgaccccaagatcaggatctacgatgttggcatgaagagaaagggtgttgatgagttcccctactgtgtgcaccttgtctcttgggagaaggagaatgtctccagtgaggctcttgaggctgcccgtattgcctgcaacaagtacatgaccaagtctgcaggaaaggatgccttccaccttcgggtccgggttcaccccttccatgtccttcgtatcaacaagatgctttcgtgtgcttgggctgataggctacagactggaatgaggggtgcctttggcaagcctcantgcacctttgctagggtggaca

SEQ ID NO: 6874 - DNA, 465 bp, Zea mays
  Clone ID: LIB3279-035-P1-K1-B12
atttctcgttattttttttgcaatgtgaccaaatcgcttatgtggcagctaaattaatgctatagaaactagctgacgtggagggttaggattgctctaaatgatttttagagatgaatgtttctgactcgtgagttcccttaactatttatagaggcggtcattacatgtgcatgcctggagaaatggttcgacctatgtcctaaaatcattttctagtagtgtcatacgagcaaactttggccatttcattaacctataaaactagtcttaggtggaagtttcatgtgagtataatatgcatttaataaactatcacacaaataatttgatgatatgataatgtttttaagaagagagagatgataactatatttacactattaaaatatacctttgtgtgatattcgggttcaaagcttaataatattgaaataatactcaaaaaaaaaataaaagggcggg

SEQ ID NO: 6875 - DNA, 461 bp, Zea mays
  Clone ID: LIB3279-035-P1-K1-B2
tagacacagcggcaccacttgagaatgattcagctgctggtgggtacattgatccaatggatctttacggagcttatggttcaatgagatctttcggcaggttctgtggcggtctagattacaattatggctatggccccagcagcggaagcagccgatcaagatcggattggcgataccgaccttactgaacgtgtccattgtcagtgatgttctagtttacctccagggaaggaaactgaaatggcgaaaagaaacattttaagaatgttaagtgttacgttaagtggcatgttaatcgtaagagggccctgcggaatctgtcgatttgttcatgttgtaattttggacatggaaatgcttttatgcaatttctttgctgtgattcacattattgacacacgatgaaggcagcagcctttgtgtattattgtgtgggagtgcttgatgtgtgataaaaa

SEQ ID NO: 6876 - DNA, 397 bp, Zea mays
  unsure (1)..(397): unsure at all n locations; Clone ID: LIB3279-035-P1-K1-B3
cttcaagtttggacgagcaagtgcctttcttgcatgttagcatgttggattttggagatccatttaggaagcatgaaatgagatgcaggtatagacaaaaacttcctatgccgtggtctgccatcaccaatcctttgggcacatttgtcatatggatgcttctagggtatagcattgctgctgcatattctcgatatgacaaagttactgaagattgcagaaagatggaagagctaaaaacacaagcagaagctgctgatgttgcaaaatctcagttcctggcaactgtgtcacatgagatcagaacacctatgaatggcgtccttggaatgctggatatgcttttaggaacagatctaactatgacacaaaanggatatgctcaaactgctcaaat

SEQ ID NO: 6877 - DNA, 427 bp, Zea mays
  Clone ID: LIB3279-035-P1-K1-B4
cccacgcgtccgcccacgcgtccgtcggcgatgtctggccgcggcaagggcgggaagggtctgggcaagggcggcgccaagcgccaccgcaaggtgctgcgtgacaacatccagggcatcaccaagccggcgatccgcaggttggcgaggaggggcggcgtcaagcgcatctccgggctcatctacgaggagacccgcggcgtgctcaagatcttcctcgagaacgtcatccgcgacgccgtcacctacaccgagcacgcccgccgcaagactgtgaccgccatggacgttgtctacgctctcaagcgccagggccgcaccctctacggtttcggcggttaggtcgcccctctcccggtggccgaattacgtggtggccgtggccgtcgtgttgtgttcttggtctaattagtctgtgttgacttta

SEQ ID NO: 6878 - DNA, 452 bp, Zea mays
  unsure (1)..(452): unsure at all n locations; Clone ID: LIB3279-035-P1-K1-B5
aaaagataaggggtgactctcccctctttcagctaagtccctgccccctctccttttcttacattcaggtcctcgcagctcctctcttttttcttgcttctttctttcgatctgcgagccgtccaggtccagtactctcctttccgtgaaggaactcttgcagccggcccctctggtttactcgaattcttgctccccggtccctcctactgtccccgcgtagatccgtccgtccgaggagcacaccgtccccacccccatgtttacccaccagttcctctgacggccgccgtgctccgatgaagctgagcgtgctacgtattccgcgttcccactccttgtccgtcgtcttcctgtactggatctacgtcttctcatgaacgcatcgtccctctccacctgctgatccttcgccatctcttcatctntctttctctctgagatagtctttc

SEQ ID NO: 6879 - DNA, 343 bp, Zea mays
  Clone ID: LIB3279-035-P1-K1-B6
gggaccgcaagccgccggagcgcttcaggcgcagggaggataggcctgctggtggacaaggaggcccccgccctggtcctggtgctgctgctacagctccatctccagcaccggttgctgctcgcccataggctttagcttttcgaccgtgttaagtcttctgcccactcagtttcggagttgtcccctgtgcgtgtgtgaagctgctatattagagttactttttgtctaaagtctgaacattttcgaagaatttgaatatctgaacatttgaatgtttgtgctgagtttttcaaagaatttgaatatctgaacaattgaataaaaaaaaaaaataaatata

SEQ ID NO: 6880 - DNA, 436 bp, Zea mays
  Clone ID: LIB3279-035-P1-K1-B7
cgaacgcctcctccctccctggttccgttggctcttgcaccagcaatggcggcttcttggagagccgtggcgctgtcggtcgtcacgctggcctggctccttggcggtggcgcgtgggcgttcccggcggaggatttggtcacgcggctgccggggcagccgccggtaacgttcaggcagttcgcggggtacgtggacgtggacgtcaaggccggcaggagcctcttctactacttcgccgaggcgcaggagaacgccgtcgccaagccgctcacgctgtggctcaatggaggtccaggctgttcttctattggaggcggtgctttcacagagctagggccattttaccccagaggagatggtcgaggcctcaggttgaacatgaagtcatggaacaaagcgttcaatcttgtgtttgtggaatcgccggctgggg

SEQ ID NO: 6881 - DNA, 395 bp, Zea mays
  Clone ID: LIB3279-035-P1-K1-B8
cccacgcgtccgcagactcacctctgaggcagtatgccctgcctttgctgtgtgatatggctcatgcttctcgcaactctagagagcagttgagggctcatggaggactagatgcgtacttaaatctgttggaggatgatgtatgggcgtgcacggcattagattctattgctgtttgtttggctcacgataatgatcatagaaaagtggagcaggcactgttgaaaaaagaggcaattcaaaagttagtgaagttcttccaagactgcccagaacagtattttgtccatatattggactctttcttgaagataataatgaaatcttctaggctaaacacagcaatggccaccaatggcttgacagcattgctcaatgcaaggcttaaccatcga

SEQ ID NO: 6882 - DNA, 401 bp, Zea mays
  Clone ID: LIB3279-035-P1-K1-B9
cggggttaggagatctgacccaatggccgcgaccaaggtgtgcaacgttaggttcgagggcaacgtgatcaccaccaccgtgacggcctccggcgcggccgtggagagctggctcgacgagatcctctccgtccaccgccgccgcctgcacaagctcgtcgtcgggctggacgtcgagtggcgccccagcttcagccgcgcctacagcaaaacagccatcgtccagctctgcgtcgggcgccgctgcctcatcttccagcttctccacgccgactacgtccccaacacgctggatgagttcctcagcgaccccgactacacattcgtcggcgtgggcgtggctgcggacgtcgagcggcttgagaacgactacgatcctgaggtggcgaacgcggaggacc

SEQ ID NO: 6883 - DNA, 428 bp, Zea mays
  Clone ID: LIB3279-035-P1-K1-C1
taacttttagccatagtgttgctagctctgctatccaagatacacctgctcggatgtcaggagacggtgtggtttctgtgaacaacatatccaatgtggccaatgacatgcgtagtcctcgtgactgtgatgaatttctatcggagttgtctagatttatgaatgattctcctctgcgtaacactcctcttggagagtgctctggtcttcctccgatgtctgaagctgaggctcatgcttttgaagtcaactcttttggcctctacaatgaattatcagagcttgttgggttaggatgcgcggataacaacttaaacaccagcaatgtggaaactacggattatctcatgttgccacctgacagagaactgtcggctaatgattacatggaactaaacgatctccttgctcctgacccaagctttccc

SEQ ID NO: 6884 - DNA, 422 bp, Zea mays
  Clone ID: LIB3279-035-P1-K1-C10
aaaaagaaaggatgccgataagtattaaaacaagctaaggttctagcccgcatagaatgtcgaatttggaatgccactaccaagttcactcgtccacgatacaaagccaaagcaatccacagacagacagattctaccctcagttcaaagatgtggctaaaccatctcattctaataattcctatacagcatcagaaaacgaccatgtgcctcactcctcacttcctcattaaaataaaaacggactggcaacaacttcatgccctgtgcaccccttgttaaccatcctcatcagaaatcgtagtctttaaggtctttcttggagtcggccaattccatctccaccatacactcctcttggctgagaggcgggagcccattcttgtggcgtgtgtagttgtgtttgtgccacccactcttgc

SEQ ID NO: 6885 - DNA, 89 bp, Zea mays
  Clone ID: LIB3279-035-P1-K1-C11
gtctagaggatgcaagctagcgtacgcttgcatgggacgaagtatatgttctatagcgtgacataaattaaatttactgtccggtgatc

SEQ ID NO: 6886 - DNA, 382 bp, Zea mays
  Clone ID: LIB3279-035-P1-K1-C12
tctctctcctccggcctcgagtcgcctccgatccgtccgggaaagcaaaacataccgaaagaagaaaggcgacgaggaagagaaggctctccgcgagatctgggggagctcccattctcaagatgcacgacttctgcttcaccatcccctacgggttcgccgtgctggccggcggcgtgctgggctacctccgccgcggcagcaccgcctccctggcggggggcgccggcgccggcgcgctgctcctcctcgcgggcttcgtcagcctgaaggccttcgagaagagacgcaactcctacgtcgccctcgcgctcgagacgctttgtgcattagccttaactttcgttatggggcaaagatttctcgagacttcgaagattat

SEQ ID NO: 6887 - DNA, 387 bp, Zea mays
  Clone ID: LIB3279-035-P1-K1-C3
tgagcttatgttcttatatgactactagctagaagttagagcctagatgatggctgcttctgttggcgtgaaagctcgagtgctcctaaatggtcgtcgtattagctgatacgacatctacccgatgcaatagataatattgtttacacgcgtgagtccaaaattgttggctttgggtcggagcagttaatgcgagaagtgtattttatcacttctgagtgcaaccttttttttattatttttccgagcttctgcctcttgcatatgttgtagattctcgccgagaagggagtagtagtattacctgatatctatgctaattcaggtggtgtggtcgttagctactttatatgagtgggttcaaaaacattcaaagtttcatgtggg

SEQ ID NO: 6888 - DNA, 426 bp, Zea mays
  unsure (1)..(426): unsure at all n locations; Clone ID: LIB3279-035-P1-K1-C4
gggttttgttgctctccgaccccgagctccgaaggccgcagcatcaggcgcggcccccctcgcgtgtgaccgagatggcgctgccgaatcaggggaccgttgattaccccagcttcaagctcgtcatcgtcggcgatggtggaactggtaaaactacatttgtgaagaggcatctcactggagagtttgagaagaaatatgaaccaaccattggtgtggaagttcatccgttggatttcaccactaactgtggtaagatcaggttctactgctgggataccgcaaggcaagagaagtttggtggcctcagggatggatactatatccatggccagtgtgcgatcatcatgtntgatgtaacctcaaggcttacttacaagaatgttcctacgtggcatagggacctgtgcagggtctgtgaaaaca

SEQ ID NO: 6889 - DNA, 470 bp, Zea mays
  Clone ID: LIB3279-035-P1-K1-C5
cgccacccagccccttaaccctcgttcctctagccgtctcgcgcagccacagcctccattggtcctccgacggcggtgcggctagctcaaccatggcggactccaaggccacctcggcggtcaccctccgcactcgcaagttcatgaccaaccgcctgctggcccgcaaacaatttgtgcttgaggttatccaccccggccgcgccaacgtctccaaggcggagttgaaggagaggcttgccaagatgtacgaggtgaaggaccccaacaccatcttcgtcttcaagttccgcacccacttcggtggaggcaagtccactggcttcggcctcatctacgataacctcgagtctgccaagaagttcgagcccaaataccgcctcatcaggaatggtcttgctactaaggttgagaagtcccgcaagcaaatgaaagagcggaagaacagggccaagaagatccgtggtgtc

SEQ ID NO: 6890 - DNA, 473 bp, Zea mays
  Clone ID: LIB3279-035-P1-K1-C6
aaaggtcacccttttaacaccacgccgccgccgtttgctgttcggcgcctttcctaacaacgggtacgccaacgtctccaatctcgtatactttcgtgctcagcatcatggacggcttccccaagagcgtcggcggtggcggccctaacattccggcgggatcccaccccgcaggcgggagccaggcggcggcaggaggaggcgcgacgcagcggacgcagtatccgtatgtgactggtaattcagtcattgccttgaaatacaaggatggtgtgatcatggcatgtgacactggagcctcttatggatcaactttgagatacaagagtgtggaacgcattaaggcagttggcaagcatagcatcattggagcaagcggagagttcagtgacttccaggagattttgcgctatttggatgaactaactctgtctgatcatatgtgggatgatggaaactcgctgggccccaaa

SEQ ID NO: 6891 - DNA, 400 bp, Zea mays
  Clone ID: LIB3279-035-P1-K1-C7
cccacgcgtccgccaacgcgcacccaacatggccgctccgaccgccgccgtcgacactgccgccccgcctcctcctccctcggcagaggccgcggctgcacctgtactggatcaaaaggtctctcctgctgctgcccctcagcccgatgcgcccgcgcccgcgcccgcgccgaagaagcggaagctcgaggaagcggggttccacacctccgaatactacaagatccgtgccgtcgtcgccgatctgcgtgttcgcttcgtccaggttcacgaagctactgatttccgcaacacggatgctgcacgtgagattatgagagaaataaatgtggtaatggatctatccaagaaaatgaggctcaagcttggtgctacttctgaacctgtgaaaccattggag

SEQ ID NO: 6892 - DNA, 295 bp, Zea mays
  Clone ID: LIB3279-035-P1-K1-C8
cgttgatgaagatgcaataaactgcggttggccattgctggtggatggaactgcaaggtagataatgtggtgacttactgcttctggtgtggttgcatgtgctccatgccacagaggatcacccaaccgaagcttacataagcaatctgacatttgtttttaagtgccgtacataccttgtacatataggttttctcttcaacacaaataggtgggttggtttaatttcctcatcggcaaaaaaaaaaaaaaagggccggccgtcttaaagatccaagcttaccttccccttcat

SEQ ID NO: 6893 - DNA, 390 bp, Zea mays
  Clone ID: LIB3279-035-P1-K1-C9
cccacgcgtccgccgacgagaagttcgtgcgcaagcacaccgcccccggtgtgctctccatggccaacgccgggcccaacaccaacggctcccagttcttcatctgcaccgtcgcgaccccttggctcgacggcaagcacgtcgtcttcggccaggtcgtcgagggcatggacgtcgtcaaggccatcgagaaggtgggcacccgcaacggctccacctccaaggtggtcaaggtcgctgactgcggacagctctcctagatctctctgatctggtctgttcggccgccctccctccggcatcgtcgactccccctgcgtccgttcctttggatctgaataagatggtggtgatctgagtggtggtcttagtttatcatgtatcgctcgc

SEQ ID NO: 6894 - DNA, 117 bp, Zea mays
  Clone ID: LIB3279-035-P1-K1-D1
cccacgcgtccggttttcattgctcttagaaaaccaaggatctattcatgctgatgtaagaactaacaagtcatcgttcattggcatgaatagatccttggttttcattgctcttag

SEQ ID NO: 6895 - DNA, 449 bp, Zea mays
  Clone ID: LIB3279-035-P1-K1-D10
cccacgcgtccggcaagaattaccggtgtgctataccaaagctgaacaaggaaattgttcctgagaaatgtaaggttgtggtgaaaccaaccagggttgttgttactcttttcaagggttctaaaggcaactggttagacttgcacttcaaggaagacaagttcaagccaaacatggacaaggaaaaagatccgatgtcaggaattatggacttaatgaagaacatgtacgaggagggcgacgaggatatgaagcgcacaatagccaaagcttggtctgatgccaggtctgggaagacgactgattcgatgagcggattacgttgagctggtataatcagttgatgggcttaagttttctgcgctagcccctgcagccgaagtgtttctgatggttcaaatagcgttgcagtgccttgttggtgttagtccttgtttatcttacatttg

SEQ ID NO: 6896 - DNA, 401 bp, Zea mays
  Clone ID: LIB3279-035-P1-K1-D11
cacaaccgtctgtacatggaagcgcgccccctggaggagggtcttgctgaggcaattgatgatggccgcattggcccacgtgatgatcctaaggtgcgctcccagatcctctctcaagagtttgggtgggacaaggatcttgccaagaagatttggtgcttcggacctgagaccaccggcccaaacatggttgttgatatgtgcaagggagtgcagtatctcaatgaaatcaaggattctgttgtggctggtttccagtgggcatcgaaggagggtgcactggctgaagagaacatgcgcgggatttgcttcgaggtctgggatgtcggtcttcatgctgatgctatccacaggggttggggccaggtcattccaactgacaggagggtcatgtatgcttc

SEQ ID NO: 6897 - DNA, 404 bp, Zea mays
  Clone ID: LIB3279-035-P1-K1-D12
atttgcttgacttctgaccagtaataattagcgaaagaaagaaaatccagaaccatgaatgagcttgatagcagtaacaaatttgcttgacttctgacgagtaagaaattggcagcaagttcagcaggggccagactaataaatcagcttgatagcatccttgcagcggtgccttggactttggcggttagaagagttgcggctctggataaactcgaagctgacctatccaagttcgacgacgggcccttcttcctaggccaattcagcttggcggatgtagcgtacattacgattctggaaagggttcagatatactattcccatcttaggaactacgacatcgccgaaggcaggcccaacctccaggaattcatcgaggagatgaacaagatttgagcgta

SEQ ID NO: 6898 - DNA, 456 bp, Zea mays
  Clone ID: LIB3279-035-P1-K1-D2
cggcgcgctccagagggagctcatcaggttcctcaacgcaggcgccttcggcaccggcgcggatggccacgtcctgccggccgaggcgacgcgcgcggccatgctcgtccgcatcaacaccctcctccaggggtactccggcatccgcttcgagatcctcgaggcgattgtcaagctgctcaacgccaacgtcacgccgtgcctgccgctccgcggcacggtcaccgcgtccggcgacctcgtgccgctctcctacattgccggcctcgtcaccgggcgtgagaactctgttgcgctcgccccaaacggcagcaaggtcaacgccgccgaggcattcaagattgccggaatccagggtggcttcttcgagctgcagcccaaggagggtcttgcgatggtgaacggcactgccgtgggctctggcctcgcctccactgtgctcttcgagggtaacat

SEQ ID NO: 6899 - DNA, 195 bp, Zea mays
  Clone ID: LIB3279-035-P1-K1-D3
gctgattcaggcgtagtgagagatatacaatagaactcagagcgagtgaagcttctctaagcaattgtatcatctcctttgtggtataccgtattttaagatctcggtatacctgttcttttttatggctgaattggtacctgcaacttggtttttactataacgaaatgaccagttatgagattggtcggccct

SEQ ID NO: 6900 - DNA, 455 bp, Zea mays
  Clone ID: LIB3279-035-P1-K1-D4
cgacccacgcgtcccggtcgcgtgggggaagagctaaatcacaagctagatggtgtcaggactgcaaggagttcgatcaagctaaagatggcgatggatgggttgaacagtcctttcaacctgttctatttggcatgctgcagaagcctgatttacctcatgcatatgtttgcgcagaaagctacatatttgatgtcactgagtggttcaactgtcagggaatgagatgcccggcgaacactcacaaggcaaccttccatgtcaatgccaacatggcaaagcagagcagtggcaaggcgagtacctcaacgcagagggctggtaaggccccaagtggtgtaaacatggatggaggaggactcaacgaggaagagttcttcgagtggttccagaatgcagtcaactctggaatgtttgaaactacattcggggcacaaggcgacccgacttcttct

SEQ ID NO: 6901 - DNA, 435 bp, Zea mays
  Clone ID: LIB3279-035-P1-K1-D5
aatcatgtcgtcgtaaaaaataggatgttaatcaattgttcatatgtaagaaacgacgagatgtcggtcctattaccatcagccaatcaaggagtctgctctggggacccagacacagagctcgaccccgatccggcgaggcggcgacccccctcccccctttccttcgctcgtccagcactgaacactcgcatccccgtcagccatggcagcggcagcaggtggaggcgcggtccatgcgctgtcccgcggtccatgcgctgtcccagaaggagcaggacatatagatgatgctcgccgctgacgtccaccttggcaccaagaactatgatttccagatggagcgctatgcctttaagcgccgcaccgacggtatctgccttcgctctcgcatcaatgccttcccccccccccccccccgcatgccaatccacg

SEQ ID NO: 6902 - DNA, 399 bp, Zea mays
  unsure (1)..(399): unsure at all n locations; Clone ID: LIB3279-035-P1-K1-D6
aaacgcttgcgtcgccgtcgcgggcggccggacccgttgcggcgccaccgtcggcaccgagggcaccggcgcccccgcctccgccgccggcgccggggactggtacaaccaggagctggacctcaccctgcagcagcggatgcgctgggtgcagcgcaagtacatgatctacaactactgcaccgaccccaagcgctaccagcagggcctccccgccgagtgctccatgcagtagcgcccggttattcctcgcccgtacaacaatggcgcgcgcgcgcgtgtgtgtgcatgtggtccgctctactgctaccgctacgacgatcggtgtcgatcaccggatcaaggcaagacgaaaggcatcgaaacatggtagataaataaaggacttgacgatttgnn

SEQ ID NO: 6903 - DNA, 263 bp, Zea mays
  unsure (1)..(263): unsure at all n locations; Clone ID: LIB3279-035-P1-K1-D7
cttcgcatgagtttttccctgattgggtttctcattcaaagtttttaacgagacaacatcaacacaaggtctatgtcgtatcatctatttttcccgtcgaggttttcaaggatgatacattatgacatagctattgttgtatttgaactaggatatgagtttatgtccctagatttcaaattgatcaacagtagagttgtggatctggataaactcgaagctgacctanccaagttcgacaacaggccctttttcctatgcca

SEQ ID NO: 6904 - DNA, 248 bp, Zea mays
  Clone ID: LIB3279-035-P1-K1-D8
ggtgggttggcttctcctccccctccggttcgggttcgggttcgtgaggttctccggggggcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtc

SEQ ID NO: 6905 - DNA, 378 bp, Zea mays
  unsure (1)..(378): unsure at all n locations; Clone ID: LIB3279-035-P1-K1-D9
agccccggcgaaagttctgggatggaacaagaagaaaaaagatggagaaggcgaatatgaaaactggactggtgagagtgaggatgaaaaagagtccacgggaagagttaccagtgtgaagagaccaaagtttgcgacaagatctaaaagctcagaaaaacatattagggaaaactcgaagactggaagtggcagaagtatcgacgaagatgacggcactgaggatgagcaagatgagactttgggaggtttttttgttaacgactaggtttacgagcttgcanaatagctgagcgatnaataggtaggaattttactatgaggaatgtnntnnttgataaccactgttaaaaagaacttttttggtgtttaactttt

SEQ ID NO: 6906 - DNA, 406 bp, Zea mays
  unsure (1)..(406): unsure at all n locations; Clone ID: LIB3279-035-P1-K1-E10
cggctcccgccccaaccgcgccgctgggtcgggctactggaaggccacgggcgcggacaagcccgtggagcacgggggccggacggcggggatcaagaaggcgctcgtgttctaccacggcaagccgccgcgcggggtcaagacggagtggatcatgcacgagtaccgtctcgccgaagccggcggcgcccgcgccaagaagtccggcgccggcacgctcaggctggatgactgggtgctgtgccgcctgtacaacaagaagaacgagtgggagaagatgcagcagcagaaggagaaggagaaggagaagaaggcgatggagtcggaggcgtngttcttgcactcccactccgacacgcggacgccggagtcggagatcgacgacgacccgttcccggagctgggc

SEQ ID NO: 6907 - DNA, 392 bp, Zea mays
  Clone ID: LIB3279-035-P1-K1-E11
tgttcctttgtatggccatgattatagttctgtattggaagctatagaaaagatggagaaaaaccttccagggttcttctacgcaggaaatagcaaggatgggcttgctgttggaagtgttatagcttcaggaagcaaggctgctgaccttgcaatctcatatcttgaatctcacaccaagcataataattcacattgaaagtgtctgacctatcctctagcagttgtcgacaaatttctccagttcatgtacagtagaaaccgatgcgttgcagtttcagaacatcttcacttcttcagatattaacccttcgttgaacatccaccagaaaggtagtcacatgtgtaagtgggaaaatgaggttaaaaactattatggcggccgaaatgtt

SEQ ID NO: 6908 - DNA, 388 bp, Zea mays
  unsure (1)..(388): unsure at all n locations; Clone ID: LIB3279-035-P1-K1-E12
gccaaaaattctgcggcgagctccgatccggtccgactactaaccgacgccgtagaagccgcgcgacctgatcgcgcgggggtcgaggagaggggaagcgcggcgccgcggttgcctgccaccgtaccgccgcaggagaaggaagaggagcccgtatccctccgccccgctgcccgccggaccgatggactccgagcactggatctcgcgcctggccgccgcgaagcgcttctacgcggcgcagctcggccacagcgatcgggccgggatggacgagctggagatggacgaggaggtcaggcccgagttcccctgcccctactgctacgaggaccacgacgtcggatccctctgcgcgcacctggaggaggagcaccncttcgaaccc

SEQ ID NO: 6909 - DNA, 114 bp, Zea mays
  unsure (1)..(114): unsure at all n locations; Clone ID: LIB3279-035-P1-K1-E2
atattattatttatttttttttttttgggtttggggttaattattttgggaanngggataataatatattttttttaaattttttttaattttttaatttttttaattttttgg

SEQ ID NO: 6910 - DNA, 467 bp, Zea mays
  Clone ID: LIB3279-035-P1-K1-E3
tacaccgttgcactgaatcccatcctcttccaggtcctaatcagtcctatgcttgggggaaccaccgaccagaaagttgtggatgagaaccttgagaagctgaagaaggtgctagaggtgtacgaggcacgcctgaccaagtgcaagtaccttgctggagacttcctcagcctcgccgacctgaaccatgtgtctgtcactctctgcctgttcgctacgccctacgcatctgtgctcgacgcctacccgcatgtgaaggcctggtggtctggtctgatggagaggccgtctgtccagaaggtcgctgccctgatgaagccatctgcttgaaacggttgccctgtcaatcggtgaatggaataagccaagtctgttctgggttgtttgcttgttcagggatgtgtcttctatgacgaaaggtgagtgcctatgtgtgagcatgcttgcttgtaacgagacattgaatt

SEQ ID NO: 6911 - DNA, 355 bp, Zea mays
  unsure (1)..(355): unsure at all n locations; Clone ID: LIB3279-035-P1-K1-E5
cccacgcgtccgggcctcgccggcggcacagcgcagcgcagcgcttccactgttgggtgtggtggatgtcctccgcccccgaacgatcgatcttttgcatggcagcagcggctagctccaaggggcgggcgatcgctgggagcttcgtcagccgcgtcctggccggcaaggccgcctccccgaggagggccgtgcacgcctcgtcgtacgacaagaacccggaggagcaggtgcgcccggcgttcgtgccggacgatgtgatcggcggcgcggngagccccgacatgtactggagcccccaccccaagaccggcgtgttcggcccggcggggggggacaccaaccagctgggcgt

SEQ ID NO: 6912 - DNA, 451 bp, Zea mays
  Clone ID: LIB3279-035-P1-K1-E6
gttcctatatgactactagctagaagttagagcctagatgatggctgcttctgttggcgtgcaagctcgagtgctcctaaatggtcgtcgtattagctgatacgacatcgacccgatgcaatagataatattttttacacgcgcgagtccaaaattgttggctttgggtcggagcagttaacgagagaagtgtattttatcacttctgagtgcaaccttttttatttttccgagcttctgcctcttgcatatgttgtagattctcgccgagaagggagtagtagtattacctgatatctatgctaattcaggtggtgtggtcgttagctactttgagtgggttcagaacattcaaggtttcatgtgagctgaggagaaaggaacgatgaactagaaaaggacatgagcagtgcttttcaacacatgaaggccatgtgcaaatctttggtgc

SEQ ID NO: 6913 - DNA, 337 bp, Zea mays
  Clone ID: LIB3279-035-P1-K1-E7
gtatttccgtcacaactcacaacccgagccccccaaacccgaagcagcaggagctcccctgaccttgctccgcctccgatcaaggaaaaggaagatgagctactacggccagcagccccccgtcggcgtcccgccgcagcaaggctacccggggaaggacggctacccgccagcggggtacccgccggccggctaccccccgccggcgcagggctacccgccgcagggctacccgcagcagggttacccacagcagggctacccgccgcagtacgcgcagccgcctccacagcagcagcagagcagcgggccttccttcatggaaggatgcttggct

SEQ ID NO: 6914 - DNA, 431 bp, Zea mays
  Clone ID: LIB3279-035-P1-K1-E8
attccagaaaactctcaaaatactcttgtcccatattctgcctataactctcctgttcatactaagtcagacgattcattcgtcactattctcaccaacagtgaacttcactgtgctacaccacatacacccagctataaatacacccagctaccctctccctctccacacacactcaacaccctcagccaaggcaaacaccccacccacttagttactctgctctgccggctacacacatagtgtcgcttcgcctccagtccaccctcctgttatcggagcgttcgtgccgtctcgtggaggccagatctgcaagtctacgctaggcggtggagccagaagccagttccgcgagctccccttcccccttcaccgaataagcacgaaaaaggagatcgggtaagagttacgactgttcccaaccttgcctg

SEQ ID NO: 6915 - DNA, 398 bp, Zea mays
  Clone ID: LIB3279-035-P1-K1-E9
gtgacgtggtaccccgagtcgttcaccaaggtcccgatgaccgacatgcgcatgcggccggacccgtcgaccggctaccccggccggacgtaccggttctacaccggcgacacggtgtacgcgttcggcgacggcctgagctacaccagcttcgcgcaccacctggtgtcggcgcccaagcagttggccctgcagctcgcggagggccacgcgtgcctgaccgagcagtgcccgtccgtggaggccgagggcgcgcactgcgagggcctggcgttcgacgtgcaccttcgggtgcggaacgcgggcgagaggtccggcgggcacacggtgttcctgttctcgtcgccgccggcggtgcacaacgcgccggcgaagcacctgctgggcttcgagaaggt

SEQ ID NO: 6916 - DNA, 464 bp, Zea mays
  unsure (1)..(464): unsure at all n locations; Clone ID: LIB3279-035-P1-K1-F1
cgcctccctcccttccctgtgcgcctcttttcatgcgcgaggagggaccgtggggaccacgaccaccagcaccaccacctccatccgtgcgcctctcgctctcgctggtggtgctcctcctcctcctcctgctcccggggcgggcggcctccttttccacctcctgctggtgccagggccgggagggcgtcgcggaggtggcgcgcatggngctcgccggngacgggtcggcggacaccgcccacctcagtaataatgaaaatgggcggttcatttatggagttgcgagttctcctggtaaaagagcatcgatggaggacttctatgaggcaagaatagacgacgttgatggagagaaaattggaatgttcggtgtatatgatggtcatggaggagtccgagcagctgagtatgttaagcagcaccttntcagcaatttaatcaaacacccaaagttcatcact

SEQ ID NO: 6917 - DNA, 346 bp, Zea mays
  Clone ID: LIB3279-035-P1-K1-F10
cggacgcgtgggtaaaattcgagatgttgaatgctaaaaaacaattagtgacaatattgtttagatataaatttgagatgtcggaggaagctgcagaaaaaggtaggaaattccaaagaaaactaaaaagaacgtagagagtttttgaaaaagattatagaagtaggaaaaagatggggaagctttgcatgaaagtgatgggttttgttgctcgtccttctacgaccattgttgagcaaattcgtgatgttattagtattcatatttactttctacttaattttaaattgttggtatgctcgtaggttaactttatctctggggctaagcttcaattcgacattcg

SEQ ID NO: 6918 - DNA, 360 bp, Zea mays
  Clone ID: LIB3279-035-P1-K1-F11
gccaaaacctacctagccgccgccgcaggcggccccccatcgccgccaagatgcagatctgtgtgaagactctgacggggaagaccatcactttggaggtggagtcctccgacaccattgacaatgtgaaggccaagatccaggacaaggagggcatccccccggaccagcagcggctcatcttcgccggcaagcagctcgaggacggtcgcaccctcgccgactacaacattcagaaggagtccaccctccacctggtgctccgcctccgcggtggcgccaagaagcgtaagaagaagacgtacaccaagcccaagaagatcaagcacaagcacaagaaggtgaagctctccgtgctgc

SEQ ID NO: 6919 - DNA, 221 bp, Zea mays
  Clone ID: LIB3279-035-P1-K1-F12
cccacgcgtccgggcgtgctcgtgatctcaacccaaggcgtgcctccgctccggtcacccgtcactccacgcaaccatgtcgaggaggaagaccagggagcccaaggaggagaacgtcacccttggacccactgtccgtgaaggagagtatgtctttggtgtcgctcacatctttgcatccttcaatgacaccttcattcatatcactgatttgtctggga

SEQ ID NO: 6920 - DNA, 434 bp, Zea mays
  unsure (1)..(434): unsure at all n locations; Clone ID: LIB3279-035-P1-K1-F2
gacaaagggcgtccattggagtccagctcaggctgacccgggcgccgtacaggcgcacagggccctgcgctgcgctgcgcctccctccaccgcacacgtnggacgcgcggcgccggagccggcggttcggcttcccctttcagccacattcctcccgccccccacgtcgcgctcgccgacatcaagatccgcgcgcacaagggtccgcgtccgcccggccggccgtacgtgcgtgcgtgcagtccggcgattcgtcttcgcgctgcgggtggtccgtggtcgcggggccggcgctgcgctcggctccaaggccagctagcaaggacgacgacgcgtcggaaacagggaccaaacaatctccggcggcattgacggtttgcccgccatctgtcttgcagcactgtagctagtatttcaattcaatgggtaccatg

SEQ ID NO: 6921 - DNA, 465 bp, Zea mays
  unsure (1)..(465): unsure at all n locations; Clone ID: LIB3279-035-P1-K1-F3
tacgccttcgttcgcgccgccgccgccgccgccgttacgccccgcacctggtttcatttcgtgtcgccaagatgacgaagcgcactaagaaggcaggaattgttggcaaatatggaaccaggtatggtgctagcttgcgtaagcaaatcaagaagatggaggtatctcagcattccaagtacttttgcgagttctgtgggaagtttgctgtgaagaggaaagcagttggaatttgggggtgcaaggactgtgggaaggtgaaggctggtggtgcttacaccatgaacactgctagtgcggtcaccgtcaggagcacgatccgccgcctgagggagcagactgaagcatgatatagctctttatattattggggtttcctgtagttgctcttgtcaggcatgttgtgggggccttatctagtggaaatgtggnatcactgtactggctggtttgccgaaacaatgc

SEQ ID NO: 6922 - DNA, 431 bp, Zea mays
  Clone ID: LIB3279-035-P1-K1-F4
cggacgcgtgggcaaagttccatcccattgctcgctctgtccctccgttcacaacctcctgcacgaccgaacgagcagagcagacccttccccctcaccagctccgggttccagcggcggcggcggcgaagatgatcataccggtgcgctgcttcacctgcggcaaggtgattgggaacaagtgggacctctacctcgacctcctccaggccgactactcggaaggggatgctctggatgctttggaattgttccgctactgctgcaggcgaatgctcatgacccatgttgacctcattgagaagttgctcaactacaacacactggagaagactgagacaagttaagtgagcaagcatatcatgctctgaaagcactactgtttcgcagtatcatatatattggaggcggtatgttgtttcttctctatc

SEQ ID NO: 6923 - DNA, 240 bp, Zea mays
  unsure (1)..(240): unsure at all n locations; Clone ID: LIB3279-035-P1-K1-F5
cccacgcgtccgcccacgcgtncgcggccccgtggttgaggagcgaaatccgcggaatctgggtgaggaagaaccatagcacgtccgacgctaactagctgctgggtgaaaggattgaatcggctgacgtggtcgtttagtgcctatcgagtcaactttagtcatgactcgctaattgatcacgtgatgcggacgacaagagccgagttgatcccaaaatgatgctggtgaacgaacctg

SEQ ID NO: 6924 - DNA, 260 bp, Zea mays
  unsure (1)..(260): unsure at all n locations; Clone ID: LIB3279-035-P1-K1-F6
tgttctgctgcccaagaagacggcggagaaggcgtccagtggcgggagcaaggaggcaaagtcgcccaagaaggccgccaagtcccctaagaaggcatagactgactgtccggagtgatctgatgtttagcagtaccttgttaccagtatgcggtgatgcgtangctgcagatgggacgaatgtgcttgtatgtgtatgtgtcctgctgcaagttgtcctttgctatttagaatggaagaagaaatgccttgtttctctg

SEQ ID NO: 6925 - DNA, 461 bp, Zea mays
  Clone ID: LIB3279-035-P1-K1-F7
ctaacaacggagaccatggtcccatcccactaccgcagcgctctatcgaaggctgggcagggcttgtttctggagttaaagacgatgctgaagaagatgatctttacaatgctttcagtgattttggtcatgtcaaggacttgcatctcaatctagaacgccgcactggatatgccaagggatacgcgctgattgaatacgaaaactttgaggaagcacaagcagcgatcagagcaatgaacgggagtcagctgttcacaaaaactatcaatgttgactgggcattcagcagaggtcctatacagaatttcaagagtgcaaggccatcacgcccaagatctaggactcctccgcgcaggcttgctgccttgacgccatattgactaccgcgggggagcggtggctaggctgtgtcagttctaaaactgatcgtgttttggctgtgagcagccgctagatac

SEQ ID NO: 6926 - DNA, 448 bp, Zea mays
  Clone ID: LIB3279-035-P1-K1-F9
atttccgtctctcctcttggtgcaactccaccgcaaggtcccattgcattgacacgaccaagtatgcccaccatgtaccgcggccagcatccaccagtaccaaatttcactggttcagcgccattggtttccaggcctcctggtggtggggctcagtcttttcctacagctgcgcctcaaggcccttcctcagtagcatttcccggtggaccatcgctgcggccaccttaccctccggcgcctgatcaagcgagggggccacctccagctttctctccagttggatcaactcctggcatggtgcctccacctattgcatcttccggcctgcctgccccgcgtcctgcgaacacagctgcattcagacacatgtagtagcccctttgagacctccgctcccagccgcgggcgattttactttccggcctgccataccaccggcgcatgc

SEQ ID NO: 6927 - DNA, 433 bp, Zea mays
  Clone ID: LIB3279-035-P1-K1-G1
tccgaatcctttaacctacgaagaaccaagagcctcaccccagctggaggccgccgccattgacttccccgtacaccgccgtagaaacctattggccgtggtctgggcttccccagagacatcgtgtgactacccgtgggaattctagggctggattgccgatccagccgcggcaatttcttgtcggagcaccgtctccgcacctcttcgtgtattgcgccatcatcatcacggactcgggtgaagagtaggtagcccaggaggaggtccacaacgaggagtacgagcttatctaggtggcgtctcgtagtcagcttatggtgccaaggaataattattagttcactttactgttatcacttatttttgtaagactcttccgctatgtaataataatatttgtgacatttatctctatacacttggtcattat

SEQ ID NO: 6928 - DNA, 459 bp, Zea mays
  Clone ID: LIB3279-035-P1-K1-G10
cgattctccgcgtgacttggggcgtcgtcgccgagctttctccggccgagggcggcgcgaccggacaaccagcgtgagcgcgaccggcgacatgactcgcggcaaccagcgtgaccgcgaccgtgagcgcgcggcggcgcggaagcccaacgccaagaactcccaggacgggctcaccccggagcagcgccgcgagagggacaagaaagctctggaggagaaggcggccaagaaggcgcagcaggcagcggccggcggcaccgggacctccacggacaacaacaagaacaaggcaggtggcaagaagtaggaggcagtggcgcgccgccacctctgtacgattaatcgatgccttgagcttgtaacttgttcgcatccttgtaggtgcgatgcttgttgggtcataaactctgatgatatcgagaattggtgatgagaataatgcgtggtttctggctt

SEQ ID NO: 6929 - DNA, 325 bp, Zea mays
  Clone ID: LIB3279-035-P1-K1-G11
gttggcttctcctccccctccggttcgggttcgggttcgtgaggttctccggggttcgggtgcgtgggtgagcggatcgagatggcggcgtctgatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtca

SEQ ID NO: 6930 - DNA, 405 bp, Zea mays
  Clone ID: LIB3279-035-P1-K1-G2
cgtgaacccgccgccgacgcagcagcaggagacgcgccaaggagagcccgcaaggaggcgactatgagggccaagtggaagaagaagcgcatgaggaggctgaagaggaagcgccgaaagatgaggcagagatccaagtaggctgatggggattgtggatggtggtgtcggcatagttgtgttacgtttcttcgatgcgtgagttcatggagagatgtcacatcctagttcgtcgtcaccgtttgccatgggtccaatggctcgtcttggaaacctgcacttcagtaggccatctatcgtggtttctagctatatccagagttttgtgctaagacaaatcagtcagtcgttttgtgaacctattatgatggagctttatttgctgctaatatcgacctacctatt

SEQ ID NO: 6931 - DNA, 430 bp, Zea mays
  unsure (1)..(430): unsure at all n locations; Clone ID: LIB3279-035-P1-K1-G3
gcaggcttttcggtacctatacagaacttgatggttgaggcaagcaggctctatgagcagagggagcaaaaacttcagagtttgcaatttgagaaacaacattggtctgacatgctgcaagagaaggaagccattatccaatccctaaactcagctcggtttgagcaacagaacaagtatcaagtggagcttagacgcttcgagcatgatctgaatgttatggcccatttggtaactacctacaaaagagctttaaaacagacccgggcttcttttgatgagtacaggaagaagttcccttgcaatgttcctctttatgatgatgttgctggtggtggtggtcttgttcttagtgtgagggagtttgagaagaggctgtgtgaggaggagcancaaaaaattgccatggtaaatgatatgatcgaaagat

SEQ ID NO: 6932 - DNA, 346 bp, Zea mays
  Clone ID: LIB3279-035-P1-K1-G4
ctctctcgcatccgcagcctctcgagctctactccatcccctcgatctcgaagcgcagcagcagcagtcaggcggccatggacgccagcgcagcaggagccggcgggaaggcgaagaagggcgcggccgggcgcaaggccggcgggccgaggaagaagtcggtgacgaggtccgtcaaggccgggctgcagttccccgtcggccgcatcgggcggtatctgaagaagggccggtacgcgcagcgcgtcggcacgggcgcccccgtctacctggccgccgtcctcgagtccctggccgccgaggtgctggagctggccggcaacgctgccaaggacatacaagaaga

SEQ ID NO: 6933 - DNA, 427 bp, Zea mays
  Clone ID: LIB3279-035-P1-K1-G5
tccagatatcggccgccaccttcacctccaccgccccggcgcacctgtgcgtctccatcggcgccgggtctcctccttcggacacgactgaccttccactggcgccaacgaagaaaacacataggaagaagctcaccgccaaacctcatccagatccagtcgctgccctccgaaggccgcatacggaacgtctcgtctcttcctttggatccggcggtcaactccatcacccccagcttcacctcccttagtccccctccgtccgctctcacccaccgcttctatatcgccacctctctcgttgtagaagaagacactgaggatctggctttctggaatcacatctcttgagaactatctgttggagaactaaactaggctcttgttcatattatggatcaacaagctaagattgatgctgattttc

SEQ ID NO: 6934 - DNA, 457 bp, Zea mays
  unsure (1)..(457): unsure at all n locations; Clone ID: LIB3279-035-P1-K1-G6
tgtctacttatcttcgctacatctggatgctgcttcttatcttcgctacacaagcatgtctccaacgtccgcagtgctgtcttgaaaaaaaggggtctgtactttctctcaccccgacggcgcttcctacttcctagggcgaccgcggcggcgccacatgcttcgccagcgtcggtcttcccgtcgtcatttctacttcttctgccggcgtcggtctacagataagacgggtcgcagaacttgcgctaccgtgccctctcctcttacgtaggggcctctaagctcgcagcggctaacactaaagagcgctctatacgctgcagctntaggagagggcacgcacgttcccccagatcaaggggaacactgtagcggctccttgcacagtgctttcatatttaatagttaataaaaatagggataaaagataaatagtgttagataatgatattttata

SEQ ID NO: 6935 - DNA, 449 bp, Zea mays
  unsure (1)..(449): unsure at all n locations; Clone ID: LIB3279-035-P1-K1-G7
ctttttgaatgtttctaagagggcggacttacgctggaatagacaatttgaaaatttggaggagttgatgtgtttacaagacgagcttcttgattcggcatcaatgttggtaaagccaggtggtatactaatttacagtacgtgttcgattgaccctgaagaaaatgaagagaggattactgcttttgttcagaggcatccggaatttgctcttcagagtgtatgtggatatgttcctagagaatttatcacagatgaaggtttctattcctcaaatccaactaagcactctatggatggggcatttgctgcacgtcttgtccggtcaacgcactaagattataggagttgccacanggccacaactaggtgtgaagttgaacaaggaatcacatgtattgccctaagtgcacccagtcattgcttcaatatctttatcttatatattc

SEQ ID NO: 6936 - DNA, 452 bp, Zea mays
  unsure (1)..(452): unsure at all n locations; Clone ID: LIB3279-035-P1-K1-G8
cccgctttgtgctattcccgcagccagaaaaccctaacttcccggccgccgcttggcttgggctcgatccacagctcgcgccgttcctgcaagtgcgcacccatcgtcccgcctacgcactgccgtccaacgatctacgagctgccatggctaactcagcggcaccgggaggaatgaggtcgttcctgcaggccgtgtctacggtcaccgaggaggcgccgacgccactccgcgtcgtccagatggagggcctggctgtactgaagatcatcaagcactgtgaggagttcgcgccagctttagttacaggtcaattgcttggtttggatgatggtagtgttctggaagtgaccaactgttttccgttccctatcagggaagaggatgatgaancatatgcagatggtgccaattatcagcttgagatgatgaggtgtgtgagggaagttaat

SEQ ID NO: 6937 - DNA, 414 bp, Zea mays
  Clone ID: LIB3279-035-P1-K1-G9
cgctggtgctgctgctggaatagctggcacattggcatgccatcctctcgaagttatcaaggatcgcttgactatcaatcgagaggtttatccaagcattagccttgccttcagcaagatctatcagactgatggtttaggtggtctctatgctggcctctgtccaacactaattggcatgcttccttacagcacatgctactattttatgtatgattcggtcaagacctcttactgccgcttccataaaaagtcatctttgagtcgccctgagcttctacttattggggctctttcaggtctcactgcaagcacgatcagtttcccgctggaagtagcaaggaagcgactgatggtcggcgctctgcaagggaagtgcccgccgaacatgattgctgctttgtcagaagtgat

SEQ ID NO: 6938 - DNA, 357 bp, Zea mays
  Clone ID: LIB3279-035-P1-K1-H10
cttccttatcgtctcctcctttcctcccctcaactccaatcgaatcgctcgaaccattcccaggtttgtgcgtcgatctaggcttgcgcgaggatccaattgcatcccgctcccctttgagcttgtgatcttcggagccggagttcttcgcgagcctcccccaacccccacccccaccccccgatttcttttggtttatttgtgcgagttttctcaagagcagaaaaggctgtttgcaattccggtgcactcaggcctcaagatccaactctgaggcctttcccgcgctatccgcgtcgatctacgcaagaggatgggcaacgcgggtagcaacggtggaggcgctgccgctggtca

SEQ ID NO: 6939 - DNA, 307 bp, Zea mays
  unsure (1)..(307): unsure at all n locations; Clone ID: LIB3279-035-P1-K1-H11
tttacttatcgtcatcctccttncctaccatcaactatcaatatgtatcgctcgagccattccggggtttgtgcgtcgatctaggcttgcgcgaggatccaattgcatcccgctcccctttgagcttgtgatcttcggagccggagttcttcgcgagcctacgaaaacccccaccctgtcctaccgatttcttttggtttatttgtgcgagttttctcaagagcagaaaaggctgattgcnattccggtgcactcaggcctcatgatccaactctgtgtgctttcccgcgctattccgttcgatcta

SEQ ID NO: 6940 - DNA, 447 bp, Zea mays
  Clone ID: LIB3279-035-P1-K1-H12
gcgaaaaccctctcctctatcatccgccttcctggcgattgcggcgacgaggtgacgatagagctgcccccgcaaggaaaacggacaagagaggcggaggctgatagggagaggagacggaggaccaagagcggcgtcgatctaaaagcgttggcggcggccatggccaccgcggaccggacccggactttcatgaaggacgtcaaacgcgtcatcatcaaggtgggcactgcagtcgtcacgaggggtgatgatgggcgactggctgtgggccggttggggtgtctttgtgagcaggtaaaagagctgaatgtcttaggatacgaggtgatccttgtgacctcaagtgcttgtggtgtggggaagcaaaggctcaagtacaggaagcttgtcaatagcagctttgctgatctgcaaaagccacaaatggagcttgatggaaaggct

SEQ ID NO: 6941 - DNA, 452 bp, Zea mays
  Clone ID: LIB3279-035-P1-K1-H2
cccacgcgtccggataaatcttaaatctgtctctgtcctcgtataattatacttactatcttgtgatgttccggcagcagagtcggttggacattgtttcgggctacagaagagttcaagagtaattttgctactaacacatagacaaatagcatagcctattgatcttgtcttttcgaacagattcaaagacgttgaaggaagaacaaagagaggagttatttgaaagtttaaaggccaatagctctattgggtgggaagtggatgtcatatgcccaaaggatctatctgctaaaatgttaaaaaggtcgaaagttaatctgaatgaaatatcacataactctgccatgggtcttgttagaaaagttcttgacatgggagttctactggcagaagtatatgtagatacagtgggagatcctgaaaaatacagaaccaagctgacagaaaag

SEQ ID NO: 6942 - DNA, 457 bp, Zea mays
  Clone ID: LIB3279-035-P1-K1-H3
atcattttgttataatatattgttcatagctacagaaactaattagtgtgaaagcacttttgagatacgagtctagtcgtataattttcatacattaagcattacctataagttgactaattttttgttagaatatccaaagttttttttcccaaaaaatgccacaccctatacaactggatgggagtagacatctctgtgaattaaaatttgtgtagtctgtcaacaacttcattaccatgtagggttttttgggtgctagagttctgtgttagcttattttgtatttgaccgaaatataggtacaagaggaaaaacaagaaacagctacataagatactctatgactgtaatgagcagttgaagcagtttagtcatgtgaaccaaaaggctcttgaccaatatgtgaacttcacagaacaacgcgaacaactgcagagaaggcgagctgaacttg

SEQ ID NO: 6943 - DNA, 206 bp, Zea mays
  Clone ID: LIB3279-035-P1-K1-H5
caggggcctgggccgacacatgtacaataaattactttcattgtattctcaatagacatgccagatcaaggcatgacgatgagagaacgactatgctatagggtcactacaaactaagactacgataaggagcgcggagcgtcacactaataatatcaaatcaggtgagctcttcagatgaaggaactataccttgcttgatccat

SEQ ID NO: 6944 - DNA, 323 bp, Zea mays
  unsure (1)..(323): unsure at all n locations; Clone ID: LIB3279-035-P1-K1-H6
ggagggccaagcgccggcgcctgtcgtctgaggaggcggtggcttcgccggcggagccgggcgcggcgacggggactagccccggctggctcttcggcttcttctccggagcgaagagggtcatttcttccgtgtctctgttctcttcgcccgaggagaccggctccggggaggacggtgaggtggaagaagaggaggactacgaatacgaagagggcatcgacttgtatgaaaatgaagatattcatgattttcacggggaaatngtttcttatagcgagtcaaaacttgctattgagcaaatggttatgaaggaaacattc

SEQ ID NO: 6945 - DNA, 360 bp, Zea mays
  Clone ID: LIB3279-035-P1-K1-H7
cggacgcgtggggcgtgaacgcgccggcgccgcggatcctgccgtcacgaatggaggcgtggccggacgatttccgctgccccatcacgctggaggtcatgacggacccggtcatcctcccctccggccacaccttcgagcgccgcagcatccagagctggctcgacggggggcacctcacctgccccgtcaccaacctcccgctgccgccctccccgccgctcatccccaaccacgcgctgcgccgtctcatagccgccgtctcgccttccgcggcggcgtctctcgtccctgcggagggaggggcgcacgcgaggcaagaagcggtgtctgctgcggcggcggcggctgtgccagccc

SEQ ID NO: 6946 - DNA, 312 bp, Zea mays
  Clone ID: LIB3279-035-P1-K1-H8
ggggagtactatgcatgatgttctggctccattaatctatgccgttattcagagttttgagaatctctggactggattcagatcaactgacagacagacaacactactgttgataggacattattggcaattatcagatcagatgactggattgaacctgtgctatgttttaactactgcttttgtaagggaacatagaatgtgggatgctttcgtctgtgcaaaagatccaccgtcaaaaaggtatgtttgcatgcgataggtgttggatgctgtatgaataacgagcgttcagatttaggaatctttccg

SEQ ID NO: 6947 - DNA, 431 bp, Zea mays
  Clone ID: LIB3279-035-P1-K1-H9
gcaagcagcaaggatgaggctgatagcaccgacaactcaaaggatgctgctgccagtgaaggcaaggattcaaaagatgaagtgaaatccagtgaagctatcgatggatccaagacaaatgacctttcaaccaaaaggaagccagatgagaatgaaggtgagtcatcagaggaggagaaggcgtctactaaaactactaccagaaagaagcgcagaagaaagagccgcaactagttgcccagaagctatgcagctcatcatctaagtggcgttccgcccttgcagtctcaagtctcaaagatgttggcatgaggcatgccatgtactgtacgctttatattcactggtccggttaccagcttagcgctttggtagttggccattatgagtcagctcgtagttatagcagtcttaaactctcaataggagct

SEQ ID NO: 6948 - DNA, 418 bp, Zea mays
  Clone ID: LIB3279-037-P1-K1-A10
cggacgcgtggggtttggatgagctttctcaagttgcctacattacttttaaagacaaacaaggagcggagacggcaatgcttctcacgggggccaccatagttgatatggctgtaatcgtcacaccagcaaatgattatgagctaccatcttctgttttagttgctcttgagcccaaagacacaaaaccttctgcccttcaaaaggccgaggacattgttgggaccatgctggcaaagggatttatcctcggtagggatgcactggacaaagcgaaagctttggatgagaagcatcagctaacgtcgactgccacagctagagtatcttccttcgacaagagaatcggtctaagtgagaagatcagtgttggcacttcagttgtaaacgataaagtgaaggaaatggatcagaaata

SEQ ID NO: 6949 - DNA, 449 bp, Zea mays
  Clone ID: LIB3279-037-P1-K1-A11
tgtcgccaggaactgggaaacatcaggtgcctagctctcgagaaggtggcagagcaactccagcttccgtgcaagtaccagagcacgggatgcaccgagatccacccatacaagagcaaactgaagcacgaggagctctgcaggttcagaccgtacagctgcccgtacgcaggttcggagtgcctgatcgcaggcgacgtcccgttcctggtgtcccatctcatcaacgaccataaggtggacttgcacgagggctgcacgttcaaccaccggtacgtgaagcccaacccgtacgaggtggagaatgccacgtggatgctcactgttttcaagtgtttcgggcagcacttctgcctgcacttcgaggcgttcgtgctggggatggcgccggtgtacatggcgttcctgcggttcatgggcgaagagagcgaggccgcagggttcgggta

SEQ ID NO: 6950 - DNA, 401 bp, Zea mays
  Clone ID: LIB3279-037-P1-K1-A12
ctagtcctctgttacttctccctccgccgccactcccctcccattcaccgccaccgccaattccataccgtgctccgccacctctgctgagagcgagaagagatggcaggcaagggtgatgggccggcaatcggcatcgatctcggcacgacgtactcttgcgtcggcgtctggcagcaccgtgtcgagatcatcgccaacgaccagggtaaccgcaccacaccctcgtacgtcgccttcaccgactccgagcgcctcatcggagatgcggccaagaaccaggtcgccatgaaccccatcaacaccgtctttgatgccaagcgtctcattggcaggaggtttagtgactcctctgtccagagtgatattaagctgtggcccttcaaggtcattcctgggcc

SEQ ID NO: 6951 - DNA, 378 bp, Zea mays
  unsure (1)..(378): unsure at all n locations; Clone ID: LIB3279-037-P1-K1-A2
acgcccacgcgtccgcccacgcgtccgcccacgcgttcgctcatgacgagttgtgagaaccagacagaatccataggaacaggtcgggacgacgcattacgcatgtactacaagaaggcagtttgaggataaattttggttgctcaattttttccaaaattttatttgacgaccgaaagacgaggctatgtaggtgttgaggaacactagatgctgtagggccaaaaatattttatcggtagtttctgattgctgtatagcagcctcatcgttgtgtaagttactcgcctcgaaggcgtagttcaggatctagaatcgctttgttatactgaactcatttcattttttaatgaagaatgctatataggatnttacgtc

SEQ ID NO: 6952 - DNA, 461 bp, Zea mays
  unsure (1)..(461): unsure at all n locations; Clone ID: LIB3279-037-P1-K1-A3
cccacgcgtccgagctgcctttgaccaaggctaagcgataccttgaggatgttattgctcacaagcaggcaattcccttccggagatactgtggaggtgttggtcgcaccgcacaagcaaagtctcgccactccaatgggcagggtcgctggcctgttaagtcagccaggttcatattggatttgctgaagaatgctgagagtaacgctgatgtgaaaggcttggacgtggacaacctctatgtttcacacatncaggtgaaccaagcccagaagcagaggcgccgcacctaccgtgctcacggacgcattaacccttacatgtcctccccttgccacattgagctgattctgtcagagaaggaagagcctgtgaagaaagaggctgacaacattgtcgcggcaaggaagcagtgaaatatgttagcctgctgataatggcatcctttcgaagcattatag

SEQ ID NO: 6953 - DNA, 440 bp, Zea mays
  unsure (1)..(440): unsure at all n locations; Clone ID: LIB3279-037-P1-K1-A4
gtttgctgagaagatcattgtcctgctactgacagttgatgcccttgagggaccggactacatggtccgcaacgcaaggaggtccatgctggaggagctggaggggatgctggagatcgtggagcctcagccgccggggaagccgaggacgcttagccgcaggaggttcgatctcccagaaggcggagccatcgaaaaggagacgcgggaggcgggcaagtgaagtgcatcggtgggtggtggcatgcttgggcagtttggtatatgcgcgatgcggactatagagtttgagtttgtgctgctaccgaaccgtggaccaccttaccccgttgagatgtttgatagctggactttttgtgctgttgtatttgtagaccaaaacgttgttctttgtaataaaatnggcgtgtgctgctttttgctaatattcgcttggcttt

SEQ ID NO: 6954 - DNA, 463 bp, Zea mays
  Clone ID: LIB3279-037-P1-K1-A5
cccacgcgtccggccccttccttctcccatttcggcgtctcgaagccagtagattattcatttctcgatccacaaatccctccacactctccatcccgaaccctgaaatcgaggagcgcaggaggacgccgcaaagcgcgttggctcttagggtttgccggtagggttgggaggctccgatccgggcgcgcaggcatgaggattcgggagctccgagatgggctggaggtggaggacgacgagcgggaggagcagggatcggaggttggcagtggttacggggaggttgtcgcggttgtgcgactgcgggcgaagcgcgctatcgttggtgccggcgcgagggtcctgttctatccgacgcttctctacaacgtgctccgcaaccggttcgatggcgagttcccgtggtgggatcgcatcgacaggtatgttttgctaggtgctgttccgttctctagcgatg

SEQ ID NO: 6955 - DNA, 383 bp, Zea mays
  Clone ID: LIB3279-037-P1-K1-A6
gttacgagcactcgccgccactcaccagcaaattcccgagccgccccttccccatctctttcgcgacccatttgatcgattcctgatggcgcccaaggccgagaagaagcccgcggagaagaagccggcggaggagaaggccgagaagaagccaagggcggagaagcgcgtgccgagcaaggagggcggcgagaagaagggaaagaagaaggcgaagaagagcgtcgagacgtacaagatctacatcttcaaggtgctcaagcaggtgcacccggacattggcatctcgtccaaggccatgtccatcatgaactccttcatcaacgacatcttcgagaagctcgccgccgaggccgccaagctcgcccgctacaacaagaagc

SEQ ID NO: 6956 - DNA, 446 bp, Zea mays
  unsure (1)..(446): unsure at all n locations; Clone ID: LIB3279-037-P1-K1-A7
acgccaccggtcggacctcgacctctgctactccatgagccagcgcttcctggacgagcaccaccaccagcagctgggcaaggcggaggaggcgccgccgctcgctccggcctcgccggcgcagccggccgccaccaccaactggaagatctccagccctggtaattacttgcccttggttcgcgatgggacatgtcaaatctgttcgacatataatagatctaatgtatatgcccaatatgtgacgctgcaggcgacagcccggacgaggtgaaggcgaggctcaagtactgggcgcaggcggtggcgtgcaccgtcaggctctgcagctagctgatcaacggcgtggcagtggcggtggcggtggcggtggcnccaccatcaatcaatcttggcacaagagatgagagttgagacgagcacgcaagaagggaaatccattccgt

SEQ ID NO: 6957 - DNA, 458 bp, Zea mays
  Clone ID: LIB3279-037-P1-K1-A8
cggacgcgtgggcttgaggtcccatggactgcctaaggaaccaaatgcagatagtgcaacgctgaaccaccaacacggatagaactttcttagatcttataatatttggcaggaagacttcaaccacaatgaaacattcgctactggtacaaaactcagaagtacaagatcacagacaaaacagcttcctccgaactccaaaactaagagctttggatgggagaagtatattggacagaaaggcaaagctattggtatcgaccgttttggtgcaagtgctcctgcggggaaaatatgcaaggaacttggtttgacagtggaacacgtcattgcagcagccgaggccctgtaaatggtcgtcacattactgaaacacatagtttgataggtatatggtgccactgggttgaaggcttgaagcactatttatggtcatatgtaagtatctgaacttctaa

SEQ ID NO: 6958 - DNA, 348 bp, Zea mays
  Clone ID: LIB3279-037-P1-K1-A9
cccacgcgtccgcccacgcgtccgtgaatctctgattgaacgagagttcttggaaagagacaaagtagatagaaaattatatcgttatcttgcatagaaaactgtcatgagataattcattagcagttggcatccttctgctcttgtaaaacggttttctttatgctcgagttctcttttatcagttgcattggccgctgggttcatagatgttcaaacattggttattggttgaccgcgaactgaagtggtgattgtattgaagtggttcatagatgttcaacacttactctttttgtttgatgggtctgcaactgcaagaactaagaagccatattatctgtttcc

SEQ ID NO: 6959 - DNA, 211 bp, Zea mays
  Clone ID: LIB3279-037-P1-K1-B1
cacgcaggaacctgtgtgtacgcatagacgaggaagggagccggcacccggcgcacctggccatgacctgcctgtaccagggcgggcagacggacatcgcggatcgaaagctgtcacacgcgcacgcacaggcagcggggaggcggcccatggcgcccgtgcgcatgcgctatattcagacgcggcgcacctaaagcgcgccggcggagcc

SEQ ID NO: 6960 - DNA, 380 bp, Zea mays
  Clone ID: LIB3279-037-P1-K1-B11
gcggtagccggtaggcgagagagtcaggattcaggacgcggcgaggccaccatgagcactgtcaagttctgccgggaatgcaacaacatgctgtacccgcgggaggacaaggagacgcgcaccctcctgtacgcgtgccaaacgtgcgagcatgaggagattgccactgatacttgtgtgtacaaaagggttatccgcaagcctggtggtgagcccaaggatgtcctgaaggatgcagcaactgatcctagcctgcctcgcaccagaagcgtcagatgttacaactgcaaccatccagaagctgccttttttcaagccccgactaaaggagaacaagccatgacgctgtacttcatctgctgcaacccaagctgcgggca

SEQ ID NO: 6961 - DNA, 380 bp, Zea mays
  Clone ID: LIB3279-037-P1-K1-B12
cggacgcgtggggccggtcggacttcttgcgctccaagaactcggcgaggatggaaatgttttttggcagctttctcagtgaatcagtatcaccgcagaaccttttcggacacccggatgttgagagatgcccattcctgaggaatatcaatggagctacaaccttttccctcgcttctgctttgccagtagctgctcaaggaggcaagggtccaatttttgaggaagggtcaggctttgagtcagcattcaagcttttccatggccgagatggaatagttcccctttcagaaagatcatatgtatctgatgaaaaccacaatgagagcattgatgtcaggactgaacctgctctgccgttaatccattggctgctagag

SEQ ID NO: 6962 - DNA, 336 bp, Zea mays
  unsure (1)..(336): unsure at all n locations; Clone ID: LIB3279-037-P1-K1-B2
cccccactcagaaaacccagccgccgccgaatcggcctcccaggtaagcagtagcgtccaccccagccgccgccatgaagcgcaacccccgcgtcacgagctcccgccggaagtgccgcaaggcgcacttcacggccccgtcctccgtccgccgcgtgctcatgtccgcggcgctatcgacggagctccgncacaagtacaatgtgcgttccatcccgatccgcaaggacgacgaggtgcangtcgtgcgcggcacctacaagggccgtgaggggcaaagtggtgcaggtgtaaccgcccgtcgcttgggtcaatcccaacgttgaggcggatcac

SEQ ID NO: 6963 - DNA, 387 bp, Zea mays
  Clone ID: LIB3279-037-P1-K1-B3
ccggatgtcatcgcgcccggcgtgaacatcttggcggcatggagcggcgacgccagcccgtcgagcttgtccagcgaccgccggcgggtcggcttcaacatcctgtcggggacgtccatgtcgtgcccgcacgtcgccggcgtggctgcgctgatcaaggccagccacccggactggagccccgcgaagatcaagtccgcgctgatgaccaccgcgtacgtccacgacaacacgtaccggtcgctgaaggacgcggccaccggcaaggcgtccacgccgttcgatcacggagctgggcacatacacccgctgcgtgccctcaaccctggcctggtctacgacatcggccaggacgactacctggagttcctctgcgtggagaacctg

SEQ ID NO: 6964 - DNA, 53 bp, Zea mays
  Clone ID: LIB3279-037-P1-K1-B4
cgaccagctaggatcggccgtgtttttctgcagcgggctccctagcagcgggg

SEQ ID NO: 6965 - DNA, 63 bp, Zea mays
  Clone ID: LIB3279-037-P1-K1-B5
gccagaacccgacccagaggccccaccaggagcctggtgttaccgacgtccacggaaaggcct

SEQ ID NO: 6966 - DNA, 460 bp, Zea mays
  Clone ID: LIB3279-037-P1-K1-B6
gccaaaaccccaatcgcacaggagagaccgagagagaggttttccatccatggctcccggcgtcgcttccgtgctggtcccgcaggagcccgtcctcctcaaggacatcctcgcctcaccgtccccctgcgggaacaccgctgtctccgcccgccacctcttcggcaacggagtcgcgccgccacgctcctcggacgacggcatcaaggacgccgctgccgaccgccacggtgaccgcgacctctccatccccaagatcttcaccggagacgtgctggacctgctcgacgatgctgcgaggctggacctgatgctggcgctgacgggggacggcggtgcggcgtccatggccggcttctccgcgcgcgggtggtgggtctcgaaggaggatggcgacgcggtgcaactgaaggtgccgatgccggggctggggaaggagcacgtgaagatgcgggtggag

SEQ ID NO: 6967 - DNA, 423 bp, Zea mays
  unsure (1)..(423): unsure at all n locations; Clone ID: LIB3279-037-P1-K1-B7
cgattcccaatccagcaaaccctaccagccttttgcaaactcagagagggacccgatggcacccaaggcggagaagaagccggcggcgaagaagcccgcagaggaggagcccgcggccccggcggagaaggcccccgctgggaagaagccgaaggcggagaagcggctcccggcgggaaaatccgccggcaaggaaggcggtgttgacaagaaggggcggaagaaggccaagaagagcgtggagacgtacaagatctacatcttcaaggtgctgaagcaggtgcacccggacatcggcatctcctccaaggccatgtccatcatgaactccttcatcaacgacatcttcgagaagctcgccggcgaggcggccaagctcgcccgctacaacaagaagcccaccatcacctnccgggagatcca

SEQ ID NO: 6968 - DNA, 441 bp, Zea mays
  Clone ID: LIB3279-037-P1-K1-B8
ctcaacaagatagaagattttggtgtccattgcaaatcgtactatgctttggatataacgtgatttcaagtcatccgtggatggtcacctccttgatctgctctggaacaaatactgggtcaacacgctatcttcatcatcacttctgggcaacagagattatgttgctgggcagatctttgatttagctgataaactagagcaagctgaaggccagctggcacacagtcgatttggtggtatgattatgccttcacaacgaaagaaagagcaagaagagtctccactggctaaggtaacacgagatagctccaaaatcacagctgagcaggttcacggcctcatgtcacaggtcataaaagacatccttttcaactctgttcacccgtcaagcaaggcaagcacaagtgctccaccagattcatcaggtcctgagcctat

SEQ ID NO: 6969 - DNA, 452 bp, Zea mays
  Clone ID: LIB3279-037-P1-K1-B9
ccaaagttgtcttagataatcggatcaattgtccgtacgtaagaagggtggagatgtaattagagtggacatggcgttgctaatatgatcgtttgcagcttgcggtcactttgggggacagatatcccccagatccactagaaggcaagaaggcctcgcggaaggctttgggcctattatctcgcaaggccatcccttcgtgggccaggggaggactactggtggaatgggccgatgcgtgataaggaataagtctcaggcccaagcaactcgacaaactcaagcgctatctgcagcgtccgcccgactttcccgcgcgcagtgcccttggacgtcggaatggatcagagataaatcaacaagattacaggaagataagttcagtcggttcactattgtttaggtacacatcatcatcatacacacatgtagtgccccacggtcgagtatat

SEQ ID NO: 6970 - DNA, 446 bp, Zea mays
  Clone ID: LIB3279-037-P1-K1-C1
cttagcctctcactgccactcacactaaaagctatagcataaaagttaaactgaagtgtacaagcaagtttatacaatacatgcacaaactaaaggcaagtagttaccttcatggtagagttcagtttaaagctctcctccctctgtttccagttttggtgccctccaaacagcggtgaaggatctttgtcctgcttgtcaacggttatatatgacaacttcttcacgattgtgttgggagtcctctttgggatggcaatagcatttggatcattcgcaacaggtatcgggcagcctgtagattgaagtacaaatgtggggctacgaagcagtcacaatttagccaccaaaaggatttttttttaaggcacgaatcttacggtggagtggtttcgatgagagccccatcgagtccaacaccgagaaaactttactgtccttttcac

SEQ ID NO: 6971 - DNA, 459 bp, Zea mays
  Clone ID: LIB3279-037-P1-K1-C10
atcagccacctcgtgtgctattgaacagtgcaagatacatccagaaagaaaaggattcaacaacaacaagacaagcatttctgcagctagcatggaagaatggcttgcctttattcatgctgtcttatggcgattctgatatcctggcagccactgttagaaggaagggcatctctgaaaaggatgatctggaaagcacatatgctgtattcactgttgaagaacctaagaaaaaaagtggagcttggatcaaggcagggggcaagaacaagaaacaccaccttttgtctagcatagtcggggaaataaaggttgcacgtcgaaaatcaagatgtcaccatacagcagatgttcatgtatacagggaatttgtgttgcttggttccggatttctaccatcatctgaagaatcgggtgattcacatgttagtggagagtttgcggcttttattagtgcac

SEQ ID NO: 6972 - DNA, 416 bp, Zea mays
  Clone ID: LIB3279-037-P1-K1-C11
cggacgcgtggggccgcaggcacctcctagtcacccgccacaatgccatgctgatccacagtcttatcatccacaatttgctgctagacctgacaatgctagtgccaataatagtggtagttcagcaaacattgagtcagctgtccaggaggctgttcttcacgcgcaggacattgagactcagcaagtcatacagaatcaaagacatgcaaacacaacaagtgaacctacaaaatatggggaagacttactttcgaaccgccgtgaccctaatgcattgaaggagcatttactaaagatgacagctgatcatcgtgcagagatggcaagcaaaagggggaagccacttcatccaaacaatggcaactgtgaaattggcaatggctatggtgtacctggaggccgtgcttattatg

SEQ ID NO: 6973 - DNA, 378 bp, Zea mays
  Clone ID: LIB3279-037-P1-K1-C12
gtcagtttgtttgcgcgaaaaaggataggaatcctcttgtgtcctggccgtcggccgtcgctgcgtcgttccagatttggggaaggaaatccggcaccgagattcgagtcgaaaaggacatcatttgctagatggcgcgtaccaagcagaccgctcgcaagtccactggaggaaaggctcctaggaagcaactcgctacaaaggcagcccggaagtctgcacccacaactggaggagtgaagaagcctcaccgttaccgcccagggactgttgctcttcgtgagatccgcaagtaccagaagagcactgagttgctgattaggaagctgccgtttcagaggcttgtcagggagattgctcaggatttcaagacggatc

SEQ ID NO: 6974 - DNA, 453 bp, Zea mays
  Clone ID: LIB3279-037-P1-K1-C2
gatgacccaaattatgtttgagactttcaatgttcctgccatgtatgttgcaatccaagcagttctatcactctatgctagtgggcgtactactggtattgttcttgactctggtgatggtgtgagccacactgtgcccatttacgaaggatatgcccttcctcatgccattcttcgtttggatcttgctggtcgggacctcacagactccctcatgaaaatcctgactgagaggggttactccttcacaacctctgccgagcgagaaattgtaagggacatcaaggagaagctggcatatatagcccttgactatgagcaagagttggaaactgccaagaacagctcctcagttgaaaagagctatgagctacctgatggccaagtaatcaccattggtgcagagagattcagatgccctgaggtcctcttccagccatccatgattggtat

SEQ ID NO: 6975 - DNA, 215 bp, Zea mays
  Clone ID: LIB3279-037-P1-K1-C3
cggttccagattataccatgccgacttctactgtacctcgtgaatcgtgatgtctattgggcacttgttgctgacagaactgtgcacaatgttgatccaatttgatggatggtggtggttctgttatttactagtcggtcaaaacactaaacggtggccatcatggctgtgtgatgtatcataactgttcagtaaatttgtgttcttctgcccgg

SEQ ID NO: 6976 - DNA, 432 bp, Zea mays
  unsure (1)..(432): unsure at all n locations; Clone ID: LIB3279-037-P1-K1-C4
cccacgcgtccgcccacgcgtccgcggacgcgtgggcggcgaaccccacccgccgggcgtgcgccccatccaccaccgatcgggcccgtcgctgcaacaaaggcgttcagtttcgttccgtttgggttggtctgtttagtgcggcggcgacagcgacagcgacagcggatgaggagagcggggaccggaggtgccatggcggacgcggcggcgccggggctgctgccggtggcggcngacagggagagggacaagggcaaggacgaccgccgccgctgngcggctcgctgcggtttcgccgtcctcggcatcatgagcaccctcctcgtctacggcgtnctgcaggaaaagatcatgagggttccgtacggagcggacaaggagttcttcagatactcgctattccttgttttctgcaaccgtatcaccaca

SEQ ID NO: 6977 - DNA, 152 bp, Zea mays
  Clone ID: LIB3279-037-P1-K1-C5
gtgactgcttaccaaaacaggcgcacattacttggggcctaaagtccattgcaagtaaaatatgccgatggggagttggaaggattggaacacaacctcttcgtgggaatgctgcccaaaaatgtaacacatgctgaaaatgacggatttat

SEQ ID NO: 6978 - DNA, 452 bp, Zea mays
  Clone ID: LIB3279-037-P1-K1-C6
cccacgcgtccgcccacgcgtccgtccaagcacaccaccactccacagtgcacttcactctacagcaacgacagaaaagtgagcagcagacagcagcagctgctgccatggaggcgtggagatctctcctcgcgagcttcgtgctcgccgtgctggccgcgcaggccttggtggctgtggtcgagtccaggaccggccccgtggagcaggcgagccaagcaggtgacgacgtgaagaagccggactgcgtgccggggatagacccgcgctcgttcccggggaccggcggcggccacggcatcacgcccgtgacgccatcgcacggaggctccagctccccgacgccgtcccacggcggcggcggcgggtacgttccaacgccgtcgcatggcgggacgctgccttccccgtcccacggcggctccagctccggctcctcttcgacgtcgccc

SEQ ID NO: 6979 - DNA, 459 bp, Zea mays
  Clone ID: LIB3279-037-P1-K1-C7
cccacgcgtccggcagcatgcgcagcagcagcagcagcagcacaggggcgccgcgttggactcggaggacgactcttcgtccaccagcaccagccgcggcagcgacaggagcagcgtggtgcagagcttcaccccgtcgaccccgccggcgacgcccaacagcttccgaaccgggaagcggcgcaagggcgtgccgcaccggtcgccgttcggcagcctcatggtggaggagttctagtcaaaggcgtggtccgaacccgatgccggcccacgcggttgccctcgccaaaagcagcggtacacccccactgtagcatacgcacttctataccatctactataggtgttgccggatcggccggtctacatagttcatagccacccaagaaaaaaaaaaggagctagtagtagcaagcaataaccaaggccccactgcacgcccgcgcttctggacgacga

SEQ ID NO: 6980 - DNA, 437 bp, Zea mays
  Clone ID: LIB3279-037-P1-K1-C8
ccgaccgccgtgggatgtcgaggtgctctggtcgagagaagtggggggtcggagatgtgagcagagatccgccgtgcgctagaaccggtcacgccgtcgtcaaaccctcggtaatcagctcatggcgttcgctggagggtgttgtgggtgatggtgccctcaccgtgcggttttgctgcctgggatgcagggaatttctccccggaatcaagccgccaccgcagtaccgcgcgtggccatgggcagaattcagtgttgtgccgtagctggtgagtatccacccatctgtttcctcgtctccctcgtgttctttttcagctaactgttatcggaggggattgccgatgccacatagggagcctgcttcggtgagttgtcgggtaaagtttgggcgacgccaccgtggtagtgaacgggtggccagagagtataacaca

SEQ ID NO: 6981 - DNA, 460 bp, Zea mays
  Clone ID: LIB3279-037-P1-K1-C9
ggcctccagaagtgtgcgacgttcccaccctcatctggtcagcctcagcaggaggattgtgcatgctgccatgtaggtgacgggctcacgtgtgctcctgcctatgggcgatctgtgtctttacctccaactttgaagctggtctctgccatgaaaggaggccgtgaaaagaacggagtggcatcatcaccaactgaaaaccgccatgtcaagtgggctcctgatgtgtacgatccccctgtgacatcggtatgccattcagtgaccaacagctatcagcgccggtcaaagcaccgcaaggagaagaacaaacagaagaagaggcagaaggggaagtcgaagaagaaccaacaacagagttctgcccagaatccatctgcgcggcaggttcctggtctcgggccgaaaggcgttagcaccactggtggccagtctccagtagacgatctcagcgaacatg

SEQ ID NO: 6982 - DNA, 461 bp, Zea mays
  Clone ID: LIB3279-037-P1-K1-D1
ttgaataggaggatcatgcacatcatgagaagagtgttgcatgtccctactaccctttcatcttgggtcctcctaacaaaacaaagtgaatactcttagtggtacctcacctctctcttaagtggagtctttttgtgggaaagggtcattttgggtggttgtggtgctctagaaaggggatcactagatatgtcgggcaaggtatcaagtggcttctttagatggttaggtttgagaaaccacacttgtttttgaggtggtgctcttagaggctcctcaaacattctatctctcacatctgggacggcagatttaggtggagagaatttgataggatgagaagtggctgaaggtttctttgaaggtgccaagccactacactcatcaaccttaccataacaagcgccatcctatctttagcagcaaagcctaaccctagcactgacagtcgtgaggctgtg

SEQ ID NO: 6983 - DNA, 359 bp, Zea mays
  Clone ID: LIB3279-037-P1-K1-D10
tcggcaagaccgagaaggagatgaatgagctcaagctcaaggagatcaagaacggcaggctcgccatgctcgccatcctcggttacttcatccaggggctcgtcaccggcgttggcccgttccagaacctgctcgaccacctcgccgaccccgtcaacaacaacgtgctcaccagcctcaagttccactagaacgttggtgcatcagcatacctgctgccgccgccgccagttgtttgctgtggaaagctagatgcatgcgtgttgtaaaggaacctgaagcgttgcatcggtcatgattcatgcatggccagcctgctgcctgtaacaacaaactagtattgatcttattgagaccgg

SEQ ID NO: 6984 - DNA, 412 bp, Zea mays
  Clone ID: LIB3279-037-P1-K1-D11
cggacgcgtgggcggacgcgtgggcggccctctctagtttctaccccggcccccaacatgggcctgatgctgctgccatgtagcccagcgctcccccctcggcttcaccggcggcggcggcaacgacggtgaaaactacatcgggtgctagctccgacggtggtgcgtgccctgttgacgatagggcacgcggggcgcgggcagcttgtaagcgttcgatcggccatgtagggcaactatacatctttggcaggtctccatcatcctccgggggagagaagatggtaatggagtgcgtgtgtatgtatgtgtatgcccagggcgcgcgcgcgcggctctgggcgagtcacagtagagatgcaatatcatgtatccagtatctttcttacaacacaaaccgtgagaaattatt

SEQ ID NO: 6985 - DNA, 439 bp, Zea mays
  Clone ID: LIB3279-037-P1-K1-D12
gccacctccatctgctggatatgtttgtttgtaatcagaaatttctttaccagtttcaaggtacatatggtatagccaagaagaacaatcaaccaacaggacatcatggatacacttgtgatcagttccctggtaatcctttgtgatgcatcggttttaactgtagttgtgtgctaccgtgacttcagctcctaactggggagctgcataatcagcatttcagatctcaagcaacattgtatgattgcgataccagtggacaataatcaagtctgatgtagttgtaatagctaatctgtaatttcagtgtacatggatagattgttctttcgtcagagtaggaaggtttccaaatgtttgcatactatgcatgctgcagcctgggacgcggtttaaacaggacagctatacaagttgccagatctgagctagattgggc

SEQ ID NO: 6986 - DNA, 159 bp, Zea mays
  Clone ID: LIB3279-037-P1-K1-D2
ggaggagctaattggggaggaccaaaacctcctgtttgtggaatacaaaaacgtaattggagccggccgcgcttaatggccaataatttcttcaatcaaccaaaaggaggagggccgaggcaatgaggaccgattaccactaataaaggataatcgggc

SEQ ID NO: 6987 - DNA, 376 bp, Zea mays
  Clone ID: LIB3279-037-P1-K1-D3
ctcgagttctcctcaaccaaattcaaagtcacagcggcgaaactctcggcgatgtctggccgcggcaagggcgggaagggtctgggcaagggcggcgccaagcgccaccgcaaggtgctgcgtgacaacatccaaggcattaccaaacccgcgatccccaagttggccaagaagggccgccttaaacgccttttccggcttaattaacaagagaaccccggggggcttaaaaattttcttgaaaaccttattccggaacgccgtaacttaaaccaagcccccccgccgaagaactgtaaccgccttgaactttgtttaccttttaaagcgccagggccgaaccttttacggtttcggcggtaaggtcgcccttttc

SEQ ID NO: 6988 - DNA, 454 bp, Zea mays
  Clone ID: LIB3279-037-P1-K1-D4
ctcgagttctcctcaaccaaattcaaagtcacagcggttaaactctcggctatctctctcccgccgaaggtctgtaagggtctgggcaagggcagttccaagctccaccgcaaggtgctgcgtgacaacatctatggcatcaccaagccgtcgatccgcaggttggcgaggaggggcggcgtcaagcgcatctccgggctcatctactaggagacccgcggcgtgctcaatatcttcctcgagaacgtcatccgctacgccgtcacctacaccgagcactcccgcctcaagactgttaccgccatggacgttgtctactctttcaagcgccagggccgcaccctctactgtttctgcggttaagtcccccctctcccggtggcaatatacgtggtggctgtcgttattttttcttggtctatttaatctgtgtcgtctttatcggtgctttttt

SEQ ID NO: 6989 - DNA, 452 bp, Zea mays
  Clone ID: LIB3279-037-P1-K1-D5
cgaggaccggcagttcgattcatcccgtgtccaatccgccatggcagcacttgcttcatccaaggaggctgactggaacgcgatgaggctgagggagaaagaattggctgctgtgaagatcaaccctgccgatgtcgaaattatcgctactgagcttgagctggacaagaagatcgcggagagaacgctccgtgagcacaagggtgatgccgtggctgcggttcgattcctgctgcgctagttccgagatttcgtcgccagcatcatatgttccccttcagttcctcacaagaggtggtgatgtgaagcactagtacttttgtctgtgtgcctgttttggaagtttgctattagaactatgttgcagaaaatttaagaatgagaataccatgcaaaaggtgtaatatgaattgtattaattatttgctattagaactaattaaccattatat

SEQ ID NO: 6990 - DNA, 455 bp, Zea mays
  Clone ID: LIB3279-037-P1-K1-D6
agatcgggctcgcaggtatgacctacatgtggccattttttgttaatcttttaaactgaagcaaaggttttcccgtgagattttttcccctggttgtgtcgcggttaggcgtaatggatgcctcttttgcttctcgcatgtgcttgtttttccccgcgtgtagcaacctttgcttagcattcataaaaaaatgtcgtcgtccccatatttggatagatatatggatctaattaaatatcttgtgcctatcataatgttcacgttgctagcagatttaaaagggggtagtggggaaacaccattttccgttggtcaagcaattaactcgcctgagttagtgtgagccattgcttgctttactgccacacggggggtcttgttgcagttatgcagctgtctgatttgtataccttttcttgtccggagattaagtcggtctgtccggtgcattccca

SEQ ID NO: 6991 - DNA, 349 bp, Zea mays
  Clone ID: LIB3279-037-P1-K1-D7
cccacgcgtccgccgtcaaataccaactcagcgcaaatacgacaggatcatctcttgcgagatgatcgaaggtgttgggcacgaatacatggacgatttcttcggctgctgcgagtcccttttggctcaaaacggcatatttgtcctgcagttcatctcaatcccagaagaacggtatgaggaatacaggcgcagctaaaacttcataaaggaatacattttccttgggggttgcctgccttcgttagcccggatcacgtttgccatgtctgcagcatcaaggctctgcttcaagcactttgaaaatatggggtaccattactacccaacgctgatacagggggggcac

SEQ ID NO: 6992 - DNA, 394 bp, Zea mays
  Clone ID: LIB3279-037-P1-K1-D8
cccacgcgtccgcaatgctataaatgctgcaaccgaagcttcctgccttattcttagcgtcgacgagacagtgaaaaatccaaagtcggagagcgcacaaggtgaggctgctgccggtgcgatggctggtcgcggtcgaggtgcaatgcaaggccgtggtggcagggccttgcccaggcaataaactgggtcacgtaaatcatggtcagattttttttggctggttggcaagggctttgggccttaccagacctggatgggcccttgacttactaatgggcccttttgggtggggaacaagcctagacttttttggttcaaaagagaagcaccacgcggttattggtgtgcctttcgctggatgtgctataagagacctgagctttggattctt

SEQ ID NO: 6993 - DNA, 459 bp, Zea mays
  Clone ID: LIB3279-037-P1-K1-D9
gcgagcacaaaaaaaaaaatcccaatatccgcaacggcaatgtctccgctgcccccgatggggctcctcgccgtcgccgccgccgcctccgcagcggtcacggcgtcagccacgtcgctcagcggcgcggcgaacgacctactccccaagtacggcctcccgaaggggctcatcccggactccgtcgcctcctacagcttcgacgaggccacgggcgccttcgagatccacctcgccggcacctgctacgtccacttcggctcccacctcgtctactacgagaggaccataaccggcaagctctccaagggcgccatcttggacctcttcggcgtccaggccaagaagctcttcctctgggtctacgtcacggagatggtcgcgcaccctgaccagggcaccatcgagttccaggccggcttcatctcggagtcactatcggcctcgatggttgacgag

SEQ ID NO: 6994 - DNA, 459 bp, Zea mays
  unsure (1)..(459): unsure at all n locations; Clone ID: LIB3279-037-P1-K1-E1
aacccccacttttggcactttcctttccggccccttttcctgggcgcgatctaaatccgggccggcgatggacggcggggggcagcccccggacacggagatgacagacgccggcttgggcggcggggggcagccgccgccgccgccgcagcagccggcgggcggggccgggatgatggagaacatccacgcgacgctcagccacggtggccgcttcatccagtacaacatcttcggcaacgtgttcgaggtcacctncaagtacaagcccnccatcctccccatcggcaagggcgcctacggcatcgtctgctcggcgctcaactccgagacggcagagcaggtggccatcaagaagatcgccaacgccttcgacaacaagatcgatgccaagcgcacgctccgcgagatcaagctgctccgccacatggaccacgagaatattgttgaataagagat

SEQ ID NO: 6995 - DNA, 434 bp, Zea mays
  Clone ID: LIB3279-037-P1-K1-E10
ggaagtggaaggcacagcggctctgcggctgagcgagtgagctgctcgggccgagcggacggcgggcggaggcgcggagctgctcgcctgctcgggccgtcaggcgctcggcggacggtgggcggagcggctcggtccgagcccgagcggacggcgggcgaaggccggaggcgcggagctgctcgcctgctccgctgctcgggccgtcgggcgctcgctggacgggcagacggcgggcggagggtcgtagccgcggagcggctcgcggcctcgggacgagcggacggcggatagaggcgcggaggcggagcggctcgcctgctgggcggtgctggctgctcgggccgtcggcgctcggcggacaggcgggagcgggaccgaggaagctcgagcgctcggccggctgagcggacgggcggacggcggcgaccgac

SEQ ID NO: 6996 - DNA, 392 bp, Zea mays
  Clone ID: LIB3279-037-P1-K1-E11
caccaaccactagaactttgtctcgtcaccactagtgtcatcatcgctattctaaagcttgcatgaggcgttccatcctcacttgagcccctttgtcctcaacttaggcgcgacaagcttcatcaacgttaaggacaaccgaaatacatcatggtttgaactataccgatgtcttcttcctagaccacaatgtggtggaactgaccagattaatccaacttaaattcacgggtcccaccccatgggcgatgacacacttaaattagattaaactatcagtctgtcggatctagtccgattaaccaccttgcgagatgaaaaaaccatacctcatacgaagatgataccagtgaatacaacataccataagaaccataattaaaaatattagt

SEQ ID NO: 6997 - DNA, 452 bp, Zea mays
  Clone ID: LIB3279-037-P1-K1-E12
gcaattgcagaacggaattccattccagaaccatccttcgctcgcccccgccgccgcgctgccgcggccatatacggcgaaagccctattcgtgcccgcggccgtggatagataggtcagtgacgattgagaaacccgtagtcggagcagaggaggggtagaggatggtgttcggtcaggtggtgatcggcccgccgggctccggcaagaccacctactgcaacggcatgtcgcagttcctctccctcctcggcaggaaagttgcggttgtcaatttggaccctgcaaatgacgcattgccatatgagtgtgccataaacatcgaggacctcataaaactcagtgatgtcatgtctgagcattcgcttggccctaatggagggcttgtgtattgcatggattacttggagaagaatattgattggcttgaaaaaaaactgaagccttttatt

SEQ ID NO: 6998 - DNA, 415 bp, Zea mays
  unsure (1)..(415): unsure at all n locations; Clone ID: LIB3279-037-P1-K1-E2
caagagagcacgctactactcatcactcgccaacgtgcaaagatcagggaagcggcactccatccactgactgaccgctcatggcgaaggtccacctttacgtcgccgcggcctgcgccgtcgttctcgcgctcgccaccccggccctcgccggtgaccccgacatgctgcangacgtctgcccggctgactacgcctccccggtgaagctgaacgggttcgcgtgcaaggcgaacttttcggcggacgacttcttcttcgacgggctgaggaacccgggcaacaccaacaacccggcgggctccgtggtgacggcggncaacgtggagaagttcccgggcgtgaacacgctgggcgtctncatggcgcgcatcgactacgcgccgggcgggcagaacccgncgnacacgcaccc

SEQ ID NO: 6999 - DNA, 273 bp, Zea mays
  unsure (1)..(273): unsure at all n locations; Clone ID: LIB3279-037-P1-K1-E3
ccggatttcccggtccgccccacccgtccggccttttcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccttccacaacgccttcagcacctacggcgaggtcctcgagtccaagatcatnctcgatcgggagacgcagaggtccccgcggcttcggctttcgtca

SEQ ID NO: 7000 - DNA, 498 bp, Zea mays
  unsure (1)..(498): unsure at all n locations; Clone ID: LIB3279-037-P1-K1-E4
cggtccgcnatctcgtccctcttccccttctcttcccccaagggccccaaacccactttgaggcggagctcctagagaaggcagaaagccanntggcgtccttggttggttcnngtgccgccggcgccgntncgccgccgccgcccgtctccctcncctccgtccctcgccgcaaccggcagcggggtggctctctcggcttgaggggtcggaacccagggcactacgggcgcnggcggctcgcgctttgcttcgtccacagcnttctcacaaagagttcaagatcgcctgccttactgtcgatgacagcagtttgggcccgggggatgaatatgagtctgacccccgcatgccaggcgaggatgagttcgaccatttctaccgtgttctcgccaagaagactgacaacctgctcagctgctacattccaatgccgcttgcactttctgaagaggagaaagccgtgcagaaggagttcaagctgatcgcgagcggatg

SEQ ID NO: 7001 - DNA, 214 bp, Zea mays
  Clone ID: LIB3279-037-P1-K1-E5
gctggaactacatttgtaaatgcaatcttcggtccaccctctggaggcagcggccaaaactccaatgcatctgagaggtggcttgtcacactcggatttaagggcaaactcgggcgcatctcaaatgtgtgctaggatcaagtctcacacatatgatggctcatggtacagaaatcaatgtcatatctttattaaataatcggagtttttttac

SEQ ID NO: 7002 - DNA, 460 bp, Zea mays
  Clone ID: LIB3279-037-P1-K1-E6
cccacgcgtccgcgcaagcctcccctcggggctagatctccggtctccgcttgcccaactgccaccactgaggcgatgcaggaggccaagcacctcaccacctcaaagcttccgccgcaatcccaatcctcattcccatccccttcggctcccgccgcgaaccctcccccataccatcacgactatggtacctttcaccggccgtttcagccgacgctgcccgtcgtaggccccgcctaccatgactaccatgcctctcctatcgggttcggcagccaggggttcgttgcctttccgggcgccgtccaacagcaggtcttcgtggagggcattcccgttcgagagcgcgccctaccgttctgcggcgtcggcgtcggctggtttttggtcttattggggttcttcttggcggcaatcccctggtatgctggggcgttccttctattctttggtgctttgg

SEQ ID NO: 7003 - DNA, 461 bp, Zea mays
  Clone ID: LIB3279-037-P1-K1-E7
cgcatccaacagcttctatcgctcttgagcctgttctctgatcaagcatgcatggcagttacagctctactgaactacaacatcgacaatgaactggacatggcagtgagtagcatgctaaatgggaagcatcctctagcagcacttaacagaatgacaaataacatgacatcattcctgaagcattcgaacatacttgacaaaataccagaggatacacttaaatggaaaatgaagctgatcaaacgggctgcttcttacgccaattatcgtctacaatcggttcaggccgatgtgctactgttagtcagctgtgctgacaggttacttccaagcaaagacgaagctgacaggctgcagaagttgttaccgaagtgtaaaatctacttctttgagaagcacgggcacagcttactactggaatacggtgttcatgttgcaagtatcatcaagtgcactgg

SEQ ID NO: 7004 - DNA, 337 bp, Zea mays
  Clone ID: LIB3279-037-P1-K1-E8
cggacgcgtggggcgcaatgccaaaatcgacatgttcaaaggatcaatgaggcttgcagtggacaaatgggggcggattgaggctacagagccagccagcttcacagtgaaggaagacaacaacttgtcccttgtagagtatgaattggttaacgtggctgaataaccgtcgaagcgtttctgcccccctttcttctttttcacgcacgccataagatgataagaaaacgaacagcatctcgaagctgagtttatttgttacggtggtcgataaggtcaaggcttctgctgttacacctttggatccaatccattaagatgaattacccttgcatct

SEQ ID NO: 7005 - DNA, 457 bp, Zea mays
  Clone ID: LIB3279-037-P1-K1-E9
ctttccccttccctccctccctctccccgcgggccgccagaggcaatttcgccctcgattcgaccccgattcgtccgcccgcgaccgggattccctccgccaagcgcggatctgaacgctgcgctccgtgtcgtcgctcgaatccgccatgaagggggccaaatccaagggcgccgccaaggccgatgccaagctggcggtgaagagcaagggggcggagaagcccgccaagggcaggaaggggaaggccggcaaggaccccaacaagcctaagagggctcccagcgctttcttcgtgttcatggaggaatttcgcaaggagttcaaggagaagaaccctaagaacaagtctgtcgctgcggtgggaaaagctgctggcgacaggtggaaatccctgagcgagtcggacaaggctccctatgtagccaaggctaacaagctcaagctagagtacaac

SEQ ID NO: 7006 - DNA, 444 bp, Zea mays
  Clone ID: LIB3279-037-P1-K1-F1
cgtccgaacagaccctttgtactacacaatgcgttttatagatgggttgagacaaggaggaggcactagaatcgggtcgacgtcgacgcattgagcctatcaccaaccggacggcttggacccagagtggtcaatcatctgagtcaaccaagggtgaacatgtgcagggtgttttggagaaatcttagggagacactgctcgtcatgtttctcctatcgaccgggtggtctcattgaagagctatcgacgtgcggaggggtctttgcatcgctgtgcggagaaatgggcaccaggtcacaaatgtgccaccacagtgcaactacatgttattgatgaagtatgggatttgctcagtcaggaggaatgtccaaagatagcgacagagacaattgagcagatttttatggctgttagtccaaaaatagtgcaaatacgtgccgggt

SEQ ID NO: 7007 - DNA, 277 bp, Zea mays
  Clone ID: LIB3279-037-P1-K1-F10
gaccgtcacagccatggacgtcgtctacgcgctcaagcgccagggccgcaccctttacggcttcggcggctagggcgctaggctaggccatgctcgacccgccccccactctccgctctggcgtcgtcactggttccttgacccctgtgcgggtcggtcggtggtgctagggtcagcagttgtctggtgtctgtagcctctctggctatccgttctttggtgtgaaatggaattccaaatcgtgtgaatgggaatggatctctgttggattgttcaa

SEQ ID NO: 7008 - DNA, 407 bp, Zea mays
  Clone ID: LIB3279-037-P1-K1-F11
gcccaaacagatagacccggtccgggtggcggccgtttcaattcgaggcttgtggccgggcgccgctgaagcaggaaggagcgtgcgtcggacatggaggacgcacgcgtgctgccggttgtcttcgtcgacggcgagcagagcgtggacttgggcacggtgaccgtgcagccgtcgtttggcggcgtgaagcggcttcaggccgtcgtggcagaccgcgtgggcgccgcgccgcaccagatctcggcgtccctggcgcggccccgccgcgcccgccatgtgcccctcgacgacgccaccgacctcgccgccgccgtcgcgcgggagggctccgggtgctacgtcatcgctgggttccgccgctcccgccggggcggccggtcccgccgcgacaggaagggagtcaa

SEQ ID NO: 7009 - DNA, 458 bp, Zea mays
  Clone ID: LIB3279-037-P1-K1-F12
cggacgcgtgggtagaggtgggttggcttctcctccccctccggttcgggttcgggttcgggaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggcgggtacggtggtggccgtggaggcggcggctaccgcggtggcgggcgccgtgatggcggcggcggcta

SEQ ID NO: 7010 - DNA, 344 bp, Zea mays
  unsure (1)..(344): unsure at all n locations; Clone ID: LIB3279-037-P1-K1-F2
ccaacgcgtccgcccacgcgtccgttcgagttttcctaaaccaaattcaaagtcacagcggcgaaactttcggcaatgtctggccgcggcaagggcggaaagggtctgggcaagggcggccccaaccgccaccgaagggtgctgcgtgacaacatccagggcataaccaacccggcgatccgcaggttggcgaggaggggcggcgtcaagcgcatctccgggctcatctacgaggagacccgcggcgtcctcaagatcttcctcgagaacgtcatccgcgacgccgtcacctacaccgagcacgcccgncgaaagactgtgaccgncatggacgttgtctacgc

SEQ ID NO: 7011 - DNA, 434 bp, Zea mays
  unsure (1)..(434): unsure at all n locations; Clone ID: LIB3279-037-P1-K1-F3
tcctgaatccaccctctttaatgtggcatcatcatcttcattggggggagtatctgggacatgagcatcatctatcatctttattagggggagtttcaggggcatgatcatcatctggctgccattgcattgtcaccaaaacatgctggtgttacttttttttacattatctttgtagcttggggaaggccatcctagtcttctagaagtgcatttggcgtttgtcatggacattacactntgtagtattcgtattatgtatttccctttgtgcaagtgcaacgttgtgttttcattataatagttgatgtggtttcgctggtttactaacaattctgaaatcttggatgattcattccatcatgtcatggcattttgacgaggaaaatttgtagacatggcatgtcaatatggcatacttcattccatgcatg

SEQ ID NO: 7012 - DNA, 447 bp, Zea mays
  Clone ID: LIB3279-037-P1-K1-F4
gcgtccgcctcccctaccatctagggtttctagggttttcgaggaggaggaaatggcgtctgatagggtgctcgggactgtgaagtggttcaacggaaccaagggcttcggtttcatcacccccgacgacggtagcgaggacctattcgtccaccagtcctccatcaagtccgacggctaccgcagtcttaacgacggcgatgccgtcgaatacaccgtcggcagcggcaacgacggccgcgccaaggccctcgatgtcaccgcgcccggcggcggcccgcttgccggcggggaacgtcccgacggcggcaacggcggtgggcgaggcggatactgcggcggcgaccgcggttacggcggcggcggtgaccgcggctacgggggaggaggcgaccgtggctacggcggcggcgaccgtggttacggtggaggtggcgaccgcggcta

SEQ ID NO: 7013 - DNA, 461 bp, Zea mays
  Clone ID: LIB3279-037-P1-K1-F5
cccacgcgtccgggcttctcctccccctcttaccaagtcctcttcgggttagggttacttagggtgtttgtggaggggcgatggcggcggctgatgtggagtaccgttgcttcgtcggcgggcttgcctgggccaccagcaacgagtcgctggagaatgccttcgcctcctacggcgagatcctcgactccaaggtcatcaccgaccgggagacggggaggtctcgcggcttcggcttcgttaccttctcctccgagaactccatgctcgacgctatcgagaacatgaacggcaaggagctcgacggccgtaacatcaccgttaaccaggcccagtcccgtggcggtggcggtggcggcggtggctacggcggcggtcgcggcggcggcggctatggtggcgggcgccgtgacggcggttatggcggcggtggcggctaccgcggtcggcgcgagggtggt

SEQ ID NO: 7014 - DNA, 468 bp, Zea mays
  Clone ID: LIB3279-037-P1-K1-F6
gcagcatggaggaagccaagaagaacatgtacgcattcagcacgaccacctacaccgggttccagtgcaccgtggacgaggagacgtcggagaagttcaagggtctgcctggggtgctgtgggtgctccctgattcctacatcgacgtgaagaacaaggactacggaggtgacaagtacgtgaacggcgagataatcccctgcacgtacccgacgtaccagccgaaggagcggaggacgtccaagtacgagagcaggcggtacgagaggcggagagatgggccaccggcggccagcaggaaaccgaggcagcaggcaccagctcagactcagaccgagtcggcgtcttcgtgacgagctctgcaggcattttgtccacgtacctacctacctagaagtagaacaagagaggaggacgcctaaaattctgtcgcattgggcaccgcgtactggactggacaggcgggtc

SEQ ID NO: 7015 - DNA, 459 bp, Zea mays
  Clone ID: LIB3279-037-P1-K1-F7
cccacgcgtccgcccacgcgtccggcggaacgccatcgagggcatgaacggcaaggagctggacggccgcaacatcaccgtcaacgaggcccagtcccgcggcggccgtggaggcggcggcggcggcgggtacggtggtggccgtggaggcggcggctacggcggtggcgggcgccgtgatggcggcggcggctacggcggtggcggcggctacggtggtggcggcggcggctacggtggtggtggcggcggctacggcggtggcaaccgtggcggcggctacggcaactccgacgggaactggaggaactgagcggtggggcccgcgcggccaagttatcctgttcgctaccgtgttgtttaccctagtccagagtgtttatcttcgttcgtctcgtgtttgttgttgcccatctgtgtttttgattgaaggtcgctctgtgtcagttgttagtgctg

SEQ ID NO: 7016 - DNA, 428 bp, Zea mays
  unsure (1)..(428): unsure at all n locations; Clone ID: LIB3279-037-P1-K1-F8
caaggatgagcttgttcttgaaggcaatgatgctgagcttgtctctcgctccgctgctctgataaaccagaaatgccatgtcaagaagaaggatatccggaagttcttggacggtatctatgtgagtgacaagggccccatctttgatgagcaatgagctgccctttgttcctggctagcaaaagccgtgttaggctgtggccagtagactgtttgcggagtggatgtagttggaaataggagatgggatgagtaaggttgctggagataagagctttagcaagaatttatgagatggacctttattttgtgttgtgtgtttttttttgtttgagttcagttaactacatctttgcaagttggttggatctgaagttctgtactggtttaggattgtattatgtaanccgaggtggacattgtttgtg

SEQ ID NO: 7017 - DNA, 432 bp, Zea mays
  Clone ID: LIB3279-037-P1-K1-F9
tcacaaccgatccagacggcccacccagcgcgaaccggatataccacacggatgccgctctataaataagaccccgcggccagcctactgtacttttccggcctcccattcctcgcgcggcgaccacccgattcgaagcgtgcggagagaccgaagaagcgggagagatggctcgtaccaagcagactgctcgcaagtccacgggagggaaggctcccaggaagcagcttgccaccaaggctgcccgtaagtctgcccccaccactggtggagtgaagaagcctcaccgctaccgccctggaactgttgccctccgtgagatccgcaagtatcagaagagcactgagctgctgatcaagaagctgcccttccagaggctcgtcagggaaattgcacaggacttcaaaactgatttgcgtttccagagccatg

SEQ ID NO: 7018 - DNA, 157 bp, Zea mays
  unsure (1)..(157): unsure at all n locations; Clone ID: LIB3279-037-P1-K1-G1
tagtgcgttgctttaatctaagtcgtaatgtggggaaccctgtgtcgtggaacctgacttcactagctcaccgcagtnagtattgtgggaatgggtcccaactgcagncttgancgtggtatatttataaatnngtgaagaaattcaggcttgcccc

SEQ ID NO: 7019 - DNA, 238 bp, Zea mays
  Clone ID: LIB3279-037-P1-K1-G10
cccacgcgtccgaaccgttagatttttagatctcaggatcaaagcaggactgaagagcgggtgaatctgaatggagcaagttggctaacatacgcacggtagctacaaatacttataggaataaataaagttggtcaactgttggtttgatggtgttggagtacaacaactgtactgttcttatcctcatatatgaactctagttcatcacataatataaatctgtaagagagccgag

SEQ ID NO: 7020 - DNA, 455 bp, Zea mays
  Clone ID: LIB3279-037-P1-K1-G11
agagaacctcgtgttttgcgtggagaaggcaagccgctcgacgcccgtcgatgtttgtagcgatgcacaaatcggaccgagagatgatgatcgagccagtgatgtggtgccaaccacaagatgcagtggtggacgacctgaagactgatggacttaaccagtggatgctcgccaagcgagcacctcccccccagcaaacactatctaagtgttaaaaattaaaggtactccttaggttgattggttgatggtgtgacttggccttcatccctgccaccgggatagacggtcgagtgggttattgcttccgcaggagaggaccaggaggagtagcgtggccaggcttcgccatgattactgggttttctccgttagatatttccgctgcattaaaatttatggttattatttctgaaactccgataatgtaatcactaatgatacttattaaattt

SEQ ID NO: 7021 - DNA, 454 bp, Zea mays
  Clone ID: LIB3279-037-P1-K1-G12
caagagagcacgctactactcatcactcgccaacgtgcagagatcagggaagcggcactccatccactgactgaccgctcatggcgaaggtccacctctacgtcgccgcggcctgcgccgtcgtcctcgcgctcgccaccccggccctcgccggtgaccccgacatgctgcaggacgtctgcccggctgactacgcctccccggtgaagctgaacgggttcgcgtgcaaggcgaacttttcggcggacgacttcttcttcgcgggctggggaacccgggcaacaccaacaacccggcgggcttcggggtgaccggcggccaccgggaagaagttcccggccgtgaccacgctgggcgtctccatggcgcgcatcgactacgcgccgggcggccaagaacccgcgacacgcacccgcgcgccaccgagatcatcttcgtcctcgacggcacgctc

SEQ ID NO: 7022 - DNA, 227 bp, Zea mays
  Clone ID: LIB3279-037-P1-K1-G2
cgccgctgacctcattgacaagcttgttgctgtgaaggcataggccgcatctcttctatcattggcttaccactctaggtttctatggtctgaagacttgtgattttctccgcactgctgttgctattcccgtgtcgtaataatacgagatgttttaagcggctgaacacacggtggtgtaatctgttactggtaaggtgcattgttgtatgaattgtttctcaccc

SEQ ID NO: 7023 - DNA, 187 bp, Zea mays
  Clone ID: LIB3279-037-P1-K1-G3
cccacccgtccgccaacccgtccgttcgccatggcctccttttcctttgccgccgaaaccgccgggttgtttttcgaaccagggccagccctcaccgtggtcagaaggaggttcttaaccgtgcgcgcctttttgcgcaaggccaccggcaccgtcgccgtggcaatggctgccagcgccctgcttg

SEQ ID NO: 7024 - DNA, 468 bp, Zea mays
  Clone ID: LIB3279-037-P1-K1-G5
gaagtccctggatgaagaggtagaatcaaaggagatgcagaagcagcaaccgcatgattataatagcatgagcctaggggtggtaacgggtcatttaatttagcctagcaaatttacggatcgaatcaagttagggccggatcataaaataatacaattttgaactaataaaattaagggctttgttggttcgtgaagcaagtattagggccatgatccattaccactcctacatgagcctcaggaatcttaaagccacacacaagaaatatctcattgctgcaaaggaagaggaggtcaccgaagggaagaggcttcctctcgaggaggtggaagagaacgcatgcatcagccactgaacagaacaagcaggcgatttttttgtgtggatggcgtctgccacaaaaggattgaatcgaggagtgtgctctggttgtgaagtgataactaggctaccacatgttcatt

SEQ ID NO: 7025 - DNA, 404 bp, Zea mays
  Clone ID: LIB3279-037-P1-K1-G7
cggagacgaagagagctgaagcgaagagcagcggcgcaaaggaaagggagccatgctcgcctcgccggcgctcgccggcgcccactccttcgcggcgtccgtgtatagaaacatcctcgttccctcgcctcccgtccccgcgccggcacgtcgcgcggcgctgtccgtcgtcgccaaggtcaaggtggccacgccccaggacgaccgcatcgcccgccacgtccgcctgcgcaagaaggtaagtggcaccactgagaggccgaggttgagtgttttccgctcaaacaaacatctgtacgctcaagtcatcgacgacacaaagcaatgtactctggcttcagcttcaaccatgcacaaatctctctccaaggaatttgaatactcggctgggccaacgatcgaaa

SEQ ID NO: 7026 - DNA, 394 bp, Zea mays
  Clone ID: LIB3279-037-P1-K1-G8
cggacgcgtgggcggacgcgtgggcatggccctccagtatgtattcgaggggtgcaccaagctgcagaagcttgaggtcagagatagccctttcagtgacaggggtttgctctcaggactggactacttgtacaacatgaggttcttgtggatgaactcgtgcaggctgacgatgaggggctgtagaggtgtagctcagcagatgcagaatctggtggtcgaagtaatcaaggaccactccgaagatgaaggggaggctgagaccgttgacaagctgtacttgtatcggtcactggcagggccaaagaatgatgctccgccgttcgtcaccctcttgtagtgctgctgccgccaccggaagaacacagccctgcttgtacccacgaacatgttt

SEQ ID NO: 7027 - DNA, 202 bp, Zea mays
  Clone ID: LIB3279-037-P1-K1-G9
cccacgcgtccggaaattattgctgaagtagacacagatcacgatgggagaatcaactaccaggagtttgttgccatgatgaagaataatagccccgagattgttccaaatcggaggcgcatgttttaaggctcatctcctacatttaattggaaaaaagaaagacgttccagtgagcgcagaaaaagttggtgattcggtg

SEQ ID NO: 7028 - DNA, 436 bp, Zea mays
  Clone ID: LIB3279-037-P1-K1-H1
attgaactctgttcgttgggttgttcaatacagaagtgagaatacaacatgagcttcagcagctcaatgaaccgaagcataaatgtcctaccattatttgtcgatgcgacacgccaaaattaaaatttcaagcaaagaaagtgctgcacatgagaccaaccgaaggcagcctcatcccaactctgaaatatgaaggctagtgggactccatcttatcaggacagtaagaccaccgcatcccacgcattcaaggtcatcatcaggctttgatggtcacgctgcacaggcaagaacccgtcggcttcagctttgacgtgcaccactccgaccccattggagctgcagggtcatacatcagcgtctggtacccgggctcttcctccagagggaagagcagcagcttgtcctcgtgcaccacgagggagaaacgagtgct

SEQ ID NO: 7029 - DNA, 438 bp, Zea mays
  unsure (1)..(438): unsure at all n locations; Clone ID: LIB3279-037-P1-K1-H10
acgggcaatctctctcaaatgaaggacgagacaaatcttcaagtgatataccaccttgctctactatcttcattgcaaatttgggacatacatgcacagaggacgaactcaaggaagttttatccaaggaacctggatttcatgtccttaaaatgcgtcgccgtggtggaatgcctgcagcttttgctgattttatggatattgaatcgtctaccgctgctatgaatagactccaaggcactgtactggcatcttctgataacgatggattgcacattgagtacgcaaggtcgaagatgaggaaaagctaagttgttggactgcaaggattggcagtgtcatctcctgtctgtcttcctggaggctaccagtaggcatccctgcacacgtagctgcgtgtagctgcttgcttagtcgttttatccatgntagcgtgag

SEQ ID NO: 7030 - DNA, 207 bp, Zea mays
  Clone ID: LIB3279-037-P1-K1-H12
acctcacgcgtatgtggacacacgtgcggtcacacggggacgcttttggagatcaaccaaaatggatggatcaacacatgagtcacgaaattccaccacccaacccaatcggtatccaatcaaatactgtagacttagatgctgaagactctgttccatcaagctttacttcgaagaggccgctaggtcatgattcgtccaaggaaa

SEQ ID NO: 7031 - DNA, 76 bp, Zea mays
  Clone ID: LIB3279-037-P1-K1-H2
ccaacccgtccgcccacgcgtccggacccccgtaccgaagcgtaaaccctagtccccggcggggacctggcggcct

SEQ ID NO: 7032 - DNA, 454 bp, Zea mays
  Clone ID: LIB3279-037-P1-K1-H3
gagccgctggggtgggctttcgttagactaacaaagttggaaaccgaggaggcaatgtttgactctaaaaggatgaaagcagctgacagcaggcgtgtagccactgcagctgttaaagctagcagggcatgtcgagatttgaatgcgcaaactgttaaatatctggatacgctgcatgaacatttaagcataatgttgtctgtccgcactgcattttctgatcgggcaagtgcattattgactgtgcaaacacttatgtcggatttggcatcattagagtccaggatcgagaaactcgaggctgcatccttgaaaatatttggtggtgataaagctaggactcgcaaagttgaagagctaagggaaacaattagggctactgaagatgctaagttctgtgctttaagagagtacgagagaattaaggaaaataacaggagcgaactccagcgac

SEQ ID NO: 7033 - DNA, 468 bp, Zea mays
  Clone ID: LIB3279-037-P1-K1-H4
cctaaatacaatttctaagaatattttgtaagatatatgttgggcacttgttttttattactgattcataaaacaagacaacacaattgttaaatgttaaggacctttgtccttcgaagcattatttcccttcgggcataatggttcttggacgaaggttgtgaagaacaagtcttcatcattcataaatgttgggaccatgcttcgtcgccgaaggtcctgcagaaagaaacagcttcgactgaagctgctcgtacgtgatgccgaaggtgccatttcgtgaagcttcggaattacaaaccgacttaaagatagaatgaccttttagtccataagagtccgagtcattgttgtaaacttttatgaggggtacgattgtaatccctcacgggctgtgtcctgtgcctataaatagtgaacagtattcctttactgttcacacattcctgcaattgcaatcgcatcact

SEQ ID NO: 7034 - DNA, 459 bp, Zea mays
  Clone ID: LIB3279-037-P1-K1-H5
acattgaacccgataaatacatccatcgagctttgtctaataacattatttgatgttgacctgtgttgtatttgggagaacagggtatttcttgtacttcagcttatgtctaccataagattcatcacacagctgatgaattacaaattgtgtgagacaaattttgaagaaagctacctctggttgtcgcgatctctgttactgtcatcatcacatcaatgagattgatcatatttttgaccctcaagttcgcacaacgttggcacaaacagaggtcattgtcatcaaactactgctatttttcatcatgtgtggactctcactaatgtccaaggctaataaacttttcatggagcctacactaattggtggttacgttacgttcgtatgcctgctagcgatgacaagatgggacgtagatattgggtggatcagcacatgggtccatatcgctagcga

SEQ ID NO: 7035 - DNA, 398 bp, Zea mays
  unsure (1)..(398): unsure at all n locations; Clone ID: LIB3279-037-P1-K1-H6
atgtggaaaaacctcctgtgaaacctcactgttttcagaatatctatgttgaccatctgtctcaaataaagagagttcttcaagaacaaccaagtctaagccttgaagtctaaaattgacaacggcttgatgcaactataaatgtcatctcaggtaagccatccatccttgaatacctaattattctctgcatttggacactgcacaatatcttttagactcataaaactagtagcaatctgccaacataaaagtctttttctgctaaaactatttaccttccatccagtacatctgtaccccttttcgtataaagcagtctgtcgtctctctttgagctttaggtaaagagaaaaccatagaacctgacttgtttttaaatggacctataactctnt

SEQ ID NO: 7036 - DNA, 247 bp, Zea mays
  Clone ID: LIB3279-037-P1-K1-H8
gaaagcatcgaaggggaaggccaacccagttttgttgaataaaattcttggagagaagctaaatgccaaataattatttttacccccatactgaatctcaggcgtccatgaagaatgggacttcaaattcatagaatgagattaatgtgaacgacgtagaagttttgtccacaatacagatatcattgtactaagctgatactttaaaagggcgtgttcattatattttatgcgatagcttgccctt

SEQ ID NO: 7037 - DNA, 419 bp, Zea mays
  Clone ID: LIB3279-037-P1-K1-H9
cggacgcgtgggctccctcgccggctccaactccagtaacctgggctttcccatcgacatgaagcgcgtgctggcgctccccggcgcgtgcggcgcgtccaacgccgccttcagcaagtgcaacatttccgcgctttccccaaccgaagcacctgcaccgtccgccgccggggggtcatcgagcggtggcgcggcggcatcttcaccgcgcgccgcggcggcgagctctcctccgatgacggcgaccgccctgttggctgccgtggcggctcccctgctcgcctactactgctgctacctcttctgagggtttccttctgctgctgctgccgtctaggctgagtgacctatttctatgtatgtgacgattcaagttaacttgtggagcgcggctgcgcgtgcgtttgtgcttgtgcagt

SEQ ID NO: 7038 - DNA, 453 bp, Zea mays
  Clone ID: LIB3279-038-P1-K1-A1
cctacgcgtacggacgcgccctaccgtagaccgagcaaggctacccaccactgagaggcgcgcagaggagcacgatgccggagaccaagatgtcctctgtgttcagcggcgatgagacggcccccttgttcggtttcctcggcgccgccgccgccctcgtgttctcatgcatgggcgcagcgtacgggaccgcgaagagcggcgtcagcgtggcgtctatgggtgtgatgcggccggagctcgtcatgaagtccatcgcgcccgtggccatggctggttggctcgggatctacgggctcatcatcgccgtcatcatcaggactggggtcaacccccaggccaagccctactacctttttgatggctacgctcacctttccgacgggcttgccctgggccttgctgggcttggagctggcatggccatcggcattggtggggatgctggagtca

SEQ ID NO: 7039 - DNA, 291 bp, Zea mays
  Clone ID: LIB3279-038-P1-K1-A10
cccacgcgtccggttattgctgagcggactaagctttcaatcagtgacgtggaatgtctggttatgaagagcctctcggttcatcttattgagggaataattgatgaagtggacagtacagttcacgtatcatgggtccagcctagagtgcttggaattccacaggttaaggctttgcgcgaccgcctggatgcctgggttggaaaggtgcataccacattgctttcagttgaggcggaaacacctgatcttggtgctgtgtaatttcacagcttgtacactttcgcgaga

SEQ ID NO: 7040 - DNA, 311 bp, Zea mays
  Clone ID: LIB3279-038-P1-K1-A11
aagactagaaagggaatatatagaactagaacctttttaaagcgtatcagccgacctgggttacgaatttatgccaactatcaaggaattcctaaggttttgggcggaatgggaattgctattctttctacttctcgaggtataatgacagatcgagaagctcgactaaacaaaattgggggagaaagtttatggtatatatgggaatggccccacctatagtacccaaattttatcttgaacttcctattttggaaataaaaattgaaaaattggagaaaaatatatggcagaaaaaaaaaattgttgag

SEQ ID NO: 7041 - DNA, 318 bp, Zea mays
  Clone ID: LIB3279-038-P1-K1-A12
cacactcgttcgcccacgcatgcgaccacgatttcgctctaaagcttccccacccgtggggtgacaatggatccctactctgatggaacccctacctttctggaccggagtggcaacgtactgttctctgtacttccagcagtaccaggacagatcgagaccctacactgaacagagtcgggggagcactctcatgctctatatggtaatggccccacatatatgtcacatatggtatctctacctttctattttggtgctggagaatctaacagttggagcaacttatatgacaggctattaaaaatagtggagcaa

SEQ ID NO: 7042 - DNA, 402 bp, Zea mays
  Clone ID: LIB3279-038-P1-K1-A2
cgagacgaagcctctccccacggcgcctccccctccacatggcctgggctcgccttgccggccggtcccgtctgcgccccgcggcctccgccgccggccgatcccgacacgcctcaacaccggctccgcctccgcctccgtccccacctaccacacgcacggtacctgcggccacctccgcgccaccgctccggcgtctcctcctgcttccgcggcaccggtttgctgacgccacgccctcagcatcgaccgcgtggctgctcggtgcccgctggcgccaggggcacggcaggaggtgctttgcgagcgccgcctacccggcgcaggcgacgccgggggaggcgtctgagctggtggatgtgccactggcgcaaactggggaaggcatcgccgagtgcgagc

SEQ ID NO: 7043 - DNA, 311 bp, Zea mays
  unsure (1)..(311): unsure at all n locations; Clone ID: LIB3279-038-P1-K1-A3
ctagatcgatcgcactctcgtgatcaacatgaaccagtcaccgagaaagctattcttacagactcggatcccaacaagagagctgngttgatatcattaatctgcaggagggccaaaactcggtgaccttttgcttttccaccaaagttcttgggaagcaacaggttgatgcacatatttacttgtggaaatggaatgctaaaattgtgatatctgatgtggatggcaccataacaaggtctgacttgctgggtcaggtcatgcctttgcttgtacttaatgggagtaactaaggtgttgttcgctttttt

SEQ ID NO: 7044 - DNA, 447 bp, Zea mays
  Clone ID: LIB3279-038-P1-K1-A4
cccacgcgtccgttttcaaggtaagcgaagatcagccagttctgaaagctttccaactgatgaggggaaagggagttggtggcttgccagtcatggacacaagtggagcaaatgccattggtaatattagcatcagagatgtccagtatcttttaactgctcccaagatatacatagagcacaggtcaatcacgacaaaggatttccttagtgctgttcgacaccacctccaggagcagcgtgagggcctcaccgttgctgcatgatgtattcacttgcaaaaaggatgatacaatcaaggacatcatactgaagctggactctgagaagatccacaggatctacgttgtggatgacaaagggaacaccgagggagtcatcaccttgagggacatattctccaagctggtgcatgagccacgccattactttggggatttttttgat

SEQ ID NO: 7045 - DNA, 460 bp, Zea mays
  Clone ID: LIB3279-038-P1-K1-A5
ctcgtgtccaggacacagggtaccaggattgcctctgatggtctgaagcacagagtctttgaggggggtctagctgatcttcagggtgacgaggatcaggcttacaggaaaatcaggctccgtgctgaagatgtgcaaggcaggaatgtgctcacaaacttctggggcatgaattttaccaccgataagctcagatctctagtaaagaagtggcagacattgattgaagcccatgttgatgtcaagacaaccgacaactacatgctgcgtttgttctgcattggttttaccaagaggcgcccaaaccaggtcaagagaacctgctatgctcaggcatcccagattcggcagattcgccgcaagatggttgagattatgatcaaccaggcttctacatgtgaccttaaagaacttgtttctaagttcattccggaagttattggcaaagagattgagaagt

SEQ ID NO: 7046 - DNA, 221 bp, Zea mays
  Clone ID: LIB3279-038-P1-K1-A7
ctgatttttgacttggcattgagatagaattatactaggattcaatacttgacttgacattggattgataatacgaacaccacatgaatcaagcctccaatgttgatggtacctacaatcaattatgtgatcccatcaattatccactttttgatggtacccaaaccaagttgggctttcaagtttagagcaacaaacttagacattgtcttagtatggat

SEQ ID NO: 7047 - DNA, 273 bp, Zea mays
  Clone ID: LIB3279-038-P1-K1-A8
cgcgtccgacagcaggcaccagctcgatcgctagctcctccgaaccggaaagccaagcccgcgttggcgatcgtgcttgcttgcttggttccttcaattcctgccggagccagcgagagctagctgctgctgctgtcgcgtggtagacgtcttgccagcgagagcctagctcgatcggtctctctggtacaacgtagggagaaagatcgagggggagaggacgacgacgatggccggcgcgaccgttaccgtggaggatgttaggaaggccca

SEQ ID NO: 7048 - DNA, 379 bp, Zea mays
  Clone ID: LIB3279-038-P1-K1-A9
aaagagatgggattcttctgcttgaactagatagattgctcaggcctggaggttgttttggttactcctctcctgaagcatatgcacaggatgaggaggatctccgaatctggaaagaaatgagtgcccttgtagaaaggatgtgctggaaaatcgcatagaaaagaaaccaaactgttatttgggtgaaacctctggacaatgattgttacaagaggcgagcacatggtacaaagccacctctatgcaaaagtggcaatgatccacattcaatatggggagttccaatggaagcttgcattactccgtatgctgaacaaatgcacagagatgggggaactgggctagctccctggcctgcccgattgacagtcccggc

SEQ ID NO: 7049 - DNA, 381 bp, Zea mays
  Clone ID: LIB3279-038-P1-K1-B1
gggcggacgaggagctgaggagagagaagcttcacggagcttgcttgggagttggggacttgggggttgccgagctgtccgtctttcccctcctctctacccaccagctacctcgggagggcaaggcaaacatctgcggcctcctttcccgaacccgggttggatggagcgggacttcctggccgcgatcggcaaggagcagcagcacccgcgcaaggagaaggcaggcggaggcgcggaggaatcagcttacttcggggcagcagccgtcccggcgatggactggtccttcgcgagcaagccctgcgccgccccggcgctgatgtcgttccggtcggcggcaagggaagagccttcgttcccgcacttctccggcttcga

SEQ ID NO: 7050 - DNA, 406 bp, Zea mays
  Clone ID: LIB3279-038-P1-K1-B10
cccacgcgtccgcccacgcgtccgcccacgcgtccgcccacgcgtccgcccacgcgtccgctcgaacttgtttcaacataggttcaagataaatcgaccactatttcttccgcataatgaaagtttgtggaacaacatgatgattacttcgagcagaagagaaatgcagctcaactcatcaataagggataagttgttttcaaaaggttattgcagttttccgtgggctaacttatagagtggcagctgatgctacagatgagtacgtacgcattggagaaagtactgcgctggaaagtctaagaatgtttggtaaagctggaatagaagtttttggagttgagttaaaaaaaaaaaaaataattaaaaaaatataaaaaatatttttaaaggaaaataaaaattt

SEQ ID NO: 7051 - DNA, 438 bp, Zea mays
  Clone ID: LIB3279-038-P1-K1-B11
cttaatatgcctgggctcatggagggcattaccaagcctgactatgcgacgtgtgttaagagctctactgatgcatctatcaaggagatgatcccacctggtgcacttgtcatgcttacacctcttattgtggggatcttctttggtgttgaaaccctctctggagttcttgctggtgctcttgtttctggtgtccagattgccatctctgcatccaacactggaggtgcctgggacaacgcaaagaaatacattgaggctggtgcatctgagcatgcaagaaccttgggcccgaaaggttcagacccacacaaggctgctgtcatcggtgacaccatcggtgatcccctcaaggacacctcatgcccctcgctgaacatcctcatcaagctcatggctgtcgagtcccttgtctttgctcccttcttcgccacccat

SEQ ID NO: 7052 - DNA, 87 bp, Zea mays
  Clone ID: LIB3279-038-P1-K1-B12
gcggtgcgagcgccacgtcgtccggtgtacatatcaactagcgccaacatacgagcccattacacatacctgcactgttcagacctg

SEQ ID NO: 7053 - DNA, 470 bp, Zea mays
  Clone ID: LIB3279-038-P1-K1-B2
gccgctcgcgcatcctattgccctcgcgccaccgtcgccgccgccgccgctgcagcgagcgaccggcccgccgtcgcttgaggtagacaccaatccaccgccatggggcgtatgcacagccgcgggaagggtatctcttcatcggcgctgccgtacaagaggactcctccgatctggctcaagacagctaccaccgaggtggaggagatgattaccaaggctgcgaagaagggccagatgccgtcgcagattggtgttctgctccgtgaccagcacggcatcccgcttgtcaagagcgtgactggtagcaagatcctccgcatcctcaaggcccatgggttggcgccggagatcccggaggatctctacttcctcattaagaaggcggcggcgattaggaagcatttggagaggaacaggaaggacaaggactccaaattcagactcattcttgttgagagcaagatcca

SEQ ID NO: 7054 - DNA, 402 bp, Zea mays
  Clone ID: LIB3279-038-P1-K1-B3
gagagagagagtcccgaagcgagcacaagaggccaccgcacagcggccaggcggcgagcgagacgggtccacacgtctctcccccttcccctccccttccgttccctctgtagctgcgcccgaccgaacccccctaccccgtggaatcgtcctccgatgcggcgccgataggggctggcggaggagcggaatggcggggcacggcgagaagcggcgccgtacgggaggggcccacgagaagccggaggaggaggaggaggaccgcatctcggatctcccggacgtcctgcgcctgcacattctgagcctgctgccgctcaaatcggccatccgcaccggcgcgctcttctcgcggtggcgccttctctgtgcgtaccgatggccgcagcccttcttaatgac

SEQ ID NO: 7055 - DNA, 392 bp, Zea mays
  Clone ID: LIB3279-038-P1-K1-B4
gacctctccctccgcccttcttccgccttctcgcaccttcatatcctccgcattgtctccggggagcccgcgctctacggcaccgttgacgtctacagcgtcactgacatcgtcctcaccatcctggcccatggatgcaagcggctggtcatgctggagcttcatggttgcgaggggagctacgacggcatctcggctgtggtgcgctgctgtgcgatgcttgaggagctcaccatctctgaccacaggatggacggcgggtggcttgcctcgctagccttctgtgggaacctcaagaccctgctgctgcagagttgcagtaggatcaacgactttcctgtcccagcggtacaccttgtttcttgtctcactcttgagagcctgcatctgca

SEQ ID NO: 7056 - DNA, 439 bp, Zea mays
  Clone ID: LIB3279-038-P1-K1-B5
gggcgcagcgtttatggcggcgacaccggcggacgcgaagaccgaggccgccaagatggacctcctcgaggacgacgacgagttcgaagagttcgagatcgaccaagaatgggatgagaaggaagaaggcaatgaagctgtccagcagtgggaggatgattgggatgacgatgatgtgaatgatgatttctcgctgcagctgaggaaagaactggagggaagcaacgcccagaagagctgaagtattatttctccagtttacaaatgatccttctatgccagctacttctggaaatcggaacctttatgtgatttgtgctgctgggagcaatcgaactctggagtaagaaagtaaccataccagtgatttctaagtatgaacggcaggaagttgacggacatcagtcggctatttaaaaaatatctcagttgtggttag

SEQ ID NO: 7057 - DNA, 471 bp, Zea mays
  Clone ID: LIB3279-038-P1-K1-B6
cggacgcgtaggaactgttcgtagtttcttcatcttttaagctaaagatgatgaccgtagagatggagcatcatttcagctgtgcagatataatattccatagaattaccatatcttaaatagcaataatgttatggggaatttcattccccaagttatcatgcaacttcaagttctgcaatttagagtccattagcagttcctccccagattcattcattggagtcttccccttcctcatggatcgatcttcttttcctgtcattgttaaatgtggtttcctcagtgttctacataaagatttgtgatgaactcagccttaaatttaaactaaatgcgtacttttttgtctggcttgagttttattatatagagacagtaaataaatggaaaataatttatgaattttaatatgtgcttttatatgcaattggtttaatcttgctcagatgaagtctaccattttttaaa

SEQ ID NO: 7058 - DNA, 324 bp, Zea mays
  Clone ID: LIB3279-038-P1-K1-B7
cgcgtccgcggacgcgctagagctgtagaaacttcattgacctcgcatgctatacatcaagagggcggggatccagcggtagttgttcacaccaatacttacccatcatgacaatacacatgccaaggaaggagatatgttgatcggggctgccagtccggatggcatcatgcatctctttctggacaaattcaacctggatcagcaacaccttcacaaagggatggaaggcaggcccgctgccgcatcagattgctgctctgctgcatgacctccacagattgacgcttgctaagagcgcgactggtagcaagatcctggcgc

SEQ ID NO: 7059 - DNA, 204 bp, Zea mays
  Clone ID: LIB3279-038-P1-K1-B8
accaatcaatataaaaaaaaaaaaaaaaaaaaaaaaaaaaaacaaaaaaaaaaagagagcgagtataaaaggatatgaggttaaaaccaattcaatcccctggtggggtatgctcaatcgttggaaccggtatttttttatggggtgctgcgttcacgaggacattcttggaggttgccgtaggcgctattcagccggtgctcg

SEQ ID NO: 7060 - DNA, 406 bp, Zea mays
  Clone ID: LIB3279-038-P1-K1-B9
atctcccctcccttccctcttctggtctccgccccgctccttgcctccgatccccaattcgtccttcggatctcgcattcagcgcagcgcaagtgtgaaggaagggggacgcggaggaagatggggctcgcgttcgggaagctcttcagccggctcttcgccaagaaggagatgcggatcctcatggtcggcctcgacgccgccggtaaaaccaccatcctctacaagctcaagctcggcgagatcgtcaccaccatccccaccatcggtttcaatgttgaaactgttgagtacaagaacattagcttcactgtctgggatgtcgggggtcaggacaagatcagacctctttggaggcattacttccagaacacccatggtcttatttttgttggggacagcaatg

SEQ ID NO: 7061 - DNA, 466 bp, Zea mays
  Clone ID: LIB3279-038-P1-K1-C1
aatttttgttaagaatttacctttcgaagcaactgttgaaatggtcgaacaagagttcaggaaggggggtgctattaaatctggtggtgtacaagtcaaatgccagcctgatcagttttgctttggctttgtcgaatttgagtctcagcaatccatgctagcagcaatcgaggcttctagggtttatttcggcacaagagaatcatatgttgaggagaaaagaaccaaaacacgagttgttgatggtgttatcacccgtggggatgacaatggcaatggcggtggcggtcggttccattctggcagaggtggtggttactatggggacggctacaagcggctgtggggcggtcagaacaacggctactacaacggcggggataacatgaggaacgactactcatgtcgtgtccgtggaccgcatgggaacggccaccctcagaacggccactgctaccatcagaac

SEQ ID NO: 7062 - DNA, 325 bp, Zea mays
  Clone ID: LIB3279-038-P1-K1-C10
gtcgcttgcgcatgctatggacgtcgcgcgaccgccgccgtcggcgtccctgcagcgagcgatggctccgccgtaacttaaggttgacaccaatgcaccgccttggttagtgtgcacagccggcagacgggcttctactcatcggcgcctccgttcatgacgtcttacgggatatgactgaagacagttaccaccgaggtggaggagatgattaccaaggctgagaagaacggccagatgcatactgagatgggcggtctagctcatgaccagcacgggatgcgagttgtcatgagcgtgactgggagcaagatcctaatgatac

SEQ ID NO: 7063 - DNA, 408 bp, Zea mays
  Clone ID: LIB3279-038-P1-K1-C11
ctccgccgccgcaacaaccatttccttctctagccgccgcctccgatcccctcccgaggctacagaaccagttcatccaggcgcgaatggcggcggcgaaggagcctggttttggaggccctccgcttggggggggcccccgcaggggggttcgggagggccgccgggttgttgcatggaggcctgggggggcaggggggggtgtcttcggaggatgccaagggctctttcctggataagagcgaggtcactgaacgcatcatcaaggtcgtcaagagcttcccgaagatcgatgacccctccaaggtgacaccagatgcccatttcaagaatgatcttggcctatacagtttggatgcagtagaggttgtcatggccctgggagaggaattcagattcgagatacct

SEQ ID NO: 7064 - DNA, 468 bp, Zea mays
  Clone ID: LIB3279-038-P1-K1-C2
ggggaaaccaactagtccccaaagtcaataaagcggctacacgtttcgtccaagttcaaatgccagccagagattatcgaagcaacgagcgccgctccccttcacccctccgcctccctccaaaactcaaattgacctagcgagaagcagaagaggcgaagagcgataacgaacctctctcacatcgatttccccaaatcgcctggcgcgatgaccacggcaggagaggtggattcggcagcaggaggtgaggacctggagccgctcttcgactacaagcgagtgcagcccaggacgacgttctgctttgacgacagcgacttggaggtggccgacatcttcaaatactgcaacaagcgcccaaaggtccacacctccacggaggaggagggtaagcctgacgaggaggtcgccgctgccaaggtggtggtcctcgatgaggaggattggttgcagccaccgccaccc

SEQ ID NO: 7065 - DNA, 340 bp, Zea mays
  Clone ID: LIB3279-038-P1-K1-C3
cggacgcccaccagcagctgcccccttgctgtcgccgcctctccgcgcgaccgatctaccgccggcgccaccatgtcgctgatcgccggcgaggacttccaacatattctgcgtctgctgaacaccaacgtggatgggaagcagaagatcatgttcgccatgacctccataaagggtgttgggcgccgcttctccaacatcgtctgcaagaaggccgacatcgacatgaacaagagggccggtgagctgacgcctgaagagctggagcgcctgatgacggtcgtggccaaccctaggcagttcaaggtgccggactggttcctcaacaggaagaaggttt

SEQ ID NO: 7066 - DNA, 399 bp, Zea mays
  Clone ID: LIB3279-038-P1-K1-C4
cctcgatccgatccgccgagtgcacaccacctttcccactccgatcgaatcgatggccggcggagggcgagaagaagatgattaccctcaaaagctccgatggcgaggagttcgaggtggaagaagcggtggcgatggaatcgcataccattcgccacatgatcgaggatgactgggccgacaacggcattcctcttcctaacgttaactccaagatcctatccaaggtaatcgagtactgcaacaagcacgtacatgccgtcggcgccgccgacgacgcctcgaaggccggttccgacgacgtgggtgccggctccgccaacagcaccgtcgtcttcggtgaggacctcaagaactgggatgcggtcttcgtcaaggtcgaccaggccacgcttttcc

SEQ ID NO: 7067 - DNA, 436 bp, Zea mays
  Clone ID: LIB3279-038-P1-K1-C5
cggacgcgtgggcgcattcgttccaactcctgagcactttctcctcgtcccagacaagccaatcgaagccgagatacgaccatggactccaccggcaccggagcagggggtaaggggaagaagggagcggccgggcgcaaggtcggcgggccaaggaagaagtcggtgtcgaggtccgtgaaggccggtctccagttccccgtcggccgcatcgggcgctacttgaagaagggccgctacgcgcagcgtgtcggcaccggcgcccccgtctacctcgccgctgtcctcgaatacctcgccgctgaggttctggagctcgccggtaatgctgccagggacaacaagaagactcgcattattccgcgccacgtgcttctggcgatccggaacgacgaggaggctgggaaagctgtgggcggcgtgaccatcgctcacg

SEQ ID NO: 7068 - DNA, 436 bp, Zea mays
  Clone ID: LIB3279-038-P1-K1-C6
aaaaaagaagtgcggtcagcttgctgctcagctcaaggcatggaagaaccagcagcatctaccctaaatgtgaaggggaatgtgtttgtcgatcacaggacagcgaccaaagcctacctgtctggggcatcattaagaccgaggacacggaggtacacgacaacgaccaatactgacagaaaaccgaaggttacaaggaagcacggatgcatataatgtctgtctagtgggctggctaactcatggttgagttgttaaaaagaagtttagcatgtaaatcttaggcgtgtgtgctacttagctactagacagaatggttgtcatgtgcaagcaaggaagatgacttgggtgattcctgctgttaatttgctatgcaaaatgtcacgtaaggcccttatgatccagccttgagcatcaaataaaactgtagaactcg

SEQ ID NO: 7069 - DNA, 447 bp, Zea mays
  Clone ID: LIB3279-038-P1-K1-C7
cggacgcgtggggaaaaaacttcagatctcagggatctctgggaggaaaccagctgccaggtggaggagttacaacgactgaaatcttgtgtcaaacttgagaaagaaggattaaaatgcacaacatcgccatcgtggtctctgtcttttactcccaaattcacagatgagaaactgttgattgcttcctcgaaaccaaaggtcgctatcattcgtgaagaagggagcaatggggacagggaaatggctgctgcattccacgctgctggatttgaaccatgggatatcacaatgtcagacctcttggccgggaagtcttcgctaacacagttccgtgggattgcgtttgttggtggtttcagttatgcacatgtgctggattcagcaaaaggttgggctgcatcaatcaggtttaacaaacccctcattcagcaatttcaggaattc

SEQ ID NO: 7070 - DNA, 460 bp, Zea mays
  Clone ID: LIB3279-038-P1-K1-C8
accttccccttccccatcaggcatggaatgtccgccgctgctcctccacaagtcggatgagctcaagcggaggtcctcttgaactgacaaatcggcgaagcgcggtgatggctgtctttgctagtgatgtcggatatgatggcggtgacaagggaaattggtggtccagtctttgggtagctgactttctccaggtagcaagatattgctgtgtttgtttgatcagtcaaagcatcaaacagacagacctacgttcatgtgaactgcctcatgcatgtgctagattgaaaaaaaagttatcatattttggcatgagactatgattctactagctagcatccttagcacacttgagatgttgttgactcgcgtcctagagtagagtcctctgggttgatccatgtatgcacagtgattcttgtccggactgggacatgttaacaccagatgtttcaagctt

SEQ ID NO: 7071 - DNA, 468 bp, Zea mays
  Clone ID: LIB3279-038-P1-K1-C9
cgttcctgctgaagacgtacgagatggtggacgacccgtcgagcgacgcggtggtgtcatggagcgacgcatccgacgggagcttcgtcgtctggaaccagcccgagttcgccgcgcggatgctgcctacctacttcaagcacaacaacttctccagcttcatccgccagctcaacacatacggttttcgcaaaatagacccagagcgctgggaatttgctaatgagtactttgtcaagggacagaagcacctgctgaagaatatccacaggaggaaacccatccacagccatagccatcagccaggtgccctgcctgacaatgagcgtgcgttatttgaggatgagattgacaggctttcacgagagaaagctgccctccaggctgacctctggaaattcaatcagcagcagtcaggtgctgtgaaccagttagaagatcttgagcggcgagtgcttgacatggagc

SEQ ID NO: 7072 - DNA, 152 bp, Zea mays
  Clone ID: LIB3279-038-P1-K1-D1
tcaccattcgttccaactcctgtacacttgatcctggtgccagactagccaatagtaacgggaaggggaccatggactcgaccggcgccaaaccagggggtcaggggaagaagggagcggccgatcacaaggtcacgcggccaaggaagaag

SEQ ID NO: 7073 - DNA, 419 bp, Zea mays
  Clone ID: LIB3279-038-P1-K1-D10
atctttaaaactagatgagtctgtttatgcatagaagagataagacttatttcatcgtgggggtgagacgagacatggaggacaaatatatctgtacgcgacgcacgacacactaagcttgagctgagctgaaactcagataacatcattaacctctgcgtgctattatcaaccccaaacatgttgttggactcggatccggaaagaattcgtactgttatcaccaccaaacatgttgtttgacttcactttggtgctgaagcgttcccaatccctcgggactcaaacgtgatacaattactagtgtcaggaggctagtaaacacatctatacatcagatgatttcagatctgctgaaacgagacaaacctataaaggtggcgatcaactttaagaggtggtgcacaactcgggacata

SEQ ID NO: 7074 - DNA, 403 bp, Zea mays
  Clone ID: LIB3279-038-P1-K1-D11
ttcttctcaatccttggtaaattcggggctgttttcgcatcaattcccggcccagttatggcagctgtatactgtcttctcttcgcatatgttggtatggcaggtgttgggttcctacagttctgcaacctgaacagcttccgaacaaagttcatcctgggattctccttgtttatgggtctatcggtgccacagtatttcaacgaatacacttccgtcgcgggctttggtccagtgcacacgcgtgcaagatggttcaacgatatgatcaacgtggtgttctcctcgaaggcgcttgttggcggggcggtggcgtattttctggacaacaccctgcacaggcgagatggcgtcgcgaggaatgaccggggccaccatttctgggacaggttcaggtccttca

SEQ ID NO: 7075 - DNA, 397 bp, Zea mays
  Clone ID: LIB3279-038-P1-K1-D12
atattttgctggaaagtggagaaattaacagagctctattgggacaaatcgtattttgtgacccatcaaaacgtcaacttctaaaccgtcttctggcaccacatatttcttatagcattgtctgggagatagcaaaactgtggatgaaaggctgcaaggttatcatccttgacatcccgctgctgtttgagacaaagatggatagatggacgaatccaatcattgttctctgggttgatccaaaagtccagattgagaggctcatttcaagagatggatgctctgaaggacaagctcagaataggatcaatgcacagcttgcactagactggaagaaatcagaagcagacatagtgattgacaattctggttccctggatgacaccaaacagcaatt

SEQ ID NO: 7076 - DNA, 474 bp, Zea mays
  Clone ID: LIB3279-038-P1-K1-D2
ctaaattcttcaggctgcttagatgattctgggtacgtcccgccatgttcagataattctgacaaagtgaaccgaccaccagcgaccttcgtgaaggtttacaaatctggaacctacgggaggtcgcttgatatcactaggtttagcagctatcacgagctccgtagggaactggggcgcctatttggccttgagggccagttggaagacccattgagatcaggctggcagcttgtattcgtcgaccgtgaggaggacgtccttctcgtgggcgacgacccttggcaggaattcgtgagcacggtgtcctgcataaagatcctctccccgcaggaggtgcagcagatggggaagcagggcctggagctcctgagctcggcccccgcgcggaggctcggtagcagctgtgacgactacgtcagcaggcaggagtcgagaagcctgagcaccgggatcgcgtccgtcggttcggtc

SEQ ID NO: 7077 - DNA, 179 bp, Zea mays
  Clone ID: LIB3279-038-P1-K1-D3
accgccgtcgccgcccaaccgcagtaaggaggaaggagcatgaagatgccggcggggcacgggctgcggtcgcggccccgcaacctgttcgcccggcccttccgaaagaaggggtccttccaattaaccaggtacctggccacctacaaaatcggggactacgtcgacgtaaaggttaa

SEQ ID NO: 7078 - DNA, 457 bp, Zea mays
  Clone ID: LIB3279-038-P1-K1-D5
cccacgcgtccgcccacgcgtccgcgccgccgccgtcgccgcccaaaaccctacctaccctgttgtccccctcactctcctttcatctccattctaatggcggcccaacccgtccggcgaagctgctagtgcttgtatctactatcttcatcaggtacttcgcgatcctactgaagtattccccgccgccgctgccatggccaccctcaaccctttcgaactcctcggcgccgacgacaacgacgacccgtcgctgttgattgcggcggcggcggctgctgctcagaaagccgaggcgaagaagtccgccgtggcgcctgctgggaaggctgcccagcctgcggcgaccaccaagttcccgaccaagcccgctcctccctcgcagacggttcgggatgcacgcggcggtggctcatcagctcgtggaggctttggccgtggtgaacgtggccgtggc

SEQ ID NO: 7079 - DNA, 474 bp, Zea mays
  Clone ID: LIB3279-038-P1-K1-D6
gtcatcgatctcgtttcaaatccatccatcctcgtttcctccgtcccgcagcatctcaaccccatggccaagatcaagatcgggatcaatgggttcggcaggatcggaaggctggtggccagggtggccctgcagagtgacgatgtcgagctcgtcgccgtgaacgaccccttcatcagcaccgactacatgacctacatgttcaagtacgacactgtgcacggacagtggaagcaccatgaagtcaaggtgaaggactccaaaacccttctctttggtgagaaggaggttgctgtgtttggctgcaggaaccctgaggagatcccgtggggttcggttggtgctgaatatgttgttgagtctactggtgttttcactgaccaggagaaggctgcagctcacttgaagggtggtgccaagaaagttgtcatctctgctcctagcaaggatgcccccatgtttgtcgttggtgtc

SEQ ID NO: 7080 - DNA, 428 bp, Zea mays
  Clone ID: LIB3279-038-P1-K1-D7
cccacgcgtccgcccacgcgtccgcctgaagcggctcaactgctccagattttctggagggtgaaattttggtagtccttgctcagccatgggtagtaggagatatgacattgatacgaggagatgtgggatccactcaagaccaaccaaatcaatgtatctggatgctcaacaaatcgtcagctgccaaactagagtgggagaccacgatgttggttcctgtgctgtgaagcatcacttcccgtctccaatcgtatcttggatagaagatctttccagctttgagcaatgcttcttttaatcctgtctctgaatatgtggatgagcaagccagagcttcagtgggacaagtcttagcatcaagtaatgtgcatgacatgcaaatatcagtgagattgacagccgaattcatggagcttgcaaaggag

SEQ ID NO: 7081 - DNA, 330 bp, Zea mays
  Clone ID: LIB3279-038-P1-K1-D8
cccacgcgtccggcggcggagcggagatggttgccgtggcggtggatggcctgatccgcggtgcggacgccgtgccggcggcggagagggaagcggtgagggcggcagctgccgaggcggcggccaagggcggtgagggggaatcggggaaggaggaggtgagggagtatgagagcgacatgaggatgctggaggagctgctttctaagctgaacccctcggcggaggagttcgcgcctcactcccgccgccgcgtgtacggcggcactccccgccttttggacgacgcgcccgtgttattgtcgccgtgaatctgctactacgcgcgcc

SEQ ID NO: 7082 - DNA, 465 bp, Zea mays
  Clone ID: LIB3279-038-P1-K1-E1
caaattttcagcctgggacatacattgaccaacgtgagaaacatgtcaagtatagcgattggatcaacaaagagctgatactcttctcaatggcagacctgcagcgatcaataccttcaatggttgatggccttaaaccaggccagaggaaaattctgttttgctcattcaagaggaattttgttaaggaagctaaggtggctcagttctctggttatgtgtcagaacactcagcataccatcatggtgagcagagtttagcaggtacaattattggaatggctcagaactttgttggcagcaataacatcaaccttatgtaccctagtggtcagtttggcaccagagctcaggggggcaaggatgctgcgagtcctatgtacatcttcaccaagctgtgtcatatcacacgtacaatttttccgaaggatgatgatattcttcttaattatctgaatgaggatg

SEQ ID NO: 7083 - DNA, 380 bp, Zea mays
  Clone ID: LIB3279-038-P1-K1-E10
tcgacccacgcgatcgcgaactatcacttgtcccttccaccagtaaagctccattgcagcatgcttgccgaggatgcgagtaaagctgctgtaaaagactacgaagccaagaagtcaaagatggggcagaagggtgaagacagcccttcacagaaggctgctgaagcatgaaaggttctgccgtgaagtatattgtgctgatacgtttctcagtccatgactccccgccgcatattgccaaagataaatgcttctgtttgtgaggcgagggattgtgtgtaatgttcacgaactgtggtagtgcggcatgtgactcaactgttttaaggatggtgatgaccaatttcaaatataattgctgccatcgtagaattagaagt

SEQ ID NO: 7084 - DNA, 462 bp, Zea mays
  Clone ID: LIB3279-038-P1-K1-E11
attttaacaaagatttcattcctttcttgtttacatggcatcttagaaatacaaatatgatgcctacccactgagaaccaatgagaatagcctaagggtcttgtggattttgaaaaggttgttgtgagttgtggattgtggaaaacaagggcggactcatggcctagcgagcgtgggcacttgcccaggctcatccattagtgcaaatagacttatatatgtgtaccaagcaataaaatgcaactaaacaaaggcaaaaactgggcaagacgatatctttatagtatgagtattatattttcttaggcttttgaagatttctgggtcttccactggtggaaaagtagtcgtgggttatggaatgtgcgaaagttaagaatcgtttggttcaatagttgtggcttctaaaaaactgccgttagcctcgctcagtgacaagtggaccctgtctgtcttgtcttc

SEQ ID NO: 7085 - DNA, 406 bp, Zea mays
  Clone ID: LIB3279-038-P1-K1-E12
cccacgcgtccgcggacgcgtgggtactttgcacggaggcatccgtcaaaatacacgaagggcaacgaggcgaggcctagtatagaggaaaacgagtgagaggggggaaatgctgcgccacgccgcccgccgtctcgtctcccgcaccgccgcggcgcccaccgcccgccgggcgctcgtcacggcagaggtgcctgcggaggccgccgaggactccacgtttgtggagacgtggaagaaggtcgcccccaacatcgagcccccaacgacgcccctctttctcatgcagccgcgcccgcccacgccggctaccatccccactaagctcaccgtcaacttcgtcctcccctacaagtccgagatcgccaacaaggaggtggacatggtaattgtaccagctacaact

SEQ ID NO: 7086 - DNA, 467 bp, Zea mays
  unsure (1)..(467): unsure at all n locations; Clone ID: LIB3279-038-P1-K1-E2
cttaactgggtctgccgataactctgtccgaatgtgggatcgtcggaatctgggttcaggaggagctggttctccaattcacaaatttgaaggccataaagctgctgttctttgtgttcagtggtcacctgacagagcatctgtttttggaagttctgcagaagatggtttcttaaacgtgtgggatcatgagaaggtggggaagaagaaaaattctaatgtcccagccgggcttttctttcagcatgctggtcatagggataagattgtagacttccactggaattcgtcagatccttggacaattgtcagtgtctctgatgatggcgagagcactggtggaggtggaacactgcagatttggcgcatgagtgatttgatctaccgcccagaggatgaagttcttgcagagctggagaatntcaaggctcacttggccagctgtgcaccgaaagattgagtcatgt

SEQ ID NO: 7087 - DNA, 477 bp, Zea mays
  Clone ID: LIB3279-038-P1-K1-E3
aagtaaaatgttcggatctcatgcaacgatgatggccaacacccttcgcacaccaatcattgtatttacacagacaggctccatggctgtcctcctgagccactatcgtccctcgtctacactatttgcatttacaaacgaggaacgagtgaagcaacggctagcactctaccagggcgtcatccctattcacatgcagttctctgacgacgcagaagaaactttctccagagcaattagcagcttgctgaaagcacaatatgtgaagaagggagactacgtcactcttgttcagagcggagtgacttcaatctggagagaggaatccactcaccacatccaagtgaggaaagttcaggtctgatgtgccggtgggaattggtcgtctgagaaattttgatagcgccgcctgatgtgttatcatcattatatgtgtaattttactgttttaccaggagattgctacgtcgagttata

SEQ ID NO: 7088 - DNA, 453 bp, Zea mays
  Clone ID: LIB3279-038-P1-K1-E5
caactatccatccactaccggctccctccctcctcctgaaaaccccgaccgcgggcgaacgaaaccctagcgagcgaggcgatcagcgtccggcgaccggcgacagagcgcattggagacgcgcccggcgccttgcgacctcgaggcggccgtgcccgcgggctccggggctgcaacggcggcggcggcgcatcaggaggcacccgcggcgaaaaaagtggcggaggaggaggatccgcgcctgcgctgggccttcgtgcggaaggtgtacgccattctctcccttcagttcgcgctcaccgcggccgtcgcggtcaccgggtgccttgttcgcccgatcccgcgcttgttcggcttcggtccccccgccggcgtgtggttcacgttcattgcgatcctcctgtccccggtcatcgtcatgttccccatgctcaagtacagggagaagcaccc

SEQ ID NO: 7089 - DNA, 428 bp, Zea mays
  unsure (1)..(428): unsure at all n locations; Clone ID: LIB3279-038-P1-K1-E6
gccgacatatncatccagtaccgtctcccttcgtatggctaaaaaccctgaccgtggtctaacggtggggtatcgagcgaggcgatcagcttccctctaccgacgacagagcgcataggatacactcccggcgccttgcaaccttgaggcggccatgcccgcggtctcacggtctgcaacggcggctgttgcacagcatgaggcacccgtggaatagacttatatatgtgtaccaagcaataaaatgcaactaaacaaaggcaaaaactgggcaagacgatatctttatagtatgagtattatattttcttaggcttttgaagatttctgggtcttccactggtggaaaagtagtcgtgggttatggaatgtgcgaaagttaagaatcgcttggttcaattagtggggcttcttaaaaactggcgtta

SEQ ID NO: 7090 - DNA, 448 bp, Zea mays
  Clone ID: LIB3279-038-P1-K1-E7
gccgctcctctcccaacccagtcgctcaaaaccctagagctctcgcctgctcgcctgcgccgccggagcgagctccccatcttcatccgtcaaccatggcgacccagatcagcaagaagaagaagttcgtcagcgacggtgttttctacgccgagctcaacgagatgctgacgcgggagctggcggaggacggctactctggcgtggaggtgcgcgtcacgccgatgcgcacggagatcatcatccgcgccacgcgcacgcagaacgtgctcggcgagaagggccgtaggatcagggagctcacctccgtcgtccagaagaggttcaacttccctgagaatggcgtagagctttacgccgagaaggtcgtcaaccgtggcctctgtgccatcgcgcaggccgagtccctccgttacaagctcctcggaggccttgccgtccgcagggc

SEQ ID NO: 7091 - DNA, 339 bp, Zea mays
  Clone ID: LIB3279-038-P1-K1-E8
ctcgaattacgattcccaatccagcaaaccctaccagccttttgcaaactcagagagggacccgatggcacccaaggcggagaagaagccggcggcgaagaagcccgcagaggaggagcccgcggccccggcggagaaggcccccgctgggaagaagccgaaggcggagaagcggctcccggcgggaaaatccgccggcaaggaaggcggtgttgacaagaaggggcggaagaaggccaagaagagcgtggagacgtacaagatctacatcttcaatgtgctgaagcaggtgcacccggacatcggcatctcctccaaggccatgtccatcatgaactc

SEQ ID NO: 7092 - DNA, 467 bp, Zea mays
  Clone ID: LIB3279-038-P1-K1-E9
cccacgcgtccgagaaaaccctagccgccgccaccgaagcggcctcccaggtaagcaggatcgtccagcccgccgccgccatgaagcgcaatccccgcgtcacgagctcccgccggaagtgccgcaaggcgcactttacggccccgtcctccgtccgccgcgttctcatgtccgcggggctgtcgacggagctccgccacaagtacaacgtgcgctccatcccgatccgcaaggacgacgaggtgcaggtcgtgcgcggcacctacaagggccgtgaggggaaggtggtgcaggtgtaccgccgccgctgggtcatccacgtcgagcggatcacccgcgagaaggtgaacggctccaccgtgaacgtgggcatccacccctccaaggtgatcgtcaccaagctgaagctcgacaaggaccgtaaggcgctcctcgaccgcaaggcccggggccgcgccggcgacaag

SEQ ID NO: 7093 - DNA, 470 bp, Zea mays
  Clone ID: LIB3279-038-P1-K1-F1
ctttccccgtgcttctccgccgccgaggccgcgtcccagtgcgaggagactccaactcagagggcgcagccgctgggtccggcccgaggtgtacccgctgttcgcggcgacgggcgtggccgtcggcatctgcgggtttcagctcttccggaacatcactggcaacccggaagtcagggtaaacaaggcagggagggcagctggtgtgcttgagaaccatgaggaggggagacgttacgccatgcatggcctaagaagctttgtgcacgacaagactcctgagatcatgcctgcagttaacaagttcttcactgaccctaagtgaagcatgttgattggcatactactactactacttgctactggggattttacactgtgctggcaactcaatatgttggggacatccatgacctctaaaagtactttgagcgcttgggatgacttggtatatgtatgatggtggatga

SEQ ID NO: 7094 - DNA, 364 bp, Zea mays
  Clone ID: LIB3279-038-P1-K1-F10
tttttaaagagccgttataggccgagtggagggataattacaaccatataatatcatccgattgcacgtagctgaatccccaagacactagcagacaagttgcaaaccaatatccatccaccaacgcagcaccaaagtgctccagacaacaccctcaccgcctactaataaaaaccacacttgagatatcaacaccaacatgtggcctgcgcacacataacctctaggcagctcaatggaaaatactgcatcaaccaacatcaacaggccattctactgctgcttgcactccgctggttgttccgcatttccctgcgacaccttctgtggcgccttatgtctgcgaccagatcctgacttcctt

SEQ ID NO: 7095 - DNA, 357 bp, Zea mays
  Clone ID: LIB3279-038-P1-K1-F11
gcccccacagtgccgtaccccgaccagccatgcgcatcttcgtgctgtccgggcagagtaggcatggccggccgcggcggcgtacaccacaagcactgggacggcgtggtgcccccagaatgcgcgccggatccgtccatcctccgcctttcctcggcgcagcaatgggagggagcccgcgagccgctccacgccgacatcgacacaaccaagacctgtggcatcgggcccgggatggcattcgcccgggcctgggttttgcgccttgaaggaggcccccctggcgccgggacccaaatcgggatccggcctgggccctgcccccgttgccggaccggccttccggaggggtccctt

SEQ ID NO: 7096 - DNA, 457 bp, Zea mays
  Clone ID: LIB3279-038-P1-K1-F12
cctgaagtcaccgccggccgagaacaagacgatgaagagggcgtcgatgatctcgatccgggtcacgacattcttctacctctgctgcggctgcttgggctacgccgccttcggcagcgacgcgccgggcaacctccttaccggcttcggcttgtacggtccgtactggctcatcgacttcgccaacgcgtgcatcatcctccacctgctgggcgggtaccaggtgtacagccagccgatattccagttcgcggagcggctcttggcggagcggttcccggacagcgggttcgtgaacggcggctcctacaccgtccggttcgcgtgcctgcgggcgtgccgggtgaacccgctgcgcgtgtgcctccggacgctgtacgtggcgtccacgacggcggtggccgtggcgttaccctacttcaacgaggtgctggcgctgctgggcgcgctcagcttc

SEQ ID NO: 7097 - DNA, 438 bp, Zea mays
  Clone ID: LIB3279-038-P1-K1-F2
gtaggctcaccggtcgcgaccaaattctcccagagacggtcggaaatgacgagccatgcgctggggttcctcacgatcgcccttctgaccgtgctcgcgcgatccagcaacaggcaccaccaccaccaccactcccacgatcaaagcacagggcatgggtgcacgcatcaggaggaggaggaggacagaggggagctggccagccggtcgcctggaccaccacgcgcagggccgaccttgcacagctcgtggggttggacgatgtgtgcaccacaggtgtgccgataccttgcctcggggccacagggtcgccactgaccctgaatgaactgtgtcaagtgcaatattactactactacttggtactgcgaatgcatcacctctgctggcaacttaatgtgtgggggacatccatgagcctgtaaagtactttgagcg

SEQ ID NO: 7098 - DNA, 470 bp, Zea mays
  Clone ID: LIB3279-038-P1-K1-F4
attttggagtctggtgtgttaaggcagcctatgcggtcaaggggactgcttgctcggccttatattcattcaatgcttgctatagcagcagtctgcgtatgcgtctgtgtattcatgcgagctttgctgcggatcaattctggaaaatccttcaagtgggagaggctggattacggtacaatataattgtggggacacacctgagccttgtggtattattaagttaacaagcagttgttatggagctattttggagccttgaagggtatggagattgtttcatgcttcctcgaaactcgcccatccgtatggctgagtggaataatgtaatatttttgctggacaattcctttacttcctgtgaaatagaagtgttaataggtgagcagccggagatgttaggggggtggcaaaacttggtaccaaatgtggagcttgagcagagttggaacatgtcatggcaagggccg

SEQ ID NO: 7099 - DNA, 468 bp, Zea mays
  Clone ID: LIB3279-038-P1-K1-F5
caatcgtaaaggattttgctatgttgaatttgtttcagctgaagctgctgcaaaggcatataaagagaagcaatcaaaggagctgcatggtcgtgaagtaagacttgacttcgctaaaggaagaagtacacaaactcctcgcagcggcaatgatggatctttccagaaggctgctcggggtaacagcagctcaatatttatccggggctttgataaaaatctttcagaggatgagatccggagctctctcgaacaacattttagtgattgtggtgagatgacaagggtctctatcccgactgatcatgaatctggtgcaataaaaggaatggcttacatagacttcaaggatcaggactctgtgtctaaagcccttgagctcagtggctctgacattggtggtggtatgagctttatgttgatgaagccaaaccaagaggcgatggccagcgtggtggtggtagatct

SEQ ID NO: 7100 - DNA, 478 bp, Zea mays
  Clone ID: LIB3279-038-P1-K1-F6
agcagcctccttgaaacctccagatctgtgcctccaaggcccccgttcctcggcaacaagccgggcagatggacaccggcgcgcccctgcaactgaaagcctgcgccggcgacgccgcggagaagctgctgctcgccgtcgcagccgagggtcctatctgtggtgtgccagacttcaagatgaggggaaagaagagtgatgagctcgaacctgtcgatgctggcgatgaagatgatgatggtggtgacgatggggacgaggatggtgactttggggaggagggtgaagaggacgtctcacaaggggagggatatgacaacccaaagggcaatgagaccaagaagcaaagaggtgatcctgaggaaaatggtgaggaagatgaggaagaaccagaagatcaggagggtggcggccacgacgacgacgatgacgatgatgagaacggggatgacgaggacgacgacaatggggatgacga

SEQ ID NO: 7101 - DNA, 468 bp, Zea mays
  Clone ID: LIB3279-038-P1-K1-F7
cgcgaatccagagccccacgccccgtccgaaccccagagcagagcaaagcctcctggacctgcctgtccccagccttccccgatggcccgcacgaagcagacggcgcgcaagtcgacgggcggcaaggcgccgcggaagcagctggcgacgaaggcggcgcgcaagtcggcgccggcgacgggcggcgtgaagaagccgcaccgcttccgcccgggcaccgtcgcgctgcgcgagatccgcaagtaccagaagagcacggagctgctgatccgcaagctcccgttccagcgcctggtccgcgagatcgcgcaggacttcaagacggacctccgcttccagtcctccgccgtcgccgcgctgcaggaggccgccgaggcctacctggtgggcctcttcgaggacaccaacctctgtgccatccacgccaagcgcgtcaccatcatgcccaaggacatccagctcgcgcg

SEQ ID NO: 7102 - DNA, 351 bp, Zea mays
  Clone ID: LIB3279-038-P1-K1-F8
gtcttcctctgactgctcatcgccaatcctaaagggacacaacacagagaatcacaaaagggaaaaggacgatggtcaaaagaaatgctcaccgataagaccccaccctttgcttcacttggtattagattctgttatatgctgatggaacatacaaaaaataaaataaaaccaaggacttcactttaaggatatgaaattttagcaaaatcatgtcagcttttgcaactaaaagttgtcaaaggtaattcctacatctgttaattatttgctttgagaactcccccaatgtacctgttgaactggataaatctcatacagctgcaaacataatactccactttcgaactg

SEQ ID NO: 7103 - DNA, 451 bp, Zea mays
  Clone ID: LIB3279-038-P1-K1-F9
gctgaatcggctcacacgcttgctcatactccgagtgcggcgctctcagcctgaagctccgaggccaggcagagctcggcgcctcctcgcacgggaccgttgcccaggccgccgccgccgccgcaaccacgccgccctcgaggaacctcgccgccgtcctgaccgccggcgccggcgccgggttggctcggagggagcgcatgagggcggcgtgcgcgtgcagcggcaggccgcccacgaccacccgctgcgcgtggtacgaggatcgcttggcggcgctgcgctccctcttgtgcgcgttctggtgcccgcccagcgcctgcgagctgaagaacttgcgcaggcagaagttgcaggagaacaccttgtgcgggggcggcttggcggcgggcccgggcccggacccggacccggactcggagtccgcggagcagctcgcggcgtccgggga

SEQ ID NO: 7104 - DNA, 337 bp, Zea mays
  Clone ID: LIB3279-038-P1-K1-G1
tggagatcgtgcgcaagatggtgtccagcgcttgcggcggcacccctcttgacagacgcacggtggtcgccaggaaggtggacctcaccggtgtcgacggtcaggcgctcgccggccacggcctcgggagcaactaatcagtggggatcttggtgctgctccacaacgttttcagcaccgtaaagtcgaacttcgttggattggcctctgcttcaactccttattagccatcgtaacttacttacctacgtgtttacagattggcagtcattagcctaaggtttccaagggatgggttctttgttccagggctctaactactgccttagcccaattt

SEQ ID NO: 7105 - DNA, 461 bp, Zea mays
  Clone ID: LIB3279-038-P1-K1-G10
cggacgcgtggggtcgcattttctggagttcagcggctcggcggctcgcttcgcatttggtgctgcccacaaatctgatgctgagtttttaaacaagcctttggagaactataaggaaatgttcactgtctttggaaacaatatggctacaggaaagtatgcaaaaggatcaagtgaagctctaggtactgaagatagaaacagtatgggctgaacagagattgatgagggagatgttaatgctgttcctagtcctatagatgatattggggcttcatcctcagctcctaaacctaagaaggagggcaagggttcttattatggaaaggcagggctgattggagcattcaaagatggtgctgaaaggcttgcaatggctattgagaaagcttggtgagatgacctaccacctgacttgcttcaaacattgcaaagtgttccaggttttgatgacacacaca

SEQ ID NO: 7106 - DNA, 452 bp, Zea mays
  Clone ID: LIB3279-038-P1-K1-G11
ccctgctcgactcccacctcgtcccatccgccggcggcgccgagtccaaggtcttgtacgggaagatgaagggtgactaccacaggtaccttgctgagttcaagtctggtgcagagaggaaggatgctgcggagagcaccatgaatgcctacaaagctgctcaggacattgctcttgcagatctggctccaacccaccccatcaggcttggccttgctctcaacttctcagtgttctactacgagatcctgaactcccctgatcgcgcctgcaaccttgcaaaacaggccttcgatgaggcgatctctgagctagacagcctgggagaggagtcctacaaggacagcactctgatcatgcatctcctgcgcgacaacttgaccctatggacttccgacaccaacgaggatggcggcgacgagatcaaggatgctgctgccccgaaagaatct

SEQ ID NO: 7107 - DNA, 439 bp, Zea mays
  Clone ID: LIB3279-038-P1-K1-G12
acgcggacgcgtggggcagattctctccagtcagctcatgatcttttgcgatcagaggcgctgagattagaggtgagaactggtgctgcccatgctgaaggaggtatccatggactggtttcatacgtgaagaaggcattctagttccataatcaaacaaagaagtattggaacgattgaggatcgctgcatgatatggaagggggcgatgctcatttatcctacctggcaaaagctcagcagcttgtcagcaaaaatcgttgagttgggcagcaagtgttccatatactcggcgtgataataataataataaacctctggcatcgtaactgttgtataagctcacaacttgtcatctaaacttttttgcccaattttgttaaagagaaaacctcaattgttgatagatgtactttggcccgtcatgttttaacctacc

SEQ ID NO: 7108 - DNA, 470 bp, Zea mays
  Clone ID: LIB3279-038-P1-K1-G2
gcggcgcgggcggacaaggagcaggcggaggaggagttgtgccaagccacaatgggtatctggcgtgactcgatgcacaagcgccgagccaccggtggaaagcagaaggcctggaggaagaagcgaaagtatgagcttggtcgccagccagccaacaccaagttgtcaagcaataagacagtgaggagggtccgtgttcgtggaggtaatgtgaaatggagggctcttcgccttgatactggtaactactcatggggaagtgaagctgttacccgcaagacccgtatcctcgacgtggtctacaatgcatcaaacaatgagcttgtgaggacacaaacccttgtgaagagtgccattgtgcaagttgatgctgccccattcaagcagtggtacctcactcactatggagttgacattggtaggaagaagaaaacccctgctgcaaagaaggataatgctgagggacaaga

SEQ ID NO: 7109 - DNA, 472 bp, Zea mays
  Clone ID: LIB3279-038-P1-K1-G3
cccacgcgtccgcccacgcgtccgctcttctttctttcctggcatcttggagacggcggcgagacgaggagaggactggaccatggctgcctcttcggctctcaggctaatcctgggctcctcgtcggcgtcgcgtcgccagattctgtccgagatgggatacaaattcacgcttcttgttgtttttttttgcgccctatcgtttgagatgtttgctttagtaatttcttctcccgcacctttcagttcattcattttcttttttctccgggggctttagagtgcggatatcgatgagaaagcgatcagaaaggagaacccagaggaactggtggtcgccttggctcatgcgaaagcagacgctattctggagaagatgcagaacaatgggatgatgaaagagattcttgattctcaagatactactctgatgataactgctgaccaggttgtgttgcatgatggagtgatt

SEQ ID NO: 7110 - DNA, 295 bp, Zea mays
  Clone ID: LIB3279-038-P1-K1-G4
gcagaagctaccggtaaggttcgccatggacagggccgggctggtcggcgcggacgggccgacccactgcggggcgttcgacgtcgcgtacatggcctgcctgcccaacatggtcgtcatggccccgtccgacgaggccgagctctgccacatggtcgccaccgccgcggcaatcgacgaccgcccgtcctgcttccgctacccgagaggcaacggcgttggcgtcccgttgccgcccaactacaaaggcactcccctcgaggtcggcaaaggcaggatcctgctggagggcgac

SEQ ID NO: 7111 - DNA, 474 bp, Zea mays
  Clone ID: LIB3279-038-P1-K1-G5
gaacgcagaggaagaggaggcggcgagagtaagaagcggaagtctgccaatggtggtcggtccaaggcattaaggaagcgcatgaagaggacacaccgtaccgtagcaaggcatttcgctttctgtaggtggagagcagtggcaggtacagtatggaaatcgaagacgaggcgaaggtgacgtcggttggctggcgactgaccagcaactattccacggcgcctataggtagaagaaccggcagaggcttttgtaatgcacacaagtatctgggatagagtttagggataaaatgagcaagaacagagtggaggaatggggaagtcacggttgatgtccatgggactttgggcacttttttgcatctttttgcattttagcctttttttggtttttttttcacaactataccctttgcagtttcatttcaaaaaatggacccttgatttggcgctgtatgtgaaagtagaaact

SEQ ID NO: 7112 - DNA, 407 bp, Zea mays
  unsure (1)..(407): unsure at all n locations; Clone ID: LIB3279-038-P1-K1-G6
gtttgacagcattgcatcacttgctgttgctcaaaacatgcgtgagctttatagattggggctagtcgatacaccactggccccttacttctcagagtgcattacatctgaggatttggatgacatgaatattgagattatgaggaacactctctacaaagcatatcttgaggacttctacaaattttgccagaaactaggtggtgcaacagctgagatcatgtgtgatctcctttcatttgaagctgacagaagagctgttaacattacaataaatagtattggtactgagttgacaagagatgaccgcaggaagctgtactccaactntggtttattgtatccatatggccacgaagaattggccgtttgtgaagatgttgaccaggttcgtggtgcaattggag

SEQ ID NO: 7113 - DNA, 465 bp, Zea mays
  Clone ID: LIB3279-038-P1-K1-G7
taaatatacagctgcacgtatttcctagaaacctcatgatgagtttgttcaaacaatgtaggcattttattatcttttttttataaacatggcattcctggtatgaatatgcagtcacttcattcgttgttattttggctcagctaaccatcaggaggtctggaggatcacaagtgccttggagaaccacaagtatgaaattgctgactgggaccttggtgccggaatatacgtagacttctacgttttgaagaactcaatgcaagaaagaaatgccatggatgattcgggttcacttgaggagatgagtgaatcatgcagaagtttctttggccgattaaacgagtcgttgttagtctggggaagcaaattacctgttgagtcaagggcatgctactcgaagatggcagaggagctatgtgcgcttctggtggacaccccaagcgagacgctgaacctacccat

SEQ ID NO: 7114 - DNA, 467 bp, Zea mays
  Clone ID: LIB3279-038-P1-K1-G8
cccacgcgtccggacaaccgctgcgtaaacgaatccatcgccatggcgtctcgtctggttgcggcggcggcctcctcctcctccctctcttcagcgtcccccctcgctcgcctaatctctcgccgcggccttgccggtgccgcagacggccatgggtctgcgaaggtgcccttgtggaaagatccgttgagcccgagcaagtggaaggaagagcactttgttctagcaagcctctcaatgtggggggttattttttatggtggttacaagctttttagtggaaagaaggaagccaagactgaggcgggatcaccacaggcataggtggcggagatggagttgtacccatatctgtggcctggcaacaatgttaaataaaaggaatgctttatgttgtgctttcaagttgataaattgtggcaacaagagattttgctttacctaggcaatatatggagaagctactc

SEQ ID NO: 7115 - DNA, 466 bp, Zea mays
  Clone ID: LIB3279-038-P1-K1-G9
ccactgctcgcactcactccaccgctgcccacttcttgtttgtattgtatccagactccagaggaagccgagagggccaatgaggcaaggcatgagctccccttccgccgccgcggcgctcgtgctcctcctggccctgctcgccggaggccagtgccgagaggcccatctcgacgccgcggacgccggcaccggcacggagaactacaccgccagcgacgccgccgtgtactggggcccctggcagagggcccgggccacctggtacggccagcccaacggcgccggccccgacgacaacggtggcgcgtgcggattcaagcacaccaaccagtaccccttcatgtccatgggctcctgcggcaaccagccattgttcaaggacggcaagggctgcggctcctgctacaagattcggtgcaggaaggacccgtcctgctccgggcggacggagacggtgatcatc

SEQ ID NO: 7116 - DNA, 464 bp, Zea mays
  Clone ID: LIB3279-038-P1-K1-H1
cggacgcgtgggaactgatttgcgtttccagagccatgcggtgcttgccctccaggaggctgctgaggcataccttgttggcctgtttgaggacaccaacctgtgcgccatccatgctaagcgtgtgaccatcatgccaaaggacattcagctggcaaggaggatccgcggcgagagggcctaatcgccacctcaaacatcgtgacaaaaacatgaagtcctggggttattgttaatctggtgccattgtaaggacatatgagtagggtttgttttgtggatcgcaagtttctcttctgctactgttgctgctacctttgctggtgttattgctagggtcgaatacttaagttaactatgcgctgacagtctggactagcagtgttatgtgcgctgctggaccttgcgcgcaatgctgtggccgatttgttcgttaatgtcaagaatggtgttacagtgcgtgt

SEQ ID NO: 7117 - DNA, 431 bp, Zea mays
  Clone ID: LIB3279-038-P1-K1-H10
ccatttcaaatccttcgatcgcacagcgccgcccgccctcacgcagctctctccgatggcgcgcacgaagcagacggcgaggaagtcgaccggcggcaaggcgccgcggaagcagctggccaccaaggcggcgcgaaagtcggccccggccaccggcggcgtgaagaagccgcacaggtttcgccccggcaccgtcgcgctccgcgagatccgcaagtaccagaagagcacggagctgctcatccggaagctgcccttccagcggctggtgcgggagatcgcgcaggacttcaagaccgacctccggttccagtcctccgccgtcgccgcgctgcaagaggccgccgaggcgtacctggtgggtctcttcgaggacaccaacctctgcgccatccatgccaagagggtcaccatcatgcctaaggacattc

SEQ ID NO: 7118 - DNA, 385 bp, Zea mays
  Clone ID: LIB3279-038-P1-K1-H11
gccatcacactaggctgtttgctaacaaccacaatgatcagcgcacagtcgataggggcggaaacatactgcctggcaccgtggtcgattcgaagatttgccatcctactgagtttgacttctacctgtgtagccatgctggcattcagggaacgagccgccctgctcactaccatgtcctgtgggacgagaacaagttcacagctgacgagctgcagaccctgacgaataacctgtgctacacgtacgctaggtgcacccgctccgtgtccatcgtgcccccggcgtactatgctcatcttgcagccttcagagctcgcttctacatggagccagacacctctgacagcgggtcactggccagcggtgcccgtggccccccacc

SEQ ID NO: 7119 - DNA, 258 bp, Zea mays
  Clone ID: LIB3279-038-P1-K1-H12
ggcaaccagcaaccatgaggccagacacggcggcctccgcctctccgactccgaagaagagacccgacagtaaagccgcgctggacctcgcgtcgtggagcttcaacgtcaccacgtccgtcgggctcatcatggtcaacaaggctctaatggcgacgtacgggttcacgttcgccacgacgttaacggggctgcatttcgcgaccaccaccgtgatgaccctcgtgttccggggggtcgggctgagccagccgtcgc

SEQ ID NO: 7120 - DNA, 285 bp, Zea mays
  Clone ID: LIB3279-038-P1-K1-H2
cccacgcgtccgaactcgtctgcgcattcacaggcgcgcgagcctgaccctgagatgggcgggagagggatccctctcaagacggccctgaaacaccaacttgacctccatctatgctaagcctatgaccaccatgccaaaggacattccggtggggccgaggatccgttcttagagggcctaatcggcacctaaaacatcatgacaaaaacatgatatcctggggttattgtcaatctcgtgccattgtaaggacatatgagtcaggtttgtatataggatcac

SEQ ID NO: 7121 - DNA, 463 bp, Zea mays
  Clone ID: LIB3279-038-P1-K1-H3
cccacgcgtccggcagtggccggctcttctccaggccctcgccctccgccctggcggcccgccggggttccggctcaccggcgtcgggccgccgcagcccgacgagaccgacgccttgcagcaggtgggctggaaacttgcccagttcgcgcacaccatccgcgtggacttccagtaccgtggcctcgtcgcggccacgctcgccgacctggagccgttcatgctgcaaccggagggcgatgacacggatgacgagcccgaggtgatcgccgtgaactccgtgttcgagctgcaccggcttcttgcgcagcccggtgccctcgagaaggtcctgggcacggtgcgcgcggtgcggccgaggatcgtgaccgtggtcgagcaggaggccaaccacaactccggcacgttcctcgaccgcttcaccgagtcgctgcactactactccaccatgttcgattctctc

SEQ ID NO: 7122 - DNA, 468 bp, Zea mays
  Clone ID: LIB3279-038-P1-K1-H4
ggaaccctgcctggtccaagcgagtagcgattagcctgtcgttttctgcttcttgattttgctggttttcttcaattttttctatggttgcgttccgttgttgctgcagttttttgagattcctggtatagtaatgagattcctgatatggtaatgcgattatttgacattttctggttaggatcttgccgacgtgagaattgagatcgatctgaaaggcttgattgtgccttccctacatcaatccatcttgaagtctcttggaaattccccaaaagctaaaaagaacctgtttggtggttgcattgttggctttggtaattcaactttgcttttgcttgtttcttctttattccgtgccaatgatgattcactttcaaggtgaattctttgattgttttgtgatgttcttgaggcgttcaactgaggcacgaccgaatcgaaatttaattactgctttgtagttca

SEQ ID NO: 7123 - DNA, 446 bp, Zea mays
  Clone ID: LIB3279-038-P1-K1-H5
cttcgttccatttaatgggcacttgtagctggggtcacgcatggcctaattctccacattttttgcaccttctcttccctcttatcatcttcttcttgcttttttcagattggttttcagcctgcacgtcaacttcattagctgcctctctgtcagcctcttttcctttttctgcagcaacctttttgcccttgctattcccaccttcaaggcaactcttgattctgagttttttgtaccttcctctacctctcttgtccagtggggcgccaacaacaaatggtaggtccacatgtggccactgggtcttatctggcagtggctcaataattctcttgtatgcattcttgaacctctgaaccgaataaaaatcatgcacaaaatcctccaactccacatccacactatcttgtgctgtaatcaacgccagtgcatgctggcaaggc

SEQ ID NO: 7124 - DNA, 437 bp, Zea mays
  Clone ID: LIB3279-038-P1-K1-H6
agctttgcaagcattcatagaccacggcaccgtttcaaggacagttgatgcgaatgtgtgtgaggcggaaggtgtatacagcgccttggagaagcttggcatcgactgggaagaggttggaaagcagcttgagctggaaggcgtggactccttcaagaagagctttgacagcctactcgtgagcctgcaggagaagggcaacagcctcaagatggcgagtgtgtaaagctgagaagattgggtacctgcgagtgaacgattttactaaataaaatgctagcttgctggctctcctcttagtttttacgctgtacctttgctctcaattttctgaatcggctttgtatcccaggcttgccagaacgtcattgtgtagccactgttcatggcttgtaattgctacggggtatccgataacgtcattgtggatgatgcct

SEQ ID NO: 7125 - DNA, 333 bp, Zea mays
  Clone ID: LIB3279-038-P1-K1-H7
aacggccctgctccacgcaatggctagaccattgaaagtgtatggagccgagctcaagggggctgcatacagctacatcaatgtgtcatgccggattaagtcagatcagtgtgaaatttaagcattcaagattggttgggttgcttttgaatacaaccaaataacaattagtagatgaagttttaattggccatgtaagagtgatcaaggtagcagcagaagctcatatcaaagaaaatagacacgaaattgactgtactctcggagcattttggcggcttttgcaagtcttgtaactgcattctcatatgactatattgtccccaacgaagc

SEQ ID NO: 7126 - DNA, 386 bp, Zea mays
  Clone ID: LIB3279-038-P1-K1-H8
gaagaacaactccttccttgtgaagcagttcggcaacggcaatgccaaggtgcagttcaccgaggagccgaacaacctctacaacatccactccttcaaacactcgggtttggcgaacaagaagactgtgacgatccagccagctgcaaaggactcggctgtggtcctctctactaccaagaccaagaagcagaacgcacctgcgaagctcatccacaagtctgtgatgcgcaaggagttccgcaagatggccaaggctgtgaaaaaccaggttagtgacaactactacaggcctgatctgaccaagccagctcttgctaggctaagctcggtgtaccgcagcctccaggttgccaagtccggtgtcaagaagaagaacaggcagt

SEQ ID NO: 7127 - DNA, 379 bp, Zea mays
  Clone ID: LIB3279-038-P1-K1-H9
gacacacatacgatcccgagtcacagcaataactgctgccaacgctgaggtgccgcgggggagggcacaccacgtgctgaggacctcaaactccctcaacacgcagctggctcccctcgagaacactcgtgaagacagcgacacaggctgcgtacgagtggatcacataaggccaggcgaggaacgcgtccatcggccgttgaacacactaaaacactaacagctgtcgcacgaagacgagcccgccaacccacctccaagcgcggatgcccaggaagcctacagcacctcctcctcaggtgacgaatgcagtgctgtctacgccgcagcccacggcgcatgaccttgtagatgaacaacaatgtactagcatcagagc

SEQ ID NO: 7128 - DNA, 331 bp, Zea mays
  Clone ID: LIB3279-039-P1-K1-A1
ctggcttctcctccccctcttaccaagtcctcttcgggttagggttacttagggttttgtggaggggcgatggcggcggctgatgtggagtaccgttgcttcgtcggcgggcttgcctgggccaccagcaacgagtcgctggagaatgccttcgcctcctacggcgagatcctcgactccaaggtcatcaccgaccgggagacggggaggtctcgcggcttcggcttcgttaccttctcctccgagaactccatgctcgacgctatcgagaacatgaacggcaaggagctcgacggccgtaacatcaccgttaaccaggcccaatcccgtg

SEQ ID NO: 7129 - DNA, 513 bp, Zea mays
  unsure (1)..(513): unsure at all n locations; Clone ID: LIB3279-039-P1-K1-A10
caggaagcaactgagcgtgcatgaggtgccaaacatattaacagttgttcttaaaagatttcagtcaggaaaatatggcaagatcaacaaatgtgttactttccctgatatgttggacatggttccttttgtgactgggtctggtgacaatccccctctttatttcttgtatgccgtggttgtacatgtggatacagaaaatgcatcattctctgggcactatatatcatatgtcaaagatatgcagggtacatggttgagaattgatgattcagaggtccaggttgtatcagtgaatcaagttatgtcagaaggtgcatatatgcttttctacatgaggtctttcccccgaccaccaagaatatacatcgagaaggggccgactgttccatccgcgaagcgccacacatcaaagtattccaagggctctaaacacgagcgcgagcagacagagttactcctctcggcgaacgatccagcatacggtgtttatgactntagacccgatggcga

SEQ ID NO: 7130 - DNA, 538 bp, Zea mays
  Clone ID: LIB3279-039-P1-K1-A11
cacgccgcaacctccctcgagcccgagcaaacaagggtggacgcggagccggcggcggagcggagatggcggagaagaagcgaggcgccggcactcgcaaggatgaggtggtgacacgcgagtacaccatcaacctccacaaacgcctccacggatgcaccttcaagaagaaggcaccaaatgccatcaaggagatcaggaagttcgctcagaaggccatgggtactactgatgtccggattgacgtgaagctcaacaagcacatctggagcagtggtatccgcagtgtgccgaggcgtgtccgtgtcagaattgcccgcaaccggaacgatgaggaagacgcgaaggaggaactctactccctggtcacagttgctgagatcccaccggagggtctcaaaggtttgggaactaaggttgttgaggatgaggattaagccctgtataccatgagagaaatttgagaatgttacttcagcttattgttatctactgccaatgactcatgtaatagaaggttcgagacttgtctcctttc

SEQ ID NO: 7131 - DNA, 98 bp, Zea mays
  Clone ID: LIB3279-039-P1-K1-A12
cacacgcgtacgtggactcatggaccctctactatctcgacccgcaccgatgcggtcaatgtcatatgcggttaagtgtatgctgcgcacacggttgc

SEQ ID NO: 7132 - DNA, 573 bp, Zea mays
  Clone ID: LIB3279-039-P1-K1-A2
tcttaatatgtctaataagcaatttagctcataatctgaaatataatgagggcatataacagtgtgtatccaagtattgtgctattatcaatgtataggactatttgccttttgctgtcaggtgttggtgcttatttggagttccaactacataaatgtttgtcgtcattatattcccttcctactctcagtaattcgttactacttactactaaggattgtccaatatgccatcaacatgtgatgttttccttgttctgtcacctaatatgcttaatcacagccctaaattattgatactgtacatcaaatatggtgctttttcatacttatgctgcacttcaccttggtgcataaaactaccaaatgcaaatttcatgctgtgtctcataaagctcacccaaatttctttatactgatgaatgatctaatttaaacttagaatttatgggaaacatgtttggtgtatcatcttaggatcttaatgaaaaaaactatgaattgagtatgtgcatttgctacttattatctatattaattctctcgagatcatgggcatattcatattttttt

SEQ ID NO: 7133 - DNA, 396 bp, Zea mays
  Clone ID: LIB3279-039-P1-K1-A4
aggcacgacacgagctcatccggcggcggcagagcgggaggagggagaacgcttcgggccctcccaacccaacctcctccccttcccgacaaggcgactcgaagcgagatgccgctgtacgactgcatgctgctgctgaagacgacggtgaccagggaggtcctagcggaactggtgacgcgtgtggcgcgccgcgcatgccagcgcaacggggtcgtcaccgacgtcaagtcattcggcaaggtcagcctcgcctacggcatcaggaagctcgacggccgccacttccagggccatcttatgcaaatgaccatgatggttcccccttcgttcccgcaagaactccactatctgaacaaggaggacaggctgcttcactggctggtcgtgaagcac

SEQ ID NO: 7134 - DNA, 408 bp, Zea mays
  Clone ID: LIB3279-039-P1-K1-A5
cgtccgtttgtttccatggcaggttacgcgccactattcgtaaacgacaatgaccagacgtggaacccagaggcaatcgtcttcaactcctggcagcattacggcactcccagttactggatgcagacgcttttccgcgagtctagtggtgctatgttccatccaacgacaatcagctccagctactcaggttcacttgcagcgtctgcgattacctggcaggactccgagaacagcttcctaagagtaaaggtcataaacttcgggtcagatgctgtgaccctgacaatctccacaagtgggctccaggccagtatcaacgctctgggatcaaccgccactgttctcacatcagcagatgtgatggatgaaaactccttcagcaacccaaccaaggttgtgccggta

SEQ ID NO: 7135 - DNA, 317 bp, Zea mays
  unsure (1)..(317): unsure at all n locations; Clone ID: LIB3279-039-P1-K1-A6
gcgncacgcgtccgcccacgcgtccggttctccaggtttggagcagtagctcgtcttctcagcacaaagccagccncaagggatgtcataggtatcgatctaggcacaacgaattcctgcgtctccgtcatggaaggaaagacaccacgggtgattgaaaacgcataaggcgcgaggacaacaccctccattgttgccaagaatcataatggtgacctgttgattggtatcacaacttgccggcaggcatgaaccaatgtccagatcacaattccgtgggtgaaagcgtttgatcggtgatgacttgttttgaccca

SEQ ID NO: 7136 - DNA, 194 bp, Zea mays
  Clone ID: LIB3279-039-P1-K1-A7
gcgggcaatgtgtgaaagctgtaacctgactcgacgggtgtcatctgtttttttggcttaatcctgtatcataccttgttgtaagacagccctggagaggggtaaaaaattgtacaagtgcacgccatggcaacagtaaagatttttcttagaatagcatatctactaattaaaatgtggcgtgggccatgtcg

SEQ ID NO: 7137 - DNA, 380 bp, Zea mays
  Clone ID: LIB3279-039-P1-K1-A8
gaaaggtaaagggaagggcgggaggtgattgatgttttcgaggcacagtggtggtctaagattgatcgagcgttgatgatgttcagcagacaccacctttgcttctcgcagttttgtttatctgttgcagtggagagaccatagcgtctccttcctgtttgcaaccagactggtgtttaattatactcggctggataatgtcagagcattaattttgtggaaactttttttttgctttaaaaaaaaaaaaaaaaaaaaaaaaaaaaaaaaataatattcacctaatatgcttaaatacaacccctaaaatattgattctgtacaatcaaatgtggggctttttcatacttatgctgcacttcaccttggtgcataaaact

SEQ ID NO: 7138 - DNA, 534 bp, Zea mays
  Clone ID: LIB3279-039-P1-K1-A9
ggaaaccctagccgccatatctcacgatccactcgagcaccaagccgagggaaggtgaggagcgatggcgcgcggcgtggtgtcggcgaagggcggcgcggtcgcgggcaagaagaaggggtcggtttccttcacgatcgactgcaccaagccagtggaggacaagatcatggaggtcgcctcgctcgagaagttcctgcaggagcgcatcaaggtcgccggcggcaaggctggcaacctcggcgactccgtcaccatctctcgcgagaagaccaaggtcaccgtcacctctgacggacccttctccaagaggtacctgaagtacttgaccaagaagtacttgaagaagcacaacgtgcgggattggctacgcgtggttgctgccaacaaggaccgaaacgtctatgagctccgctacttcaacattgctgagaacgagggcgaggaagaagattagattgcactacgcttatattttagtattgaactcggtgcattttgatacctgtacccgtagtttcgcaaatgtcccat

SEQ ID NO: 7139 - DNA, 378 bp, Zea mays
  Clone ID: LIB3279-039-P1-K1-B1
gcgggcgccctcggccaaaggacctggtgaaatatgcagagagctgcatgtacagccccatctaccgcaactaccgttggagtcggatcaactccaggtatgtgcaaatcagcagcagccttgcgtcaactgcaagatttcctaagaatataactcgtttcagtctttcatactgtaataccctaagctctctagcaatagctgtttcacgtccttttctgcccctacatattccgcagcgtttatctcttgcgatgtcatgtaaatcagctccggttaggcttttggatgctagtcagtcatggtgctgctgccgtccttccggttccggacaaggataaatttggaataaagtttgagtcgacgattcctcctcaa

SEQ ID NO: 7140 - DNA, 630 bp, Zea mays
  Clone ID: LIB3279-039-P1-K1-B12
gtgcagacgtcgtctccgaagctaccgcacaagcagtactccttcgtgtcggactccggagaggagagcgatccggataagctggtggagagcgtcttggacagcctgcagaaagcacggggcggctcgaagctgcacaactgagcgtctgctgccatcgaattattgtttttgcaacctaacgagtcgtgcttatggtggtggccatggctgactgtcaaggacagcggcgcctgcaagcatcagccggagagactggtgaataaagctcgtcttttacttggactaggccgtagtacaatgggaacagtccttggtaattggtatgttaacattggctagagaccgcctcccatttctgtttcttgtttctttcttttcatgcaggatggttgtcccgccaatctacacgctcattttcttaacaaattggttaacacggcggtgcttagaccggcgttcgtcaccagtgttggtatttcaagcccaatcttttttttgcttggagtatagtaaacataaattgccatggcacatgctggggtctagagtattgctgtttctggagtcccaacattcatgtgatggcacattggatgccagttgactggaatagtcccatgaatccta

SEQ ID NO: 7141 - DNA, 514 bp, Zea mays
  Clone ID: LIB3279-039-P1-K1-B3
tcctccgtcgacccctctacaccggcgatcggcggcgaacgatggggtgggcgacgcggttcctggcggcggtgtgcttctttgctgcgggcgtcctcttcgtcccagaggctatcggttccccatccggcgcaggagccgtcaccgccgccaagctggcccacgtcctctcctttgccacctcctggggcgccgccctctgggccaccttcatcggcggcatcataatgttcaagaacctgccgaggcacatgttcggcaacttgcagagcaagatgttcccggcctacttcacgcttatatctgcatgcgcagccatctccgtcgccgccttcgcgtaccttcacccgtggaagacggcgtccactgtgcagcgctaccagcttggattcctcctctcagcgctcggctggaacctctccaaccttctagtcttcactcccatgaccatcgagatgatgaagaagaggcacaagatcgagcgggacctgagtatcggcgaggaagtcggatg

SEQ ID NO: 7142 - DNA, 330 bp, Zea mays
  Clone ID: LIB3279-039-P1-K1-B4
gcggtatcatcatttttctcttttaggaaatccacgtgccagagataccagtgccgtggcattgaattgagtataaatgggtgttttgtacaaaaggatcaaagaaacagataagaggacagttatgaggaagtcacggtgttagatccctgagcatgaagttctcggtcgaagatccatgttgctgtagtaacgatgctgttccaacttcctttcctgataaaatgacaatgtagaaatagttctgaagtttatgttgatttgtcgacaggtgggtcaattgtgatcctgtacgattgttatgaatccctcttgttttgttttgatgtt

SEQ ID NO: 7143 - DNA, 509 bp, Zea mays
  Clone ID: LIB3279-039-P1-K1-B5
gcgtccgcggacccttgggcgacagagagagagagagagaccgacccgccggcagatcccaagttcaccggagagggggaagagggcgaccgaaggcggcgatgggtttcatcatggacttcgcggagaatctgatcctccgtctgatggaggacccggacaagcgcgaccaggttcggcgggagcatgtctacaagatgaaggagcggtgcgagcgcactaaggcggcgtggagcctccctctgcgcccctacggcttctggaccttcgaccgcttcaactcgcagctctcctgggatccccagatcagccaggccgccggccgtcgggacccctacgacgacctcatcgcccgccactctggctcggcggcgtcttcctgaacacccgttccgatctttgcccagaaggtctacttgggcatcaataagaaactcttttccctaaactgattggggttcatcctcttctgtctggaaaatgtggcaccaaactaccctatttcctgt

SEQ ID NO: 7144 - DNA, 416 bp, Zea mays
  Clone ID: LIB3279-039-P1-K1-B8
gcgaacctatcttgtgagtatggttcatcttatacagatgatgatatttgagtaaactggtcagatcaacaaactttgtggggtgttcatttagaataggggtgtttggcactgctctgagtttcagctttaacatgaagctatggactgtggtgtataatataaatgtaaatggttttaaaaaatattttagtctaaatgaaaaacaaaatgacttgtctaaatatattctaaaagtttgtaactttaggttcatgattttttgaagctcctaatgacctgcttcatcaacttcaccaaactttatgaagttgaagcaggcccaaacaagtgtttgaatacactagagctaatagttagttggctaaaaaattgctagtggaattagctagctaacttactaaaaatagctaata

SEQ ID NO: 7145 - DNA, 376 bp, Zea mays
  Clone ID: LIB3279-039-P1-K1-C1
gcggcacactgaaccttctactcaagaacctgaggctcaatccattgggtggggacaaggtgttgaccatgctggcgagtgggctgcgcaagggaacgggcatggatggcaatggctcaaagatcctcggttggactaccttggttacagaggaatttttccagctgacacgataccacccctagttgagtctgtcaaagaagcagatgaacgccattatcaactttggcggatagaaaatggagtcgcagaaggttcgactgagatcccaaaaggcgaatcaatcccgcttgagtacaatcttgctggcttgaacgccatttcgttcgagaagggctgctacatcgggcaggagcttatcgctcggacgcaccat

SEQ ID NO: 7146 - DNA, 593 bp, Zea mays
  Clone ID: LIB3279-039-P1-K1-C10
gaagcaagcacatatccccacttcacaatgatcgggcaaagtcttggctctgtttatcttgcatgggaagcccttgcgtaaatttaccccacaggtttactttgatacaagtggctatgcttttgcgtatccactggctcggctctttggttgcaaagtcatatgctatactcattaccctacaatcagttctgatatggttgaacgtgttaagcaccgcagttctatgtacaataacaattctcttatcgcagggagcatttggctatcccgatgtaaaatcctctactataccatattcagttggttatatggtctggtgggttcatgtgcgcatcttgtaatggttaattcctcatggacaagatcccacattacaaatatttggaagatcccagagcgtactaagagggtgtaccctccatgcgatacttctgctcttcagatgctttccctggatagaccaacaacacctcctgttcttatttcagttgcacaggttccgccagaagaggcccatggccttcagctggaggcatttgcacttgctcttcaaaagctagaccctgactttcctaagccaaagattcaat

SEQ ID NO: 7147 - DNA, 560 bp, Zea mays
  unsure (1)..(560): unsure at all n locations; Clone ID: LIB3279-039-P1-K1-C11
ctaatgcaaagtgagcacaatggacggaccgatgtggacaatgatcactgtaacggttcttcacaaactagcataggagtaacatcaaatatggtcccagaggaaatgatgggagattgtccagtcgataactgcaaagaggatagtagtctttgtagaaaagtgctttctggaagtacggaaccttgcccaggtgcaaaaatgacaggatgtgggaatttgagcgaagaccaggttgctgaaggtagcgtgcttcaacgtgtcgaatctatatctcctgttataacagatattgatgatttactcgtagacccgtatgagagtgaagaggaagatgaagaaaagtcaggggagcagaatggacagattgatgtgaatgctgagcagtgttttggttcttctcaaactatcatagaagtgatatcagacatggcccctgatgaagtcatggaaacttngtcagcaaataactgcgaagacataatagcatttgccgaaagtgctttctgcaagtatggcaccttgcccaggtgcagaaataccaacatctgaaaaaatga

SEQ ID NO: 7148 - DNA, 250 bp, Zea mays
  Clone ID: LIB3279-039-P1-K1-C12
cgtgtcaggtccggaggccgtctcagttcccgtcggcgcatcgggcgctacttgaagaagggccgctacgcgcagcgtgtcggcaccggcgcccccgtctacctcgccgctgtcctcgaatacctcgccgctgaggttctggagctcgccggtaatgctgccagggacaacaagaagactcgcattattccgcgccacgtgcttctggcgatccggaacgacgaggagcttgggaagctgttgggcggcg

SEQ ID NO: 7149 - DNA, 386 bp, Zea mays
  Clone ID: LIB3279-039-P1-K1-C2
gtgtaatgattcttggaggtgttctctttttcttgaaacgcgaaagaataactcttcttgttgcctgttgatattctatgtatagagcgagatgctatgttggatggctcggattgcttttgcacctcaacttatctctctttactagagatattctagtgcaattcctaagggacaatacttacattaaaaaattcaatggttcttcaaagtactctaagcgaagctcagttctacaaggcactatcttttaaaaatctcagccatcagccgattgcacctcccaagccacttatgctcaaccttcagatcgagatttttcatcaccaccgacacaacaaccttgttaaacactaaccattttattttttagcaaagtgttttct

SEQ ID NO: 7150 - DNA, 564 bp, Zea mays
  Clone ID: LIB3279-039-P1-K1-C3
taactcaagaaggcaccctcccttgccactccttttccttgagatgacgacgacgatgaagaagaagcagcggcagcagctcctcctgcgcctttctctcatgtttctcgttgctgtcacagcagccgctgttgctgccgatccacatccacagcaggtgcaggtgcagcagcagcagcaagcacagatgaggattaacagggccaccagatcccttcttcctcagccgccgccgaaactagactgcccgtccacctgctccgtgcgctgcggcaacaactggaagaaccagatgtgcaacaagatgtgcaacgtctgctgcaacaagtgcagctgcgtgccgccggggaccggccaggacacccgccacctctgcccctgctacgacaccatgctcaatccacacaccggcaagcttaagtgcccctatgccttcgccactcatgttatgtacaatgtactatcatcacttcaataaataaataaaaaaacttctggttctggatgcctgtttctactcattctgcccattcttcttcagaacgtgagatgctacactgcact

SEQ ID NO: 7151 - DNA, 293 bp, Zea mays
  Clone ID: LIB3279-039-P1-K1-C4
ggcggtttgatccggatgtcactgtcaaatgcaatgttatctagcgccagaggggtgtgtctttgaaaaagataaatctatgtttgaaatttaccataaagcagctccaccagtgaattcaggatctactagtgaactatttagatacacaatagctttaaatccataaaatataatatgttttggttggaaagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaattaaaaa

SEQ ID NO: 7152 - DNA, 406 bp, Zea mays
  unsure (1)..(406): unsure at all n locations; Clone ID: LIB3279-039-P1-K1-C5
gtgcgcataaaataaaaaacggnggtgtatatctttaggattggagggagttgtgatgggaagtcgaagtccggtggccggtgtaggtagtggcggcggggccttccctctacttccgcgtagagatagatcggatctcactagtctgtgtatgcatgaggatgtgcaatgaatgttggttcgtgtgccggccttgatccctatttatttacacggtatgaaagggggccaccaccaacacggtcaggatgcgagtgtgaggtccggctcgatcctcaaacagagtccggatgagatcaacccaacaaaactgacctgtgtcctgttcagtttccaactctttccatgaccaaactactatctttagtagaggttatttggatgtcctctgtatatccaactgcat

SEQ ID NO: 7153 - DNA, 468 bp, Zea mays
  Clone ID: LIB3279-039-P1-K1-C6
gcggtgaggtcaagcaggcagagtctgcacctcctattccgaaaaaggctgctccttctaaggagccaaaggcaaaggatgtcaagaaggaggctccaaaggaggcccccaagccaaaggtggttgaggcaccagcagaagaggaagcaccaaagccaaagccaaagaatcctcttgacttgctgccaccaagcaagatggtccttgatgactggaagaggctatactcaaacacaaagaccaacttccgagaggttgccatcaaaggtttctgggacatgtacgacccagagggctactctttgtggttctgtgactacaagtacaatgatgagaacaccgtctcctttgtgaccctgaacaaggttggtggattcctgcagcggatggacctgtgccgcaagtacgcctttgggaagatgctcgtgataggctctgagccacccttcaagctgaaaggcctttggc

SEQ ID NO: 7154 - DNA, 505 bp, Zea mays
  Clone ID: LIB3279-039-P1-K1-C7
cccacgcgtccgagcaattacaatggatacgattatctcatctcatttggaggatacaatggacgatacagcaatgaggtttatacacttagcctcaaatcagattttaagtccaccacaaaagaagaaactgtctcagatctagggtcgtcgaaccagaggttgaaatggtgattggcgtggacagtgctgattcagacctgaagaacagtagtacagtactgatgaagcaagtgaacagttcttagcagctctcaaagctgagaaagaggaactagaagcgacacttaacagggaacagctgcaaactgtacaacttaaagaatacattgctcaagcagaatccagaaatgtggaactcacaaaggaacttcaagccgtccgtggccaacttgctgctgagcagtcaagatgtttcaaacttgaggtcgatgttgcggaactacgacagaagcttcaaagtatggatgcattggaaaaggaggtcgagctgcttcgacgacac

SEQ ID NO: 7155 - DNA, 539 bp, Zea mays
  unsure (1)..(539): unsure at all n locations; Clone ID: LIB3279-039-P1-K1-C8
gcgcgagattgacggcaagcccgcaggtcggattgtcatggggctttttgggaagactgttcctaagacagcananaactggcgagctctttgcacaggagagaaaggaattggcaagagtggcaaagctctccactacaagggaagtacattccacagaatcattcccagcttcatgctccaaggaggtgacttcactcttggggatgggaggggtggtgaatctatctatggcatgaagtttgctgatgagaacttcaagatcaagcacactggaccaggccttctgtccatggccaatgctgggagagatacaaacggatctcagtttttcatcaccaccgtgacaacaagctggttggacgggaagcatgttgtgtttggcaaggtgttgtctggaatggatgttgggtacaaggtgggngctgagggccggcagaacggccacccaaagaacaaggttggcatatcaaatagcggcgagctgccgatgtgatgagctgaactgatgttctatctggaagaatattaagaagttg

SEQ ID NO: 7156 - DNA, 508 bp, Zea mays
  Clone ID: LIB3279-039-P1-K1-C9
gcgagctaatccaccagttatttatagggatttcaagtcatcgaacattctgttggatgaaagtttccacccgaagctgtgggattttggacttgcgtaagttgggtccagttggcgacaaatcacatgtctcaacacgtgtaatgggtacatatggttattgtgcaccagaatatgctatgacagggcagctgacagtgaagtctgacgtgtatagttttggggttgtcttgctagagttgattactggccgtagggctattgacagcaccagaccacatggagaacaaaatcttgtctcatgggcacgtcctctgtttaacgacagaagaaagctccctaagatggctgacccgaggctggaagggcgataccccatgcgtgggctttaccaagccctttgcagggcttcgatgtgcattcagtcggatgctgctttacgcccactgattgcagatgtcgggactgctctgtcctacttggcatcccagccatatgatcccaacgc

SEQ ID NO: 7157 - DNA, 564 bp, Zea mays
  Clone ID: LIB3279-039-P1-K1-D1
acaattactgttgatgagattgcaacaccagggctgaagaccatcttaagctttgctgttcctgatcagagatctgggggggttgagctccagtatgtgcatgattatgctggagttaatgcaagcatcggtctgacagccaatcctgtagtcaacctctctgctgcctttggtactaaggctgttgcagttggtgccgatatctcacttgatactgcaactgggaacttgactaaatacaatgctgcactgaggttcactcatgaagaccttgtggcatccctgaacctgaacaacaagggcgacagccttactggagcctactatcacaaggtgagcgaattgaccaacacagctgttggggcagagcttacccacagcttctcgaccaatgaaaacaccctcacctttggcgggcagcacgccctggacccactaaccgtcttgaaggcccgcattaacatctctggcaaggccagtgccctgatccagcacgagtggaggccaaagtcgctggtcaccatctcggccgaggtcgacacatagaccatcgagaagagctcg

SEQ ID NO: 7158 - DNA, 568 bp, Zea mays
  unsure (1)..(568): unsure at all n locations; Clone ID: LIB3279-039-P1-K1-D10
gcggctagttcactccgaaccgcgaagatgatgtgtccagattcttcatttgatgaacttttgaaggttgtcataatgggggatcaactagctggtgatcaagacgttggcggctgtggaaaaccgaatcacatacaccacatcctttctactcccccacatgtctttacagttgttttgggatggcagaacaacaaagagaatgtggatgacatatctgcaactttggctggtatttcaactgagatagacattagcatattctaccgtggcctagatcaaggaagcaaacacaccctggtgtcagtggtttgttactatggccagcattatcattgttttgccttcaaggatggacgatgggtcatgtatgatgaccagacagtcaaggttgtaggtagttggggtgatgtgctcgtgatgtgtgaaaagggtcacttgcaaccncaagtgcttttctttgagtctgcaaattaatcattcttcagagtcgtaaagtgttgtgcagtgggtaacatgccctcaaatatagggtttttacctgtggccgtgaagatagaaatagagt

SEQ ID NO: 7159 - DNA, 524 bp, Zea mays
  Clone ID: LIB3279-039-P1-K1-D11
ggcgaagacactgagctggtctgtttagttggaaagccatctgtacgtttttcgccgatcatggaggatgagaggaacgggcagcagcaccagggcggtgagcaggcccaggaccaggagaacgaggtgaaggacaggggactcctggacagcctactcggcaggaacaagcacgacgaccaggagaagaagaaccagcaggcggaggaggagctggcgaccggcatggagaaggtcacggtggccgagcccgaccacaaggaggagggacacgaggccgccgagaagaaggacagccttctcgccaagctgcaccgcaccagctccagttccagctcgtcgagcgacgacgaggaagaggaggtgatcgatgagaacggcgagattgtcaagaggaagaagaagaagggccttaaggagaaggtcaaggagaagctggcggcccacaaggcccacgatgagggcgaccaccaccagacgcccgcgccggccgtggtggtggacacgcatgctcaccaccagga

SEQ ID NO: 7160 - DNA, 515 bp, Zea mays
  Clone ID: LIB3279-039-P1-K1-D12
gcgcggacgcgtgggcgagcgcactatctacatcccacaaccaacctggggaaatcacccaaaagtcttcaccctatcgggcttgaacgttaggagcgtgaccgctattatgatcctgcaacatgcagccttcacttcgaaggactcctggaagacctcggttctgctccttcaggttcaattgtactgctgcatgcctgtgctcacaaccctactggagtagatcctaccatcgaacagtgggaacagattaggcagctgatgagatcaaaatcactgcttccgttctttgacagtgcctatcaaggctttgcaagtggaagtcttgacaaagatgctcagtcagtgcgtatgtttgttgctgatggtggtgaacttctcatggctcagagctacgctaagaacatgggattgtatggagagcgtgttggcgctttgagcattgtatgtaaaagtgccgatgtagctggtagggttgaaagtcaactcaaacttgtcatcaggcctatgtattc

SEQ ID NO: 7161 - DNA, 406 bp, Zea mays
  Clone ID: LIB3279-039-P1-K1-D2
gcgcaacagcccaaacagatagacccggtccgggtggcggccgtttcaattcgaggcttgtggccggccgccgctgaagcagtaaggagcgtgcgtcggacatggaggacgcacgcgtgctgccggttgtcttcgtcgacggcgagcagagcgtggacttgggcacggtgaccgtgcagccgtcgtttggcggcgtgaagcggcttcaggccgtcgtggcagaccgcgtgggcgccgcgccgcaccagatctcggcgtccctggcgcggccccgccgcgcccgccatgtgcccctcgacgactccaccgacctctccgtcggcgtcgcgcgggagggctccgggtgctacgtcatcgctgggttccggcgctcccgccggggcgtgcggtcccggctggacaggaa

SEQ ID NO: 7162 - DNA, 520 bp, Zea mays
  Clone ID: LIB3279-039-P1-K1-D3
cgggttgtaaaaccaaccagcctaccacccgaggccgagtgcgtcgctttcctcctccaggcctccaccctagctctcgctcgctcgtgcggtcgtcgtcaccaccacaccatcgaggcggtggaaggcgcggcgcggcggtcttcgctcgtcgagggaggcgcgccgtccatggaggcgatggaggaggccaacaggacggcagtggagagctgccaccgggtgctggctctcctctccaacccgcacggccagctcgtccccagcagggagctcgtggccaccaccggggaggccgtagccaggttcggctccctggcggccaagctctccagctccaacggcaatggcctgcagggccacgctagggtcaggaagaccaagaagcccctgcccatcttctacagcaacctcttcctcgagagcagctctgcggtggccgccgcccaactgtggtcaagacgcccagtccgagcccgaccacttgcctccagctgttcccgaggtaccaccagatgga

SEQ ID NO: 7163 - DNA, 422 bp, Zea mays
  Clone ID: LIB3279-039-P1-K1-D4
gcgcccgccaccagccttctcccacccacgaagtacggaaggctgccggaaggagctctcacctcacatccatctctgtggcgcccgtcatcctggggtcctcccctcctcaactgctatcggattggcgctgcagtggagatcgacccggtctaggaatttctttcgttggtaaggaaccctaatttggtcggatgggattttcatcttcgacgaagcccgcgagattgatcgaccttagctgacgcgagggattggaaagcgaacgctcgggcgtagttaattttctaggaagattggggtttcagctcaaacccccatgctcgatgctgaggacgaccctggtgggagatgacgaggatcttcgtgcagcgcgggaccggcggctcctcgtccagctccggccggtcgggctcgcaatc

SEQ ID NO: 7164 - DNA, 501 bp, Zea mays
  Clone ID: LIB3279-039-P1-K1-D5
ggtgcggcaggagctcccccgtctccgtcctcctccgcctctgtcagggtcccggtcggacttcctcacgaccgccgcgccggagcccgtctcgttcctgcgttccgctgcgcatcctcaggaatggaacttggcgccaccactgccctgtaccctctgcaccgctgcaaaaccatttacctggtcaggcatgcccagggcattcacaacgtcgcaggcgagaaggacttcggcgcctacatgtcacatgaactgttcgatgctcagctcacccctttgggttggaaccaagtcgatggtctgcgggagcatgtgaagaaaagtgggcttgcagagaagattgaattggttattacttcccctttactgaggactatgcaaactgcagttggggtctttggtggtgaaaagtatgctgatggtgtaaatgcacctccactaatggttgaaaatgctggacacagtggacgtccagcagtttcaagttgaactgccccccat

SEQ ID NO: 7165 - DNA, 274 bp, Zea mays
  Clone ID: LIB3279-039-P1-K1-D6
agcgtcgttctcgccactattattctgcacagcaacgcatcaagccttctagaaccatctcgccggcgccacaccacaacgcttcgaagcgaagcgaagcaatggccggagtctgatcgaaggccctcgccgttgccgccgttctggcggccgtctccctctcggtggccgccgcggccgaggcgccggcgcccatccccgtcttcaccgccgtcgcggagtagacgcccttctccgagatccttgacgacttcgacgttttgtgcctatttga

SEQ ID NO: 7166 - DNA, 654 bp, Zea mays
  Clone ID: LIB3279-039-P1-K1-D7
attgaaggccacaagtcgactggccgcgatgatctaggacaagggcctatccatctgtgttcttgcttgggctatgggggggccattcacttatgttctttgtcaggattctccttggatttccgtgattcttctggttggacagctttgcattgggccgcatactgtggaagggaaaaaatggttgctgctcttttgtctgctggagcaaatccaagcttggttacagatcctactcatgatgtccctggtggacaaactgctggtgatctggctgctggacaaggttatcatggcttagctgcatatctttctgagaaagggctgactgctcattttgaggctatgtcactgtccaagggtaagcgatcaacatcaaggacagagtcactaaaacggaataccaagggaattgaaaaccttagtgaacaagaattgtgcttacgagaatctttagcagcctaccgcaatgctgctgatgctgctagcaacatacaagccgcactcatggagcgaactcttaagcttcaaacaaaagcaattcagttggccaatcccgagaatgatgcatctgcaatagttgctgctatgaggattcagcacgcataccggaactacaacagaaagaaaatgatgagagctggtgcaagaata

SEQ ID NO: 7167 - DNA, 537 bp, Zea mays
  Clone ID: LIB3279-039-P1-K1-D8
gcgagtccccaattatttggcctccgtcagagaggggagaaagacccgttcgaggcggcggcgatgtctgtgcgcggcaggggcggcaagggtctaggcaagggtggagccaatcgccaccggaaggtgctccgcgacaacatccagggcatcaccaagccggcgatccggaggctggctcggaggggcggcgtgaagcgcatctcggggctcatctacgaggagacccgcggcgtgctcaagatcttcctcgagaacgtcatacgcgacgccgtcacctacaccgagcacgcgcgccgcaagaccgtcaccgccatggatgtcgtctacgcgctcaagcgccagggccgcaccctctacggcttcggaggctaggcgcctcttcgtagctggggaatgcttaaggtgatacgtctctgtcgctgtgggtcgtagtggtgctgcgttcctggatgtaatccatttttttttctgcaatgaagagatgctggcaagcatactacctgcatatgttgcgcctgggtgatggttctcctt

SEQ ID NO: 7168 - DNA, 148 bp, Zea mays
  Clone ID: LIB3279-039-P1-K1-D9
gcggaagattttggggttgtatcataaggcctcgtaggatagatctttctgcaaatgttagcgaagccagtgtttatggggtgtttgctagattagcgttatcagtttgcacgttccccttttttttctgaataattgtccttgtatg

SEQ ID NO: 7169 - DNA, 592 bp, Zea mays
  Clone ID: LIB3279-039-P1-K1-E1
agaaatttcaaaagctcaatgaaattgcccctgttgctagactctttgctttcatcatgtccacggaatgccaaccctggatgcaaaagatattggaaatatctaattgaataagtaagttttatcttatacaaacgaaggtcctcatcactccacttctcaatttggttatcaattgatgcattaggattcatatagccaatgtatttctcttgagctgtcttgtgtgccatagaatccgcatgtttcaaaagtgatttgcttcctatattccaatttctccatccacccacagtaaatgcatctatgcccttgcccttacttttcttatttttgaataaatagcacacaaaacaaaatactgcatcattcttgataccatattcaacccaaggaaaattatggaaccacacaaaattaaagttgcggtctctatctccaaattttctttttggaaattcatgtccatatggttgcaaaggacctttcagaacatatgctcttcgaattgcatcatgatcattaacatgataacttgatatgggttggctttcacccggatcatgtggaagacgattgatatcataaaccg

SEQ ID NO: 7170 - DNA, 534 bp, Zea mays
  Clone ID: LIB3279-039-P1-K1-E10
gcgcggacgcatggggcatatcttggcaaaactcaagaatttacactttgatgaggagactctttaacagcagtgttgcgaagttaaccctagtgtatcggaatgtcactttatatatttcgtatcttatcttcttcgctacgaggtaaacaagccttcaattttgcatattcagtgcccattaactgcagtctgctggaaattctctctctggtatattgccttccaccgctcaagctcttccctgcagatgggtaacagcccaaacattagcatcaacttttttttttttgtttattgtaaagtaataggaagcacaagggttctcctgtgtcagtcaatcggttacacctttgctcttacacagttagtcaaatgctgaaaggctcttaagaaaaatctggttatttgttagtattctagtgctagaaacgtcggtcctataaaacagaatcctggtttcacaatttctgtgaggtatctggagatcaaaaccgtttgctcctgtcagatttgcaagtttcaaggttttct

SEQ ID NO: 7171 - DNA, 458 bp, Zea mays
  unsure (1)..(458): unsure at all n locations; Clone ID: LIB3279-039-P1-K1-E11
gcgcggaagaagaacttgcagtactatgagatttctgccaagagcaattacaactttgagaagcccttcctttacctgggtaggaagctggcaggggatcagaaccttcactttgttgaagctgttgctctgaagccaccagaagtgcagattgatatggccctgcagcagcagcatgaagctgagcttgcagctgccgctgcgcagcccctccccgatgacgatgatgacctgatcgaatagatatgttatacatggcccttgttgatgactcttgttaaaaatctgtggtggttcaatccttgttagagttaggcagtacctgaatgttctcttgatgtattcgaagagttgagaaggaagttaatgacatcattatcctgttggctgttgttgacttggggtttttggtgaacctgtccttgatcatacagaggtatngtcaggcagtacgcttc

SEQ ID NO: 7172 - DNA, 509 bp, Zea mays
  unsure (1)..(509): unsure at all n locations; Clone ID: LIB3279-039-P1-K1-E12
gccgaggacaatgagcttgaagtccttgagatcatccatcatttcgtcgagatactggaccgctattttggcagtggatgtgagttggatttgatattcaattttcataaggcctactacatactggatgagattctcatcgctggtgaacttcaagaatctagcaagaagaatgttgcaagacttattgctgcacaggattcattggtcgaagctgctaaagaggaagccagctccataagtaacattattgctcaggctacaaaatgaagttcttcatgcctgccccccttccctctatcttgttattgttgtacaagcaactgtaatgcactggactgcgagttcatttgctctgctcatgtttatggatttcaagactccaggttatttagaatgagcgtgatgtgtaactacattgcatgtgttcccggtgcaaagtaaatcatgattntcaggattgctcaggcatacatgtaaattcctaatgtataagtggatatttttgc

SEQ ID NO: 7173 - DNA, 227 bp, Zea mays
  Clone ID: LIB3279-039-P1-K1-E2
ctagatcgccacatccttctacctgttccatctacagacagcggcttacctcttaaccatccacctccagatcgctcagcagaacctccaaacactgcacttgctgtcactgatctctctaaggagaacacgcgcatactggttcatcacccaattaacgccatgcacgctcctgatcgcactaacataggacatgtacctgcgctaccaggctgagatcttcaaat

SEQ ID NO: 7174 - DNA, 384 bp, Zea mays
  Clone ID: LIB3279-039-P1-K1-E3
ggatggaaattgaatgggaattgaatgaaggatgctacgtataatgctacactggatcctacactcaagctattctgctgctgggtgttttaatatacatctacacataataacactccgtgctacaacgactcttttttccactgtgttttactacatctcttatctcttttttttggaggtttttttttatgacctaagagatgacataacaccatcactcacaccataccccgctgaagctgcgtctactggaggccttaatccagcacgaactgctccacagatatgtgcaaccttatagtccaagagccattgctagagccgcctgttccaacgcataccataacttacatcctgtctcgtggtgtcctcgctgctctc

SEQ ID NO: 7175 - DNA, 514 bp, Zea mays
  Clone ID: LIB3279-039-P1-K1-E4
aactgcctccccacttcgcaccgccaccgtctcccgaccgcgacgccggcgacctccgcaccgcatcgctccagccagtcgttccgagatttggtgatcaaagaaccatggaaggatcgttccagttgaatcccaacgccagtcctttcatacctggattgctgggttcatctgcacaaaaagccccagaaaaacaaggagggtcatcatcaaagggagagccttctggtagcacctttgatccttctgagtatgaggaaaatgacatggatgaacttgctctagtcaaaatggtcttttcaatgttcccaaatgtctccacggacttcattgatgagttaatcaaggcaaatgattttgacatgaatctgactgttgatatgctttatgagctgaactcacaagatatggttcatgatgattctgaagttatcaatcattttcatgatgattctgaggctaccaatgaccttcatgatggcaagggcgtacctggtgctgattaccacaagac

SEQ ID NO: 7176 - DNA, 519 bp, Zea mays
  Clone ID: LIB3279-039-P1-K1-E5
cggacgcgtgggtactgatcctaattattctatacggtgtagtatttatgcagttcagaggaaatggattggcatagatgtaaacaaaaaatgggttttaaatcctttatttcctccataaatataggatcactccaactgccatgtagctaggttcgtcagaactagttcatgatatataccgatattaattatgctacactttgtaggtatttattcaatgtggtacactacgtaaaatgtggttcaccggtggacgtatctccatgttcgagcgtaaaaacctttaggtttgagcgtaaataccgatccaacatgaaagatgttgaaaacctcttgatgttggcatagatatgtatacaaagtgacataaaaatatgtacgcgattgtatatcgtcactccaccatgaacatgcatccaggtgcgtcccccaccaaacacatgcatgcggtcttatttttatggcagatctgaaaaatatggcaaccattaggcacatgcatgtggtacctatttt

SEQ ID NO: 7177 - DNA, 403 bp, Zea mays
  unsure (1)..(403): unsure at all n locations; Clone ID: LIB3279-039-P1-K1-E6
cacgcgtccggtggagtcaggtgggattggcaccagaagccggtggaaagaaggtgatgaggaggaattggggagcagtgaactatccacggggcccaagattgtgagctgggcatttggtggcagcaggatggcattggccagagctgatcagctgtctgtggagatatgggatagtgctacagcagcaattggcgcaaacccctgagtagagggaggatatcgcaaaagcaagccgacgcttgtcaatgttcaattgctgcttggtcctctatgcaatgtaaatttactttagcgtgttggttgtgttggatcccagataggtagaatcttgaatgcaatgcctggaaggtatggaatgattttactggggttgtntnaaataaaattaagatatatgtat

SEQ ID NO: 7178 - DNA, 647 bp, Zea mays
  Clone ID: LIB3279-039-P1-K1-E7
cccacgcgtccgccgcgcctagactgtgcctgcatccctcatcgctcggctcgatcgctgatcagttctgcggccgggggggcggcaacggcaaaggagagggcacggagacgatcacactggaggcctcggagtatgtaacgggagtggcctggtccgtgggcccgttcaagttcaagaacgtggagcgctgcatcacctccttcaaggtcgtgaccaacctccgcagctacggccctttcggccacggggtggacagcacgcaccacagcttgcccgtgctcgacggcagcgtcgtcggcatgttcgcccgcgcaggggattttctcgacgccatcggcttctacgttctcccagatgccctccctgctctaaaaccgacgacggaccctgctgaacaagaagaaaaagaaaaggattctggccatcaacagaatgggaaggcaaaatctaaccaagaagaaaacgaggactccaaaaacgagaaggataaacccttgtcgtagttcgttttctacgacaaaaaatgaatcctaatctttgtcggatatctatttgtgctcttgttgtgagtctcttcagctattgttccaactattattaatatatgtacatgcgtgggagctatgcattgtaataatcaattt

SEQ ID NO: 7179 - DNA, 486 bp, Zea mays
  Clone ID: LIB3279-039-P1-K1-E8
gcgcgatcgcaacacaatccaaagaacgacgcgggggagcgagcgataaagccagaacaagaggagcgatccagaggagaggacgaaagagtcaggggagctgctaaggaccgatggccgaccccagctattggatagggatggacatcgaaacctccgtcacgatgctcgtcatcggtctcgccaccgccgtcgtgagcgtgtgcctcttcttcattttcatgtgcatcgtgcaatggtggtactcgccacggatgcgcgtcttcaggctcggcggcgtcaccaccctgaggcagaacctggactacacctgcaccctgtgccaaaacagcatggaggccggcgagaaggtccgcacgctctcctgcgaccacgtgttccactgcggcggcagcgtcaagtgcgagggaatcgaccactgccttcgcactggaccgatggagcgctgcccgacctgttaccgggttccccatcccgtgccctgga

SEQ ID NO: 7180 - DNA, 512 bp, Zea mays
  unsure (1)..(512): unsure at all n locations; Clone ID: LIB3279-039-P1-K1-E9
gactcaaagaagcactacgtcaaccctcagtcaagtacactcatatctacctttctatccaatacatgtgacnttagtaaaaggggggctgctaacaacccatacccnaccccatctattgtatatggatgtacatttaaacctccgactctatgctcatcttctgtctctccaccgccgtcatattcgtgttccttttcttcattttcatgtccatctgactatggtggtactctccacgtattcgcatcttcagtctcgtctgcttcaccaccctgattcataacctgtactacaccttcacccttttccaaatcatcatgtatgccctctataatgttcgtactctctcctgaaaccacttattacatttcttcttaatattaattctatttaatctaccacttttttaactctttacctatttaactttcccttccttttacacttttaccatttccttcctctgatacttactccttctctctttcttctattacttactctcttta

SEQ ID NO: 7181 - DNA, 122 bp, Zea mays
  unsure (1)..(122): unsure at all n locations; Clone ID: LIB3279-039-P1-K1-F1
ttcctaatattcccgtttctacccacccttcctcccacccttcctcttactttttccattataaccttctcattttcttaaacctcctaatattctaaaccnttttatgataattttaaaac

SEQ ID NO: 7182 - DNA, 333 bp, Zea mays
  Clone ID: LIB3279-039-P1-K1-F10
ggcggcacgcgtccgatctctttgcctccctccaccaccagtccaccaccactgctacccaaccgtctcttccccagagcgtaccaagggacacgggggccggcgatggactgctactgatgatgcgctggtgctctgcaccaccacacgcgctcacccgaggacgtcttccgcgatttccgcgcgcgccgagccggcatcgtcaaggccctcaccacggatgtggagaagttctatcagcagtgcgatccagagaaagagaacttgtgcctttatggtttggcaaatgagacttgggaggtcactcttccagctgaggaaggacctcctgag

SEQ ID NO: 7183 - DNA, 570 bp, Zea mays
  Clone ID: LIB3279-039-P1-K1-F11
gcgcggacgcgtgggcaaaaccgaaggacttgtccagcagaaaaacaccagggatcttcatgcagtacaaatattactgaggaagggttacgaagcagcggctgcgtgaagctaggctgctcatggttgatttcctgatactaggcctagctggtatctgcttagggacgatagcaaagctcagtgacaaaacattcgggatgcctggctacatatacactataattgcagtctctcttttgtgcaagatcgcagcactgcggtcgttttcgttggagcgattgcagtacttcagagagagagaatctgggatgagctctctggcatacttccttgctagggacacgattgatcatttcagtactggtgtgaagccgatcatttacctgtctatgttctactacttcaataacccaagatcaacaattgctgataactacattgtgctcctcgcgcttgtgtactgtgtgactgggataggatacacttttgccatctgcttcagtcctggctcaacacaggtgtgttctgcgcttatccccgttgttctaaccctgtattcactcaaaa

SEQ ID NO: 7184 - DNA, 500 bp, Zea mays
  unsure (1)..(500): unsure at all n locations; Clone ID: LIB3279-039-P1-K1-F12
gcggacggcgatcgcgaccccgatcgacaactcgcctttcatcgtctcctcctcccgggacaagtccgtgctggtgtagaacctgaccaacccggtgcactccaccccggaatccggcgtcaccgccgactacggcgtccccttccgccgcctcaccggccactcccacttcgtccaggacgtcgtccttagttccgacggccagttcgcactctctggctcctgggacggcgagctccgcctttgggacctctncaccggcctcaccacccgccgcttcgtcggccacgagaaggacgtcatctccgtcgccttctccgtcgacaaccgccagatcgtctccgcgtcccgcgacaagaccatcaagctctggaacactctcggcgagtgcaagtacaccatcggcggcgacctcggcggcggcgagggccacaacgggtgggtctcctgcgttaggttctccccaaacaccttccagcccaccatttgtctccggatcc

SEQ ID NO: 7185 - DNA, 436 bp, Zea mays
  Clone ID: LIB3279-039-P1-K1-F2
ccttaatgggtgtggatcttaataaagtgcctctagccactgataatgctggtatgaagccaggagactgctcaaaggatacattgggagctggggtgcttcaccataaaatactcacgtaagtgaacatgattccagtgacgaagatgccaacatgactgagcagcaggatgatgatggtactgccattggtggcagcactcaaggtctagaatgcaccagtccagaaaggtcagaggggagattgaggtcaggttttcatggcaatcctgtttctacagctcctgatagagaggttacagataccgagcaagttcccgagacagatatccaagctggtaatgctggttgcgatgaccaaagatgttacaacacaggatgagagactattccactagaagatgatatgctgctcccaaagaacgaggaacctact

SEQ ID NO: 7186 - DNA, 316 bp, Zea mays
  unsure (1)..(316): unsure at all n locations; Clone ID: LIB3279-039-P1-K1-F4
atcgtgcctataacatactggtggccacagcaagtcacgcctgctactctcacccttcttcaaccatacagtatctcctcaaggctccccacccaaatggggggctatnacctcaactcctcacccctccaccactaaaaagcctccatccaacctcccatccccaatccccacctccccaacttcacctctatcccctcttctcacctcaaaccctattcctcccctctccttatctttacctacatcttcctcattcccattaaagctgcgactatcctcaatcacacgtacagcatcatcgtgcctacctaca

SEQ ID NO: 7187 - DNA, 376 bp, Zea mays
  Clone ID: LIB3279-039-P1-K1-F5
gcgtgcataaccacctatctcaaggctgtttgtctaactctacatcttctgaatttcatactcacaactttgcacttcctggagcctaccataaacgggaggtacatctacctcaccgatcatatccataagagacacacatacgagaatatcaaaaaaactttcaagactaccttccaaaacccactcacaattcttatggcctatgtgaaagaaaatctccaaactacctacttcacattttacagtatattgctcatccaatactccttgatcgtgatcgctctaccccaccactttggaaagctcttcagcctgtactacatccaatggtgactcaggacccccttcctatacaccatccaacacatcttca

SEQ ID NO: 7188 - DNA, 424 bp, Zea mays
  unsure (1)..(424): unsure at all n locations; Clone ID: LIB3279-039-P1-K1-F6
ggtgcggtgcgcanagaatccccaagcaaacaaacagggtanagggagaggagaggagaggagaggagaggttggntctggaggaccatggctccgatggggctgtacggggcggttatttcnttgaacgtgacgaggtgcgcaacggcgctggaggaggctggctccgactacgagatcgtgcccatcaacttcgccaccggcgagcacaagagccccgagcacctcgtccgcaacccgtttggtcaggttccagctctgcaggatggtgacttgtacctcttcgaatcacgagcaatctgcaagtacgctgctcgcaaaaacaagccagagctgttgatggaaggaaacctcgaggaggcagcaatggtggatgtttggatcgaggtggaggctaaccagtacaccggtgcactgaatccca

SEQ ID NO: 7189 - DNA, 392 bp, Zea mays
  Clone ID: LIB3279-039-P1-K1-F7
gcggcggatgtcatcgcgcccggcgtgaacatcttggcggcatggagcggcgacgccagcccggcgagcttgtccaggggccgccggcgggtcgggtgaacatcctgtcggggacgtccatgtcgtgcccgcacgtcgccggcgtggctgcgctgatcaaggccagccacccggactggagccccgcgaagatcaagtccgcgctgatgaccaccgggtacgtccacgacaacacgtaccggtcggtgaaggacgcggccaccggcaaggcgtccacgccgttcgatcacggagctgggcacatacacccgctgggtgccctcaaccctgggctggtctacgacatcggccaggacgactacctggagttcctctgcgtggagaacctggcg

SEQ ID NO: 7190 - DNA, 524 bp, Zea mays
  Clone ID: LIB3279-039-P1-K1-F8
gggggcatccatcagaatgcccattctacatgaaaactaggacatgccaatttggatcagcttgtgagttttatcacccagaagatcggtgctcagggagagggggagtgattgatggtactgactatggacatgattttgccacgaagtcacggaatgttctgcaggaactggcaatatatcctgaaaggcctgatgaacttgagtgttctcactacatgaagcatggctactgtaaatataagatgaactgcaaatttcatcatccaagagatcgtcttccaaagaaataggaccatttgctacaaccactgttgtaactggctgtcgttgatgagtggaccaagtactgatgatgggatgatgatgggacagaaatgcaggaaggaagccatagtcttcctttttgaagagatcgattctactcatgtctagtgtcggtagagttctcgtaccagatgcgaactggctggtggcttcccaactaccgttcattcatatactaccaaacattgctgtgatct

SEQ ID NO: 7191 - DNA, 337 bp, Zea mays
  Clone ID: LIB3279-039-P1-K1-F9
gcgcgtcaatctgccctgggagcgcgcccacctcgcccacctcgaggagatggagaggaccggtgggaagcactagatggactgccccgtccctgggcggcagcgcgggaggacgggtgactttcatggggtccattcaggctgatggcttctgttttcttctgctgttgagctactggagtcatgttactttggtcgttggttttgtacccagacagcaagaaactgtccagcttattgtcttgttcctcgcgtcttgtcataagtaacttcaaacaaaggagtgcatgcattgtgattaaaaacgttttcagcaattgagtacgaatattctctt

SEQ ID NO: 7192 - DNA, 653 bp, Zea mays
  unsure (1)..(653): unsure at all n locations; Clone ID: LIB3279-039-P1-K1-G1
ggggcggcgccggcctacaaccgttttcgtgctcacacacccaaaccttagtcgcgatcaggccccaaggactcgagatggagtcgagggcacggggagcgccggcgactccaggctctcggtgaggaagaccaaggctgagaaggacccaaacaagcccaagaggcctccgagcgcgttcttcgtcttcatggaggagttcaggaaggactacaaggagaagcaccccaatgtgaagcaagtctccctgattggcaaggctggtggtgacaagtggaagtccctgtctgatgccgagaaggctccctacgtgtctaaggcagagaagctcaaggctgagtacaccaagaagatcgacgcttacaacaacaagcagtctggagaccccacggcgtctggtgattccgacaagtccaagtccgaggtgaacgactaggacgaggagggtgacnagtgatgtatgacggatgaaactctgtccaagtgtttgcagtcaaggaaaaaatctcgtcgttgtcggcctaaccgggttttctcgaaggactttctagatgcagtagattagtgccgtcttctgagtagtttccttgcaagtgtcgtcccgtccctggaggaggcagtttaaatttgaggttcttcgcttcatcggcact

SEQ ID NO: 7193 - DNA, 430 bp, Zea mays
  Clone ID: LIB3279-039-P1-K1-G10
gcgctcgtctgctcgcatttcctcccaatccatcccgcctccaaacccgaactccaagtcgccccgcatcgatggcgcgggaggccgagaagaagcccgcggcgaataagccggcggaggaggagcccgctgccgagaaggcgccggccgggaagaagcccaaggcggagaagcgtgtcccagcaagcaagtcccccggcaaggaaggcggcgagggaaagaggggccggaagaagggcaagaagagcgtggagacctacaagatctacatcttcaaggtgctgaagcaggtgcacccggacatcggcatctcctctaaggccatgtccatcatgaactccttcatcaacgacatcttcgagaagctcgccgccgaggccgccaagctcgcgcggtacaacaagaagcccaccatcacctcccgtgagat

SEQ ID NO: 7194 - DNA, 591 bp, Zea mays
  Clone ID: LIB3279-039-P1-K1-G12
gcgcttggagactaggttagacaaagctctcggaaagattagagcaaaaaaagaacgatgtgctgtgttctgaagtcgagtacatgcagagaagggaaatggagttgcagaatgacaacttgtacttaaggagccgggttgatgagaatgaaagggcacaacagacagcgaacatgatgggggcaccatcgacaagtgagtatcagcagcacggttttactccttatgatccaataaggagcttcctgcagttcaacatcgtgcagcagcctcagttctattctcagcaggaggaccggaaagacttcaacgaccaaggtggaagataaatattggacctctcaagcttcagtacttatccgtgatgatgcatgactgccagtgagaaactgagctacattactgtggaattatatgtaaagactagtactactgcttcatatatgtgcatgtgcgcacacgcgcacgtagtatgcacaatttcattccactattatggcttggcaccaactatgtctccttaattatcataagagaaaaataggtcacgcacaaaaaaattctaaagatgaggcgcagtgttggatgact

SEQ ID NO: 7195 - DNA, 444 bp, Zea mays
  Clone ID: LIB3279-039-P1-K1-G2
caccctcttgttaacgagaaagagaggtgggtcacatacattaaggattctccaaagccacctccagagagagttacattcacgtttgcagtaatcaactcatccgcatacgttgcgatggtggtgactggagctggaaaggcggcagcggtgcagaaggcgctctcagacaagcaaacctcgtcagacctgctgcctgttgagatggctgtgctgcaagatggagaattcacctggttcactgataaggcagcggtgtccttgctgcagaacaagtagagtcccatggtaaccttggctcgaagccattttagctcataaaataaaagatccaggggcctgcgtgcatagctgcattcgtcctccaggatttcgtgtaacggagactcgatccctttatgtagtgtgtgttgttcggagtaatgttcaaaaactctattgtct

SEQ ID NO: 7196 - DNA, 435 bp, Zea mays
  Clone ID: LIB3279-039-P1-K1-G4
gcgcgcctctcctgctcctaccgcagctctccctcaggtttagtgttcgcaatggcggccttcaacaatgcttggtggcgctgtctaaggcacagtgctgtggtgagcggtatcactggtggctcttctcctgcagtgttcaatgctgcacggctcatgtctaccaagctatttattggtggtcttgactggggtgttgatgacgtgaaactaagagaagcatttagcagctttggagaggttactgaagcgagggtgatcacagacagggagactgggaggtcaagaggctttggctttgtgaactactccgacagtgatgctgccaaggaagctatttctgcaatggatggcaaggaaattgatgggcggcaggtacgtgtcaacatggctaatgagagacctgctgggaaccgtggtggtggtggctatggc

SEQ ID NO: 7197 - DNA, 192 bp, Zea mays
  Clone ID: LIB3279-039-P1-K1-G5
gcgtgctttagcttcatgctgcttagcgttagtaaagcctaagcactagctacacaatagagggcgtgagctatggcgaggaagggtaacttcaatgggcggctctttattgtgttgaccccaggttatatgaattttgtttttggacaagatgtgtaacgtgcctaaattccaagggttttttttggcttc

SEQ ID NO: 7198 - DNA, 523 bp, Zea mays
  Clone ID: LIB3279-039-P1-K1-G6
ggcggcgcctacaccctcctcgccgcctcactccctctgaggtcgcagatccgtccggttagacgaagccgcccgcacccgagcctccggtgagctcgcctgcacctacgccgccctcatcctcagcgacgacggcatcgccatcaccgccgagaagatcgccaccatcgtgaaggcggccaacatcaagctcgagtcctactggccggcgcttttcgctaagctcctggagaagcgcagcgttgaggatctaatcctctccgttggatctggtggtggcgctgctccagttgctgcttccgccccagctgggggtgctgcagctgctgctgcccctgctgcagaggagaagaaggaagagcccaaggaggagtctgatgacgacatgggcttcagcctgttcgactgagagtctgagaccctcgctacccagccattaacaaattcgcttatgctgtccaagacttatcttacgttatgtctgtaggcttttgttattacaagtactcaagtttttgagttt

SEQ ID NO: 7199 - DNA, 581 bp, Zea mays
  Clone ID: LIB3279-039-P1-K1-G7
ggagcaacttgcccagtttgcttggagcatccacatgatgctgttctcctcctgtgtacctctcaccacaagggctgcgcggccatatatgtgtggtaccaactaccgtcattccaactgccttgaacactttaaaggagcttatgcaaaggaaaaaatggctcttggtgtttcggctgagtctgcatctggccttccattatcctcaaacacactgccatcaagcaaccagccatgtgtaatggaacttgcctgccctctgtgccgtggagaggttaaaggatggactgtggttgagcctgctcgtcagtatctgaaccggaaaaggagaaattgcatgcatgatgggtgctcattccatggctcgtataaggagctttgcaagcatgtgaaatcgaaacaccctacagcaaaacctcgtgaagttgatcctgctactgcagatgagtggaaaaggtttgaatgtgagagagagcggcaggatgccatcagcactatcaggtccatgaacccaggagctgtgatcatgggggattatgtcccttgagttgaatgggggtggcaacaaccattttgctctc

SEQ ID NO: 7200 - DNA, 444 bp, Zea mays
  Clone ID: LIB3279-039-P1-K1-G8
gcggtgggaagtttgctgtgaagaggaaagcagttggaatttggggatgcaaggactgtgggaaggtcaaggctggcggtgcttacaccatgaacactgctagtgcagtcactgtcaggagcacgattcgtcgcttgagagagcagactgaagcatgatttagcttgctacatcagggttctcctagttgctgttgtcgggaatgttgagctcctctagttggatcacgagactggctaaaagttgggtgctaagatttgtagttggttaccgttgtgaatttctcaagtgatattatcctatgcttgtctcaatgactcaaatttggttgtggtttctatgcttttggctgtgtcaatggtttgccattgttgaaattcaacccttaatgctgcctcttataataaaaagtttttttattggtctggttcagaaagcaagatt

SEQ ID NO: 7201 - DNA, 344 bp, Zea mays
  unsure (1)..(344): unsure at all n locations; Clone ID: LIB3279-039-P1-K1-G9
ggcgcgcggattcggcttcgtcaccttctacacggaggaggcgatgcggaactccatcgagggcatgaacggcaaggaagtncgcggtcgcaacatcgccgtcaacgaggcccagtcccgcggcggccgtggaggcggcggcggctgcgggtacggtggtggccgttgaggcggcggctacggcggtggcggtcgccttgattgcggcggccgctacggcggtggcggcggctacggctgtggcagcggcggttacagtggtagttgcggcccattcgtaagtggcaacagtggcggatagctatggttacttcaactggtacattattatctgaacttttatg

SEQ ID NO: 7202 - DNA, 625 bp, Zea mays
  Clone ID: LIB3279-039-P1-K1-H1
tgtgcgcccacgcgtccgcccacgcgtccgcggaaggcagctcatccatatccccagaaatcatctaaaaatgtttctcaaaggattttattacaagaacaacctactcagcgggagcaaggttctgtcatgcctatggatactgctactgtgataaacacaaatgcgaatgtggcagtggcagtggcagtgccttcctgggacaatactcttgctcaatctctcagtgctggtcttgttccaggtgcaacaaataactgttcaagtagcatagagagtccatctggtacttggccaacttctgaagcagttgagcaagaaattgtggttccatcactccatgctatgccagattttgcccgagtatacagcttcctaggaagcatatttgatcctgatacaagtgggcatttgcagaggttaaaagtgatggatccaattgatattcaaacggtactactacttatgagaaatctttccacgaaccttaggagtcctgactttgagcaacatctatggtggtggggaccatgttaaacctgaaggcatggaaaatcatggatctcctcagagtggccatcttccattcctggtaacaagtgaatgagagcacactggcaatttg

SEQ ID NO: 7203 - DNA, 545 bp, Zea mays
  unsure (1)..(545): unsure at all n locations; Clone ID: LIB3279-039-P1-K1-H10
ggaagtcttaccagggcaagaataaccgcaatcactggcaacagaaggcttctgctgctggaacagtggagactaaggaaaaggagaatgctgaaggcaccaccattgcgaatgatgtacaagagagcaaagatccatcaacggtgaactcagctgtgcccatgccatgtccagttgtccagaagacaccaccactcaaaccagctaccacagaacagaagctgaagctggagttgccgccagttaccaatgcggcagcctatgctccatttgttctgaaaaggtgcaagtcagagccgatgcgatcatcggcgcgtttggcacccgatgcttgcttctggaaggaccgccatcggccgctgaatgcggctggagttgggttctgatccgtgccagacagctgctggaatgtgacatttagttaggtagtgagtgagtttgcgagcctgttgtgtaatagtagcgagtggttctttgactgtgctttgtgctgttatgtgatgtgtggacaccaccaaataatggcatgctgntaaagtactata

SEQ ID NO: 7204 - DNA, 295 bp, Zea mays
  Clone ID: LIB3279-039-P1-K1-H11
gatcacagcggcgcctgcttataacagcacccgtagctagaccgaacgccgttcaccatgatcatgcccaagaagaaccgcaatgagatctgcaagtacctcttcaaggagggcgtgctgtatgccaagaaggactacaacctggcgaagcacccgcagatcgatgtgcccaacctccaggtgatcaagctcatgcagagctttaagtccaaggagtatgttagggagaccttctcctggcagtactactactggtatctcaccaacgatggcattgagcacctacgcaactacc

SEQ ID NO: 7205 - DNA, 604 bp, Zea mays
  Clone ID: LIB3279-039-P1-K1-H2
gcgcttccgtcgccacccagcgtgctctctctccctctttctctctctctcgtggcggcgcctgggcagccgtcgctggcgctgcgctaggtgccaggtcttcttcgggcccttcgccggcgacgagtaccaccaggttgtacatgtgtacacccatgtgctttactgggtcggaccctactcatcctccacactaaggccatctccatagactgcactgtttagactccactgtttagagagtggagatagggagtgagatagagagtggaatagggaggatgctggagatagcctaaggttgccactgagtgtgtgcatgattcagaggcaatgtcatcacaaactggaggtggcaaagagagtgacgccggccctgggcaacacaggcagatgcaaagtttggcaagacatgggtctttatacaaccttaccctcgatgaggtgcagaaccatttgggggagccattgcttagcatgaattttgatgagctcctgaagagcgtgtttcctgatggtgtagattcagatggtgctgtcacaggcaagcctgatcggacctcgagcctgcagcgacaggggagcatcctgatgccttcgcagt

SEQ ID NO: 7206 - DNA, 406 bp, Zea mays
  Clone ID: LIB3279-039-P1-K1-H3
tctttatcctccatacctcttattagctgcaaatccaatcctactgcactatccaaatacccatacgcactactactccttgatgattctgcatcaatgtactcgactattcacctttatctgtcatgtttatgatactcatttctcgttccaactacataaatgtgcgtcgtcaccatattcccttcctactctcacctatcctttactactcactactaacgattgtccactttgccatcaacatttgttctctttcctgcacctgtcacctaaaatccttaatcacaaccctattatttctgcactgcacatcctgtatatgtatagtttcatacttctgcatgacttccactaaaaaaataatactccttattagagctgtttttctctatttctcactgta

SEQ ID NO: 7207 - DNA, 459 bp, Zea mays
  Clone ID: LIB3279-039-P1-K1-H4
gcgcggacgcgtggtcgccgtcgccgcctcctctccccagcacccggagctcgaccgaacgccgctcaccatgatcatcgcgaagaagaaccgcagtgagatctgcaagtacctcttcaaggagggcgtgctgtatgccaagaaggactacaacctggcgaagcacccgcagatcgatgtgcccaacctccaggtgatcaagctcatgcagagctttaagtccaaggagtatgttagggagaccttctcctggcagtactactactggtatctcaccaacgatggcattgagcacctacgcaactacctgaacctcccgtctgagatcgtgcctgccacgctcaagaagtctgccaagccacctggccgcccatttggctctggccctcctggtgaccgcccaaggggcccaggccgttttgacggctacaggccaaggtttggtgacagggatgggta

SEQ ID NO: 7208 - DNA, 353 bp, Zea mays
  unsure (1)..(353): unsure at all n locations; Clone ID: LIB3279-039-P1-K1-H7
gcgcccacacatccactcacacttacattacagcattcatgccctctacttattctgctcacctgctatactctctaagaacctttttatacatgatccacacattantaaaacactcccatccttttctcctctagattgcagctcctatgccaaattacctgcactcacatttaaagtaggcacgccaccctcatttttcaccatcatcacataaataattatcgaccttttctcctaatacaactcccatacccattttgcaattacctttatctcaacatatcttcgatacttaccagacattacactccaaccgacctacctatacttgtgaatcacccatagttcat

SEQ ID NO: 7209 - DNA, 707 bp, Zea mays
  Clone ID: LIB3279-039-P1-K1-H8
caagttttgatacagagggccgctaccttctgttgaatgcaattgcaaaccaactgcgctatccaaatagccatacacactactactccttcatcattctgcatctatttgctgaggctacccaggagattatccaggagcaaataacaagggttcttctggagcgtctaatagtgaaccgcccccatccttgggggttacttattacttccattgaattgataaagaatccgcgttacaacttttggaaccggtcttttacacatagtgcacctgagattgagaaactgtttgagtcagtggctaggtcctgcggcgcaaaagctgtagatgaaggaatcagtgtgcaggatggcagtcactaataaagtaatttgctttgttagtgctgtttttgtgctatttcgcactgtaaattgtgtgctaccctatctgggcttgtacagaccacggaaatacatagtgcgtcacgtcagctatttgggtgcctgtgctttgcctggtagctaggaattactattgatcgccagatgctccaggtgcaaatttttccgtggactggttcacttatttgattcaactatgtcagaatggtagatggtgcgaacttcagcttagatagtgagttgagttgcaggcatgtttgtaaataatatttttgatgccattctgttttctcatagaacggaacatttcaggatcaaaaa

SEQ ID NO: 7210 - DNA, 709 bp, Zea mays
  Clone ID: LIB3279-039-P1-K1-H9
gtcgagaagtccatgatcacacagatcctcgagagggagaaggagggcctggagcagttcaccgccaccgatggttacgactacgagggcgggagcaacgtgctcaaggtgctcggctactacagcatgattggcctcctcaggatacactgcctccttggggattactacactggcctcaagtgcctcgctcccatcgacctcaaccagcaaggggtctacaccattgtcatcgggagccacatttccaccatctatcactatggcttcgcaaaccttatgatgcgcaggtatgttgatgccactcgtgaattcaacaagattcttctgtatatcctcaagtacaaacagtatcatcagaagtcccctcagtatgatcagatactgaagaaaaatgagcagatgtatgcactgttggtgatttgcctatctttgtgcccacagaacaagctcattgatgaaaatgttagcacccagctgaaagaaaagtatagcgacaagatgacaaagatgcagaggtatgatgatgaagcatacgctgcttatgatgagctattttcgtatgcttgccccaagttcattacaccatcacctccagtgctggaccagccgctaacaaactataaccaggatgcataccgtctacagttgaagctgtttctttatgaagtaaagcagcagcagttgctttctgggatccggagttatc

SEQ ID NO: 7211 - DNA, 376 bp, Zea mays
  Clone ID: LIB3279-041-P1-K1-A1
ccacgacttccgtgctcgccgccttctcggactaggggggttcggctcgagatctgatggcgggcgccggaggactacatggaggttagggagatggcgatggccgcggcggctgcggctgcggcgtccggcgggggaggcgtcaagctgccgccgcccaatcccaacctgccctacagggaggactgctggagcgacggcgagacggcagctctcgtctccgcctggggcagccgctacgtcgagctcaaccgcggtaacctgcgccagaagcagtggcaggaggtggcggacgccgtcaactcgcgccggggagcctccgcgcggcgccgaccgtcgcgcaccgacaatcagtgcaagaaccgcgtcgataccc

SEQ ID NO: 7212 - DNA, 406 bp, Zea mays
  Clone ID: LIB3279-041-P1-K1-A10
cccacgcgtccgatgagctttatgtcgaagaggaggactacgagagactccgtgaatcaggtgacatgcatgacaactttgaccagattggtcttgcccagaagcttgagaagcatgaattgctggagatgaggaggatcgccgcctacatttacaagaaggctggcaggtggaagcagtcgattgctctatcgaagaaagacaacatgtacaaggactgcatggagacatgctcacaatctggcgaccgtgaactgtcagaggacttgctcgtgtatttcattgagcagggtaagaaagaatgttttgcttcttgcctcttcatttgctacgacctgatccggccagatgtggctcttgagcttgcatggatgaacaacatggtggactttgccctcccgtacct

SEQ ID NO: 7213 - DNA, 346 bp, Zea mays
  Clone ID: LIB3279-041-P1-K1-A11
gccacgcgtgcggcggacgagacggcacaggacatggtctaccacatcctgtacgaggacggccaccatgacgcgtaccatatggagatccacatccgcaccctcagcagcgaactgaagggcaaacacacagcgatgtaccaatacatgtaccactacaggaacttctccagcaagttcaccgccaagctcaccaaggatctgaaggaggatctaaaggtgctacaagttgtgctgcacgatactcaccacctaaattaccatgtacatggtactgagtatggcactaaacacagcacgagacatatgtggaggcttatgagaatgcatatgatagtgaataaga

SEQ ID NO: 7214 - DNA, 286 bp, Zea mays
  Clone ID: LIB3279-041-P1-K1-A12
cccacgcgtccgcgacgacctcacggtcaccgtcgcaaacatcgaggaaggcgggcagttgacgatctctggcgctgaggagatcctgaaggcgctttagaagccgcagcaacgatcggtctagtttgaactcgcctttgaataacttgtcgttggacaaggtctagttcggtgttgtgtatggaacggtcgtcactgagtcatgcacgatttggtatccgtgtgtttatgttcgccggtttgaggaactctctgatccgtcgtgacacaaagttgatgctgagag

SEQ ID NO: 7215 - DNA, 291 bp, Zea mays
  Clone ID: LIB3279-041-P1-K1-A2
tggcaattaagctcccgtggggaatgctgctgcggctgctgctggtactctccgtgtcgcccatttaataagaatcagctgctgccactcttgccttcagcgctccgcccccactgcctgttcctcctcctcgtcatgctcaagacgccgaaagcatgctcatcaacggcaacttcgagacggcgccgcggaagctgaacaagaccctgatcgtggggcgccactcgctgccggggtggactgtgcaaaaccacgtggagtacgtacttggcggtccccaacccgggggca

SEQ ID NO: 7216 - DNA, 410 bp, Zea mays
  Clone ID: LIB3279-041-P1-K1-A3
cccacgcgtccgaaagaggctgggagtcatcatccacaaaagtcaagttttctacgttaagagaagaaaagattgctgatttgttaagtatgaaaccagatccaaactgattgttaatttgcttcatgccatcaccacgatcgaatcttcaagactacaaatttgtcagcgtgatggagcctgcccatcagtacatagttctttttttttctttttttttttggacttggggatgcatcctgttggggagatcctcttcccctgcaccatggtccgaggttctgtggagccagggcgctttgggctagggaggaaattgtaacaataaattttcatacagttcatcgtgattagttttgtgtacagagcagagcatacacgtggtgacatggtccctgtagagggacaca

SEQ ID NO: 7217 - DNA, 372 bp, Zea mays
  unsure (1)..(372): unsure at all n locations; Clone ID: LIB3279-041-P1-K1-A4
gcgcccacgcgtccgaaagaggctgggagtcatcatccacaaaagtcaagttttctacgttaagggaagagaggattgctgatttgttaagtatgaaaccagatccaaactgattgttaatttgcttcatgccatcaccacgatcgaatcttcaagactacaaatttgtcagcgtgatggagcctgcccatcagtacatagttntttttttttttttttttttcttgacatggggatgcatcctgttggtgagatcctcttcccctgcaccatggtccgaggttctgttgagccaaggcgcttttgtctagggaggaaattgtaacaataaattttcatacaagtcatcgcgattagttttgtgtacagagc

SEQ ID NO: 7218 - DNA, 436 bp, Zea mays
  unsure (1)..(436): unsure at all n locations; Clone ID: LIB3279-041-P1-K1-A5
ctgattttgacgccgggtcgtgggcaaatcaggtagagcggctgcggattttggcgcccggcctcgggagtttgggagcttagcgactccacagtggaagactggtggacggcctttgcccgcgctgcgtcttcccctgcttcgcgatgggaggctcccctgtatgggacgggactctgtctccggacagcttcaacacctccgcggcggcgcttgttaagaggtggaaggagatcgaggtcgacgattcccttcctgaatggacgtggaagccgtgcagcaaattgggggtgccgtcggaggtagaagggtatctagccctggaaagagtgtaccgcagctgtggaacaagccaagagcagattgaggagatgaagttcgatggtgcangggatgtagcttgggtcgagagctccagcgacaatgttcatgttta

SEQ ID NO: 7219 - DNA, 444 bp, Zea mays
  Clone ID: LIB3279-041-P1-K1-A6
ccgcacaccccaccttccctacaccgccgccgccgtcgcacgcagccgcatccgccatgggggcgtacaagtatgtctcggagttatggaggaggaagcaatccgacgtgatgcggttcgtgcagcgcgtgcgctgctgggagtacaggcagcagccggccatcgtccgcctcacaaggcccacccgccccgacaaggcccgccgcctcggctacaaggccaagcaggggtatgttgtttaccgtgtccgtgtcaagcgtggcggcaggaagaggcctgtgccgaagggtattgtctatggcaagcccaagcaccagggtatcacccagctcaagttccagaggaacaagaggtctgttgctgaggagagggctggacgaaagcttggtggactcagggttctcaactcctactgggtgaatgaggatagcacctacaagtact

SEQ ID NO: 7220 - DNA, 357 bp, Zea mays
  unsure (1)..(357): unsure at all n locations; Clone ID: LIB3279-041-P1-K1-A7
cgtaacgcatttaagagatggcaatagcagttgtcagtgtgcggctatcgtacctccgttagggagtttttagcgcaagttgcgtcatttcgtaccctgtgagtgaccaagaagaaatattgttganngatttcctttttacaattctacatgnntatgatctcacttacctgattcannaaaaaaaaaacaaagagggcgggctcgtctcttagannggatcctaagctnnntacgtaccgcgtgccatgctgacggtcattagcttctttctattagtgtcancctannaattcaattcacttgnngccgtctgttttacaaaacgtcgtgacttggnngaaaacccttggcgtt

SEQ ID NO: 7221 - DNA, 408 bp, Zea mays
  Clone ID: LIB3279-041-P1-K1-A8
acgcatgcgtaccatggaggcggagggtcgtacaaagataggtggtttcattagagctgtattttctgtgttccaagacttggatttctcatttcttgagatgaacccattcaccttggtaaatggtgaaccgtatcctctggatatgagaggagaactagatgacacagctgctttcaaaaacttcaataagtggggcaacattgtgtttcccctaccatttggaagagttctcagtccctccgaaagttttatccatgaactggatgagaagacaagtgcgtctctgaaattcacggtactgaacccaaaaggacgcatctggacaatggttgcaagtggtggtgctagtgtcatatacgcaaacacttgtggtgatttgggatatgcttcggagctaggaaatta

SEQ ID NO: 7222 - DNA, 428 bp, Zea mays
  Clone ID: LIB3279-041-P1-K1-A9
cccacgcgtccgccaaaaccccaactcgccccgcatcgatggcgcccaaggccgagaagaaacccgcggcgaagaagccggcggaggaggagcccgcggccgagaaggcgcccgccgggaagaagccgaaggcggagaagcgggtccccgctggcaagtccgctgccaaggaaggcggcgagggcaagaggggcaagaagaagggcaagaagagcgtggagacctacaagatctacatcttcaaggtgctgaagcaggtgcacccggacattggcatctcctccaaggccatgtccatcatgaactccttcattaacgatatcttcgagaagctcgctgctggggccgccaagctcgcgcgctcttacaaggagcctaccattaccttccgtgagatccagaccttcgtgcgccttgttctttccggg

SEQ ID NO: 7223 - DNA, 437 bp, Zea mays
  Clone ID: LIB3279-041-P1-K1-B1
gtctcttcaggttgcaatcgaaggtgctaaagtggtgaaaggagaactggagaaaaaaatgacaatgctgattgaacagtgttctagcaaggacgacaaaattttacttcttcaccaagaaaatgaggcattgcaatcagagattgagcaatgtgagagggaatttgttgatctgatggatgatgccattactttttcagtgaattctgctgtctatgaagaaaaagcattcgagcttatgatgaatggtaaagctacagagaatagagcaatatcccaaaaggagttgctaatgaaggagatctcttctcgagatgctaatattgaggagttgcagaaaaggctggctggtattcaggatgaacatgcataactaaaagctgagttgaacacacatctagctctcatagcatcattggttgatcatgtcagtgtgc

SEQ ID NO: 7224 - DNA, 432 bp, Zea mays
  Clone ID: LIB3279-041-P1-K1-B10
atcctccgcaacttcacagcgtatcatcgttttccatcgctcctactcctatcatccagaaaatctgagcggtattgatggcgcccaaggcggagaagaagccggcggcgaagaaggtggcggaggaggagccctcggagaaggcggctccggcggagaaggcccccgcggggaagaagcccaaggcggagaagcggctacctgcgggcaagtccgccggcaaggagggcggcgacaagaagggtaggaagaaggcgaagaagagcgtggagacctacaagatctacatcttcaaggtcctgaagcaggtgcaccccgacatcggcatctcctccaaggccatgtccatcatgaactccttcatcaacgacatcttcgagaagctcgccgcggaggccgccaagctcgcccggtacaacaagaagcccacca

SEQ ID NO: 7225 - DNA, 388 bp, Zea mays
  unsure (1)..(388): unsure at all n locations; Clone ID: LIB3279-041-P1-K1-B11
cccacgcgtccgcccctccctcgctagggttttcgtccccgcgccgccgcgctcccggatcccaccgaaacaaccatggccggcggtcccgcggcggtgtcgttcctgaccaacatcgcgaaggtggctgcggggctcggagccgcggcctcgctcgcctccgcgtcgctctacaccgtcgacggcggcgagcgcgccgtcatcttcgaccgtttccgcggggtgctcccggagaccgtcggcgagggcacccatttcctcgtgccctggctgcagaagcccttcatcttcgacatccgcacgcgcccgcacaacttcttctncaactcggggaccaaggacctgcagatggtcaacctcacgctccgtcttctctcccggcccgacg

SEQ ID NO: 7226 - DNA, 404 bp, Zea mays
  Clone ID: LIB3279-041-P1-K1-B12
cccaagtcccaacacccgtcggcgtcgagcagcggcggcgatgacgacgagcctgaagaagaaccggaagaagcgcgggcacgtgtcggcggggcacggccgcatcggcaagcaccggaagcacccgggaggccgcggcaacgccggcggcatgcaccaccaccgcatcctcttcgacaagtaccacccgggctacttcggcaaggtgggcatgcgctacttccacaggctccgcaacaagttccactgcccgtcggtcaacgtggagaggctctggtcgatggttcccgccggcaaggccgcggaggcggtcggcgcggaccaagccccgctcgtcgacgtgacgcagttcggctacttcaaggtgctcggcaaggggatgctgccgtccaagcccatcgtcg

SEQ ID NO: 7227 - DNA, 446 bp, Zea mays
  Clone ID: LIB3279-041-P1-K1-B2
ggccatcgccgcctacggcgaggcgcgcttcgacgtgcgcggcgtcgcgctgcagctcgccgccgttgccttcgaggccacgcggctcgtgctcatccagatcctgctcacgtccaagggcatctcgctcaaccctatcacctcgctatactatgtcgcgccgtgctgcttctgcttcctcctcgtgccctgggccttcgtcgagctgcccaggctgcgcgccgtcggcaccttccaaccggatttcttcgtctttgggacgaactcactctgcgcctttgcgctcaaccttgccgtcttcctgctggtcggcaagacctcggcgctgaccatgaacgtcgcgggagtagtcaaggactggctgttgattgccttctcgtggtccgtgatccgggacaccgtcacaaccgatcaacctgttcgggtacgggatcgcgtttttaggg

SEQ ID NO: 7228 - DNA, 270 bp, Zea mays
  Clone ID: LIB3279-041-P1-K1-B3
gcggagagtaataaagtaatgctactggtattttaagctagatcgaggtgtgcctgtctctagtcatttatggtgtttagcaatcgtctacacagttcgtaaacggtgtatcgtggatgcatgttgccgcgagcagagtacgtaggcatgaaccgatgtgtgcgcttctgtctgtgtactctctctatgtagtaatgtgtggccagtgggtgctttgatccagatgtattcgctcgtgagtggtgagtcgtggaagttgatcgtttcagt

SEQ ID NO: 7229 - DNA, 392 bp, Zea mays
  Clone ID: LIB3279-041-P1-K1-B4
gacaatcgttgttctgtcgagattgactcttctggagctagtgatacagattatgctcgtcggcgatgtccacctcagaaccgacaactgcaacttccagtacacagctgttggtgtccaacgccacctctgatggtatgtacataactaaccttggtgaggcctgtgacgacactaagtctgctaccacgtggcattgtggccttggtaaccccggacacaatatcgtgctgcatgttactgattatggcactatggcatgtactaaatcacatgatgagaatgtttgccatgccatccatggagggcactctgttggtacatctaccaaccatttttacacctatgctagtgatgcattcgatcttatacactgtgacccgaggactgaa

SEQ ID NO: 7230 - DNA, 431 bp, Zea mays
  unsure (1)..(431): unsure at all n locations; Clone ID: LIB3279-041-P1-K1-B5
gaaaagcccccctcaaaacccacggcgccgccgcagccgcgttcacgaagcttggggaggcgagcaccccgatccggcgaggtgccgcgagcgaggcagcgatgagaggccgtgcgtcccatctccgcgcgctcctctcgcgagcgctctctccaagccttcctcctcctggtcgcgctctgcctcaggtcactaggcccggtgcgtctccgttcggagctggattcgtggggcgcgcgcgcttcttctccatcgacgcctcggctgcgacgcagggcgggtcgaagccccctgcgccgccgccggcgggtactgcgggcggcgagggaagggggtgtggtcantctgggaaatctgaacaagcggacgccgggaaagccgtccgcggagggccggtgtcttggctcagttttctactcctgcttgtgact

SEQ ID NO: 7231 - DNA, 415 bp, Zea mays
  Clone ID: LIB3279-041-P1-K1-B6
gcgaccaaaccatcctgataaccgactgcgtgggtacagccattgcgaccatgaccactatcttgaacgggcatcctaagaagcgcgggcacgtgtctgctagctagcgagctgctctcttctatcctctccctcttgttgtggctgcaattcctccgcttatactcgaccgcatttcttagcaagtacctacctggcgtctactttgtgctgctcatcttcctgggctacatggtgtacgccacttatgatgtcatccatagggcgcaccacagggacatggactacatcaagcaccccctcacccttttcaccgacttcgtgactgaccttgtcctcatccttctcatcatgctcaacaactcggctgacaagtcggaggacaagaggaggaagaggaggaggtgatgaaaat

SEQ ID NO: 7232 - DNA, 406 bp, Zea mays
  Clone ID: LIB3279-041-P1-K1-B7
aatttctgcataaggactagcccggcctccgcctgcagcttgagcgcgagttatccagactggtcatcgtcggagttggggcactgcaagagcagcaaggagaaggagcttgcccctgcctacctcaccttgagcgcgcagcctcctgcgccacgcgggaagcagcagcctcctgcgctcccctcgatcaaactcccggagttgggtcacttcggcttcatgcagcctcctcagcacgggagcgcttcggcgtcgtcgtccgcgtcggcgtcgcggccgttctacagcttcatgccggctggtccggttcgcatcgagagaccccggatcgggatcaaggccgacgacgcctctgacggcgtcgacctggaactgaagctgtgaaagcgctcatcgcttgacccct

SEQ ID NO: 7233 - DNA, 165 bp, Zea mays
  Clone ID: LIB3279-041-P1-K1-B8
gaaggcctgagctaggcgaacatctgcaggccgcagcagtatgccaaatcattatcattaccgttgccattaccaattggagattgccgtagatttccgcgattatgggaactcatttacctgattatctgatacgtttgaaataaaaggtcgccattcagaatg

SEQ ID NO: 7234 - DNA, 391 bp, Zea mays
  Clone ID: LIB3279-041-P1-K1-B9
aaatccccctgtcccgctaggattccccccaaaccctcccccaaaaccccagagcggagaggagcgcaagatgttcggcttcgggcaccacggccaccacggccagaacccgccggcgcacggcggcgtgcaccagcccaccttcaagatcttctgcaaggccgacgaggggtactgcctcaccgtccgcgacggcaacgtggtgctggcccccgccaacccgcgcgacgagcaccagcactggtacaaggacatgcgcttcagcacccaggtcaaggacgaggagggcaaccctgcgttcgccctggtcaacaaggccactgggctcgccatcaagcactccctcggccagtcccacccggtgaagctggtgccgttcaacccggagtac

SEQ ID NO: 7235 - DNA, 445 bp, Zea mays
  Clone ID: LIB3279-041-P1-K1-C1
gacgccatcaagaccgagctggagcgggagtgcccagatacagtttcctgtgccgacctgcttgccatcgctgcccgtgactccgtcgttgtgtctggcgggccgagctgggagattgaggtcggccggaaggacagccgcaccgccagcctgcagggcgccaacaccaacctcccagcaccgacgtctggcgtcgacaccctcgtgcagaagttcaggaacgtgggcctctctaccaaggacatggtcgcactctccggcgcgcacaccatcgggaaagcgcggtgcacttcgttcagtgcgcgccttgccggcgccggcggcgtctcggaaggcggcgcgggcgccttcaaggacctcaccttcttgcagtcgctgcagcagctgtgcacggggtcggctgggtccgcgctggcacacctggacctcgccaccccggcgacct

SEQ ID NO: 7236 - DNA, 404 bp, Zea mays
  Clone ID: LIB3279-041-P1-K1-C10
cccacgcgtccgcgactcgccatcgtcgagtttttttttcggccctacttctgtctccacggctgccgacgagccgcgcaaccgaactcactgcaggaggactcgcacagatcggtgagcgagcaagcgagagatggctgggaggctaaccgcggcagggtcccgcatcctgggcggcggcggcgcacgcgccgcggcttccgccctccgacaccgcgccggcatgggcctccccgtcggccgccacatcgtccccgacaagcccctccccgtgaacgacgagttggtatgggataacggcacgcccttcccggaaccctgcatcgaccgccttgccccgcacatcggcaagtacgaggcgttggcgtggctgtgcggagggctagggttcttcgctgccctcg

SEQ ID NO: 7237 - DNA, 393 bp, Zea mays
  Clone ID: LIB3279-041-P1-K1-C11
ccgctggtttgctaaggcaagcaacgtacatagactgcacgtcttggatccttcatgttgatatagtgtgttgttttatgatcaattgaccattcattacctccgcctgatggcccttattaacaacagaatcataaaagcatatggaggaactatgtataggctacaaagaagcataagaaccatttttatagcagaagccaaatgttctgatgattttgttttttcaattgtgttttctgttattggttcagcatgcacatatattgacatgatttatggcatggcatctaccatctttggtatatttatgacatcgttcttaattaatgtgtgcgacatgaaagatggatcttttttaacatcctaaaaaaaaaatgaataaagttttaa

SEQ ID NO: 7238 - DNA, 414 bp, Zea mays
  Clone ID: LIB3279-041-P1-K1-C12
cggacgcgtgggcggacgcgtggggcagcagcaaatagtggttggcctgttggtactctatatcgtcccttccagtgtacccgtcctccagcccattatacattatacttgctccagataagaccaagagcgtcatggccaacgccttgcctctcatcgtcgcgctggtcgccgccgccgggtgcgcggcgctggcttcggccacgtcgtacaccgtcggcgactcgcagggctggacgacaaccggcgtcgactacagcagctgggccagccgcaacactttcgtcgtcggagacacactagtgttcaactacgtgagcaaggcgcacactgtgacggaggtgagcaaggccggctacgacgcctgctccggcgccaacgcgctcagcgacgacgacaccgggttcaccacca

SEQ ID NO: 7239 - DNA, 441 bp, Zea mays
  Clone ID: LIB3279-041-P1-K1-C2
caataaggtgtcagagaaggttgatgtattttcttttggtattgttatgtgggaaatcctcactggcgaagaaccatatgccaatatgcactatggcgcaattatagggggcatcgtaaacaacacactgaggccacatgtgccagcttcatgtgatccggagtggagaaggctcatggagcagtgctgggctccagatccggcacagcgcccagcgttcacagagatcgctggacggcttcgctccatgtcagttgcagcaaatcaggcgaaggcaaccaaataagatacaggtggagtactgcctttcaacccccaatccgttgggggttctcttctcctttttttccttttgactggagagtaatacatatacatgcatgttatagagtgctgtaaaaattagtgcatcaatttatttataaccatgttatgagctgg

SEQ ID NO: 7240 - DNA, 439 bp, Zea mays
  Clone ID: LIB3279-041-P1-K1-C3
gaaacggtgccgcttcgagccaggtgcgggagggaccgagggaggcggagcaagtgggagctctggagctggagcgggtggaagtgggctgggactgggagccctagcaaagggccatcgcatcccctcttgcatactctctctctctctctcgtgattctcccgtgccccggtctctctgtctctagtggcgacgactgcgctgcgccgccgccctacgcaggtgcccaagtgtctatcttcgggactgcgccggcgacgagcacccaccagaaattgttggacctgggtctgcccctggactcgagcttggggccaagctaattcgagctctgagcatttgatttctagcatcttacatgcaaaaagctagtacttggaatccgagcaagatctaacccagacagtgcagtggcagttcagcgcaacatatcaagat

SEQ ID NO: 7241 - DNA, 319 bp, Zea mays
  unsure (1)..(319): unsure at all n locations; Clone ID: LIB3279-041-P1-K1-C4
cggacgcgtgggcccggctacgccctgccgccgcacccgcacgccccggggaccgggaccccctcgggaccgcctcagggcgggagccccggcaccggcgagcactcatccgggcggatgngataagctgcagtatactttgtttttctgtgtggggattgtaccgtacccggctctttgtgtatttagttgctacaactgcgcttgaccgccgatctacctaagtgaccaatgttctattttcgggactggtcttgcgactagcacgcaccaggaatagttctacctgatactttcacttcactctagcttggggcca

SEQ ID NO: 7242 - DNA, 439 bp, Zea mays
  Clone ID: LIB3279-041-P1-K1-C5
ataccattggagtccgtactccaggcaccgtggttccgatgcttgaggcagatatctccgtcgttggggtggagaagctcgctgtgcacttccacgacacctacggacagtgcctctcgaacattctcatctctcttcagatgggagtaagcgtggtggactcctccgtcgccggcctcggtggctgcccgtacgcgaagggtgcgtcggggaatgtggcgacggaggatgtggtgtacatgctcaacgggctgggcgtcaagacgggcgtcgacctgggcaaggtgatggccgccggcgagttcatctgcaggcacctgggacgccagtctgggtccaaggcagcgaccgctctgagcaaagttaccgcgaacgcctccaagctctgacaatataccatgatcccctactgcagataattgcggtaaaattagcgcat

SEQ ID NO: 7243 - DNA, 447 bp, Zea mays
  Clone ID: LIB3279-041-P1-K1-C6
aaaaaatggtcaatgaaatgcttcatgaggatgccagtgcttttgctggcaggtctgatagtgctagtactgctgaggaggagttccagaacaaagtgagagaaaccatggagaaagctttctgggatatggtcaccaactccatgagaggagaaagacctgattatagtcaattgatcaacctagtaaaggaagtgagggattcgttgcatgacctggctccaaaagaatggaaggagaaaattcttgagaacattgaccttgaaattctgtctcaggtacttgggtcaggttcccaggatgcacaatacttggggcagattttggagtattctctggatatggttcgcaagctctctgctgctgcaaaggaggatgagatgaagaaaaaccatgataaattattgagtgaattgtctaagaattctgaagttaacggcgatggca

SEQ ID NO: 7244 - DNA, 427 bp, Zea mays
  Clone ID: LIB3279-041-P1-K1-C7
gctgccttgcgtggaaccctaacatatcacacttggtagtgtgttttctcagatctgagaatgttgagtccatgtcgagctctttcaatagcttgctctctagctagatttcaagatatgttctttaggtctggtttttgcagttgcaccttcattaagaattgtactcatttctatgttaggattgctgaataaatggttcaaattactcatgcgcaggttatttctttgctgaaatttgcctgtataattttagtgttcaaattactcatgtactcattgttgtctagcaagttatttcatgtgcaaatgactgatgtgttatcaatagatctatccctcaatttccagacatcctcctggtaggcatctttgagtaaaattaattacaaatatatgtaaacacccattggatctaattaagact

SEQ ID NO: 7245 - DNA, 439 bp, Zea mays
  Clone ID: LIB3279-041-P1-K1-C8
ccgcagcgtaaaccctagtccccggcggcgaccttgcggcctccgctgcgctgtgactggggcgcgcttagacgaggagctgcggcggccaagaccaatcgaccatggctacccgtatccagtttgagaacaactgtgaaattggtgttttctccaagctgacaaatgcttactgtctggtagcgattggagggtcagagaacttctacagtgcctttgaggctgagcttgcagatgccatccctgtggtcaagacctctattggtggcactagaataataggccgactttgtgttggaaacaagaatggacttctattgccacatactacaaccgaccaagagcttcagcatctgaggaattgcttgcctgatcaagtggtggttcagcgcattgatgagaggttatctgcccttggcaattgcatagcctgcaatga

SEQ ID NO: 7246 - DNA, 426 bp, Zea mays
  Clone ID: LIB3279-041-P1-K1-C9
cccgtgagcatgctctccttgctttcacacttggtgtgaagcagatgatttgctgctgcaacaagatggatgctactacacccaagtattcaaaggcccgttatgatgagattgtgaaggaagtctcttcctacctgaagaaggttggatacaaccctgataagatctacttcgttccaatctctggttttgaaggtgacaacatgattgagaggtccaccaaccttgactggtacaagggcccaaccctacttgaggctctggacttgatcaatgagccaaagaggccttcagacaagcccctgcgtctcccccttcaggatgtgtacaagattggtggtattggaactgtccctgttggacgtgttgagactggtgtcattaagcctggtatggttttacttttgggcctactggtcttactac

SEQ ID NO: 7247 - DNA, 436 bp, Zea mays
  Clone ID: LIB3279-041-P1-K1-D1
cccacgcgtccggcacacactcgtctcatcggagaaaagtagatccgggttagggttttagacggcgatgggtgcggcgggcgacgagaaggctgcgatggctgcgtccgctgcagccgcgggtgccggtgccgccgagggcgagggcgcggtggactccaaggaccttcagcagcagagcaaggcgctcgacaagctcactgatcatgtcgaggaccggcagctcgattcatcccgtgtccaatccgccatggcagcacttgcttcatccaaggaggctgactggaacgcgatgaggctgagggagaaagaattggctgctgtgaagatcaaccctgccgatgtcgaaattatcgctactgagcttgagctggacaagaagatcgcggagagaacgctccgtgagcacaagggtgatgccgtggctgcggttcga

SEQ ID NO: 7248 - DNA, 384 bp, Zea mays
  Clone ID: LIB3279-041-P1-K1-D10
cagctgtgaatagttattttctttgcactcatctttgttggctttcatgaggctctaaaagtgagagttggagaaatacaaatcggtggacacgcatgaccaaacattcatagtcgtggctataattttttcttcagacatggcgcttaataatgtctacgtgtagtctacctatatgtgagcagatttggcctctaggagcgagcacgtgtgtttgcatatggcatgtatcgtgtgggttattagagtgaactcgaaccacgtccatcggagttgcacatccatgtgagttggcagaggtgtttgatgtgatgtgggcatttgtgttttatgtaatagatagcatcatcctcgctcgttgtgccgccttcgtccacacaagcg

SEQ ID NO: 7249 - DNA, 391 bp, Zea mays
  Clone ID: LIB3279-041-P1-K1-D11
cggacgcgtgggcgccggcgcctccacttcgcgttctcgcctcatctcctcccgctcaggatccggcggcgaaggtaaggcaagatgtacaccgcgaggaagaagatccagaaggataagggccttgagccctccgagttcgaggactccgtcgcccaggctttcttcgacctggagaacggtaaccaggagctcaagagcgacctcaaggacctttacatcaacggtgctatccagctggatgttgccgggagcaggaaggctgttgtgatccacgtcccataccgcttgcgcaaggccttcaggaagatccatgtcaggatcgtcagggagctggagaagaaattcagcggcaaggatgtggtaattgttgccacagggaggatcgtga

SEQ ID NO: 7250 - DNA, 411 bp, Zea mays
  unsure (1)..(411): unsure at all n locations; Clone ID: LIB3279-041-P1-K1-D12
tccgcattcgttccaactcctgagcactttctcctcgtcccagacaagccaatcgaagcggagatacgaccatggactccaccggcaccggagcagggggtaaggggaagaagggagcggccgggcgcaaggtcggcgggccaaggaagaagtcggtgtcgaggtccgtgaaggccggtctccagttccccgtcggccgcatcgggcgctacttgaagaagggccgctacgcgcagcgtgtcggcaccggcgcccccgtctacctcgccgctgtcctcgaatacctcgccgctgaggttctggagctcgccggtaatgctgccagggacaacaagaagactcgcattattccgcgccacgtgcttttggcgatccggaacgacgaggagctngggaagctgttgggcggcg

SEQ ID NO: 7251 - DNA, 444 bp, Zea mays
  Clone ID: LIB3279-041-P1-K1-D2
agattttggtgtctaattgagtagtttgttttgagatataggagcacaccaaattcgatggaatcaagaaaacgagttacatcagatatattctcttcattattaaagaagaacagaaatggaaagaaaccacacataattgataacttcaattgtgtaaaagatagtaaaaggagtgagaggatcgtatgtttgtaaatgtcaaactttcatttatcgagtttgagtttgttcttactcgagttgatttcgtaatttttggttggattttgtttcattcaacaaagtaacagaacctaactcggctcgctctcttgatcagaagggatatatattgtatatggatcgatctacttggaagttgtagcaatatatatgatgtgtacatggcatgtgctctcgttatccgttgtacattcctccatcttcgctaatgcgatcaca

SEQ ID NO: 7252 - DNA, 441 bp, Zea mays
  Clone ID: LIB3279-041-P1-K1-D3
caatacaggacagtgaacccctcgagggtggcttgtttggctctactatccacatgagccctcttttggatggggtggaatttagttcaattaccatcgtaattaaaatccaacctaatcaactccaacacaagtagattgcattcaaacaatatgtgattagccaaaagagcaatagtttggcctacctgacgtgcttaaggtctgatggtggagatggctaagacttttggtccagcagtttcaagcccaaataatcaacaagagataaatcaatgctacaacgaaatcacaatgaatgattttaaaacctatgtcagtaaaggcctgggtgccttttatttagcagaatttctggtgccatttattctttatgtaccagctagcgcttccttatgtgccctttgcagaagtcccattgtcattttgcaaccatgtgtg

SEQ ID NO: 7253 - DNA, 416 bp, Zea mays
  Clone ID: LIB3279-041-P1-K1-D4
ccgcactctactcgccgagagtgtgagtcgagacgcctctctcgccctctcttctcctccctccactccgccgccgcgcccgagaaaagagagttccaatgcgcctcctcccgctgctcctgctcctgtccctcgccgctgtcgcggccggcacggacgcggacgcggacgcgctgctggccgcgaaggccgcgctctccgaccccactggggcgctcgcgtcctgggacgcggcctcctccgaccattgcgcgtgggtgggggtcacctgcgcgccccgcggctccggcggaggcgtcgtcgtcgggctcgacgtctccgggctcaaccctgtccggcgcgctcccgccagcgctgtcgcggcttcagggtctgcagcgcctctccgtcggcgtcaacggcttttacgggcccat

SEQ ID NO: 7254 - DNA, 447 bp, Zea mays
  Clone ID: LIB3279-041-P1-K1-D5
gtcgaggccgccgcccagaccgcctccccttccccgcctccggtgcccaaggccaggccaacagttgtgaggtggtaatggcggaccaggctaaccaacccactgtccttcataagctaggtggccagttccacctgagctccagcttctgtgaaggtgtacgggcccgtaacatctgcctttctttctcatcttatgaaaggagatttgccacgaggaactacatgacccagagcctttggggcccttcaatgtctgttagcggtggcatcaatgttccagtgatgccgactccgctttttgccaatgctccagccgagaaaggtggcaaaaacttcatgattgatttcatgatgggcggtgtttcagctgctgtttcgaagactgcagctgctcccattgaacgagtgaagctgcttattcaaaatcaggatgagatgatcaagt

SEQ ID NO: 7255 - DNA, 444 bp, Zea mays
  Clone ID: LIB3279-041-P1-K1-D6
gtttgctgaacccagagaagtggagaaattagttataatgccatcgaagaaggaacttggtcttgcattcaaagggaaccagaagttggttgttgagtcattggaagccatgaccgagaccgaggcactggacatgaaagccgcgttggaatccaggggggaagtcgagttcaaggtgtgtacccttgggaaggatgtcaccataaagaaaaacatggtttcaatcaacatcgagaagaaaaaggagcaccagaggaaatttactccttccgtcatagagccatcctttgggatcgggcgcatcatatactgcctttttgagcactgcttctaccaaaggcctggcaagaccgaggatgagcagctaaacgtgttcaggtttccccctctcgttgctccaataaagtgcaccgtctttccattggtcaagctcgaagaaattga

SEQ ID NO: 7256 - DNA, 399 bp, Zea mays
  Clone ID: LIB3279-041-P1-K1-D7
gttgcctgcagtttccatgcagagcacaaaagatcagctacccagagaagcaatggcgatgggtcctgcattctgcgtcgcgctgctgctgatgctggctaccgccgctgccaaccaagcggcgccgccccacgccgtcacgtcgtgcacctgcaccactgaccttcatcgactcctcccgtgcctgccctagatagagggcaccgtcaccgtgccgggggacacatggtgcgccaacctgggcagtatggctcacgacgagccgaactgcctgtgtcaagctctcaacaaccccagcacggaccacgtctgcaccaacagagacgctcgtgatggccatgcctagaatctgcagctaaagactcctgccgacaccggctcctgcgcaggaggctgtct

SEQ ID NO: 7257 - DNA, 430 bp, Zea mays
  Clone ID: LIB3279-041-P1-K1-D8
gttaaaatctgtccatcccggcgacgactggcgacagccgctgccggcctactccaggtgcccaggtctacgtcggacccttcgccgcggcgagcaccaccagatggcgagcacggggcggtcgatgctgctgtcactgctcctcttcgcagtgacgctgtcgctgctggagatgtacagggccaagttcgcctcgtcggagctcatgaccatcgccggtggattcgtctgctccctcctattcctgctactcctcacctttattggaaactatcaagaagctagtggagatagaactgggtggggtgcagttgttgttgcacaacttgtagctcttattgtagccggcactgtccaccgggtctgtatcacaacatgcttcctgttttccgctggactcctttacgaggatgacaagctctctggtatg

SEQ ID NO: 7258 - DNA, 387 bp, Zea mays
  Clone ID: LIB3279-041-P1-K1-D9
gttaaaatctgtccatcccggcgaccactggctacagccgctgcccgactacgggaggggggcaggtctacattggacccttctcctcgtctagcaccatcagatggctagcacggggcggccgatgctgctgtcactgcttctcttcgcagggacgctgtcgctgctggagatgtacagggccaagttcgtctcgccggagctcatgaccatggccgggggattcctctgctccctcctattcctgctactcctcacctttattggaaacttttaaaaagcttctggagatacaactgggtggggtgcagttgttgaagcacaacctgtaacttttaatgaaacctgcgctgtccaacgtgtttgtatcacaacatgcttcctgtt

SEQ ID NO: 7259 - DNA, 439 bp, Zea mays
  Clone ID: LIB3279-041-P1-K1-E1
gaaagaactagaacaacacgtgtttctttcttaaaactgaaaccaataacccgcaaaagtacaaactgtctataagggctagtctagaaccacatttttccaaatgattttcattttctcaagaaaaaatgaattaattttccttgagaaaatgaaaaatccttttaaaaaatgagcttcctaaactagccctaagattttttccaatgtcttctaattggctcaaaagtacaaactttctataagattttttcccactgtctgctactaattggcaaccgcatgggaattaaatatgccatcatagattcaccatcgaaggattaattaacttgcaaccttttgcatctggaaaaaaggaaaattggtgaaaccgtaatcatgcggctatgatgcatcaagttggtagtagtagcttgttaagaacctaataataatt

SEQ ID NO: 7260 - DNA, 426 bp, Zea mays
  unsure (1)..(426): unsure at all n locations; Clone ID: LIB3279-041-P1-K1-E10
cccacgcgtccggaggataaagagaatactgcagctggcatgaaggaaacgaggaacgatgaaggaaatgtaaccggtaaagacaaagctgatgccaaagaaaacgttgtgaccacatctgctacgtgtcctgcagactcgtagtctgtgttgggctccaaaggtatctgacacattgtgtaggcgtgcaggtttggtatgggagatgaaaattcagcttttcttatccgttcgtgcaggctttagatctgtccataaaaaaaagacgttacatctgctccattgcaaattttgctgctgacctgaagctgattgggccttccggccatataactaacgctacgatgaaactataggagtngaagcaaactgatgtctttatgggacaattttggtgaatccgtgcgactatgtgcgcagatgtac

SEQ ID NO: 7261 - DNA, 402 bp, Zea mays
  Clone ID: LIB3279-041-P1-K1-E11
ctttccccttccctccctccctctccccgcgggccgccagaggcaatttcgccctcgatgggaccccgattcgtccgcccgcgaccgggattccctccgccaagcgcggatctgaacgctgcgctccgtgtcgtcgctcgaatccgccatgaagggggccaaatccaagggcgccgccaaggccgatgccaagctggcggtgaagagcaagggggcggagaagcccgccaagggcaggaaggggaaggccggcaaggaccccaacaagcctaagagggctcccagcgctttcttcgtgttcatggaggaatttcgcaaggagttcaaggagaagaaccctaagaacaagtctgtcgctgcggtgggaaaagctgctggcgacaggtggaaatccctgagcga

SEQ ID NO: 7262 - DNA, 420 bp, Zea mays
  Clone ID: LIB3279-041-P1-K1-E12
gcgtggttctcccgtgtcctctctctagtggcgacgagtgggcgaacgccgccaccgggttacgccagtcgtcaggcgctctgcgctcaggctttcatcttcgggtgcccttcaccggcgaccagcacccaacagttacatgtgcatcaggctttgatgattgctgtacaaggatgatatggcctcccgcccaaagctgtctggtattcagaagcaggttttggcgctgtacaggggattccttcggacagcacgccttaaggcccctgaagaacgccgcaggatcgagtctgttgtctttgcagagttccgtgacaacgcaaggagtgttgaccgtagaaactttgtacatatagagtacttgttgaggagagggaagaagcagcttgagcagctcaagaatcctgatattactggact

SEQ ID NO: 7263 - DNA, 425 bp, Zea mays
  Clone ID: LIB3279-041-P1-K1-E2
cggacgcgtgggcacggttggtgtcctgcttgttatggagaccctgagtgcattccttcacgcactgaggcttcactgggtggagttccagaacaagttctatgaaggtgatggttacaagttcgccccattctcctttgcgctgattcgtgaggaagaagattgagatcgtcccatgtagccgatgtacaatctttgatggcctttgttcccggaacaaatcattttttcatctgttgtctcggatggatcataaacctcagtcccctttgtttagacatgggacgaacagcaccatttttccttgtttagctatgcagatgatttttgggtcggttggcggcaaacatgggggtgatatcaccattgtatgatgctaataagtagttgccgattaggcggtgtgttggatataaataagcact

SEQ ID NO: 7264 - DNA, 439 bp, Zea mays
  Clone ID: LIB3279-041-P1-K1-E3
cccacgcgtccgcgcctccacaacccccctcccaggagccgcccaggtacgtcgccggcggcgatgacgacgcgcttcaagaagaaccgcaagaagcgcggccacgtgtccgccgggcacggccgcatcggcaagcaccggaagcatcccggaggtcgcggtaacgccggtggcatgcaccaccaccgcatcctcttcgacaagtaccatcccggctacttcggtaaggtcggcatgcgctacttccacaagctccgcaacaagttctactgccccgcggtcaacatcgagcgcctctggtcgatggtgcccgccgacaaggcggcggaagccggcggcgacaaggccccgcagatcgacgtcacgcagttcggctacttcaaggtgctcgggaagggggtgctgccgcccaagcccatcgtcgtcaaggccaagctca

SEQ ID NO: 7265 - DNA, 444 bp, Zea mays
  Clone ID: LIB3279-041-P1-K1-E4
gaaagcttgcccacctgccattccccatcctgattgggtttttaaatcaaaggaaatcggtggtcttccttgcaagtttgaaggcattttggagtccccagttgttaatggataccgtaacaagtgtgagttctctgtaggatattccttagagggcaaaaagacagtaggatttatgctcggaaatttcagggaaggtgtgactgctgttgaggaacctgtgaattgtccaaatgtctcagaaatttcctgcaaatacgctcagatgttccaagattttcttcaaccatcaagtttccctttgtggagcaggattgacaactctgggttttggcgccaactcacagtccgtgaaggaagatgtccagctgaagcttttggtttacagaatgcagaatcacaaatatcagaagtcattgcttattgtgcaggtgtgttcaacag

SEQ ID NO: 7266 - DNA, 407 bp, Zea mays
  Clone ID: LIB3279-041-P1-K1-E5
cggacgcgtgggcggacgcgtgggggccacccacagggtcgactggtccttcaacgcggacagctggtccaagggcaagagcttccgtgccggcgacgtcctcgagttcaactacgacccctccgtgcacaacgtggtggccgtggacgccggcggctacaacggctgccggccctccggcacgtcgtacggctccgggagcgaccgcatcacgctcggccccggcaccagctacttcatctgcagcctcaacgggcactgcgggatggggatgaagatggtcgtcaatgccagctgagcacgacgcttatatgttagtactgcaaaaatatatgggctagtggtggtccgatagatcgtgcaagaactcaatcgtgtggcatactcgtaccggtgttcgatggaca

SEQ ID NO: 7267 - DNA, 444 bp, Zea mays
  Clone ID: LIB3279-041-P1-K1-E6
gtcgcctgttgctaattcagtctcacctgtgactggagctgatgggaaaagcaaagaacccattcaaaggtctggatcatttaaagatagtaagaaaaatgtcactaaaaaggatgtcaggaattcatatgaaccaccaaatccagcttcatttgttgaggataaggttcaaactgtaaaggttggagatgtcgatctccaggaaactaaaaagctgaacaatgagttggatttgaccaactcatcttcagctccaacggttccactggcagttagtacagagaatgccgacagcacagcagtaaccaatacaagctcaagaagaccatcttctgagggtactggtgagcctggagtggaaagcttcacttgttccgctgttgaatgtgaccaaagcaagaggactcacaaagttgtgaaagatcctagcaaggataatatttc

SEQ ID NO: 7268 - DNA, 401 bp, Zea mays
  Clone ID: LIB3279-041-P1-K1-E7
cccacgcgtccgggcaaaatcccccaccagatcccggcgcccccaccacacagcgctcgcgcctccctgcttcccaattcccgtctgcccggccgcggagcggagctgctcctgccccccgtcgccacgccacgatggcggagtgccgcagcctcatcgagttcctccgcgcgttcgagcaccaccgcagggcggccgacagctccgcctccgcgtgctcccgatccaggcgggcgtccgccgccggtggctccttctgcgacaacaccccgatggccgtgatcgacgcggtcatgctcctcgccgtcgtcatcgcgatcggcttcctcctgatcccgtacctcaagctgctcctcctcgagatgggcgcgatgctccaccccgccgcgtcctgcctcccg

SEQ ID NO: 7269 - DNA, 437 bp, Zea mays
  Clone ID: LIB3279-041-P1-K1-E8
actccgcgctcctccaaaccaaactgaaccctatcctagcacgagtgcacgacggtggcagcaggagatggtggggacggcggaaggcggcgcggagagggcggtgcggcggtgggtggacgccgacggcgggcgcctggtcctggacggcgggctggccacggagctcgaggccaacggcgccgacctcaacgacccgctctggagcgccaagtgcctcctctcctccccgcacctcatccgcaaggtccatatggactacctagaagccggggcgaacattataatcacagcatcgtatcaggctactatccaagggtttgaatcaaagggcttttcaaaagaacaaagtgaaaacttgttaacaaagagtgttcatattgcactggaagcccgtgagatgttcttgaaagaacatttggagaaatccactccta

SEQ ID NO: 7270 - DNA, 344 bp, Zea mays
  Clone ID: LIB3279-041-P1-K1-E9
cccacgcgtccggtgagtgccgcagtgttggggttcaacgtggccagcaaccgtgtaatggggggcgagatccagaacgtggattaggaggatggcggcacaccaccgtgtatataacatagtttggcctttggttacatgccaccgaagtctcagggctcgagggaagctgggggtgctcggaatggcggtctggtctacctgtttttgccgagggtgggaaactgagcttagatgcagggtcttgtgctggtgattttgggttcctgtaacaattggttaggatcctgtaacggacagaaatattttcttctcaatagaaactcaccagatggattcaggtc

SEQ ID NO: 7271 - DNA, 443 bp, Zea mays
  Clone ID: LIB3279-041-P1-K1-F1
cccacgcgtccgcatgagctcaatgagcaagggaatgatttttgtgaatggcgaaggagtgggtagatactgggtctcataccgaactcttgctggaactccttctcaagcagtgtaccatatcccgcgtcctttcttgaaatccaaggacaaccttttggttatcttcgaggaggagatgggcaagccggacggcatcctcgtgcagaccgtgacgagagacgacatatgcctgtttatctcggagcacaacccgggacagataaagacgtgggacacggatggtgacaagatcaagctcattgcagaggatcacagcaggcggggcaccttgacgtgcccccctgagaagacaatccaggaagttgtctttgccagcttcggcaacccggacggcatgtgcggcaacttcactgtaggcacttgccacgctcccaatgcaa

SEQ ID NO: 7272 - DNA, 420 bp, Zea mays
  Clone ID: LIB3279-041-P1-K1-F10
cttagagtttgatttgccttatcttgaagcaaaatataacgcaggcacgactacaaatgcgagaccagccatatccatgcaggaggccctgaaagcaggggttttctccaacgctcggtctacgcagtctcttccaagtactagcattccgacggggcatcctctccctcagcaattagcacatcacccttactctcagccgactttagcacccatcacacatttcccaaatatcgttggctatccgccgtatttgccacaaaactatgctgcttacctatcttcgggcaccttccagcaagcatacccgagcaatggagcattccatcagtctgctgccgctttgctcggatctggtatgaagtactcggcccccgagtataaaaacaacctgtctgccacaagcttacaacagcaaca

SEQ ID NO: 7273 - DNA, 381 bp, Zea mays
  Clone ID: LIB3279-041-P1-K1-F11
gtcttgaaaggggagagagagagagagaagagagagagaagagagagagagagagaggagtgggagacccgcgagaggctgccgtgtagggaccgtagactcagcgactgcgaaggagggataaggggatggccgggatcggaccgatcaggcaggactgggagccggtcgttgtgcggaagaaggcacccaccgccgccgccaagaaggatgagaaggccgtcaacgccgcgcgccgcgccggtgcggagatcgataccatgaagaagtacaacgctggtaccaacaaggcgggattcaacggtacattccttaacaccaagcgccttgaccaccacaccgaaaaccttgcccattagcgagttccaagtgatcttaaaa

SEQ ID NO: 7274 - DNA, 436 bp, Zea mays
  Clone ID: LIB3279-041-P1-K1-F12
gttcacagctccaatcctggtgcaagcgcacagtagcggagcaagatgcggggaggagacgggccatcggcgtcgctccagctcctctcgctgggcctcgtgctcctctacttcttcacctcaggcagcaccgttggtctcgtggagggacagaagacgtggtgcatcgcgaagccgtcggcgtcgaacgagatcctggcgcagaacctggactacgcgtgctcccaggtgagctgcgccgtgatccagaagggcgggccgtgctactacccggacagccccgtgtcccgcgccgccgtcgccatgaacctctactacgcctacagcggcaggcacccctggaactgctacttcaacaactccgcgctcgtcgtgcagtccgacccaagctatggctcctgcacatactactgaagaggagtgtgaagaggagtgg

SEQ ID NO: 7275 - DNA, 441 bp, Zea mays
  Clone ID: LIB3279-041-P1-K1-F2
gtggtcgccctcatcgctgccgttgccgccgcaaccgctgcggggtcgccggccgcgggcacgtgcgcgcggaggggcgcgccgccgttcctcgacgccgtcggatcccgctgccccttcgtccggatcgacccgttcgcgcctctcgaggtgagaggagagactgttgatactgagttgaaccttcgaaggaggggtgcttcatactccattctcttttatgctgcatggtgtccattttctagcaaactgcgaccaatatttggaactctcagcactatgtaccctcagatacatcactttactgttgaagaatcttctgctacaccaagcctgttttcaagatatggagtccgtggtttcccagccattcttcttgtaaatgagactacgatggttcgatatcggggttcaaaagatcttaactttctggtcgatttc

SEQ ID NO: 7276 - DNA, 445 bp, Zea mays
  Clone ID: LIB3279-041-P1-K1-F3
cagaccgggagtagtcgacgcgccgtcactgaatcctcagatcacggctagccgtaatcacgccactctgctgactcccggcgagccatgggcaaggagaagactcacatcaacattgtggtcattggacatgtcgactctggcaagtcgaccaccactggccacctgatctacaagctcggcggtattgacaagcgtgtgattgagaggttcgagaaagaggccgcggagatgaacaagcggtcattcaagtatgcctgggtgcttgacaagctcaaggccgagcgtgagagaggtatcacaattgatattgctttgtggaagttcgagaccaccaagtactactgcactgtcattgatgcccctggacaccgtgacttcatcaagaatatgattactggcacttcccaagctgactgcgctgttcttatcattgactccacta

SEQ ID NO: 7277 - DNA, 205 bp, Zea mays
  Clone ID: LIB3279-041-P1-K1-F4
gcggtgattcccgtatgtcatccgtttcattttttacatgaatgagaagcgtggtaataaaaaggtgttgtagttgcgtgcgcgccgtgtattccttggtgtactggtgctggcggtaaccacttattaccagggatccttgtaatttttcctgttggtttcccaataataatgtgaatatattggtcacatgcatggtgtttcc

SEQ ID NO: 7278 - DNA, 354 bp, Zea mays
  Clone ID: LIB3279-041-P1-K1-F5
gcgctaccaatgagcttgtaacggtcattcgctcccttggccaaaaccctaccgaggcaaagatgcagggcatgatcaacgaggcccatgctgatcgcaatgggaccatcgacttcccggagttcctgaacctgatggcgaggaagatgaaggacacggactcagaggaggagctcaaggaggccttccgcgtcttcgacaaggaccaaaacggtttcatctcaggtgccgagctccgccatgtcatgaccaaccttggcgagaagctgaccgacgaggaggtcgactagatgatccgtgaggccgacttatacagcgacgggcagatcaactaccaggagttcgtcaaggtta

SEQ ID NO: 7279 - DNA, 418 bp, Zea mays
  Clone ID: LIB3279-041-P1-K1-F7
gggaggccaaaccatggcacgaacgcggagaggtggaagggtggcagccatcttgaataccagccggtcggatcccaaaacaaagctggaggcgacttccagctgagtcagggcatggaagaacgaaccgaggggcctcctgcttctggacaagcgttcggggagcgtggccacagcagggggctacgcccagcaggccgctttgtccggcgaaaccctgcctctacggctaccactaattctcaccaacatgaataatcttccgcggctgccacatccgctgagctgcaggaaaaaaactcgccttcgtggtggcgtttcacaacatgtaggtttggatgcacttgggtgggcggcaggtgtccgtcgtctacgacgagtctacggtggtgagcattaggatcatgtaacggtatta

SEQ ID NO: 7280 - DNA, 434 bp, Zea mays
  Clone ID: LIB3279-041-P1-K1-F8
gtttcacttcaattctctctataggaattggagggtcagctttgggccctcaatttgttgctgaggcacttgcacctgataaccctccactgaagataagatttattgacaacaccgatcctgctgggattgatcatcaaattgctcaactaggacctgaactggcaactactcttgtaattgtcatttctaagagcggaggcacacctgaaacccgcaatggtctactagaagtacagaaagccttcagagatgcggggctgcaattctcgaaacagggtgttgcaattactcaagaaaattctctgttggataacactgctagaatagagggatggttagctcggtttcctatgtttgattgggttggtggtaggacttcaaaaatgtctgcttggggtttactttcagctgcattgcagggtattgatatc

SEQ ID NO: 7281 - DNA, 428 bp, Zea mays
  Clone ID: LIB3279-041-P1-K1-F9
cccacgcgtccgcccacgcgtccgcccacgcgtccgcggacgcgtggccgtgctccgcagccgctgagtgagaagaagagatggccggcaagggcgatggcccggctatcggcatcgatctcggcacgacgtactcttgcgtcggcgtgtggcagcacgaccgcgtcgagatcattgccaacgaccagggtaaccgcaccacgccctcgtacgtcgccttcaccgactccgagcgcctcatcggagatgcggccaagaaccaggtcgccatgaaccccatcaacaccgtctttgatgccaagcgtctcatcggcaggaggttcagtgatgcgtctgtccagagtgatatcaagctgtggcccttcaaggtcatttctgggcctggtgagaagccaatgattgttgtccagcacaagggtgaggagaag

SEQ ID NO: 7282 - DNA, 334 bp, Zea mays
  Clone ID: LIB3279-041-P1-K1-G1
ttttgattgggaggttccgggctctgcagcaggggtgtccatggacgagtcctttgggctgacgcttcgccggaaggagaagcttctccttgttccaaggattgcttactgatcatcctacatctgtaaaacttgtgtcttgctagctgtaccgggaacaagattaaataatgcaaggaataaagtgactctgttcttcgtcaaaaaacataaacaaaaaaaaaaaaaaaaaaaaaaaaataaaaataacaggataaaaaaaaaaaaaaaaaaaaagttaaacatcccaaactacaaaaattttttatcttttttttgggggtatattaaattt

SEQ ID NO: 7283 - DNA, 438 bp, Zea mays
  Clone ID: LIB3279-041-P1-K1-G10
gaaagtattcttacggtctaatcctatatttgcataaatagttcccggtggttggacctgcttttacatcagcgcatacacattacaactcttgtagtcgctccatgtttctttggcagttaaaccatacaccacattacatccttgcattttttaactttctaatgccacttaccacaatgtctcattcgaatttgatacagagagccgaaccaatctaactctccaatggtgatttggactgcctcattcttatgcgacatagctgtggcgtagatatgtttctctcaagctccactgggaatactggtacaatatatttccatcagccttcgtagaaggtgaattcagcttggtcctggtatagctggatggacatgatccttgcccatcataaaagaacttgagcttgttttcatttggctggaagaatcctct

SEQ ID NO: 7284 - DNA, 434 bp, Zea mays
  Clone ID: LIB3279-041-P1-K1-G11
cgcagatcaggttgagaagattgtcaaaaccctgaatgaaggaaatgttccctcttcaggtgttgttgaggtcgttgtcagtcctccttatgtgttcctcccggtggtcaagagccagctgcgccaagagttccaagttgctgctcagaactgctgggtgaagaagggaggtgcattcactggtgaaattagtgctgaaatgctcgtcaaccttggcgttccctgggtcattcttggacactctgaaaggagagctctgctgggagaatcaaatgagtttgttggagacaaggttgcttttgctctgtctcagggactaaaggtcattgcatgtgttggtgagacccttgaggagagggaggctggttcaaccatggatgttgttgctgcacaaacaaaagcaattgctgagaagatcaaggactggagcaacg

SEQ ID NO: 7285 - DNA, 438 bp, Zea mays
  Clone ID: LIB3279-041-P1-K1-G12
ctgcattttaacttttgttgctatacagtgagctacctacccaagctgtgttttttctggtatatgcattctcctggaccgaggtaaccgttgggtctcatcttccgcaggtgaattcaccatgctggaacttgctgagaatgtgaaggagttgattaacccagatataacagtgacgatgaccgagaacactcctgatgatccccgccagaggaagccggacatcaccaaggcaaaggaagttctagggtgggagcccaagatcgtcctgaaggacggcttggtgctcatggaggatgatttccgggagcgcctggccgtgcccaagaaaaccaaggcctaaactgccctgcggtgggcgaagaatatccacgggggagcatactcatagttggcttgtcattattcgtggccacatttcattacggaatttgagtt

SEQ ID NO: 7286 - DNA, 272 bp, Zea mays
  Clone ID: LIB3279-041-P1-K1-G2
gcagatgcagataagcaccacatattaatggactcctcgtcatctcctaagttcagcgaccaaacagcagttcttggagggtatggaacacttggtttcgcccagaggttatgtttgcgaggcattacgacgaactgagccatgactgtttaaaggcatatacagtaaaatgccggtcgccttatggtttattgggaaagaacacctttcacatgtttgacactgtttgtcgctatattggtggaaggcatgaaccattctgcctttcatca

SEQ ID NO: 7287 - DNA, 420 bp, Zea mays
  Clone ID: LIB3279-041-P1-K1-G3
gtgactagttcttgtgagaccaatagtgcagctgatatccctgccaaggatatttcctccatttcaagtcttggtgtcccaggaatctttggtggccttcaggatgaacctagtcctgtatctgtactagatggaccgtttatatgtgataacaataggaggctactgtactcatctgaaaatttcatcacttcatccccacaagctttgtcaaggtctcccctgatcggatcattttcacggtcactgtcatgggaggatcccccgctggaagtcatgtcgccgaattcgttgagactctcaaggcttttctcgaaggctgatgaagatctagattcactgacgtttatccagaagctggtccactctcgaggcacgggtcgaaaaagttgcatattagctgaccctttggacccgagt

SEQ ID NO: 7288 - DNA, 474 bp, Zea mays
  unsure (1)..(474): unsure at all n locations; Clone ID: LIB3279-041-P1-K1-G4
ctgcggtcggncgctgnccgggcgccgccggagaggcctggagggcgctggcgcggcangaaccaggcggatcgcgtcgacttctgggcgcgggcgcggnngcatcggcgccaagcatgtacnncttgccgggccacaagggcgcggcacgaggtgggncggagcactttcggcgcacgcgagggtgggaccggttncgcgaggctcaagggccgagttcgaacccgcgggctncatcctggcggcggggcagggcatncttcagggccgcccggctctgccggcgctcggcggccgactcgtaacgtaatccagctgcttatactaattattaggcgcgtttagtgtaaggtagaggtactagctacagcagtaaccatacaggattgtttagttagctccggttggttcatgtacaaatgtggggttgttaatcgcgtgctctgccatggctgctgtgatcggttctgtaca

SEQ ID NO: 7289 - DNA, 395 bp, Zea mays
  Clone ID: LIB3279-041-P1-K1-G5
ctcgaattccgcctcgccgacgaccccaagctctcgctgcaccgctacggccagtacctgtacgatggcctcgtgctgttcgccccctccaccccacgttttggtggatcagtggaccagaacgcagtccttgaatttattgatgctgggcttgatatgatcctggcggcagattcctctgcctctgatcttattcgtggcattgcgacagagtgtggggttgattttgatgaggatccagaggcaatggttattgaccacattaactatgccgctatggatgttgaaggcgatcacaccttgattgttggtgatgatcttattcagtcagatgtcatactggggtctaaaaagattgaggctcctgtattatttcgtggaattggacacacggc

SEQ ID NO: 7290 - DNA, 443 bp, Zea mays
  Clone ID: LIB3279-041-P1-K1-G6
gcgcccacgcgtccgagaaaccaagtatgttatattaggagaaaagggcaaagttcaactgttgcgtgaggcaaaggacagcattgaaatgactgcaactgaactgcagaagaaccctatcaactacacacaggttgccgtgctcgcggatgacatattgaaaaatgtggaatatgatgctctgagggttattttcaacaagttccaatctgtcatatcgtttaagcccacaatggtaacaatactttcccccgaggttgcagaaaaagaatcagaagctggtgggaagatgggtgacctaaattcttatgagattgaaggcggcgagacaaaatcagagattttgcagaatctagctgagttccagttttcttgtgtcctgtacaatggtgccctaaagaatgcatgcagtgagcttggagcccgtatgtctgccatggaca

SEQ ID NO: 7291 - DNA, 442 bp, Zea mays
  Clone ID: LIB3279-041-P1-K1-G7
tccagttccagaagtttctggaagccaacccaagccatggacgccgccagcatagccgccgccgccgccgccgtggccaccccgccccctggcccggccgtgaccgtgcaggtaccgcgcgggcaggtggatctgattgacttcatcgactggactggcgtcgagtgcctaaaccaggactcctcccacagcatcgtcaacgcgctcaagcagagtttgagggacgacgaggggctgtacctcgccagtgattcggacgagcagctgctgatctacatccccttcatgcaagtggtcaaactgcattccgtgctattcaaaggccccgaggaagagggccctaaaacagtaaaactcttttccaacaaagagcatatgggtttcagcaatgtcaatgactatccaccaatggacactcttgagctatcctccgatcatttgg

SEQ ID NO: 7292 - DNA, 421 bp, Zea mays
  Clone ID: LIB3279-041-P1-K1-G8
aaactattaaagttccaactgctcattatgaatttggtgccaattttttagatccaaagttaatgctcattggaagggtgatgacagatggaaggcttaatgctcgcgtgaaatgtgatttgacagacaatctgatgctgaaagtaaatgcacagcttacccaagaggcacattactcacaaggaatgtttaactttgactacaagggaagtgactatcgagcacaattccaaatagggaacaatgcattctatggtgcaaattatattcagagtgttactccgaacctatcaatgggaactgaaatgttctggcttggtcaccaaaggaagtctggaattggttttgcctgtcgctataacacggacaaaatggtgggcactctacaagtcgcaagcactggaatagttgccttaagtta

SEQ ID NO: 7293 - DNA, 421 bp, Zea mays
  Clone ID: LIB3279-041-P1-K1-G9
gactcatgtacgaggacatcaagtgaggaagaactatcgcaaggtagtctggtggatcgggatcgtcgagaaagtcatactgagatggaggaaaaagaggcctgggttactcgggtttcggccccagaaacaactagaaggtccatcgcaaatccaacctgcaaaggctgaagacgaatacgatttcttgcacaactgcagaaggcaggccgaagccaggctacacagagcacttgcccgggtgcactctatgtcacagcacccagaagcgagagagcagtaccacaggcttacaacctgcgttgctgaaatgaaacagtccacgatgatgcatgatgagatgctaacccaggcggctggtggtgcggacgatttcatggcttgactggaggacttggtcctcataagataagccccgccc

SEQ ID NO: 7294 - DNA, 445 bp, Zea mays
  Clone ID: LIB3279-041-P1-K1-H1
gaaccgtttgtgtcagttgggcggcgtcggcatggacgaggctacgaagaaggtggaggctacggtgctggagatcccgcgaggctctgatatggagtccgtaacggagaacaaggaggaggcgaaggcggcggaggagggcgacgctggcagggagagcaaggacaaggaacgtaaggaagatgaggaggaggatgaaggtaagggtggcgggaagagagagtacgacgaccaaggggaccttattctgtgccgcttgtcgagcaagaggagggtgactctgtcggagttcaagggcaggtcgctggtgtccatccgagagttctacgtgaaggacggaaaggagatgccctccgccaaaggtattagtatgacaatggagcagtgggaagcattttgcaatgctgtacctgcgatagaggctgccatcaaaaagcttgaagat

SEQ ID NO: 7295 - DNA, 437 bp, Zea mays
  Clone ID: LIB3279-041-P1-K1-H10
ccctgctcgactcccacctcgtcccatccgccggcggcgccgagtccaaggtcttctacctcaagatgaagggtgactaccacaggtaccttgctgagttcaagtctggtgcagagaggaaggatgctgcggagagcaccatgaatgcctacaaagctgctcaggacattgctcttgcagatctggctccaacccaccccatcaggcttggccttgctctcaacttctcagtgttctactacgagatcctgaactcccctgatcgcgcctgcaaccttgcaaaacaggccttcgatgaggcgatctctgagctagacagcctgggagaggagtcctacaaggacagcactctgatcatgcagctcctgcgcgacaacttgaccctatggacttccgacaccaacgaggatggcggcgacgagatcaaggatgctgct

SEQ ID NO: 7296 - DNA, 388 bp, Zea mays
  Clone ID: LIB3279-041-P1-K1-H11
cgtccgactgctcgctccctgccctgccctgtggctctctccctagggtttctaccacgcgcccgcttccgactagcagcgctagcgtcgcctaactccgaccgaggggacaacgagggttttgggacggacggcgtgagatttggaggaggcagcggagggccggagaccagaccatgaggccggtgttctgcggcaacttcgaccacgagacccgccagtacgacctcgagcgcctcttctccaagtacgggcccatcagccggatcgacatgaagctaggctatgctttcatttactttgaagatgagcgtgatgcagaggatgctataaggcgtctcgacaatgtgtcttttggttacaaccggcgcaggctctctgtggaatg

SEQ ID NO: 7297 - DNA, 405 bp, Zea mays
  Clone ID: LIB3279-041-P1-K1-H12
cccacgcgttcgcggacgcgtgggcagacaagccaatcgaagccgagatacgaccatggactccaccggcaccggagcagggggtaaggggaagaagggagcggccgggcgcaaggtcggcgggccaaggaagaagtcggtgtcgaggtccgtgaaggccggtctccagttccccgtcggccgcatcgggcgctacttgaagaagggccgctacgcgcagcgtgtcggcaccggcgcccccgtctacctcgccgctgtcctcgaatacctcgccgctgaggttctggagctcgccggtaatgctgccagggacaacaagaagactcgcattattccgcgccacgtgcttctggcgatccggaacgacgaggagcttgggaagctgttgggcggcgtgaccatcgc

SEQ ID NO: 7298 - DNA, 424 bp, Zea mays
  Clone ID: LIB3279-041-P1-K1-H2
gcagaatttgacgctgaccaaacagccactcagaacattgcattttttcctgttagccatgttacaatacttgaaaagattagcaacatatatcctgagtaagggtggtttcttctttctcctaattgttttattggtagcttctggaatcttgctcgtcgtttcggatggtctgcataagaagcatgtgcaggaattccttaattatgctaaatttgtgtcgtggtgggtttcattaggtgtggcttcatcaattggactaggttctggtttgcatacatttgtgctgtatctgggtcctcatattgctctgttcactattaaggctgttcaatgtggtcgaattgatctaaaaattgctccatatgataccatacagctaaaggttgggccatcatggcttgacaagaaatgttcagaattt

SEQ ID NO: 7299 - DNA, 186 bp, Zea mays
  Clone ID: LIB3279-041-P1-K1-H3
cacgccgtcgcggcattaatactgacgtctgtactcaaatcagccagctcaggaagcattgcagtttcataccatgttatgcacatgtgtacgacgtgcattgataatgattaagcaaccatataatcctagagtaatgggctggttatctatctttactacctaatatgtctttatatggtaagc

SEQ ID NO: 7300 - DNA, 198 bp, Zea mays
  Clone ID: LIB3279-041-P1-K1-H4
gcggcagaaggaggagctcaccaaactgccccccaacacattgtattagctccagcccatcatgactcggggcgcagaacacatacgacacatacttcaaggagcccgctccttctccgtttttccaacccgggtagctcaaatcttgctccttctaccctgctagcatcgcctagtttttattcaacgtattttcac

SEQ ID NO: 7301 - DNA, 442 bp, Zea mays
  Clone ID: LIB3279-041-P1-K1-H5
caaaatattgttcattctcccattttgcttgctgctatttggttattaccaatcatgttttcagacagacaaggatttgataagtataagatctctatgtgcttttgctagaagagctcgccataaatacaagtctgaagagtcacttccatcttattcagtggtgggttcatcttctgcatttgttatcaaatggacatttgaaactaccttcttattttggggcaattgcggtgttagtctgcttcgtgtctgctggtttctctcttgcatttgctttcgctatcattccacggcaggttatgccatggacaggtttgctactgatgcttgagtggatctttgtggcattcttcttattgtttgggagttatctccgttttgtctaccggtggggaagtatcagtgcaaaccatgtgggatttagcaattctgactcatc

SEQ ID NO: 7302 - DNA, 412 bp, Zea mays
  Clone ID: LIB3279-041-P1-K1-H6
tgtaccaccacgcaaaaataacaagtgggagataaacaggaagagctaggtgaatacttggagaaagaggtcccccacaccccccacgcaggtgaatactacaagtagcagtacaaggaagagagccaatctgcccgtgactgcgagtgaattgctagggtgtggtggttagttgaggtcacgatgatgggaggcgggctgatgatggatcagagcgtggtgttccctggcgtccacaacttcgtggatctcctgcagcataacggcgacaagaacctgggcttcgcctcactcatgccgcagacgtcctccggcgaccagtgcgtgatgggggagggtgatcttgtggacccaccgccagacagcttcccggacgccgtggaggacgacagcgatgacgacgttgaggaca

SEQ ID NO: 7303 - DNA, 423 bp, Zea mays
  Clone ID: LIB3279-041-P1-K1-H7
gtcgttcggagcgggcagcagcacacagccccatcccaatcctagtcgatcttggtccggtgctcaagccggttccttcgtccacacgaccgcgcgctcggaaaactccgcggagggcgaaggaggcgaaccaagggcgacgtatccgccgccggagaaggtagccctcgatccgccgtctcccacgattcgtttgtcttgcgacagctgggcgaccgtcgtcgccgccgcccttctccaggtgcccaggtcttcgccggtccctttgccgccgacgagcaccagccaggaagaaaagaagctgaaccatggggaagagaaagtcagctgctaagccacctcctaagaagcggatggacaagcttgacactgtctttttctgcccattctgcaaccaccggagttgtgttgagtgcccaattg

SEQ ID NO: 7304 - DNA, 352 bp, Zea mays
  Clone ID: LIB3279-041-P1-K1-H8
cattacctcagcatgtgcttggaccgtactctaatttgctggagccaatccatccactctacaatgttgtcctagataagtaccatacagcctatgagttcttctcagaagagtgatctaatgttagaacctaagaacaattggctaaggttgtgtacgattgtgttatttgcacgaatgatggtaacttagtcgtgttataccagggtatttgtatgtttggtcaggtggattgcctggataaatctctctgttgtaatggtcgtgtcccgaattatgtttgtaatggtcgtgtcccgaattatgttactggtgttcattattagttaaaatgcaacagaagtgtaggtct

SEQ ID NO: 7305 - DNA, 435 bp, Zea mays
  Clone ID: LIB3279-041-P1-K1-H9
gagagcatccggagagactattgaacaaatggggtattgctgatgttgatgattgctgcggctgtgcgaggttcctggtggagagtgggaaagtagatgggcagcgcctttgtattactggtagatcagcaggtggatacactactttagcttcacttgcattcagagacacggtcaaggctggagcttctctctatggtgatggggacttgactctgttgagagcggagacacacaaatttgagtctcattatatggacaatcttgtaagaaatgaaagagcttactacgagagatcaccaatcaactttgtcaaccagttgacttgtccagtcattttgtttcaagggttggagggataaggttgtaccaccagatcaggcacgcaaaatatacattgccttgaaagagaaaggtttgccttgtgctttggtt

SEQ ID NO: 7306 - DNA, 431 bp, Zea mays
  Clone ID: LIB3279-043-P1-K1-A10
cccacgcgtccgcccacgcgtccgcccacgcgtccgcccacgcgtccgaaagagtaagaagaaaggaatccctcctacgcggaagcgacgagattcggcgcctcagccgcctctctgctcagatctgcggcggagcctcgccggcggcctgcgcccgcggcgccggcgatccaagatgccttcgtgcgtgcagggctgctgctgctgctcgtacctgcgccttctcccccgcgacgacgcgctctcgtccccctccgcctgcgcgcaccgactgaagccttggtcttggcgtgcccaatcccccaccttggcctcctaacgcttggacccgaccgctccccaccctggtctacctgtctgtacccttccctgctccatttctacatctgcccggtgctgctctgcttctggtggcacaagagtattcgcct

SEQ ID NO: 7307 - DNA, 427 bp, Zea mays
  Clone ID: LIB3279-043-P1-K1-A11
agcagggcgctcttcggtcggaggagaagcgcgaccacgaccatgggctttatgtcgttcgtcggccgggttctcttcgcctccctcttcctcctctcggcctaccaagagttcattgaatttggaaatgacggtggacctgcagcgaagaccttgaagccaaagttcaatttgttcgtcaagctagtgtccaagaatactggactggggctgccgcatatggatataaaaactgtcattgcagctaccatgtttcttaaaggctttggtggtcttctgttcatagtcagcagctcatttggagcattcctcctgctcatttacttggcgtttataacccctattgtgtatgacttctacaaccatgaaatggaatcaacacctgttggcgatctttttttcaagttcatacagaacttggcgttta

SEQ ID NO: 7308 - DNA, 437 bp, Zea mays
  Clone ID: LIB3279-043-P1-K1-A12
ccttccctccctccctctccccgcgggccgccagaggcaatttcgccctcgatgcgaccccgattcgtccgcccgcgaccgggattccctccgccaagcgcggatctgaacgctgcgctccgtgtcgacgctcgaatccgccatgaagggggccaaatccaagggcgccgccaaggccgatgccaagctggcggagaagagcaagggggcggagaagcccgccaagggcaggaaggggaaggccggcaaggaccccaacaagcctaagagggctcccagcgctttcttcgtgttcatggaggaatttcgcaaggagttcaaggagaagaaccctaagaacaagtctgtcgctgcggtgggaaaagctgctggcgacaggtggaaatccctgagcgagtcggacaaggcttcctatgtagccaaggctaacaagctca

SEQ ID NO: 7309 - DNA, 379 bp, Zea mays
  Clone ID: LIB3279-043-P1-K1-A2
accacttgagcctccaccttctccgcgtctcaccttcttctccgttctccttccgctcccctcttcacaacgaagccctagtgtcccgcgacatggcatctggtctggaggagaaactcgcggggctctcaacgggcggcgacgggcaaaatcctccgccggcgggtgagggcggagaggagccgcagctctcgaagaatgcgaagaagagagaggagaagaggaagaagctggaagaggagcggaggctcaaggaggaagagaagaagaacaaggctgcggctgccagtggaaaacctcagaaggcatctgctgctgacgatgatgacatggatcccactcaatactatgagaataggctcaaggctcttgattcact

SEQ ID NO: 7310 - DNA, 141 bp, Zea mays
  Clone ID: LIB3279-043-P1-K1-A3
gtcacttgtatcatgctccatgatccaagttgtagcaagataccgctcactttctacaatgtgagaaggcgccgctcgaggaagcaagaggtatggcctagggcaggacctagcgcaactgaagggccctgagcaataata

SEQ ID NO: 7311 - DNA, 434 bp, Zea mays
  Clone ID: LIB3279-043-P1-K1-A5
cgtcgagcccctacaaggtgcggctgctgatcgaggactacccgtacgcctcggacgggctggccgtgtggcacgccatcgagcagtgggtgacggagtacctggccatctactaccccaacgacggcgtgctgcaggccgacgtggagctgcaggcgtggtggaaggaggcgcgcgaggtcgggcacgccgacctcaaggacgagcactggtggcccaagatgcagacggtgccggagctcgtgaaggcctgcaccaccatcatctggatcgcgtcggcgctacacgctgccgtcaacttcgggcagtacccgtactgcgggtaccacccgaaccggccgtccgtgagccggcggcccatgccggtgccgggctccgacgcgtacaaggagctggagaagaacccggagaagttcttcgtgcgctccatcacc

SEQ ID NO: 7312 - DNA, 156 bp, Zea mays
  Clone ID: LIB3279-043-P1-K1-A6
acgtctatcccattcatggtttcgtatctcctcatgaactacatgcacttcaagactctagtggccgtgtgatacgtcttctgagcactgggttatcctatacctgatcatttactacccctacgactgatctctttaggccgatctgcatttaaa

SEQ ID NO: 7313 - DNA, 290 bp, Zea mays
  Clone ID: LIB3279-043-P1-K1-A7
cccacccgtccggaaatttatttattaatctgtagacatactatgttaccacatatggatttagcttccttgggggttaccgggatgagcgaggcacctacaacctaaattattggatgcaatagaaaaggatctgatctttattgggaaagaggcctgtctgaaccaggcctcctaagagaagttcttcaacaaggtataataccattttaccacagtgatcgagtccctgtctaaccttttcaacaacaataacaacaaggcctgcctgaggcttccggacaaaagta

SEQ ID NO: 7314 - DNA, 436 bp, Zea mays
  Clone ID: LIB3279-043-P1-K1-A8
cgagccttctgtacgagcagactaccacaaattgttcgatgctgctcagggtggaacagagttactcaaccaagagcagaaaaatcgattcaacatatgggtgctgcatgcagtggtggctaacgatcttttcactgatgacagctttgtgttctcaaaggctgtaggaaagatcaaagatgccatctcagccctgccagtggcaacggtggatgacgacaacgatgaagctgcggcccttgctgctgcgagcaaaactgatgtggcgacggacaacgaagcaggtcatggcgtcccagccgcagcttctgactctgtggtggatgatggcgcgcatgccgtggccttggagccggaagaagaatcctccgaccctttcggtttagatgggcttcttgagcacaggcctaagaagacgtctgggagagctcgagag

SEQ ID NO: 7315 - DNA, 362 bp, Zea mays
  Clone ID: LIB3279-043-P1-K1-A9
cggacgcgtggggccggaaaggtcagggcctgctcgcgctcttcctcctcggcgcgctcggcgtccagcgcccacgcgccggcgccgacgctgccccatggcttggacatggctgccgccggtgcgagatctagggtttggtggtgctcggaggcggacggaggtgggtgggtggaatcgaggcgatgcgaatgcgaggaagagagtaagagacgagccaggggatcttgttggctgggatcgggtggtgcacgctaaatcgcgctgtacccaggggcggaaccgaaaaacggcgtgcccgccgcaccgcgtttcgtatgatcgtggtggtggtagagtaaatttcccatcgattttagaca

SEQ ID NO: 7316 - DNA, 441 bp, Zea mays
  Clone ID: LIB3279-043-P1-K1-B1
cggacccgtaggctgagtacttattgaaccgcaaggcaagcttgaccaacacctactacggggatgggcaacttgtgccagcagcaccggacccactttacacctcatactcgtgggcagggcaaataatgacattagcatggtaaccgctttacaccaagatgacctcctatgctgggagcggtggcgggtaccacatctacttatcaatataaaatgaacgcacctattgcctggacacaaccatacacacatggaacaaagtcaacacttgaacactacccttcaacggcaaagttgattatgtaccggagctgaagctctggtttggcgcctctgccgatcggaataagttggctgccactgacctttcttatttgagcaacactggtgactcaaccacgggtttccaaccagaggttctgggcttttggatggaac

SEQ ID NO: 7317 - DNA, 379 bp, Zea mays
  Clone ID: LIB3279-043-P1-K1-B10
ctccagcttgcctctgctcggagctccttcccctcccatggcgtcctagcccctgctctgctcatccatggccgcgtctccctggcgtccggctctgcttttccctggtcgagctcccagcactgcgttcttctctcctccctagcgtcgtccctctgtttctttctgccgcgagcagctcactggtgctcggacccagctccgcgcgcttcctgctcccatggcagcgcatcctcgcgctttggtcaagttcgtcccatggcgcccggatttctgctcgccccagctctctgtgtcgcgcgctgccatcgtctagttcgcgttcgtcgagtttgccgaagccctgttacgagtgccgaactatactatacctataaag

SEQ ID NO: 7318 - DNA, 411 bp, Zea mays
  Clone ID: LIB3279-043-P1-K1-B11
gcggcctcccgtcgagcaaacatggcggcggcggtaaccctcctccgccttcctctcgcgcgactctcctaccacctccgctccgtaccttcctctcgtctcccgtccccgcgcctccgtatctttgcctcccatcgccttttctcttccctggaccatggctccgcctctgcttccgcctccgcggccgtggccgaggttgtaggcgtgccggacgcggaggaggagtcggtagaggaggaatctgcggccgaggccgaggcggaggcgcccaggtcgttcgtgctcccacggctgccgcggccgaagctgagcgtgaaggagcggaaggagctggcctcgtacgctcacggcctcggcaaaaagctcaagtcgcaacaggtcggtaagagcggcgtcacaccgaacctt

SEQ ID NO: 7319 - DNA, 414 bp, Zea mays
  Clone ID: LIB3279-043-P1-K1-B12
gttcttcctgatctgaatggcaagctcactggtatgtccttccgtgttcctactgtggatgtctcggttgttgacctcaccgtcagaatcgagaagggggcctcctatgaggatatcaagaaagctattaaggctgcttccgagggtccactcaagggtatcatgggttatgtggaagaggatctggtttctaccgacttccttggtgacagcaggtcgagcatcttcgacgccaaggccgggatcgctctgaacgaccacttcgtcaagctcgtctcgtggtacgacaacgagtggggctacagcaaccgcgtcgtcgacctgatccgccacatgttcaagacccagtaggggtttttcccccctgcttctcatggatggttgctgcttgtgtatgccgagaataaatgtgga

SEQ ID NO: 7320 - DNA, 451 bp, Zea mays
  Clone ID: LIB3279-043-P1-K1-B2
gttttggttgacaacagcatcatgtctccagtgctctcccgtcctatagaactgggagctgatatcgtgatgcactcggctaccaaatttatagcgggacatagtgatcttatggctggaattcttgcagtgaagggtgagagtttggctaaagaggtagggtttctgcaaaatgctgaagggtcgggtctggcaccttttgactgctggctttgcttgaggggaatcaaaaccatggctctgcgggtggagaaacaacaggctaatgcccagaagattgctgaattcctggcgtctcacccgagggtcaagcaagtaaactacgctgggcttcctgaccatcctgggcgagctttacactattcccaggcaaagggagcgggctctgttctcagttttctcaccggctcactggccctctcaaagcacgtcgtggagaccaccaagtact

SEQ ID NO: 7321 - DNA, 448 bp, Zea mays
  Clone ID: LIB3279-043-P1-K1-B3
cggacgcgtgggcggacgcgtgggtgaagatgagtcctgcagacagaaaaatgttgatatgaatctactagtatttgtgaatccaatgacaacatttcaccatcatggaaaattccgttaatgaattgtgtgaagctcaacaaggacaaatccaatattcagaaattgccttccagatctgatcgcctatcattttattccaagagtttggagataataggagttgcaccagagaggtttgagaagaataaccagttctggaagaaccaggttcacaagtattggtcatttcttcatgttgaaaagactagcattcgaaacgtcatggacatgaatgctaattatggtggatttgctgcagcactaagcagtgaccctgtctggattatgaatatagtaccctataccatgatgaacacattgcctgttatctatgaccgtgggttac

SEQ ID NO: 7322 - DNA, 424 bp, Zea mays
  Clone ID: LIB3279-043-P1-K1-B4
ctcagcaactacgtttcataatgggtacagaaagaaccaaaacggatgtacactataaactttacagggcaagagcatttcagacgtcgacagcatgtaggggtacagattttgttcgcgggagatttggtggcaactgagctccggcatagtagcgccttgctgtaaacatacaatcagagctcccagctgcattgacctcacaatgccaggccctttgggctcctggatcggggtgcctgctatgcgataattggctgttcaaattagaatggtaatccgtacttactttacccgggcttcggtcaccggtcggtacccggaaactgtggttctttccaatatggaaagattgcagcttgttcagtgaaggcttcatcctatttactccatttgcattgtcgaagtcaagagatggatggat

SEQ ID NO: 7323 - DNA, 402 bp, Zea mays
  Clone ID: LIB3279-043-P1-K1-B5
agggagggtacacattcatcacccatgttgtatttccgacaatcaaatcccaacgagcatagcaccgaccgaactgacacatcgcatgcataatgtgttcatccctctctaggaggggggcaacaccgttctacaactaaaaaacccaaaccaactacaaatccaccgacccagagttgtcagttgacccattattcctccgcctgatcaacattacacacttgtttccttcattcatctgtccgttcttctttttaggcctcttcctcaagcagcatctgatcgaagtgccacaccccgtgccccttgcccactctcctcagctgggcgacatacttggagatcttgtttatggcttccacctgctcctcgaggaactcactctcgatgaagtctgtcagc

SEQ ID NO: 7324 - DNA, 433 bp, Zea mays
  Clone ID: LIB3279-043-P1-K1-B6
ccaaattctaccaaatacatgtgctttattcaagttagttaaattgtgattggattgcaaataagttattcaaacttgctattggatgatcatgatgtatataaagtataatatttgttgatcaaattcatttgaatgcatatgagttgattgaattggatatatatgcatatgttgcttgctataagatgattgaatgtacaatttgctaaataatcaagtttggattgatctatgttgaataaattcaagagacttcatttagtaagtggtttaaatggatatttgtcttttgaaagtagttcatttcaaatttgattcaacttgaagaagaataactcaatatactgaaatctggtcaatattgaaaatctaacaaggctgtgctcatagccatgtttgagtgatcaaatctatttggattggcttgaaa

SEQ ID NO: 7325 - DNA, 417 bp, Zea mays
  Clone ID: LIB3279-043-P1-K1-B7
cggacgcgtgggcaagttcacagcagacgacagcatgggtgttgctgagatcaacattactgacatctacgatgctgcgaagctggacctgaagcacgcctctgatgggacaaggatcaagacgatctaccctgtcggagtaaactaccttggcggcgagagccatgttcagtggaaggatggcaaggtggtccaggacttgattctgaagctgaggaaggtcgagagtggcctgattgtggtgcagctggagtgggttcatgttcctggcgtgaagctgtgaaggccctgtctgaatgagggctgatggagctgcagttgctgtgtccctggtttgattgtttggttgtaaacgatatcctgaacgtggtgatatgcggtgtatgaatgaagtttgagtgtgatgctttgtttggg

SEQ ID NO: 7326 - DNA, 412 bp, Zea mays
  Clone ID: LIB3279-043-P1-K1-B8
ggccgattcaacattcgttgatgctcttcgtgacttggatgactgccttacaatggtgcatctgtttgcggcattacctgctgttgatggtgaacgtgttgaggtcaaacgaatccataactgccgcaggttaagccatgaatggcaagcatacatatcccgaacccattccctgaggaagacatttatttccgtgaagggcatatattatcaggctgaagttcaaggacaaaagatcacctggctaactccgcatgctcttcagcaagtattaactgatgatgttgatttcaatgtgatgctttcttttctagaattctatgagactcttctaggatttgtgaacttcaaactctatcattcaataaatgtaaattatccacctattctggatccacgtctggaagcttta

SEQ ID NO: 7327 - DNA, 420 bp, Zea mays
  Clone ID: LIB3279-043-P1-K1-B9
cggacgcgtgggcagagaaggagattgatgctgcaggagatggtgatgttttagtcattttggatctacgaaccgaccagtcattgtttgaagctggagtggctcgagaggttgtgaacaggatccagaaattacgaaagactgctcagcttgaacctgctgatccagttgatgtgtattacgaatctgtgggcaatgacaaaaacactctggaagagatattgaagtcacaggatcagtatattagagacgcacttggctcaccaatcgttccaaaggaaatggcaccaacagatgtcgtagtacttggcgaggaatcgcacaacgtacatgacatgtcatttgtcatatgcatcgcaaggtccaccccgattatttcaccagatcttctttctcatgcctcaggcaacagcaatcatg

SEQ ID NO: 7328 - DNA, 449 bp, Zea mays
  Clone ID: LIB3279-043-P1-K1-C1
cggacgcgtaggcgccgcgccgccccgctccctagtggtgctccctcccccaccactgcagctccgtgccggcggccccaagagttgcggcgaggatgaacgtgaagggcggcagccggattccggtacccccgccgggggccagcgcgctggtcaaggtggccgtgttcggcggcgccgccgtgtacgccgccatgaacagcctctacaacgtcgagggtgggcaccgcgccatcgtcttcaaccgcatccaggggatcaaggacaaggtataccctgaagggactcactttatgattccatggtttgaacgaccaatcatttatgatgtccgtgctcgaccaaatcttgttgagagtacttctgggagtcgggatcttcagatggtgaaaattggtctccgtgtccttacaaggcctatgccagagaggctaccacatatctacaga

SEQ ID NO: 7329 - DNA, 392 bp, Zea mays
  Clone ID: LIB3279-043-P1-K1-C10
ggtgggttggcttctcctccccctccggttcgggttcgggttcgtgaggttctccggggttcggtttcgtgggtgagcggatcgagatggcggcgtctgatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccaatcccgcggcggccgtggaggcggcggccgctgccggtactgtggtggccgt

SEQ ID NO: 7330 - DNA, 327 bp, Zea mays
  Clone ID: LIB3279-043-P1-K1-C11
cggacgcgtgggctggggcgaccactgccgcgagtacaagccggagcggtgggtgccgggacggactcttcgtgggcgagtcctactacaacatcactgccttcaacggcgcccctgacctgtgccttgacaaggacttctcatactaccacatgaacttcaccgccgcttcaatacttacgcggttccgctttgcgcataatagaatgctacctcgtcagacccaaaatcgcactcactatgtacatgaaacactgcctacaggggacgctcaccaaaacaggcactgcccattaattcagctcttaaccgatggtcttccatcac

SEQ ID NO: 7331 - DNA, 391 bp, Zea mays
  Clone ID: LIB3279-043-P1-K1-C12
tagcaggtttgcctgaacgcagacaccctctactcttcatcgttcctccgctcttcgtccacacgctctgatccgattctgcccatgtctgcgcacccagatccggcgcccgcgcccatggcgacgcgcaggcccgcccgcctcgctcgccttcgcttccaccatcgcctcgctcgccttcatctctgcccaaacaacatcgacgcatccgccccacgcgcgacgcacgcgccccgcctccgatgcccacctccgcaaccgacgctcggacgacgaggacgcggcggcacaggatgacgagttggttgtcgacttagcagatctggcgcctgcgcccatggcgacgcgcaagcgaatgctcctcaaatttgtcatcgtcggcaatagcatg

SEQ ID NO: 7332 - DNA, 447 bp, Zea mays
  Clone ID: LIB3279-043-P1-K1-C2
gtttgttgatgacaaactgcggaagggggtgaaagaggccaatgaggaggatcttgaaactgtcctggacaaagtgatgatgctgtttaggtatttgcaagaaaaagatctatttgagaaatattacaagcaacacttggcaaagcgtcttctttctgggaaggctgcttctgatgattctgagagaagcatgcttgtgaagctgaagacagaatgtggctaccagtttacttcaaagttggagggcatgttcactgatttgaagacctctcaggatactacacaagggttttatgcatctacttcctcggagctgccggcagatgcccctacaatgtctgtccagatactcacaactgggtcatggccaacgcaaacctgcaatacctgcaacctcccccctgaaattgtctctgtctcagagaagtttcggtcttattaccttgg

SEQ ID NO: 7333 - DNA, 449 bp, Zea mays
  Clone ID: LIB3279-043-P1-K1-C3
aaaaattcccagttctttggtccgcgtcagagaggcggcggcgatgtctgggcgcggcaagggcggcaagggtctgggcaagggcggcgcgaagcgccaccggaaggtgctccgcgacaacatccagggcatcaccaagccggcgatccggaggctggctaggaggggtggcgtgaagcgcatctcggggctcatctacgaggagacccgcggcgtgctcaagatctttctcgagaacgtcatccgcgacgccgtcacctacaccgagcacgcgcgccgcaagaccgtgaccgccatggacgtcgtctacgcgctcaagcgccagggacgcaccctctacggcttcggaggctaggctaggcgcctcttcatagtcggggactggttaggggacatgtctctgtgtgatgctttctgtggtattattgctgcaatagccgtgtaatcca

SEQ ID NO: 7334 - DNA, 435 bp, Zea mays
  Clone ID: LIB3279-043-P1-K1-C4
tcaaaaccatcgggggcaaaaggataggagaataaggaaaaaacaatggcggtgctactccgccgcgccgcggcgctcctcgtcgtcgctgctgtctgcgcggacggcgcctccacgttctactcctccgaccccaacctcggatccgcgcgcgtcgtcttccagacgaattttggtgatattgagtttggtttctttcctcatgttgcacctaagactgtcgagcacattttcaaacttgtgcggcttggatgctacaacacaaatcacttcttccgggttgacaagggtttcgttgcacaagttgctgatgttatgtcaggtcgaaccgcccctatgaatgaggagcagaaaaaagaagcggagaaaacaattgttggtgaatttagtagtgtcaagcatgtcaggggaatcctctccatgggaaggcactct

SEQ ID NO: 7335 - DNA, 438 bp, Zea mays
  Clone ID: LIB3279-043-P1-K1-C5
cccttgcaagtatagtctcggcggctctagaagacgatgggcaaggacgacgtgatcgagagcggcgctggcggcggcgagttcgctgccaaggactacacggaccctcccccggcgccgctgatcgacgcggctgagctggggtcctggtcgctgtaccgcgccgtgatcgccgagttcatcgccacgctgctgttcctgtacatcacggtggccaccgtgatcgggtacaagcaccagacggacgcgtcggcgtcgggtgccgacgcggcgtgcggcggcgtgggggtgctgggcatcgcctgggccttcggcggcatgatcttcgtcctcgtctactgcaccgccggcatctcggggggccacatcaaccccgccgtcaccttcggcctcttcctggcgcgcaaggtctccctggtgcgcgcgctgctctacatc

SEQ ID NO: 7336 - DNA, 444 bp, Zea mays
  Clone ID: LIB3279-043-P1-K1-C6
gaccgggaatccctcgtcaagtccgcgtccacggctctcaactccaaggtcgtctcccagtactccacccttctctcgcccctcgccgtcgacgccgccctctctgtggtggaccccgctcaccctgaccttctcgacctccgggacatccgcatcgtgaagaagcttggtggcaccgtggacgatactgagctcatccctggcctcatctttgacaagaaggctagccatgctgctgggggcccaactcggatggagaatgctaagatcgctgtcatacagttccaaatctcaccacccaagactgacattgagcagagtgtcattgtatccgactacgcacagatggaccgcatcctacgtgaggagcgcaattatatccttgggatggtcaagaagatcaaggcggctggatgcaatgtattgctcattcaaaagagcatt

SEQ ID NO: 7337 - DNA, 394 bp, Zea mays
  Clone ID: LIB3279-043-P1-K1-C7
cggacgcgtgggtctgaagaagaatctcatgcaagcaaggctcgataagaagctgacacaggcacaacttgctcagatgataaatgagaagccacaggtgattcaggagtatgaatcaggcaaggcaatccccaaccagcagatcattagcaagctcgagagggccctgggaaccaagttgcgtggcaagaaatagctttcctacgagtttgtgtcccggagcatcataatagggggaagacaaggcaagctgtctgcttatttgtctatgtttggtatctcaagtcctgcggactgtttctgttggcacaagagggaataaatgtgttcacggacctgtaatgcttgctccttgtcatatgaccttgctctaaacatttgtgatgaagctgtc

SEQ ID NO: 7338 - DNA, 442 bp, Zea mays
  Clone ID: LIB3279-043-P1-K1-C8
gttgattttgaagaagctggacacaagcttatgaaaattaagcttgagcctggtcaagagatggagctgtgcattatgcttcttgagtgttgcagtcaggagagaacatatcttcgttattatgggctgctaggacagcgtttttgcatgatcaataaagtgtaccaagagaacttcgaaaaatgctttgtgcaacaatattcgatgattcatcgtcttgaaacaaacaagttgaggaatgttgccaagttctttgcacatttgttggggactgatgcactcccttggcatgttttggcttacatcaggttgacagaggaagacacaacatcatcttctcgtattttcataaaaatattgttccaagaattatcggagcacctgggcatacgcctactcaatgagaggctgaatgatcctaacatgcaaggttcctttgagt

SEQ ID NO: 7339 - DNA, 428 bp, Zea mays
  Clone ID: LIB3279-043-P1-K1-C9
cccacgcgtccgttttttttttttttttttatcacaacaatgaaaatattttaccatgggattcacgatggaatcacacaaatcatccacaaggattgaattggttataatgcaaatgggactaaacctcttagggcagcagacgaagtgctttcatggtaataagttaataaccgaccattgaccacataagtcttacgcgagacattcgcaagcaaagtgactcccaaaatacttacaaccattaggacaacataaagtagacatagtagtagacaccaccaaacttaggcatcaatagatccagcacctccttactcgaaggcccactggttctccctgcggatctcctcttccttctcaggggtgaagtcattcttgatattgaaggtcttgcgaatctcttctggtgtcttgcccttgatcat

SEQ ID NO: 7340 - DNA, 435 bp, Zea mays
  Clone ID: LIB3279-043-P1-K1-D1
ggaaaccattcgtctcaaggtacgacacaacgtgaccagccatcgattcaagcgaagggcggtcgccgactttacactggatcactatctgcaaaaagaatcgtcatcttccattagctagctagctagctagtccttttgataatctacagagacgacactgaatagaatctggtatagtagaggaagctagagctctgctaacaaccccacagtccgacggcggttcgtaaggatcgtcgatgccggtgaaccctgcatgcagggcgtcgtcgtttaagcttcgcggttagctagtaagcagatacaagcaggacggccagttcgtagatcttgagtgagtgagtgatcgagtgagtgagcacctttgattttgccggcgcgtgcgagcttgtagaggcctttggggtccctggcttcgcacacttgaagcgg

SEQ ID NO: 7341 - DNA, 65 bp, Zea mays
  Clone ID: LIB3279-043-P1-K1-D10
gccagcgtccgtacctttcggacgctggttattacaaatcagctagggaaaaatagtatgagaga

SEQ ID NO: 7342 - DNA, 350 bp, Zea mays
  Clone ID: LIB3279-043-P1-K1-D11
ccgcagaggcgcagagacaggcgtcttcgtactcgcctatctccgcgactcaaagcttctgccatttcctaccgccgccgctgcagctccaccccattccgtcgacaccatgagggagtgcatctcgatccacatcggccaagccggtatccaggtcggaaacgcgtgctgggagctttactgcctcgagcatggcattcaggctgatggtcagatgcccggtgacaagaccattgggggtggtgatgatgctttcaacaccttcttcagtgagactggtgctgggaagcacgtccctcgtgctgtttttgttgaccttgaaccaactgtcatcgatgaggtgaggactg

SEQ ID NO: 7343 - DNA, 433 bp, Zea mays
  Clone ID: LIB3279-043-P1-K1-D12
cagcctcggccagccacctccccgtcgctctcacgctcttcgtgcccgccgcctgccctcttcccctccacctcactcctcccgtctgacgcacatggcctccatcgccggatcttccgctctctccttcgccatgcctgtcaaggcaatcaactcaaattctctagccttctccccggtgaggaagggtaacacattcctccgcctgcaaccagtgcctatgagatctgtttcctgcgctgccaagaaggatacggaggacaaggtttgtgaaattgtgaagaagcagcttgctcttcctgaccacactgaagtttgtggagaatcgaaattctctgaacttggtgcggattcgctggacacggctgagattgtgatgggccttgaggaacacttcgacattagcgtggaggagtccagcgcgcagacaatt

SEQ ID NO: 7344 - DNA, 444 bp, Zea mays
  Clone ID: LIB3279-043-P1-K1-D2
cgacgacgcacgcagagatccggcgtactgcaaattttgaaaactgaactgtaagatggcatcagcagagctttcccgtgaggaaaatgtgtacatggcgaagctcgccgagcaggcggagaggtacgaggagatggttgagttcatggagaaggtagccaagactgttgactcggaggagctcactgtggaggagcgaaacctcctgtctgttgcatacaagaacgtcattggagcccgccgcgcctcatggcgcatcatctcctccatcgagcagaaggaggagggccgaggcaatgaggaccgagtaacactcatcaaggattatcgtggcaagattgagactgagctgaccaagatctgtgatggcatcctcaagctgcttgagacccatcttgtgccgtcttccactgcccccgagtccaaggtcttctatctcaagat

SEQ ID NO: 7345 - DNA, 134 bp, Zea mays
  Clone ID: LIB3279-043-P1-K1-D3
acgcaacccatacaccaagaggctacgcacaaccttatgcgccaaacctgacacatacaagggggcagtggggtttacccgagaccaatatctatacatatccatcctatactagagctcgaaacaacacgact

SEQ ID NO: 7346 - DNA, 401 bp, Zea mays
  Clone ID: LIB3279-043-P1-K1-D4
tgatggtccaaaccctaacaatcgctggaagatgttcataccaattatacttgcagtggagtacttcttggtagtaaaaggaatccggagggcgatccatgcagatatcgcaaatgggaaggtggatgactgggagcagcgttaccgggacttggttggaagcagggaccctgtggagcagaaaggttctaccaccaggaaccgcaaagcctaagttggtgttagcagaaatgattttattcgtgttgtgacccactcgatctgcttgctgttccttttcctaattatgtgttgagggctttatagagttcgctggttctacttgaaaaataattgctcgtgttgtagttgataagaatatcttttccattttatgatgcttggccctcttcgcaattgtg

SEQ ID NO: 7347 - DNA, 443 bp, Zea mays
  Clone ID: LIB3279-043-P1-K1-D5
ctatcacttaacttgttgttgggggccttcttcgccaccgaaggtcctctaagcaaaaacaccttcggcaagacgatgtgcaaatagatacgacatgaagacatatgtcgaagctacaatcgaaagagcttcggcatgatggcgtgcataagacgaaggatggcaccgacttaaagaggaaaagaccacatagtccctaataatttgtattatggttatgattagttatcaaggacacgaatgtaattttgtccgggctgtgtcccgtgcctataaatagatgaacagtacccccgtactgttcacgctgactggtaatcgctcacgcgtcacttcgggatttttgccttctgtcaagccgaaggtacaatgtaatttaaacatcattgatgtttgttcatgattttataatgataatgtggataatataatgatttaaaata

SEQ ID NO: 7348 - DNA, 445 bp, Zea mays
  Clone ID: LIB3279-043-P1-K1-D6
gtgcagccgagtcaatttgctaaagctgttacaaaggaagttacctatttgcatcgcattctttcccaaacattgcttgaggttgaggtgcaaacaatattcaggcaagtggttcaaatattccattcacatattacagaagcattttcaaaattggaagtcagtactcctctggcaaagaatagattatgccgagatgttcagcatattcttgcatgcatccggaagttgccagctgagaacttcagttcagaaactattccaaattatggtcttcttgatgaattcttggctgagaactttgggacaaaagttggtgaatgattgtgcactaggaactgactcatgtctacaaatgttcaatggtggaatatcgaatatatgttagatgtgaagtgctccaagatgttgccgatttttggcgtgaactctgtgcaggtgttgg

SEQ ID NO: 7349 - DNA, 427 bp, Zea mays
  unsure (1)..(427): unsure at all n locations; Clone ID: LIB3279-043-P1-K1-D7
cccacgcgtccgatcaagaagaatagggatccaagatgggaggatgagtttgagttcgtgtgtgaggagcctcctgtgaatgataaactgcatgttgaagtcataagtaaagccccgaaggcaggcctgatacatggcaaggaaactttgggctacattgatattagccttgcagacgtgatcagcaacaagcggattaatgaaaagtaccatctcatagactcgaaaaatggtcagatccagatcgagttgcagtggagaacttcctagacaggaaggagccagaatgccttgatgttcctctattcagtttgcgtatatctgtgattgagattgaggtcatgtagatatttcttttttttatagacatctgtttttcggatcttctcttaattgaacaagtntccgacaagaactttgcagacat

SEQ ID NO: 7350 - DNA, 436 bp, Zea mays
  Clone ID: LIB3279-043-P1-K1-D8
gtccaacagaagtgcagtggcatgcaaaggcacgaattaatgctggtgccaatttctatatagtaggccgagatcctgctggaatgggacatccaacagaaaagagggacttgtacaacccagatcacgggaagaaggtcctgagcatggctcctggtttagagaaactcaacatactgcccttcaaggtagcagcttatgatacagtagcaaaggagatggccttttttgatccttcacgcagtcaagattttctgttcatctctggaaccaagatgcgcacttatgccaaaactggagagaatcctccagacggtttcatgtgcccgggtgggtggaaggttcttgttgactactacaacagcctgcaagctgaagaagcgactccagtccctgtatgaggcaagctactatttgactaagagattattcaatg

SEQ ID NO: 7351 - DNA, 434 bp, Zea mays
  Clone ID: LIB3279-043-P1-K1-D9
agaaatgatgagttagtccctagccaggtaactttaactgatggtaactttgagaatggttcacatcacgaggctacaggtgacttttggaccgaggagatggtttcgggagagaaagaactgctacctgacccagtaactcatgaaggggaacacttattgagggatgaacttctcagcaaaataatggacaaaagaattaaattagttgacaaagttttctctctgagaggaaagagtatctatgataagcattcaaatcaggtttcatttttagacatgcataggcaaaaggtagtggataaactcagaagagcatgcagtttagttgtggagcatctacgtagtagtcaaaatcacattgctcaagaggacagagatgggaaaaataagctaataattggatggtttactatgcctgtgtatgctttttt

SEQ ID NO: 7352 - DNA, 253 bp, Zea mays
  Clone ID: LIB3279-043-P1-K1-E1
tcccgaatcgacccatgcacccacgcactcgaacactactagttagaccttaatctactaatattcacctctgtgtatctaatcgatgtcggtggctgctattgagaactccctcaattattactaccctatcatttcaaatacatatgaacttattcggcctgaaattcacactaaacatgacctttctgaactgatgtactaaacaatccacgagtggccaatatatttcaatgtccctctaccttttcca

SEQ ID NO: 7353 - DNA, 401 bp, Zea mays
  Clone ID: LIB3279-043-P1-K1-E10
atttcaagttcttgtagcatcgaagatgataagatctcatatgctatcaatcgcttctttgcccactttgtgaccaacatgatgactcaatcaatcacttgttggtgggctgctcctttgcacgtcttttctggttcgaattgttcaggccttttggactgcagggcttcattccaggacaggatattgacgattttgatctctggtggtgttccaatagtgctcggctagatgggctgagtcagaagggctttgactctttggtcgctctgggtgcttggatgttgtggaagcatagaaatggtgtggtctttaatggttcctccccaagcctggtggtggcccgtcgactggccagggaggaagcttttctgtggtccttggctggagctaaaggggtt

SEQ ID NO: 7354 - DNA, 212 bp, Zea mays
  Clone ID: LIB3279-043-P1-K1-E11
atttcaagttcttgtaacatcgaaaatgataagatctcatatgctatcaatcggttctctgcccactctgtgaccgacatgatgactcaattaatcacttgctggtgggctgctcctttcgcacgtttttgctggttcgaattgttcaagtcctttggacagcatggcttcattccaggacaggatatcgacgattatgatctttggctggt

SEQ ID NO: 7355 - DNA, 433 bp, Zea mays
  Clone ID: LIB3279-043-P1-K1-E12
ggttctattacgtgtttggcttcctccttgtcgtgcttcttttgctgattgtggtgtgtgctgaggtatcagttgttcttacctacatgcatctctgcgcggaggactggaggtggtggtggaaagctttctttgcttctggaacagtggccctttatgtgttcctttactctatcaactacttggtgtttgatctcagaagcttgagtgggccagtttctgctattctctacattggatactctttcgttgtctcccttgccattatgctagcgactggtaccgttggcttcctgacgtcgttctcttttgtccactaccttttctcatcagtcaagattgattgaagatccagggttgtctttacacaaaatcacctgtgagctcaaatgatatgaccattgcatcttgaaggcctttcacagagcagtgc

SEQ ID NO: 7356 - DNA, 444 bp, Zea mays
  unsure (1)..(444): unsure at all n locations; Clone ID: LIB3279-043-P1-K1-E2
cctcgccctcatccctcctcggcgccgctgccggcccgcgcccgcccgcctcccccctcgtgccggtctgccccgcattccgcgcccgcctcgccaccgaatcgggcggaatctcagcgggaccaaaatggggtcgccaggtgcggggagcagcggcggccacgagtgctccttcaagatcctgctcatcggggactcgggcgtcggcaagagcagcctcctcgtcagcttcgtcgccgcctcccacctcgacggcgacatcgccccaaccatcggtgtggattttaaaatcaagttccttacagttggtggaaagaaactaaagttgacaatatgggatactgctggccaggagaggtttaggacaataactagttcttactacagaggtgctcagggaattattntagtatatgatgtcacaaagagagagagtttttaaat

SEQ ID NO: 7357 - DNA, 398 bp, Zea mays
  unsure (1)..(398): unsure at all n locations; Clone ID: LIB3279-043-P1-K1-E3
cggacgcgtgggcagctagcgagagaagcaatggcgtcggctcctgcgttctgcgtcgcgctgctgctgctgctggcttccgccgctgccgtccaagcggtgccgccccaggccggcacgtcgtccacctgcagcactgacctcctccgcctcctcccctgcctgcccttcatcgagggcaccgccaccgtgccggcggacacctgttgcgccaacctgggcagcatggtgcacgacgagccgcagtgcctctgccaggctctcagcaaccccagcacggcccccgtcgccgtcaacatgacgcgcgtgatggccatgcctcggctctgccgnctagacctcccgcccgccaccggcgcctgcgcagttgccggtcttcttccccatggaccatcacc

SEQ ID NO: 7358 - DNA, 365 bp, Zea mays
  Clone ID: LIB3279-043-P1-K1-E4
cccacgcgttctcagactcttggacagacgcttagatcagctctaatattctatcaatcggggctttggccactttgtgaccaacatgattactcaatcaatcacttgtcagcgggctgcttctttacacgtcttttctggctcgaatcagtcactccttttggactgtaaagcttcattccaggacaggatattgacgattttgatctctagtggtcttccaataatgctctgctagatcggctcagtcaaaaggacttagactctatggtcggtatgggtgcttggatgttgtgataacatacaaatggagtggactttaatggttcctccacaaccctggtggtggcccttacaactggccc

SEQ ID NO: 7359 - DNA, 353 bp, Zea mays
  Clone ID: LIB3279-043-P1-K1-E5
ggaatgacccacgcgacccacgcgttcgattacaagttcttgtagcatcgaatatgataagatctcatatgctatcaatcgcttctttggccactttgtgaccaacatgaagactcaatcaatcacttgttggtgggctgctcctttgcacgtcttttctggtacgaattgttcaggccttttggactgcaaggctttattccaggacaggatattgaccaatttgatctctggtggtgttccaatagtgctcggctagatgggcttgagtaaaaaggctttgacttctttgagtccctcctggtgcctggaatattgttgaaagccataaaaaagggggtgggtctttaaat

SEQ ID NO: 7360 - DNA, 424 bp, Zea mays
  Clone ID: LIB3279-043-P1-K1-E6
gttggcttctcctccccctccggttcgggttcgggttcgtgaggttctccggcgttcggtgtcgtgggtgagcggatcgagatggcggccctcaatgttgagtaccgctgcttctgtcggcggcctcgcctgggccacggacgaccactccctccacaacgccttcagcacctactgcgaggtcctccagtccaagatcatcctcgatcgggagacgcacaggtccctcggcttcggcttcatcaccttctccactgaggaggcgatgcggaacgccatcgagggcatgaacggcatggagctggacggccgcaacatcacctgctacgaggcccagtcccgcggcagccgtggaggcggcagcagcgtcgggtacagtgttggccgtggaggcggctgctactgcagtagcaggcgccttgat

SEQ ID NO: 7361 - DNA, 407 bp, Zea mays
  Clone ID: LIB3279-043-P1-K1-E7
gcagatctttgtgaaaaccctgaccggcaagactatcaccctcgaggtggagtcctctgacaccattgacaacgtcaaggccaagatccaggacaaggagggcatccctccagaccagcagcggctcatctttgctgggaagcagcttgaggacgggcgcacgcttgccgactacaacatccagaaggagagcaccctccacttggtgctgcgcctcaggggaggcatgcagatcttcgtgaagaccctgaccggcaaaactatcaccctcgaggtggagtcttcagacaccatcgacaacgtcaaggccaagatccaggacaaggagggcattcccccagaccagcagcggctcatctttgctggaaagcagctagaggacgggcgcacgctggccgactacaaca

SEQ ID NO: 7362 - DNA, 374 bp, Zea mays
  Clone ID: LIB3279-043-P1-K1-E8
aactagtccaaagtgcccttgatgggtacaaggtatgcatatttgcatatggtcaaactggatctggtaaaacttatacaatgatgggtaaaccaggaaatgatcaaaaagggataatacctcgttctttggagcaaattttcaagaccagtcggtttctagaatctcaaggatggaattattccatgcaagcatcaatgttggaaatatacaatgagaccattcgtgatttgttagcacctggtcggtctaacaattttgagtctagtagacaatgcactattaagcatgaccctcatgggaatattgtgtcggaccttacaattattgatgtctttggtattgctgatgtgactagtctactagagaaagca

SEQ ID NO: 7363 - DNA, 435 bp, Zea mays
  Clone ID: LIB3279-043-P1-K1-E9
cccacgcgtccgggcttgttaacctcaagaggtgcagcaaggtctcagatggatgtctcaaggaatttgcagaatcatctaaggtcctggagaacttgcagatcgaggaatgcagcagggttactcttacgggcattcttgcgttcctcctcaactgcagcccaaagtttaagtctctctccctgtccaagtgcgtcgggatcaaggacatctgctccgcacctgcacaacttccggtatgcaaatcactacgttccctggccatcaaggattgcccaggcttcaccgacgccagccttgccgtggtgggcatgatctgccctcagctggagaacgtcaatttgagtggccttagtgcagtcaccgacagcggcttccttccactgataaagagttcaaacagtgggctggtcaacgtcgatttgaacggttgcg

SEQ ID NO: 7364 - DNA, 397 bp, Zea mays
  Clone ID: LIB3279-043-P1-K1-F1
tctcaccaagtcgttcgtcacgcagaggaccggacgctcgtgagaggcgagacgagcaatcgaaagccggaaggaagcctaacctctcttccaaagccaaaccgaaaagggaaaaaaagtattgtcgaagagaaaaggaaaaaaataataaaggaacacaagcagcccaccggcgcatcacaggggaagcaaacaggggagaaccctagtcaacagacgccgccgccctccctggctggatctggccgccgtctcctccgccgcccgacgatcgcctggtacggagatcctaccccccaatcaggaccattaggactgctgtgtcacagtctcacggaacggacggattggaacggagcgggatccttaacgcgtcgcgtgccccccggggtgggtg

SEQ ID NO: 7365 - DNA, 417 bp, Zea mays
  Clone ID: LIB3279-043-P1-K1-F12
gcggaaaacttctgcggaaagtctgaaggatgtgaagcaggaggattgtctggagccagacgggagagcaccgatgcagagggtaggcttccaatcatccatcatctggctggttctttcggtggctgtgctgctgcttctctattgtggcgtatggatgagtatgatatgtatcctggtgcggtgttttgcgcacatgggttcctggcatcaacctgatgtgtgaacttctgtcataacatgcgtttgacagcagtaagacatcccgacatatgccaatgcagctaaaaataaaaaaaagaggtagcaagtgaagagggagaaaaaagagatgtgttattgtaggtcttagtacatcctagtcttgccaatgcagctcaaaagaaaaaagaggtagcaagtgaggagggagaaaaa

SEQ ID NO: 7366 - DNA, 435 bp, Zea mays
  Clone ID: LIB3279-043-P1-K1-F2
gctcgaggccctcccgtcgccgaggctgatgaacacgcacctgccctacgccctgctcccggcgcccgtcaccgccaccgccaccgggtgcagggtcgcgtacgtgtgcagggaccccaaggacatggtggtctcgctctggcacttcctccggcgcgccaagccggacctcttgttcgccgacacgttcgagtccgtctgcgacggcaccgtggtggccggcccggtctgggaccacgtcctctcctactggcgtgcgagcgtggcggccccggacagggcgctcttcctcaggtacgaggacatgctgcgggaccccggcggcaacgtgcggcggctcgccgagttcatgggccgcccgttctcggccgccgaggaggccgccggcgacgtcgcggccgtcgtggagctctgcagcttcgacgagatgaaagg

SEQ ID NO: 7367 - DNA, 387 bp, Zea mays
  Clone ID: LIB3279-043-P1-K1-F3
gcgagagacgggcaggggagaggaaaaaaaaaatctaaccctagcatccgcagcgctagggttcgggggttgcgatggcggcggcggcgagacagcgggggacggtgaagtggttcaacgacaccaagggcttcgggttcatctcccccgaggacggcagcgaagatctcttcgtgcaccagtcgtcgatcaagtcggagggcttccgctcgctcgcggagggcgaggaggtggagttttccgtctcggagggtgacgacggccgcactaatgccgtcgacgtgaccggccccgacggatccttcgtcaggggcggcggaagcggatgaggaggcggcggcggctactgctcccgcggcggtggcggatctggcggcggcggtcgca

SEQ ID NO: 7368 - DNA, 431 bp, Zea mays
  Clone ID: LIB3279-043-P1-K1-F4
accgaatccagcggcggcggcggcggcggcggctatggcggcggttatgaacgccgatgtggaggtgggcgacttcgacctagacgacgacgacctcatggacgaggatgccgggccggatccagcgccggcccccacctcgcgtctccgctccaccatcgcgggcgacgacgcgccgcgtaggaccaagggccgcggcttccgcgaggaccccaactcctctgcgccccgcgattcgcgctttggcgcggggggacgcgccgacctcgactcgctcggcggcccgggacccatccaatcaattgaaggatggattgtgttggtcactggagttcatgaagaagctcaagaagatgacctccaaaatgcttttcaagaaatttggcaggtcaaaaacctgcatttgaatttggaaccgcgtaccggatttg

SEQ ID NO: 7369 - DNA, 438 bp, Zea mays
  Clone ID: LIB3279-043-P1-K1-F5
ggcggcaggctcgccgacgagttcagcggtctccgcctcgccgaggagcacaccacgccacctcctctgtcaccgctgcccgccgcgccggtgatgccgaagagcatctccgttcgctcgcccggctatctcaagatgatccagaacggcaagcatcgggcgtccaagccaacgaagggctcgcagcgcgtgttagtgggcatggaaggcggagtgaaggaggaggagaagctcaacggcgggctgcagttcgaggtgtacaaccagggcatgctgaagacagagctgtgcaacaagtgggaggagaccggcacgtgcccgtacggtaatcagtgccagttcgcgcacggcatcgccgagctccgccctgttatccgccatccgcgctacaagaccgaggtctgccgcatggttctcgctggcgttgtctgcccctat

SEQ ID NO: 7370 - DNA, 445 bp, Zea mays
  Clone ID: LIB3279-043-P1-K1-F6
gacagaattgcaagagctccacaaaactgaggtcgacaagttcatgacccaatggtgtgaaagtaagggcttcagagaggactacgagaagagaatcctcacatccctaaatagccgacagctgactcgagatggtcggatgaggaatcctgatgagaagcccatatttatcgagtcacaggcgccagctccagctccagctccagagcccatccctgtaaaattgcctgcaaaacaagccaaggaagtgcctgctccccaggcagatgatgctcccaagactgaagctccttcgaaaggacctgtcaagtcgcacaaggcaaaagctgctcttgatgctgatgatgattatgaggctgagcccctgaaggagaaggcaaagcctacggaggctgatgtggctaagttgaaagagatcaagaggcaggaggagattgagaagaac

SEQ ID NO: 7371 - DNA, 436 bp, Zea mays
  Clone ID: LIB3279-043-P1-K1-F7
gaaaccagcagcctcagcgccgaccactccgggagcggggcctcacaacctcaggatccacgggagatgccggtcgccgccgcctcaccctcgcactcgtgaactggcttcctctgcgacgagccggggcgggctcggattcggcggatcttgtggggccctggcgtcgggctggtccggtgctagattgatcccgcattcgagctgcggcaagcgtctgggtagtcgcttctcccgagggaaaggaaaacaaagttgcttggccgactttgggatcaaggatcggcgaaaagaaagagaaaggagggatctttttgggaggttctgtttgagctttcagggtttatatcgtagcctcgggcaactccgtgctgatggatttcttcaagattaagaagttcgggaaggggaataagagcgcccggggcgggggaga

SEQ ID NO: 7372 - DNA, 433 bp, Zea mays
  Clone ID: LIB3279-043-P1-K1-F8
agaaaatgcaaagtttggattgaaagcacaagggaaagctagtggctttaaagagaatgagggatcatccagtagcgctggggaatcatccagtatggacattgacaaagctgagtcttctctaccaaagaaacaattaactggcgtctatgatttggttgctgtcttgacacacaagggaagaagtgcagactctggccactatgttggctgggtaaagcaagatgacggaaaatggatcgagtttgatgatgacaatccaaacatccgcaaggaggaagacattttgaaactatctggtggaggggactggcacatggcttatatctgcctatacaaagcccgcatggcggagtttaagagttaggccggagtgggtctacatttctgtgccgcgaacgcaacactagtttttctgcccatgagtgatcat

SEQ ID NO: 7373 - DNA, 408 bp, Zea mays
  Clone ID: LIB3279-043-P1-K1-F9
agtggctccaagccccgtctcccttgcccatctccggccggtggtggtggcggcgaccgctaccaatgctaggtttgttatgcagcctacgaccgaggctgctgctttgcgcctccggcgcggttacgcggcaggcggtggtgcgggccggaaggcggtgatcgaggacgaggatgatgacgaggatgagctcgaggctatgggcagcgacggcgagttcgacggcgacttcgacgacgacttcgacggcgacttcgacgacgaggatctcgatgaattcgaggacgactctgatgatggttctgagcgcgaagccgggccctagcgcggaagacgctgagctgcagagctctgctcgctgcttattgcgttttttggtattttttacggggaattcaaacagaaaaa

SEQ ID NO: 7374 - DNA, 426 bp, Zea mays
  unsure (1)..(426): unsure at all n locations; Clone ID: LIB3279-043-P1-K1-G1
cttcagaaaagggttttgcagctagagaaagcaaaggcagacaagaggatggctgttgaagcagcaaagccgcagtccaagaggcctcgtgccaatggatcggcctttgcaacccgtgctacaggctttgctgacaagagcttctactcagcaaccccagagaggcatccattcaatccttgcgagaggcagtttgtgtatggcgctgaggttcatcttcctcccatgatgacctcagcgtcttacacgatgcaacctgcccatggaccttattacggtaatggctacccagttcagtaccaggtctcgtatatccactaatggagacagccaggtgcaggtgctctttcctaacaatctagcttaacctgctgctctntgctgtagtcgtatcagttactctgcaagtttccctagctggaaata

SEQ ID NO: 7375 - DNA, 426 bp, Zea mays
  Clone ID: LIB3279-043-P1-K1-G10
cttagcctctcactgccactcacactaaaagctatagcataaaagttaaactgaagtgtacaagcaagtttatacaatacatgcacaaactaaaggcaagtagttaccttcatggtagagttcagtttaaagctctcctccctctgtttccagttttggtgccctccaaacagcggtgaaggatctttgtcctgcttgtcaacggttatatatgacaacttcttcacgattgtgttgggagtcctctttgggatggcaatagcatttggatcattcgcaacaggtatcgggcagcctgtagattgaagtacaaatgtggggctacgaagcagtcacaatttagccaccaaaaggatttttttttaaggcacgaatcttacggtgggagtggttcgatgagagccccatcgagtccaacaccgagaa

SEQ ID NO: 7376 - DNA, 386 bp, Zea mays
  Clone ID: LIB3279-043-P1-K1-G11
cttagactctctctaccactgacactaaacgctatatcatcaatatttaactggggtcgcgggtctgtctatacagaacatgcacattctaaaagtatttactctcctttatggtacagtttattttaatgctcatcttcctatgatcacagataagatgccttcaaaacttaggtcaaggatttttgtcctgctagtcaactgtaatatatctcagctaaattaccattgagattggtgttctctttgtgatggctttagcatttggactattctctacatgtatcgggctgtctgaactttcaagtccaaatgtgttgcttctatgcaggcacattattaccacctactgtagtttttttatataggcgcgaattttatctgta

SEQ ID NO: 7377 - DNA, 316 bp, Zea mays
  Clone ID: LIB3279-043-P1-K1-G12
agcttcgccgtcgtgccgggctccggcgccgggaagacgcggaaagtgaagctctccctgtgcatcaccgaagtgctgttcgatatcgacgctgacggcgataaaaccgtcgacgtcgttatcgtgccgcgcacaaatgctaagatcacgctcaacgctcgccccaccatcaagaatcggaactaggagctagctgctactagtgctcatcaagcacactgtacgtacgtacgtatgtactcgatcgcgtggtcattcatcgaccatcatcgtttatatgctgtcacgcacagtgcgggacggccagtgttgcatt

SEQ ID NO: 7378 - DNA, 375 bp, Zea mays
  Clone ID: LIB3279-043-P1-K1-G2
acccacgcgtccgcttaataaaagggttttgcatctagagaaagctaaggctgacacgaggatcgctgctgaagcaaccgaggcccattccaagaggccttgtgccaattgatcctcctttgcaacccgtgctacaggcttcgctgacaagagcttctactcagcaaccccagagaggcatccattcaatccttgcgagaggcagtttaagtatggcgctgaggcttatcttcctcccatgatgacctcagtgtcttacactacgcaacctgcccatttaccttattacagtaatgtctacccagtttagttccacgtctattatatccactaatggtgacagctaggtgcatgtgctctttcctaacattctat

SEQ ID NO: 7379 - DNA, 444 bp, Zea mays
  Clone ID: LIB3279-043-P1-K1-G3
gcgtatctcccggcggcaaaggcgctctcctcccgacctccctgcggtgccggtacgacagtcgacaggatggcaatggccacatcagcatcgtaccctccacctcctccattttaccgattgtacaaaaaatttgagcaagatccctcatctgcaccagaacctccaccaccaattgatgaaccattcaaagccttgggtgttgattacacaggagatgttgtgattccaagcttggagagtcataatgtccgtcagctttatccaaagggtcccaatattgacttcaagaaggagcttaggaccctcaacagagagcttcaattgcatattttggagctggcagatatattagttgagagaccatctcaatatgctcgtagggtagaagatattacgctcatattcaagaacttacatcatcttctcaattccttacgacct

SEQ ID NO: 7380 - DNA, 439 bp, Zea mays
  Clone ID: LIB3279-043-P1-K1-G5
cggacgcgtgggtttgtccagtgacatcatatctttgcaaacgtcatcttctatttccctcctaaagctcaaaggtaccgatggattggaagtacttcagagatttgatcagccagctgcagtgagtgattccctgccaatcacagaaaaagaagaagcttttgctgtcgtgcaacatttgggttccgaaattgagtttatcgtaaaatttacaagtgacctaagcagtgagattattagagaaaaggttaatatagaccaaaataagggcaacgttgagagggtcttcttgaatagttatattcgaactgacaagtctcatggttttcgagctttggttgtaatggaggatcattcactcttgttaattcaacaaggtgaggttgtttggagcagagacgatgggctggcttcaattgttgatgtaacaacatcagaa

SEQ ID NO: 7381 - DNA, 434 bp, Zea mays
  Clone ID: LIB3279-043-P1-K1-G6
gcgagagacgggcaggggagaggaaaaaaaaaatctaaccctagcatccgcagcgctagggttcgggggttgcgatggcggcggcggcgagacagcgggggacggtgaagtggttcaacgacaccaagggcttcgggttcatctcccccgaggacggcagcgaagatctcttcgtgcaccagtcgtcgatcaagtcggagggcttccgctcgctcgcggagggcgaggaggtggagttttccgtctcggagggtgacgacggccgcactaaggccgtcgacgtgaccggccccgacggatccttcgtcaggggcggcggaggcggaggaggaggcggcggcggctacggctcccgcggcggtggcggatctggcggcggcggtcgcagctacggtggtagctggggcggcggccggagatccggcggcgggggc

SEQ ID NO: 7382 - DNA, 411 bp, Zea mays
  Clone ID: LIB3279-043-P1-K1-G7
atctagcccatctgctatcagcgaggacgaaggcacaaacccctcacctccctcaaaccctagccctcgctctcccgcttgttcccgtcaccgccatcatgggctcagatgcggacatggaggactacgggttcgagtactctgacgaagagccggaggagcaggatgtcgacattgagaaccagtattacaactccaaaggtttggtcgagacagacccagagggtgcacttgctggttttgatcaagtggtcagtatggagcctgaaaaggctgaatggggatttaaagctcttaaacaaactgtcaagctttactataagctggggaaatacaaagaaatgatggatgcatatagagagatgttaacatacataaaatctgcggtcacccggaactacagcgagaaat

SEQ ID NO: 7383 - DNA, 434 bp, Zea mays
  Clone ID: LIB3279-043-P1-K1-G8
cggacgcgtgggtttctgctttagtcgttctggttccgtctgcctcccaaatttcttcgcagcacacataacagagcccttccccatgatgaccccgaatcaaatgggccctggatgtgtgctcccgaatgatctcccatcaggaccccgaatccaatcagggtctgcgtgttcttgagggtggagaagaaatcggtgccctcgcctttcgggattgagtttaaaaacacgaagacacgagttcagtgaaaccagtccactcgttggcacttgaaagcatggcaaggagaggagccctgctgtggccacgtggatagtttcttgacgagaagggaggcaaggagccatggggtggatcattaatttaatttcggatgagaagggagggagggaggccggccactggtgggtaatgaacctgaatctctactacc

SEQ ID NO: 7384 - DNA, 436 bp, Zea mays
  Clone ID: LIB3279-043-P1-K1-G9
gcggggttaacaccttctcgccggaggggcggctgttccaggtcgagtacgccatcgagggcatcaagttgggatccactgcgatcgggttgaaaacaaaggatggtgttgtccttgctgttgagaaacgtgtgacctcgccactgctggaaccaagcagtgtggaaaaaatcatggaaattgatgagcacataggctgtgccatgagtgggcttattgctgatgctagaacactagtcgagcatgctcgtgttgaaactcagaatcataggttctcatacggggagccaatgaccgtagaatcttcgacacaagctatctgtgacttagctctgcgctttggcgaaggtgacgaagagtcaatgtcacggccatttggagtctctctcctaattgctggacacgatgagaacggacctagcctgtactacaccga

SEQ ID NO: 7385 - DNA, 431 bp, Zea mays
  Clone ID: LIB3279-043-P1-K1-H10
ccacgcgtccgacatttgttgacacacctggtgttctttctggtgaaaagcaacgcacacagcggggctatgggttcactggtgtgacatcatggtttgctgcgaagtgtgatcttatccttctcctgtttgatcctcataagctcgatatcagtgatgagttcaaacgtgtcattggatcattacgtggccatgatgacaaaatacgcgtagttttgaacaaggcagaccaagtagacactcaacagcttatgagagtttatggtgcattgatgtggtctctcgggaaagtattgaatacacctgaggtttcacgtgtttatattggatcattcaatgacaaaccagtaaatgaattagctgttggtccacttggaaaggaactatttgagagagagcaagatgatcttttttctgatctcaaagatatc

SEQ ID NO: 7386 - DNA, 441 bp, Zea mays
  Clone ID: LIB3279-043-P1-K1-H11
cccacgcgtgcggacaccccaaaatccctcagccctctggcctcggcggcgctcaaaccttcgccgtcccgccgtctccaaaaccctcttaccatggccgccgcgacaaccgcgggggccggagccgcgacgccgcagccgccacggcagtacaagctagctccgcagagcgagctgcgtgtggaggtgctccccgacgcgcccctccgagtgcgcctcgtcactggcaccgcagagatcttcggcaccgagctgcctccggagggctgggtccccgtccctccccgatccaagatcgccattttcacctggcacggcgcgacggtggaactggacggggtgagcgagagcgagtacacgtctgacgagactccaatggtaatttatgtcaacacgcacgccattctggatgcccgcagggcaagggcgagaacagccgca

SEQ ID NO: 7387 - DNA, 406 bp, Zea mays
  Clone ID: LIB3279-043-P1-K1-H12
gcggcggctgcggccgcgcaacaatggcagatatatccgaagatggtgaagttggtaaaggcggggaagggccgtatccttctccaaggctccctttgccggcaggaaagcagttattgtgcgcgtgtttgaggagggcaccccgcaaccgccctatgggcccttgctttgcggaaggcttggcgaagtcccaaaaaaaggtaatcccaagggcctcccccaaaatgactgcaaaaaaatttttcgtaaagggcttatataagctggttaattttaatttacctaatgccaacccagttaacctcttacgtcattttcaaggatgtcgccaccggggggcccgacgcactttttacccacaacaagaaggtcgccgcctgcaaaacggccaaagcgcgccttgagg

SEQ ID NO: 7388 - DNA, 443 bp, Zea mays
  Clone ID: LIB3279-043-P1-K1-H2
cgtcgccaataccgcgcgagtgggtcgggctgcagcagtttcctccggccacccagaccgagctgcacgagctcctcggcaagctcaaggaggaggatgtgagcacattgacaattctggtgatggggaaaggcggagtggggaagtcatctactgttaactccatcgtcggggagaggatcgccactgtcagcgctttccagtctgagggtctgagaccgatgatgtggtcgcgcacaagggcagggttcaccttgaacattatcgacactcctgggcttattgaaggtggatacattaatgagcaggctgttgacatcattaagagatttcttctgggcaagactattgatgttctcctgtatgtggatcgtttggatgcgtacagaatggatacacttgatggacaggttataagagccatcaccaattcatttggaaaa

SEQ ID NO: 7389 - DNA, 426 bp, Zea mays
  Clone ID: LIB3279-043-P1-K1-H3
cattttcactcgctgttgctggtggttgttacccttcctctctctctcagccgtcaccctcggagccgcagtcgccgtagcagatcttctctctaatcctatcggtcaacagctgcttgctcgggacgggaaccggaggtggggttgcgatggcgctgcagtacgtggaggcgcagcggcagttgcgcccggacctctccgactggtacgcctccctcgccgacctctaccagcggaagctatggcaccagctcaccctcaagctcgaccaattcttacagctccaggtcgcacagaccggagacactatcattcagctctacaacaatttcattgtcgactttgagaccaagattaatctgctcaaacttgcccattttgcggtgataacttctcgccagtaccctgataaggatgctgcaatta

SEQ ID NO: 7390 - DNA, 290 bp, Zea mays
  Clone ID: LIB3279-043-P1-K1-H4
aaaaaaagccctagccagatcagcgatggcaacgcacccggcgtacccgaccgccgacgctggtgtctgcaggtcgtcgtccggcctgacggctttgtgcctatctgcatcacatgcttttgctgtgatacactctacctcaccgtgttactttttattctaaatagccgattgctttgtcgcggggtcctgatcacaccgtccgattggtattgaacaaggcctatccaacgagcactcctttgctgatgagagggtctggcacatctacgtgggctctggggacagcg

SEQ ID NO: 7391 - DNA, 420 bp, Zea mays
  unsure (1)..(420): unsure at all n locations; Clone ID: LIB3279-043-P1-K1-H5
gacggctggtcgagcggcgccgcccttggctaggtcttcgctgggtccttccccggcgacgagcgtggatctggggtcgactgaactgagcaggcattaggaagagacactatgttgttcttctcctacttcaaggagctggtggggaaggaggtgacagtggagctcaagaatgacttggcgatccgcgggacgctccactcggttgaccagtacctcaacatcaagctcgagaacacccgcgtagtcgaccaggacaagtatccccacatgctttcagtgcggaactgcttcatcaggngctcggtggtgcggtacgtgctgctcccgcaggacggcgtggacatcgacatcctccacgacgccaccaggagggaggcgcgcggaggctgatcctgatgcgcacccgctccctcacct

SEQ ID NO: 7392 - DNA, 375 bp, Zea mays
  Clone ID: LIB3279-043-P1-K1-H6
gcgaacgacgagggagagcagacctagatcagacactatctatccagagacaatactgatacagcatgggagggacggttcacatgtcaaggccagctatgcggcgcgaaggcgcatttcgggctcgtccacgagcaggctactcgtgacctttcctatggacactaccttgccgtgcgtcttgtcaagtacccaaaacaggtgatccttgaggacttcgacaagaatactgcaaacaagtcttgcggcacgggcttgataacgctcgtgaagttaacttaacttatgccctgcaccttgacccattgcagcaattacaacgatgacaacagccgtgggctctactgactctatatctacaactagaaaggcggc

SEQ ID NO: 7393 - DNA, 431 bp, Zea mays
  Clone ID: LIB3279-043-P1-K1-H8
gccaagtgcgatccccgccatggtaagtacatggcctgctgcctcatgtaccgtggtgatgtggtccccaaggatgtgaatgctgctgtggccaccatcaagaccaagcgcaccatccagtttgtggactggtgcccaactggctttaagtgcggcattaactaccagcctccaagtgtggtgcctggtggtgacctggccaaggtgcagcgcgctgtgtgcatgatctccaactccaccagtgttgtggaggtgttctcccgcatcgaccacaagttcgacctcatgtacgccaagcgtgccttcgtgcactggtatgtcggtgagggtatggaggagggcgagttctctgaggcccgtgaggatctggcagcgctcgagaaggactacgaggaggttggtgctgagtttgatgagggtgaggaaagtga

SEQ ID NO: 7394 - DNA, 425 bp, Zea mays
  Clone ID: LIB3279-043-P1-K1-H9
cggacgcgtgggctgagccgctgtaagattgtattcactttatcttgcatcggtcaggagaaactaatgccaatttttgtaaacagtgggaaacttttacagagcttggctgtagcaactagccaagggtccttcttgtctgtggatcagatcatctacaatggaatcggatttacagttgctgcagcttctactgccacgatcactatttatgcaaagaaagcacttcaaaggctccaagcagaggaggaaatattgtgagcgcatgaggtccaagcccaggatcaaaacccataacgctagtttcctttcaggtgtattatacatgaagggcttgtttggcagcaaggggaggggaatctagcccctccaaccccctccatttcccttgctgccagacatgcctgaacaagtgctactaatct

SEQ ID NO: 7395 - DNA, 409 bp, Zea mays
  Clone ID: LIB3279-044-P1-K1-A1
cccacgcgtccgctcggccatggtggtgcgcaggccggcgcacctgttcctggacgagctgggcgtgggctacgacgaggccgaggactacgtggtggtcaagcacgcggcgctgttcacgtccaccgtgatgagccggctcctggcgcggcccaacgtgaagctgttcaacgccgtggcggtggaggacctgatcgtgcggcgggggcgcgtcggcggcgtggtcaccaactgggcgctcgtgtccatgaaccacgacacgcagtcgtgcatggaccccaacgtgatggaggccaaggtggtggtcagctcctgcggccacgacgggcccttcggcgccaccggcgtcaagaggctccaggacatcggcatgatcagcgccgtgcccgggatgaaggcgctcgacatg

SEQ ID NO: 7396 - DNA, 384 bp, Zea mays
  Clone ID: LIB3279-044-P1-K1-A11
agaccggattcaatctcgcagatgatttccgtagcgtccagcccagagctagaaaacagtgcagaagttgtggaggatacggtgacagctatccttaatctctctatccacgagagcaacaagaagatcattggagacgacccactggcagtcccgttcctgatcaaggccttacagtcaggaaccatggaggcccggagcaacgccgccgccgccatcttcagcctatccgcgctggacggcaacaaggcgaggatcggcgagctcggcgcgatgaggccgctggtggagctcctcgagcacggcagcacggcagcgaggaaagacgcggcctcggccatcttcaacctgtgcacgctgcacgagaacaagtcgcgggccacc

SEQ ID NO: 7397 - DNA, 169 bp, Zea mays
  Clone ID: LIB3279-044-P1-K1-A12
ggcgtcaagggaccggtccttttccttggacaccaacttctggtccttggggttctaacccggtcccggcccacagcatcttcttcaactcaccgaaagaggcctgggagttgatgtagatctcggggtacacgccgttgaacttgaccttgacgcggatggtggggcg

SEQ ID NO: 7398 - DNA, 439 bp, Zea mays
  Clone ID: LIB3279-044-P1-K1-A2
caagggcccggcgcggtacagctaccgcatcggcctctcctcccaggctttcaagatggaccagatcaaggctgacatgaagaacggcgtgctcagggtcaccgtcccgaagatcaaggacgaggagcgcaaggacgtcttcgagatcaagatcgagtagggtgtgtgcatcggatgggtcctcccaggtctcctagttgcagtccatatccataccgtagttgcagtccatatccatatcgtagttgccatgagctagtcgtattagtagtttcaattactggagtgcagtagtcgtttctgttgcagagcagtcgtagtactagtagctttctggtggtgctccgtctctgcctgatctgaggcagcgtttacctttctgttggtcttgcaaagttcagttccctggatggcgacgatcactgacgatcttgtgatg

SEQ ID NO: 7399 - DNA, 411 bp, Zea mays
  unsure (1)..(411): unsure at all n locations; Clone ID: LIB3279-044-P1-K1-A3
gaacaaagtacatcaattatcagcattcctacattcatggatgcaagatcagccaatagaaaccaccctcagatattcttctgtgatgaacattgaagttggatgggactcaaaatgaaatcagtataactatcacatgttctttattcgtgttatattagatttgttagttatcatgtgtatgtagtttcgtcgcccttttgtggtgctttctcccctagctcattgttggttcttgtctctttttgtcatgaaaagaacgatgagctctatgattctcatcagctgataaatgtaatgtctgaatttctgtcggtgacaaattaatgatcccattcaaacggtatcaattgttcgacctnanacnnntatccatncattcattctactactactacataaaaataaaat

SEQ ID NO: 7400 - DNA, 450 bp, Zea mays
  Clone ID: LIB3279-044-P1-K1-A4
ggaaattcctctcaacatcaccagaccacgacctccctgccgagctccctccctctccgttggtgatggcatctcagagctccaagaccgcggacaccgccgcgcctccgccggaggttgcagccaccggagaggcggctccgggcgcggcttcttcaacaccggcacaaaaccctaacgctgctgcaaccgcagtggccggggccacggatctagagaagaagatgcgccgcgcggagcggtttgggatgccagtactgatgtcagaggaggaaaagcgcagcagtcgcgccgagagatttgggactggctcttcaagtgtaaaggaggaagagaagaagaagtccagggctgagaggtttggccttgcctcgccctcttcttcagatgaggaagctaagaaaaaggcccgtttggaacgatttggtcagagcgcaaatgtcgacaagg

SEQ ID NO: 7401 - DNA, 367 bp, Zea mays
  Clone ID: LIB3279-044-P1-K1-A5
ccaaaaccctagccctcgcgccgccgccgccgtgcccagcgctcgagctcctcgcctgccgcgagctcgcgccgcaacgccaccatgaagttcaacatcgcgaacccgtctaccgggtgccagaagaagctggaaatcgatgacgaccagaaactacgtgccttttatgaccgaaggatctcccaggaggtcagtggtgatgctctgggtgaggagtttaagggttatgtcttcaagatcatgggtggatgtgacaaacaaggcttcccaatgaagcaaggagttctgacttctggtcgtgtccgccttctgctccacagaggcactccctgctttccgcggttatggcaggcgtaatggtgagcgc

SEQ ID NO: 7402 - DNA, 444 bp, Zea mays
  Clone ID: LIB3279-044-P1-K1-A6
ttccctccctccctctccccgcgggccgccagaggcaatttcgccctcgattcgaccccgattcgtccgcccgcgaccgggattccctccgccaagcgcggatctgaacgctgcgctccgtgtcgtcgctcgaatccgccatgaagggggccaaatccaagggcgccgccaaggccgatgccaagctggcggtgaagagcaagggggcggagaagcccgccaagggcaggaaggggaaggccggcaaggaccccaacaagcctaagagggctcccagcgctttcttcgtgttcatggaggaatttcgcaaggagttcaaggagaagaaccctaagaacaagtctgtcgctgcggtgggaaaagctgctggcgacaggtggaaatccctgagcgagtcggacaaggctccctatgtagccaaggctaacaagctcaagctagagt

SEQ ID NO: 7403 - DNA, 394 bp, Zea mays
  Clone ID: LIB3279-044-P1-K1-A7
cccacgcgtccgcccacgcgtccgaatttaaaaaaaaaaaaaaaaaaaaaaaaggggggcattaaaatacaaaaaagacaaaaaactacataaaacaataaacactcctaaattaatcacttccacattaacaatcataatatctttataaaaattacacccacctctactttaacggcggggccgttttcaatggtgatcccttttaacacccctccttttccccattttaaccttctttttggctcccccaatttacatcccatccccgttttttaatactccccgaccttgaaaacccctctgtcccccacaatttttggtgttcaaagaaaaccccctttttcacagtgttttaaatgctaaaggccccccccttttcccccttcccacc

SEQ ID NO: 7404 - DNA, 437 bp, Zea mays
  Clone ID: LIB3279-044-P1-K1-A8
gcagaagttgcctctccttttcgtcttgtttctcctccaccccggcgacgcgaatggagaagggcagtggaggcagcaatcctccgccgccaccgctccacatggaggacttccaactggaggggaagaagcccgtcaagaacccctttgtgcccatcggcgcactggttactgctggagttctgactgctggtctgatcagtttccgatatgggaactctcagctgggtcagaaactgatgagggcacgtgtagttgctcaaggcgctacagtcgctctgatgattggcagtgcttactactatggcgatcaaatcaagctgttcaagaaagggtcgagcccatgatcttcccatgaataatgctgtttttggtgtatggaggaatgccttgtatacgcataaatttcacctggactctgctgcccctttttaaca

SEQ ID NO: 7405 - DNA, 439 bp, Zea mays
  Clone ID: LIB3279-044-P1-K1-A9
caaagcttcaaagcatctctgctaggattttagcgagcggcaggcaacgacgagcgacccaaaaaagcaatcaatagtcaccatatctgctcctctgcgacttgaggcaggacaggaggcacagacgtgcaatggggttcgtgctggtggtctctctgcccttcatcttcctctccatcctcctcggcttcggctgctacttcctcggcaagcacaggggccgggaggagatgcggaccggcgtcggcgcgcagatctacggcacgccgctgccgccgcccggcgtcgctggagcctcctcgccgccgcctgagccgttccacagcaagaaacaatggtccgaggctgtgtgactaagatttagacgtctctccatccatccattctactactactacatatatgtcttggtggggatgttggatttatattcttaatt

SEQ ID NO: 7406 - DNA, 445 bp, Zea mays
  Clone ID: LIB3279-044-P1-K1-B1
gatgagcaatggatgcaactagtcaatatgtggtctaccccaaagcacaaggaaaaatgtgtgaacaacaaagtgatccgtggaaaagttcggttccagcaaaagacaggatctcggagttacattgcacatatgcatgccgtgaagcaagccaaatatggagatgcaccaccaagtgcgattgatctttttaaagagtgccattgtagtaggaagactggttttgctgagcctgtaaaggaagcaattgacacaatggaagcacttgtggctgagcctggagtagaagggaaagaatctaagacccctacagaagcagttgctcaagtgttgtcttcatcaaaatttctttataatattggtcttgtacctgccacaaagaaaagctgcaatggtggtgatcctacacgcgtggcagaacttgaggctgaacttgaatcagaga

SEQ ID NO: 7407 - DNA, 399 bp, Zea mays
  unsure (1)..(399): unsure at all n locations; Clone ID: LIB3279-044-P1-K1-B10
cggacgcgtgggttctggacgacaagccgttcttcatcggcgagaagacggctgtgcccaacgccaactcaatcaggggcttcgaggtcattgacgccatcaagaccgagctggagcgggagtgcccagatacagtttcctgtgccgacctccttgccatcgctgcccgtgactccgtcgttgtgtctggcgggccgagctgggagattgaggtcggccggaaggacagccgcaccgccagcctgcagggcgccaacaccaacctcccagcaccgacgtctggcgtcgacaccctcgtgcagaagttcaggaacgtgggcctctctaccaaggacatggtcgcactctccggcgcgcacaccatcgggaaagcgcggtgcacttngttcagtgcgcgcc

SEQ ID NO: 7408 - DNA, 385 bp, Zea mays
  Clone ID: LIB3279-044-P1-K1-B12
aaagctgtggccgatgcctactccaaaaggtctctgaagtacttcgaaactgctctccgtgattacaaagctcagctggaagaagatcctattgtccacaggcacctttcctcgctgtatgacactctcttggagcagaacctctgcaggctgattgagccctactcaagggtggagattgctcacatagcagagatgattgagctgccaatgaaccatgttgagaagaagctgtcccagatgatcctcgacaagaaattcgcagggacacttgatcaaggcgctggctgcctcatcatcttcgaggacagcaagactgaggagatcttccctgccacacttgaaacgatcacgaatgttggcaaggttgtggacagcctgtaca

SEQ ID NO: 7409 - DNA, 430 bp, Zea mays
  Clone ID: LIB3279-044-P1-K1-B2
gatgcgcgttggctgcagctagggaatatgttttgtaccccaaagcacagggaagagtgtgggagcaacaaagcggtccgcggaacacttcggttaccagcaaaagacaggaactcggaggtccattggacatatccatgcagggaagcaagtctaatttggtgatgcagcaccgagtgggactgatctttttaaagagtgccgttgtacaaagaggactggcttagctgggcctgtaaaggaagcaattgacacattggaagcactcgctgctgtacctgatgcatacaggggaagaatctattgtcccatacagaagcagttgctgaagtgttgtcttcatcaaaattgtctttattatgtggatccatgtgcctgccacaaagaatggcatggatggtggttatcctacacgcagtggaaaatcttg

SEQ ID NO: 7410 - DNA, 444 bp, Zea mays
  unsure (1)..(444): unsure at all n locations; Clone ID: LIB3279-044-P1-K1-B3
ccgctttccgttccgtccccggccggcgccaacgccaacgccaacgccactccagtaagccgaagcgaggaggtggagacggtcacggtgggcagagtggcacgactctcgattccgcctcgctccagattgctgtgctcgcccactcactcactcacccatggcgctcgccgcctcccaccaccgncttctgcccgtcgcccccgcccccgccgccacccgtaccccgtcgcgggggcacctgcgcttccgcgcctcgcgacctctgccccgaccccgctcccggagaatttgttgtcaatctatcaactcaactaatgttttgggagcttcttcgaagacatctgatgaggcaatcccagtcccagttgtccagatagatcaagactcaaaccgtgatgcaaccattgtgcagctaagttttggagatcgtttgggggcatt

SEQ ID NO: 7411 - DNA, 398 bp, Zea mays
  Clone ID: LIB3279-044-P1-K1-B4
cggacgcgtggggaagaaaaggacccgagcctagggttcggtctgcctcccacagccgccgctacgctttggctgcatcactcgctcctcttcggagcctccctttcgccggcggcgtaggaagagatggcagagcgtttgacccgtatcgccatcgtcagcgaggacaagtgcaagcccaagaagtgccgccaggagtgcaagaagagctgccccgtcgtcaagactgggaagctttgcattgaagtaacttcggcatcaaaactagctttcatttctgaggagctgtgcatcggttgtggtatctgtgtaaagaaatgtccatttgatgccattgaaatcatcaaccttccaaaagacttggaaaaggataccactcaccgatatgggcctaatac

SEQ ID NO: 7412 - DNA, 400 bp, Zea mays
  unsure (1)..(400): unsure at all n locations; Clone ID: LIB3279-044-P1-K1-B5
gaaaccggcatccctggctgtgtgtttgtccacatgagtggcttcattgggggcaacaagacctacgagggagcattggaaatggcgagagctgctctgaaattctgattcaaccaaagcatatttattacccatgttaccattatatcagtaagcacatcaggaacacaagatgcagttgcgctttctccaatgttatcgtggactccagccgtggttaactgggactgattcttgcactgatcttctgttatcctcatcttacagaagaggtcgattgacccttctctttctttcgtgggatctggtattgcctagaatgtgacggtttatttgaaaaatgatggaactttagcatgttctccgttttggagtattcatctgtggcccggcgcannat

SEQ ID NO: 7413 - DNA, 443 bp, Zea mays
  Clone ID: LIB3279-044-P1-K1-B6
cgcagacgctgctcccgctcaccgtgaaacagaccatggacgcggcgcaaaccagcggtgacaggtctaatttcgccatcaacggcgttgaggtgtctacgattaggcttgttggacgcatgctaggtaaggttgagcgtgtcacagatgttgtattcactcttgatgatggtactggcaagatagatgtgaatcgctgggaaaatgaggcttccgatgctaaggagatggctgatgctaataacgagaactatgtcatagtcattggcggtttgaaaggttttcaaggaaagcgccatgtagttgcctatgctgtgcggcgtgtgacaaacttcaatgaaataacctgtcactttctgcactgcattcaggtgcatatggagctcacagggttaaagatctattcttcagctgcaacatatggaggagtagcccatgcccca

SEQ ID NO: 7414 - DNA, 405 bp, Zea mays
  Clone ID: LIB3279-044-P1-K1-B7
cggacgcgggggttgatgcacagtcatctcatgtggatggtgtgatcattatgatcgagtggtattctacaacggctgacaaagaacacacatgtcttacaaacatgaacaggagcttcaaagaaaatagaggctgttatggactgaatgatacgtacagactgactgggatcttatcagaggtgaacggagtcgcagctaatcatgatctcacaggcatacatattaccaccctgcccattgatccacaaatggattcattttacgtgagtgaaaagccatgtgtaccactgtgctgaaacatattggaaactgatggacctattacatcctctacatatgggggatagacaacctagcatgatccttgtggaactgcatctgcgacagtgtaatacgtggatg

SEQ ID NO: 7415 - DNA, 237 bp, Zea mays
  Clone ID: LIB3279-044-P1-K1-B8
ccctcgcgtgattgatcgccgccggctgcagtctgctgcagccgccatgggaagaaggtctacaagatgctatcgccagatcaagaacaagccatacctcaagtccagttactgccgtagtggccctgaccccaagaccaggatctacgaggctgacatgaatagaatggttcgcaggcgagccgagctactgagcgcagcttgcgcgttgggagaaggacaagcgtctccagggag

SEQ ID NO: 7416 - DNA, 434 bp, Zea mays
  Clone ID: LIB3279-044-P1-K1-B9
cacagttgatctcaacaagccccttgttttccaggttggccatcttgaggaacggtaccaggaatgggttcaccaaccgatcgtcagcaaggagggtccacgctttttcggaaatgatgtcctggagttcttgactcgcacgaagtggtgggctgtgccaactatatggctgcctgttgtctgctgcctgctcgtgaaatctattctgatgggtcatactgttcaggacgtagctatgatggctctgtttgggatatttatttggacgctgatcgaatacactttgcaccgcttcctgttccacatcgagaccaagacctactggtggaacaccgcacattaccttcttcacgggtgccaccataagcaccccatggactcgctcaggcttgtgtttcctcctactgcaacagcaattttgtgtttcccgttct

SEQ ID NO: 7417 - DNA, 442 bp, Zea mays
  Clone ID: LIB3279-044-P1-K1-C1
attttcatatatgatagacctgcgaaaagattgcgagccttcagggataacgcgtcatcatactgggagatgatacctttatttcctgaaacatggttatccaagcacaaggaaaaagttccagcagtgattgcgactcgccagctcaaggtgactgcggaatccaagatgggatcgatgcttctacagctgcttgaagttgttccacaccgcccccaccttggccttgcacagcttctttccgctgccggcctccacctcgacagtaaaatgcatggtcctggcatcacgttctgcacatatattatacatgggatgcatcagtggtggctccaacgatatcaactaggtttatgcagagtgacatgtctttcggtcttgctgttgtgctccgtgactgaagcacgcgagctcaatggcctcgaggtcgctctcacaccca

SEQ ID NO: 7418 - DNA, 422 bp, Zea mays
  Clone ID: LIB3279-044-P1-K1-C10
cgacgactactagctctcgcttgctccgacgacgacccctgccggccgcctctggtacaacgtacgagacgaagagagacgatcgatgatggccggcgccaccgtgaccgtggacgaggtgaggaagggccagcgcgcgaccggccccgccaccgtgctggccatcgggacggcgacgcccgccaactgcgtgtaccaggccgactacccggactactacttccggatcaccaagagcgaccacctcaccgacctcaaggagaagttcaagaggatgtgcgacaagtcgatgatccggaagcggtacatgcacctgacggaggagttcctgtcggagaacccgagcatgtgcgcgtacatggcgccgtcgctggacgcgcggcaagacgtggtggtgacggaggtgcctaagctggggaagg

SEQ ID NO: 7419 - DNA, 431 bp, Zea mays
  Clone ID: LIB3279-044-P1-K1-C11
gagcgcgcagccaccagctttggctcccgttccacccttgactggttccgacgtggcggagccgcctttacctcctaccagatcgaacagcagcacagctccgacgcaatcactcgcgagcaggacgcgtgcttgcgctgctcacatcccagccctggcctcactggcaatgctttgcgcctggctttccctggtatgagcttgcagtgcaggccgccctagctccgtcgctcgactgctcgagctggaccgccgatccactcatcggatgttcttctccacccatagcagtagctcatttgttcagtgaatttgcatctacgggcttgtgcggaatgcgtacgacacttctgtgtgagctatcactattcactactgacgtttcagtacatatatgttggattggatgggtaatatattgcctacttctc

SEQ ID NO: 7420 - DNA, 367 bp, Zea mays
  Clone ID: LIB3279-044-P1-K1-C12
cttccatgaagtcgatcgagcatgctattatctcatcaccattgggcattaatccaacacctgatgggaataggattattgcagctatccctccgttgacaaaggagaacatacaggtaaaatttgctgaattaacgctaatttattgtatggaaacaactaacgtattttttggtgcctgagtataggcactgtgcaaggttgttactaaatcagcggaggattttaaacaaagtattagaagagcacgccaaaaggcacttgatacaataaagaagtctgcatctagtatgcccaaggatgacgtaaagaggattgagaaggagattgaagaattgaccaaaaagttcataaagtcgtcagatga

SEQ ID NO: 7421 - DNA, 441 bp, Zea mays
  Clone ID: LIB3279-044-P1-K1-C2
atggcggcgctctccgcgcccctccgcgccgtcgccgccggatcccgcgtcgccgcgtccgaccccgtcaaggtctcgtgcgtgaggagcactggctcagctcacttcggctgcgccttcccctacatcagggcctcctcttcggctgcgaggaacctcgagccgctgagggcgatagccacgcaggcgccccctgccatgccacaatattcgagtggggagaagacaaagattggcatcaacgggtttgggcggattggcaggttggtcctgcgaattgcaaccagcagagatgatattgaagttgtggctgtgaatgaccctttcattgatgctaagtacatggcctatatgttcaagtatgattccactcatggcccgtttaaaggttctattcgtgtcgtggatgattcaaccctcgagatcaatgggaagaaggtc

SEQ ID NO: 7422 - DNA, 437 bp, Zea mays
  Clone ID: LIB3279-044-P1-K1-C4
gggcacggcggagaacgcgagtacccaggctctaataatttgtacaaaaccgatggaaacttctaaatctcctcaatcgtcaaagaacagtcatattgtggtgccttctgatagtaatggcccccgatttgacaatgatggtttttcttcagaagctgcatcaaatcaaatggtcgttttcaactctgaagcaggagataaagagcaagatgaactgggggaaaaccgtttgcagaagtcaatcataacaaggggaatatcgccatctattggagcattcactgtccaatgtgctaaatgttttaaatggaggcttattccaacgaaagagaagtatgaagaaattcgtgaacgtattatagaggaaccttttgtatgcaaaagagctcgtgaatggagacctgatgtaacatgcaatgacccagaagatatatctc

SEQ ID NO: 7423 - DNA, 446 bp, Zea mays
  Clone ID: LIB3279-044-P1-K1-C5
acaccatcttggaagaagggaggggcacaggggacgatctggctctcatggtcgtccacatttcctagttttctctacacaaccaaattcaccttctgctggcacaatctcttcatcttctgctcatatggagggagaaaatgattcaaatcctgccacacctagagctagcgagtcatctccacgagctattcgcattggagaagtgggaaaccaaagtcctgggatgcttacctacgatgctgaacaggatgctgtcgtttcttccggaaatagcactcctgtatcgagtcctaggttttttaacaggagacactccactggacagtcaactccagacagggctgggccatcggatattcagtctttctcagactccctgaagtcccgcttaaatgccgtctctatgaagtacaaagaatctattacaaagagtactcgagggg

SEQ ID NO: 7424 - DNA, 339 bp, Zea mays
  Clone ID: LIB3279-044-P1-K1-C6
gatttaatgtgttattatttttgaaatattttttacttgtagtcatttaatttttaataacgcatatgaatctctaaggttttattacgacaaaaaatactcacacgttacgcgtttcggccgatcttggccgcggtctgcctccctgacttttgttggcgctagccgtgtcgaaccgaaagtcccaagtcccacccaccaaacccaacacatcgtgtctgcgttctccccctttacgccggcgagtgttcgtcgctggctcgctgcagcggggagaatagaggcagagagcacggatgagccaccagcgggtgaaggccgaggcccttcaaatcctgg

SEQ ID NO: 7425 - DNA, 439 bp, Zea mays
  Clone ID: LIB3279-044-P1-K1-C7
aatgaatatgtgctgtacaatcacaatgagggagacagtgcacaaacaaagtatccctcggggagcaccgccacaagtgggcagggtgtagagctggctggcatcaccgtggcggcctcaaacagtccagtgacatcaagcgtatcatccaaccaggcagatcaggaagaaacaatgacaaccccaatcaaggacaaagttgatcctcctggagggctctacgacctcacagaattgcttgatattgatctgtctagctacccagccaagcttcctgcagccaccgatgtaagaaaacaatgatcaagcttgatgagatgggctattggtagggttgttgcgattgggttgggggaaaatcgtgattattatttttttactgttgaagagtgccatagttaacattgtaaaaatgtgtgtattatttgttctgattttt

SEQ ID NO: 7426 - DNA, 443 bp, Zea mays
  Clone ID: LIB3279-044-P1-K1-C8
ctgatgagaatgggccggtgctggcctggctgtgtcgcactcgtaagctccggactacgtaggaaaggggcgggcgtcatgaggatccagtgcgactcgtgcgaggccgtgtcggccacggtggtgtgctgcgccgacaaggcggcgctgtgcgcgcgctgcgacgtggagatccacgccgccaacaagctcgccagcaagcaccagcgggtcccgctcggcgacgccggggcgctccccgccagccttccgcgctgcgacgtgtgccaggagaggccggccttcatcttctgcgtcgaggacagggcgctcctctgccgcgactgcgacgagcccatccacgtccccggcacgctctccggcaaccaccagcgctacctcgccaccggcatccgcgtcggcttcagctccgtctgcggcgccagcgccgagggcctcccgcc

SEQ ID NO: 7427 - DNA, 344 bp, Zea mays
  Clone ID: LIB3279-044-P1-K1-C9
ataattgtcccgggggatgaacatgcaaactatgaacaattcaagcgaggcaggagcacctgatacattagtcgccagcgtatccactggcatggtgaagaaaggggcatgcatacgcaaggcaggtatgcacaggaagaagtaggtgcgcgcgacctcaaggcggggctgatgaatgcggttccacttgtcggacgctacatgctgaaagtcctatacgcgcacggcgtgggcactgtgtcccatgactaccttgaggtcgttctggagctcttcgacaacttattattttggtcacgccaacactctgctatagacagcaaaaaaacgcgcataattctgac

SEQ ID NO: 7428 - DNA, 441 bp, Zea mays
  Clone ID: LIB3279-044-P1-K1-D1
gccacaccaaaccacactgcgacacacagtatgcgaggcgaaggagaggcaaggcggcgcggcgggcaagatgtttgacgatcaagacctgggcttctttgccaatttcctgggcatcttcatctttgtcttggttattgcgtaccacttcgtgatggcagacccgaagtacgaaggaaactgatgtcctctagtgcaaagatcctattatctgcaggccgaaatagggctatactgttagctaatgctagtgagatcgcttgacactttgagtgcatatcatggaagctggacatgcagttcctggcattttggttttgcccatgttttaatctgctgaattagtaaatcctggagaattcaaaagcgttttcaagtactgcagttggtggttgtttctggtcctagtgtatgcatgccagaatcttatgaataatattc

SEQ ID NO: 7429 - DNA, 435 bp, Zea mays
  Clone ID: LIB3279-044-P1-K1-D10
ctggatgataggtgcagagttcacaaggacactattgatctctgccagagtgtcttacagcgcaagtcccttgactggattgctgtgcagcgcaatcatttgtgtcagccaatacgtgatgtggatcttgtggttgctgtcggcggcgatggcacccttctccgggctagccattttttggatgattcagttcctatattgggtgttaattcagatcctacttgtactaaggaggttgaggagctaactgatgaatttgatgcaaggaggagcacagggtatctttgtgcagctactgcaggaaactttgaacagatacttgatgcgacgcttgatggcagtaggcgccctttggagctgtcaaggatatcggtgaaactaaatggaattcagctgccgacttatgctctgaatgatataatggtgtcacaccct

SEQ ID NO: 7430 - DNA, 394 bp, Zea mays
  Clone ID: LIB3279-044-P1-K1-D11
cccacgcgtccgcttcgcttccccacttctccattccattgcggttctgcgagcccctacctccctgtggtgcttggccatggcggactaccacttcgtgtataaggacgtggagggggcgagcacagagtgggacgacatccagcgccgcctcgggaacttgcccccgaagccggagcccttcaagccgccgcccttcgccccgaaggttgacgccgacgagcagcccaagtccaaggaatggcttgacgtgcgcgagcccgaagagctcgaggaactagaggacgatctggatgacgaccgcttcctcgagaagtacaggaagatgaggctcgcagagctgagggaagccgcaaaagccgcgcgatttggtactatacttcccatcactggc

SEQ ID NO: 7431 - DNA, 407 bp, Zea mays
  Clone ID: LIB3279-044-P1-K1-D12
ctggatgataggtgcagagttcacacggacactattgatctctgccatagtgtgggagagcgcaagttcctggactggattgctgtgcaacccattcatttgtgtcagccaatacgtgacaagcatcttgtggtaggtgtcgaaggcgattggtacccttcttcgggctagtcattttttggatgattcatgtcctatattgggtgttaattcagatcctacttgtactaaggaggttgaggagctaactgatgaatttgctgcaaggatgatcacactttatctttgtgcagcttctgcaggaaactttgaacatatactaggagcaacgcttgatggctgatggcaccctttggagcttcctatgatattggtataatctaaatggaattcatatgctgacttct

SEQ ID NO: 7432 - DNA, 443 bp, Zea mays
  Clone ID: LIB3279-044-P1-K1-D2
gttaccgacaagattttctctaatacaacgacaatctctgaatacctcatctctgaagaccttccagatcttcagtggacccgaaggcccctttgatgtggatgtctttgactctagtgtaaattacataaagttaatgaagacaatttttgacttcgaagcaataaaaaagctactgacctccccaaagtttacattctgttatgatgcgctccatggtgttgctggagcttatgccaaacacatctttgtggaagagcttggtgctgatgaaagctcactgttgaattgtgtcccaaaagaggactttggaggtggtcatccggatcctaacctcacctatgcaaaagagttggttgaacggatgggtcttggaaagtcatcctcaaatgttgaacctcctgaatttggtgctgcagctgatggagatgctgaccgcaaca

SEQ ID NO: 7433 - DNA, 428 bp, Zea mays
  Clone ID: LIB3279-044-P1-K1-D3
gaactgtgcaggggcacaccccagatcgaggtgaccttcgaggtggacgccaacggtatcctgaacgtgaaggcggaggacaagggcacgggcaagtcggagaagatcacgatcacgaacgagaaggggcggctgagccaggaggagatcgaccgcatggtgcgggaggcggaggagttcgcggaggaggacaagaaggtgaaggagcggatcgacgcccgcaaccagctggagacgtacgtgtacaacatgaagaacacggtgggcgacaaggacaagctcgcggacaagctggaggcggaggagaaggagaaggtggaggaggccctcaaggaggcgctcgagtggctggacgacaaccagtccgccgagaaggaggactacgaggagaagctcaaggaggtggaggccgtgtgcaaccccatcgt

SEQ ID NO: 7434 - DNA, 443 bp, Zea mays
  Clone ID: LIB3279-044-P1-K1-D4
gggcagtaggctggtaatgggcaagttccaagccccagcagagggtactcacaacctcacctccttttgtttatgcgacgcttggataggctgtgacatcaagaccagcttcaagctcaaggtcctaaagcgcagccgtgctggaacaagaggccatgtgcctgaagaagggtcagcagcagccgtagaagatggtattgaggacgaagaggaggaagatgaagaggagtatgatgactatgagagcgagtacagtgatgacgaggaggatgagaagaacaaggggaaagggcaggggaaggtcgtgaacggatcggcccatcaaggggctgaatctgatatagattcaggcagcgatgagtgattctacactgtattatgttgagaaaatcatagaacttaaccccatctattttttttaatttgaacatatccctattaag

SEQ ID NO: 7435 - DNA, 443 bp, Zea mays
  Clone ID: LIB3279-044-P1-K1-D5
tgactccgcaacctcggctaaggacaggatttttctcagttatggactctcagatgatacctgttgggtgcattcctgaagcatgcacttctgttggtgcagctaaatatgggaggccaattggtttagatgaaagccttaaggtggatttgattgtgattgggtcagtggcagttgatccaagttcaggagcacggttagggaagggagagggatttgcagagctggaatatggaatgcttcgctatatgggagctatagatgattcaaccatgatagtaactactgtgcatgacaagcagttagttgatgacattccagtggagaagctgctagttcatgatgtgccagttgacattatctgcacccctactcaggtcatcttcacgaagactacgatcccaaagccacaagggatttactgggaaaagtatctccagaaa

SEQ ID NO: 7436 - DNA, 443 bp, Zea mays
  Clone ID: LIB3279-044-P1-K1-D6
cattgttgtacttggggcatctggtgaccttgctaagaagaaaactttcccagccctctaccacctctttgagcagggattcatacaatctggagaagtccatatatttggttatgctagatcaaacctttctgatgatgggttaagagaacgcattcgtgggtatctcaaaggagccccagaagatctttcagattttttgcaactaataaaatatgtcagtggttcctatgatactggagaaggatttgagaaactgaacagggcaatatcagagtatgaggtgtcaaagagttcaggaagctatcgcaggctcttttatttggcattgcctccatctgtctacccttcagtgtgcaaaatgatcagaacatattgcatgaatccatcttctcaccttggatggaccagagtcattgttgagaagccctttggaaaggact

SEQ ID NO: 7437 - DNA, 441 bp, Zea mays
  Clone ID: LIB3279-044-P1-K1-D7
attgcaaatgggctgtggtcacacttgcttcaaagggatgcatggcaaagcatggcaaacaggtcgttcaagtgccggccatcggggagagcaacgcggtggacacaactggagcgggcgacctgttcgcgagcgggttcctgtacgggctggtgaaggggttgccgctggaggagtgctgcatggttggggcgtgcagcggcgggtcggtgacgcgggcgctcggcggagaggtgcggccggagaactggcagtggatgtacaagcagatgcacgccaggggcatgctgctccctgagctcaagaactgaactaatcatgctgcagctggtgttagctgcatgctgcaccagctgttgtatctctcagcactcctacctttcccctgctagaatattgaaccactcctgagattgaaccaatcagaatgggtgtattgat

SEQ ID NO: 7438 - DNA, 423 bp, Zea mays
  Clone ID: LIB3279-044-P1-K1-D8
cccttctttcattcgccgccgccgcctgctctctgctgccgtcgccatggggagaaggcctgcgagatgctatcgccagatcaagaacaagccataccccaagtccaggtactgccgtggtgtccctgaccccaagatcaggatctacgatgttggcatgaagagaaagggtgttgatgagttcccctactgtgtgcaccttgtctcttgggagaaggagaatgtctccagtgaggctcttgaggctgcccgtattgcctgcaacaagtacatgaccaagtctgcaggaaaggatgccttccaccttcgggtccgggttcaccccttccatgtccttcgtatcaacaagatgctttcgtgtgctggggctgataggctccagactggaatgaggggtgcctttggcaagccttagggcacctg

SEQ ID NO: 7439 - DNA, 364 bp, Zea mays
  Clone ID: LIB3279-044-P1-K1-D9
gcctcattcatctccattccaaacactcttatattttcactctgccttcgcggcgaggcgatatcgatggagtgagggcgatcacgaagagcaccgcgcgcaagtccacgtggcaggtaaggtcccgaggaagcagctggcaaccaatgcggtgcgcaagtcgtcccctgctgaccggtggcgtgaagaagccgcaccggttccgcccgggcaccgaggcgctgcacgagatcctcaagtaccagaagagcacggagcttctcattcgcaagctgcccttccaacgcctggtccgcgagatcgcgcaggacttcaagaccgacctccgttttcagtccttcgtcgtcgcctgtgctgaaggagg

SEQ ID NO: 7440 - DNA, 431 bp, Zea mays
  Clone ID: LIB3279-044-P1-K1-E1
ccgcggaagccatggcggcttctgctgctacttctcgtcaccgtagccgccttatgctggattcctccggcgatcgctgctgtggcggcggccgcagccgcatcgacgtccaatggagcacggaggtcgctgctcggcttcgtggaggcgcaggggaacgcttcctaccactgcacgccctccggtccctgcgttccctgccagtattctgagaagaacgatgaaaagtatagctgcagcgaaactggctatcgcctgcccttgaaatgtgtacaggcacaaaatgctacaaaagaaggaaacatgagcaagcagaggaagatattggatgatgcatccacatcaggtggcacaaaatccgcatcaggtggtccaaagcattatattacttacagaagttgtgtgccgttggttggagaggagaatttatc

SEQ ID NO: 7441 - DNA, 436 bp, Zea mays
  Clone ID: LIB3279-044-P1-K1-E10
ccaaatcccacttctcgccagttcacctccgcctccgctccgctccgctccgctccgctcctcccctccccctccccctccccctcccgtcacgccatggccaccgcagtacgcgccctcgtcgccgcacgcccggcacggccgctgctgccgtctcggcgcctcccgtcctcctcttccatccgtcccgcgcggcaacgtgctggcgtcgggtgcgtccgctgcatggctcggcggccggattcctcctattccccgctgcgttcgggccagggcggtgaccgtgcgccgactgaaatggcgcctctgttccctggctgcgactacgagcactggctcatcgtcatggacaagcccgggggagagggcgccaccaagcagcaaatgatcgattgttacatccagacccttgcccaggtggtaggggagtgaagag

SEQ ID NO: 7442 - DNA, 291 bp, Zea mays
  Clone ID: LIB3279-044-P1-K1-E11
cccacgcgtgcggaaactgcggcggcggctacggcaacagcgacagcaactggaggaactgagcggtggcgtacgctgaggcctagttattttgatcgcttctgctaccgtgtacaccctagtctagagggggtgtatcttcgtctgtggccgattcgtgtccgcatgtttcgttttgtgttcgctgatgttgttgcccatctgcgatcttgaccgtatgctcgctcctgtgatgttgacagtgatgtatacaatagtccaattccgagcctgcattgtgctccaccgatt

SEQ ID NO: 7443 - DNA, 446 bp, Zea mays
  Clone ID: LIB3279-044-P1-K1-E12
tacatgaagccccaaaaaaaattcatcaatgaagagacgtctacaagcaacgccatgaattttttttggggcttcatgtagttaggctaaaaagtgcagaacacaatttctcagaacacaaatatccctaaaagcttcttcaactgagacccattgaaagtcaagcaccgcccgtacactccaggaaccaaggcaagctcctgcatgaagggctctcccctacaggtcgataactcgtgacagcttctggatgcggttcagcaaaaagtctccttgcttgatggttgcctggtagaaggcgttcctagcatcaggtcggttcgtttccaagacgccagcaactttgtctatcttgcagtggagcttcccagcggcaatgaagcgtgacagttcctggtctataaagtcgactgtaacgccaaatgcagcagccatggctttcattg

SEQ ID NO: 7444 - DNA, 435 bp, Zea mays
  Clone ID: LIB3279-044-P1-K1-E2
ctacattggtgagttcgagtacgtggatgaccacagagctgggaagatcgtggtggagctgaatggaagactgaataaatgtggtgttattagcccacgttttgatgtaggtgttaaggagatcgagggatggacggcgaggcttcttccatctcgccagtttggctacatcgtcctaacaacttctgctggaattatggaccatgaggaggcccgccgtaagaatgttggtggcaaggttctaggtttcttttattgaaaatgtgtttttttgagccacagatgcgtccaagaactcgtctgatgttttgaggtttgttaagactgggtgtccgagcctttgtggtttgttaagacagcgatgtgtcatgtatttcagaaattgggatttttatgagatgtacctgcgagagccctgtctgtttcgattttcag

SEQ ID NO: 7445 - DNA, 446 bp, Zea mays
  Clone ID: LIB3279-044-P1-K1-E3
cccccctgcttttttttggcctctcctctccgttggcgacgcatacatccggcgagggagcggaagaagtcagtaaattctgtcgctccaatccggacgaggagatgccgcggatccctctgatcaagttccccaagcggaatctgaaagccccatccgcgccagtgccgtcgcaacccgcagatcagcacgcgaccctcatgtcccggttgggggctaaagcagaggcaccatcttctggagggattaaaaattaccgctttagttcagatgtgccttccccaccgtcgcatactgctgtaggaggtcaagcttcactccttcctaagcgtaaacctctgactgaagaagagattgaggctattatgctgggtggctccatctgatatcacctcatatgaattggaatttctaggaacatcaataagatcgcatacccggactta

SEQ ID NO: 7446 - DNA, 444 bp, Zea mays
  Clone ID: LIB3279-044-P1-K1-E4
tgttgtggctggtttccagtgggcatcgaaggagggtgcactggctgaagagaacatgcgcgggatttgcttcgaggtctgtgatgtcgttcttcatgctgatgctatccacaggggtggtggccaggtcattccaactgccaggagggtcatttatgcttctcagctcacagccaagccaaggctgctggaaccagtttacctggtggagatccaggccccagaaaatgcactgggtggcatatacggtgttctgaaccagaagagaggacatgtattcgaggagatgcaaaggcctggtaccccgctctacaacatcaaggctttcctccctgtcatcgagtcctttgggttctcaagccagctgagggctgcaacctctggtcaggcgttcccccagtgtgtgtttgactactgggacatgatgggctcggatcctttgga

SEQ ID NO: 7447 - DNA, 450 bp, Zea mays
  Clone ID: LIB3279-044-P1-K1-E5
gccaaaccatcctccccctccgccgcttcgtcgccgcagtacccaccgggcaagatgaagacgatcctggcgtcggagacgatggacatcccggagggcgtcacggtcacggtggccgccaagctggtcacggtggaggggccccgcggcaagctcacccgcaacttcaagcacctcaacctcgacttccagctgcaggaggccggccgcaagctcaaggtggacgcctggttcggcacccgccgcaccatggccgccatccgcaccgccatctcccacgtccagaacctcatcaagggggtcaccaagggctaccgctacaagatgaggttcgtctacgcccacttccccatcaacgcctccatcaccaacagcaacaccgccatcgagatcagaaacttcctcggcgagaagaaggtcaggaaggtggacatgcttgatggcgtgacc

SEQ ID NO: 7448 - DNA, 450 bp, Zea mays
  Clone ID: LIB3279-044-P1-K1-E6
cgtagagagaaggaaaaatatccccaaaccctagctcccgatctcgatggcgaaccctcgcgtcttcttcgacatgaccgtcggcggcgccccggcgggccggatcgtgatggagctgtacgccaacgaggtgcccaagaccgcggagaacttccgcgcgctgtgcacgggcgagaagggcgtgggcaagtccgggaagccgctccactacaagggctccaccttccaccgcgtcatccccgagttcatgtgccagggcggcgacttcacccgcggcaacggcaccggcggcgagtccatctacggcgagaagttccccgacgagaagttcgtgcgcaagcacaccgcccccggtgtgctctccatggccaacgccgggcccaacaccaacggctcccagttcttcatctgcaccgtcgcgaccccttggctcgacggcaagcacgtcgt

SEQ ID NO: 7449 - DNA, 441 bp, Zea mays
  Clone ID: LIB3279-044-P1-K1-E7
ctgacgaaggcgatgatgattcaagtgatgaggatgataccagtgatgatgacgaggaagaaaccccaactcctaaaaagccagaggcaggcaagaagagaggtgctgaaaatgctctgaaaacgcctctttctgataagaaagcaaaggttgccacaccgccagcccagaaaacaggtggcaagaagggtgccacccatgtggcaactccacacccagcaaaaggcaagacccctgcaaacaatgacaaatcaacggagaagtctccaaaatctggtgggtcagtcccttgcaaatcatgcagcaagacattcaatagtgagatggctctgcaggctcactccaaggcgaagcatggggccaaatgagttgcaggtccaactgagtccatgaaggagaagcatggtggccaagtgagtcgcaagtccattcgagtccatg

SEQ ID NO: 7450 - DNA, 446 bp, Zea mays
  Clone ID: LIB3279-044-P1-K1-E8
acgacacctataagcaccaaccctagctcaaaaccccgcttccacttcacagcctctccgcctccgctcctcgcgccgccgccgcgtctcctcctgtacaggtaaggagaggaagagggcgaaatggtgaagcacaacaacgtcatccccaacgggcacttcaagaagcactggcagaactatgtcaagacatggttcaaccagcccgcccgcaagcagaggcgccgcatcgctcgtcaaaagaaggctgtgaagatattcccccgcccgactgctggtcctctacgccccattgttcaatgccagactttaaagtacaacatgaagtcaagggctgggagaggctttacccttgaggagctgaaggctgctggcatcccaaagaagcttgctccaaccattggtatttctggtgatcaccgccgcaagaacaaatcccttgaggg

SEQ ID NO: 7451 - DNA, 438 bp, Zea mays
  Clone ID: LIB3279-044-P1-K1-E9
cccagtgaaggctacatctgatctgttgcttgtgcagtctgatctttacaccttggttgatggctttgtcatccgcaacccatccagagcgaatccagctaacccttcaattgagcttggacctgagttcaagaaggttgccaatttccttggtcggttcaagtccatccccagcatagttgagcttgacagcttgaaggtttctggtgatgtctggtttggctctggaattacactcaagggcaaggtgacaattatcgccaagcctggagtgaagttggagattccagatggagacgtacttgagaacaaggtgcacgtagttcttcgctatgcataaatccttcatgctccatagggaatttgagtgcttcttctttattaagaattaaggtggtagtgctttcagggttaataccaaacctgccgtagagacta

SEQ ID NO: 7452 - DNA, 443 bp, Zea mays
  Clone ID: LIB3279-044-P1-K1-F1
cacgtctcccctcgccccgcgccgaccctaccaaccctcgggcccgcccatggagatctccgcctccgctgcgccggccgcctcctccccgcccgccaggccgctggtcctgcgcccgttcgcctcgtcatcgccccacccggctacgtcctcctcgaccaccatccgccgccgcccatcctcatcggccactgccacggtccgccgccgcgcgcgcacccgtccccgtacagggcggtccaagccccccgccgacgcgggcgactacttctccggcaacgacggccccggtctcggtggttccggcggcggtgacggaggaggacggtggagctggaacagcgggttcggctctggatcagacggccccgacgactgggagccccatgtgccggcgcccccggggtcagcggcggatgcggcgctcggggtcgtctacgagc

SEQ ID NO: 7453 - DNA, 446 bp, Zea mays
  Clone ID: LIB3279-044-P1-K1-F10
ggactcacaaaggaaaggaaaatgtgttgttctgaagacatccaccagacaaaccatattccttcctgtaattgggttagttgaccccgataagctgaagcctggcgatttagttggagttaacaaagacagctacttgatactagatacattgccttcagagtatgactcacgggttaaggcaatggaagtagatgagaaacctactgaggattacaatgacattggcggacttgagaaacagattcaagagcttgtggaagcaatagtgttaccaatgacacacaaggaccgatttcaaaaattgggcattcgtccccccaaaggggttcttttgtatggaccccctgggaccgggaaaacgctcatggctcgtgcatgcgctgcacagactaatgcaacatttctgaaattggctggtccacaacttgtccagatgttcattg

SEQ ID NO: 7454 - DNA, 420 bp, Zea mays
  Clone ID: LIB3279-044-P1-K1-F11
atcgaatgtgattttgtgttggattcatcatttttcatgtgtgcagatttgttcttatgcaaacccattgcacccactatgaagtatatggaaggaggacaccaacgtgatagtggagactgaggagaaagaggctgatggctgggaaccagccacgatggcggacatcaacgggggaagtcgtgggaggcaggtgatggcgacatttgctgtcaaccctagctgtctcgccaagatcgtgccaggattggaggttttctctcctttggagcaccagttatgatataaaatgatagggtttatactaacaatcgacgattttatgcatattcttagtcgttaaccaatcttgtataccatttccaatacttgtacaatgtttttaccaataactgggtaattatatatgataacttgggt

SEQ ID NO: 7455 - DNA, 445 bp, Zea mays
  Clone ID: LIB3279-044-P1-K1-F12
aaagctacgagcactcgccgccactcaccagcaaattcccgagccgccccttccccatctctttcgcgacccatttgatcgattcctgatggcgcccaaggccgagaagaagcccgcggagaagaagccggcggaggagaaggccgagaagaagccaagggcggagaagcgcgtgccgagcaaggagggcggcgagaagaagggaaagaagaaggcgaagaagagcgtcgagacgtacaagatctacatcttcaaggtgctcaagcaggtgcacccggacattggcatctcgtccaaggccatgtccatcatgaactccttcatcaacgacatcttcgagaagctcgccgccgaggccgccaagctcgcccgctacaacaagaagcccaccatcacctcccgggagatccagacctcggtgcgcctcgtcctccccggcgagctc

SEQ ID NO: 7456 - DNA, 443 bp, Zea mays
  Clone ID: LIB3279-044-P1-K1-F2
ccactcttcgcccccttcctctcctctcatccccttcccccctccactctctcgtgtgtggtctcgcccctgaggttcctgatcgcaccatctccctccggcgacagtccgccgccccgccccgcgcgctcgacgaggccgctccgggtggtgaagagggtgctgctgcagtgtctcccctctcgctatgagtagtgctgtgaaggaccagctacagcagatgtcgacgacgtgcgattctctcctgttggagctcaacgtgatttgggatgaggtcggtgagcccgacatggcgagggaccggatgctgctggagctcgagcaggagtgcctcgacgtctacaagagaaaggtcgaccaggccaatcgatgcaaggcccagttgcggcaggccattgcggaggcagaggccgagctcgctggcatatgctcggccatgggcg

SEQ ID NO: 7457 - DNA, 397 bp, Zea mays
  Clone ID: LIB3279-044-P1-K1-F4
cggacgcgtgggcacaaaactggaccgcagatactgcgcgttagttgaggtgcaggactgtggctcccttgtgaccgaggagcagccccacgcgatggtgatgccaatggagtacttcctcatgggatacgggctctacaggccgtatcagctaagcagcagccctcgcagtccactgagcccatgctgtatatcgcctgagctgctgtctcctgagagtatgggtgtgaagctgaagccgataaagacccgggttggtatcagtttgtagcactggcaagcaagccttttgaaccagaatgaaaggcaggctacctgtcttagaatcctcttgcagttgtataacatggcaaatggccattcctgttggagataacctatatatcatgtacatcac

SEQ ID NO: 7458 - DNA, 451 bp, Zea mays
  Clone ID: LIB3279-044-P1-K1-F5
cggacgcatgggtcccacaccaccaccaccttcttcggtccccaacccctgtcgcaccgcagccgccggccatggcctgcctcaccgacctcgtcaacctcaacctctcggacaacaccgagaagatcatcgcggaatacatatggatcggtggatctggcatggatctcaggagcaaagcaaggaccctctccggcccggtgaccgatcccagcaagctgcccaagtggaactacgacggctccagcacgggccaggcccccggcgaggacagcgaggtcatcttgtacccgcaggccatcttcaaggacccattcaggaggggcaacaacatccttgtgatgtgcgattgctacaccccagccggcgagccaatccccaccaacaagaggtacaacgccgccaagatcttcagcagccctgaggtcgccgccgaggagccgtggtatgg

SEQ ID NO: 7459 - DNA, 446 bp, Zea mays
  Clone ID: LIB3279-044-P1-K1-F6
gaagacagagattttcaaagattcctggacaacgtgcaatacaaaacaagtgggatattacgttatgagcgtgtctttggtgaaggttttgtgagcactggtggaatcgagactacaaaggaatttgtgggcatgctcgatcttaaaccgggccagaaagtacttgatgtcggatgtggaattggaggcggcgacttttacatggctgcaaactatgatgtccatgttcttggtattgatctttcggtgaacatggtttcatttgcaattgaacgtgccattggacgcaagtgctctgttgaatttgaagttgctgattgcaccacaaaggattacccagaaaatagttttgacgtcatctacagccgtgacaccatccttcacatacaagacaagcctgctctgttcagaagcttcttcaaatggctaaagcccggtggcaaagt

SEQ ID NO: 7460 - DNA, 441 bp, Zea mays
  Clone ID: LIB3279-044-P1-K1-F7
ttcatttgtgcttacataacatatatcactgtcacacacatgactgttgatggaccttgacacacagactggggaggtggctgggctggcaactcaaacatgattctcaggagcaccagtgctgtcaaggctgtgggtaaggatctatctgaattgaatggcaagctcactggcatgtccttccggcttcccaccgtggatgtgtcagctgtagacctcactgtcagaatcgagaagggggccttctacgaggaaatcaagaaagctattaaggccgcttctgagggcccactcaagggtatcatgggctacgtggaggaggatctggtttccaccgacttcaccggtgacagcaggtcgagcatcttcgacgccaaggccgggattgccctgaacgaccacttcatcaagctcgtctcgtggtacgacaacgagtggggc

SEQ ID NO: 7461 - DNA, 427 bp, Zea mays
  Clone ID: LIB3279-044-P1-K1-F8
ggggacagctgcgcgaccgccgccgccctacgccaggcgcccaggtcttcggcagtaccttcgccggcgacgaactagcacccacaggaaaatggcaagcagagcaggtggcgatggcaaggaagccataaacgagcaggtaatcgccaacacctacgccaacatgcgcaccgaaatgaaccagctctacacaaagatcacggagctggagatggaggtcagcgagcactccctcgtgatgggcgcgatcgagccgctggacccctcgaggcgatgctacaggatgatcggcggcgtcctagtggagaggaccatcagggaggtcatgcctgccgtgaagcgcaacaaggagggcctggaagaggtgattgcccgcatgcacgaggcgctggagaggaagaagaaggagataaccgagtttgagctc

SEQ ID NO: 7462 - DNA, 432 bp, Zea mays
  unsure (1)..(432): unsure at all n locations; Clone ID: LIB3279-044-P1-K1-F9
cggacgcgtgggcggacgcgtgggcgcaacgcggagctcaaggtggtggacccggacacgggcctctccctcggccgcaacctccccggcgagatctgcatccggggcccgcagatcatgaaagggtacctgaacgacccggaggccaccgcgaggacgatcgacgtccacggctggctccacaccggcgacatcggctacgtcgacgacgacgacgaggtcttcatcgtcgaccgcgtcaaggagctcatcaagttcaagggcttccaggttccgccggccgagctcgaggctctgctcgtcgcccacccgtccatcgccgacgcggccgtcgtcccgcaaaaggacgaagccgccgncgaggtccccgtcgcctttcgggttcgcgccgccgacgccgacatcgcggaggacgccatcaaggatttcatc

SEQ ID NO: 7463 - DNA, 437 bp, Zea mays
  Clone ID: LIB3279-044-P1-K1-G1
cccacgcgtccgcccacgcgtccgcgacggcgtcatcgtcaacacggtagccgagctggagccgtccatcctcgcggccatcgccgaccgcctctgcgtgtcaagacgccgcgctccggccgtctacccgatcggcccggtcctgcctctcaagccgccgtccgcgcccggcgacggcgagcaggtagtagcacagcggcacgagtgcgtgaggtggctcgacgcgcagcccccagcgtccgtcgtgctgctctgctttgggagcatgggcggcagcttcccgtcgccccaggtccgcgagatcgccgacggcctcgagcgcagcgggcaccgcttcctgtgggtgctccgtggcccgccaccgccggacggttccaagtacccgacggacgccaacgtccacgagctgctcccggaagggttcctggagaggacga

SEQ ID NO: 7464 - DNA, 448 bp, Zea mays
  Clone ID: LIB3279-044-P1-K1-G10
cccacgcgtccgatcaagaggtcacctttgcaatttgaggcatttcaaaaatgtgctaaagaatgtgatctagacactaagaaagtcctttccttagatgttgctacaagatggaattctacatatattatggttagagatgctatttactataaggatgcttttgatcgtcttgctaaaaaagataaggatagatttggtcatattgctccttcaagtgatgattggttgaatgcaataaatatcaacaagtgtttgaaaaagttctatgatgtcacattacttttttctggcacttcatatcccactgcaaatcatttctttcgcaagttttctgagattaagatggctattgcaagatggtgtgagagcagtgatgtcataatttgtacaatggcattctctatgaaagagaagttcaataaatattgggacatgaacaatatgg

SEQ ID NO: 7465 - DNA, 447 bp, Zea mays
  Clone ID: LIB3279-044-P1-K1-G11
caaccatctccaacgcagcaagcagacagaaggacaggcaggcagcgagtgcaaccgcgagagcgatcagcgatgggctccttcttctcgaccttagtgacgccccctccggccgccgacgacccgaactgcgccgtggtggccgcgcactccaaggccacctacgacgagcagtgggcggcccacaagagcagcagcaagctgatggtgatcgacttctcggcgtcctggtgcgggccctgccgcttcatcgagccggccttcaaggagctggcctcccgcttcaccgatgccatcttcatcaaggtcgacgtcgacgagctcgcggaggtcgcaaggacatggaaggtagaggcgatgccaacgttcgtgctggtcaaggatgggaaggaggtaggccgtgtgattggggctaagaaggacgagcttgagaggaagatcaggatg

SEQ ID NO: 7466 - DNA, 447 bp, Zea mays
  Clone ID: LIB3279-044-P1-K1-G12
ctgctatctatctcttttctgaaggaaaaaaaagttcagcgcgcagttaagcatagcaggacgaccacgacgatgtatcacccgcagtgcgagctcctgacgatggcgcacgaaacgccggacctggacgccggccagccgcacctaaccgtctccggcgtcgccagcatcccggcagagctgagcttccacctgctgcactcgctcgacgccgcggcggcggtcaatccctgcacggcgccgccgcagtccaccatcgactacttcctcggcggcgccgatccccaccagcaggccatgcagtacgagccgctgccgcccgccgcgggcggccaccaccagtacaccatggacatgttccgcgactactgcgacggccactaccccaccgccgagccgtacatccgcgggacaatgactggagccctcgtgttcggggccaccgac

SEQ ID NO: 7467 - DNA, 434 bp, Zea mays
  Clone ID: LIB3279-044-P1-K1-G2
cggcacgttcatcgactgccccgcgcagaagtagagcacctgctccaaggagatcctggagcaccccttgaagaagtggatgctcaagcagcagctcaaccaggacgacgaccctttccagctgcctggcgtcgccatggacaactgatacaccgtaccgtcgtctctgtttgcgtttctgtcaagtgtgcatggaataatactgtaactgagtttcctgccgggcaatgcactgtgatatgatgcccaacgaataaatgtcgcttttatttttattaacaaagaaaagaacatacagaagaaggacaactgactcgcgcgcaagaagaacaacttactgtggaagcaaaaagggccgccaccatcagagcggcccaagtacccgacggacgccaacgtccacgagctgcttcaggaagggttcctggaggggg

SEQ ID NO: 7468 - DNA, 431 bp, Zea mays
  Clone ID: LIB3279-044-P1-K1-G3
cgaggagcaccagttcgagtccaaggccgacgccggcgcctccaagacctacccgcagcaggccggcaccatccgcaagaacggctacatcgtcatcaagggacgtccctgcaaggttgttgaggtctccacttccaagactgggaagcatggccatgccaagtgccactttgttggcattgacgttttcactggaaagaagcttgaggatattgttccttcttctcacaactgtgatgttccccatgttgatcgcactgagtatcagctgattgacatcactgaagatggatttgtgagccttttgactgacagtggcaacactaaggatgacctcaggcttccgactgatgaagctctggaaggccagatcaagagcggatatgatgatggaaaggacctcctcctgacggtgatgtcttccatgggcg

SEQ ID NO: 7469 - DNA, 446 bp, Zea mays
  Clone ID: LIB3279-044-P1-K1-G4
cctccgacgagttgccccaatccgcccagacctccaacatcgcaacggagcccaccctgcctgcctcgccgcgatccctccgcgctgctcgaggctcctgtcctgaaccaatcgagaacgccgacttccggggacgggatcatctaaagccgcctccttcccgttgaatccgccgagattcggcgtgaggcgaggttaccgacttcccttgcgcgtagggccggcaggagcgcccgctggccatggcgtgccggggcttctttgagtgcgtcctcaagctcctcaacctcgtcgtcatggcggttgggctggccatggtgggctacggcgccttcctgctcgtgacctggcttcaggtcgcgccgctcccgccgccttcgtcgtcgccggacgccgtgccacccagcggggagctcgtgcggctcgggaggccgctgctgcttttt

SEQ ID NO: 7470 - DNA, 434 bp, Zea mays
  Clone ID: LIB3279-044-P1-K1-G5
aagagccaaccatgttcgagggtaccgtgaggagcaacctcgaccctcttggggagtacactgacagtcaaatctgggaggccttggattgctgtcagttgggtgaggaggtgaggaggaaggagcacaagcttgactcaccagtgatagagaacggcgagaactggagcgtgggtcagcgtcagctcgtatgcctcggcagggtgatcctgaagcggagcaagatcctagtcctggacgaagccaccgcttcggtggacacggcgacggacaacctgatccagaagacgcttcggcagcagttctcggaggcgacggtcatcaccatcgcacacaggatcacgtccgtcctcgacagcgacatggtcctgctcctcgacaacggtgtggccgtggagcgcgacgcgccggccaggctgctggaggacaagtcg

SEQ ID NO: 7471 - DNA, 424 bp, Zea mays
  unsure (1)..(424): unsure at all n locations; Clone ID: LIB3279-044-P1-K1-G6
tctagaggagagtctcgagagcaagggagcgcggtgacgtcagcgttttccagggtttctcgatcggctgctatggcgaccagggtagcgtcgagattcctgcagcgcaggctcctgtcttccggcggcaaggtcctcagcgaggaggagaaggccgcggagaaagtgtacatcaagaaaatggaacaagagaagctggagaagctcgcacgcaagggccccagctcaggagagcaagcttcgtcgactacagtctctgcagcaagtgatgtgaaggctggggctgggccaacggagtcagcgtctgcaaacgtgtcaaccgacaagaacaggaactacgctgtcctggcaggcacaattgctgctctgagtggcctgngttggtatctattgtcaaagcctaagaagtcggaggaggtgtgga

SEQ ID NO: 7472 - DNA, 442 bp, Zea mays
  Clone ID: LIB3279-044-P1-K1-G7
ggctgggttgtgtccactcatgccagaagaggttggacttctacttcaagcattaggttacccaccaactacaataatattcttggctggttccgagacttttggtggacaaagaatgcttattcctctacgagctatgtttgctaacctagtcgatcgaacttcattatgtagtcagagggagctgtttgatttagttgggtcagaagatcctctaacctcagatttgccacagcctccacctcccaaaagtgaaaaacaactcattgaagaatggaagagagcagggcctcgtccaagaccgctgcctccacctcctgcaaggccattctatgcacatgagaaggaaggctggtatggttggattggtgagaatgacacagaaccgggggcttcactgattgagttcaggaggcaagcacatcgggtgctctgggatgca

SEQ ID NO: 7473 - DNA, 381 bp, Zea mays
  Clone ID: LIB3279-044-P1-K1-G8
gacgcgacgacccagcccagccccgcgccgcgatggccatgaccgtgatccgcctcgccgccatccgcccgccgtcggcctcttcctccgccgcgtccccgtcgctgtggccgcccgcgcggatgcgccttcgcgtgaggtgccgcgccggcggggacggagggaagaagaaggaggaaggggaggccgaggcgcccgagtcgctcttcgccagggagctccggcggcgtgggatggcgccgggggccgccgcgcccacgggcgctagcaaggaggccgaggagggggcgccggaggccggggccaagcgcggggtggcggccaccgagttcgagcgcggcgccgcggcggacggccagcgggagcgctccatggcgctca

SEQ ID NO: 7474 - DNA, 450 bp, Zea mays
  Clone ID: LIB3279-044-P1-K1-G9
gcctgatggagcaatccatgttatacgtaaccttggtgctgtgtagtagcgatgatattgttccaggtgatggagatatcaaggaataacaagagcctacctgctgtgaagtcaatgtactactaggatggatagggcgcttcgatgcgccctttctgtcttcgaattgctgtgctgtgcacggagaataaacatatactattatatatatacatacaatttgctaagataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggccctttttaaaggatcaaattttattcccgggtgtttgggaggtaatagtttttttttggggcccccaaaaataaa

SEQ ID NO: 7475 - DNA, 273 bp, Zea mays
  Clone ID: LIB3279-044-P1-K1-H1
gagacacccaccgcactgtcgcatctcaaggaagatcacgacagcatcagaggggtgaaaggcaaaggccaacctccggattgtagcgactacaagtcgatgccgattacacaatgcgtgataagctaaacgctgcgcgtggccaacctgatcagagtggtgttcaatcgtgcgaacaccgacattcactttaaaggattcgtgatcctaaagggctgaaagatcttttcgtcaatttctagcctctcactttagtctggtccactataagaa

SEQ ID NO: 7476 - DNA, 375 bp, Zea mays
  Clone ID: LIB3279-044-P1-K1-H10
ggaaaccccgcggcgacccacgcgtccgggatgactgtgttcactatgctaagatgacttaagaaatcggagagcaagtgcggatgtttgtttatgaccttctcgtacaccaaccccactaggttatttaaggctatcaaggaaaaatcatgcaatgcccttatgcatcaaggttaaccaaattcgcatctattgactgatagttttgacgctattaatatttcaacattctaccatttgttgttttaattactatttatattaaatgtttattctgagatcactatcatttctgatcttgcatttttttttaccatcatatcacatattatatctgttttattatttatataaattctttttagacataattca

SEQ ID NO: 7477 - DNA, 412 bp, Zea mays
  Clone ID: LIB3279-044-P1-K1-H4
gcgtacaaaaacaataaaaggacaactttcttatggttttattgatcacaagcctattcaagagctcgtgtttatcctaccatataagatccttataccgtatataaaatcaatgtatgcgtaacatgagattcttaatttttacaaggaggccaaaatctatgtacttcgttactcttatcttaaattcaaatttaaaatggagatttgtattatatataaattattactataatcataatttaaattaaaagattatgtaaaatagaaatttaaaatgctaaaataatgtactttcatatatttatatttataataatatcttaaaaatagaacttattaatctatacttgttacatctaactatttctaattgtatattttattacataattataataattacatatta

SEQ ID NO: 7478 - DNA, 164 bp, Zea mays
  Clone ID: LIB3279-044-P1-K1-H7
gacccacgcgtccttcaaatcggaggcccttgctctcccaattctttcgcgacccctctccgcattcgggagcatgtttaagccgacggcgtcgcacacaccagcgcacactccgaaaacgccgtcgacgcaacagactcccaaccaaggtggactaaaacaca

SEQ ID NO: 7479 - DNA, 244 bp, Zea mays
  Clone ID: LIB3279-044-P1-K1-H8
cccacgcgtacggccataaccaaccgatttttacagtccagtatggtggtggcgcggggtttattccgggtctacggtagcaccatgccgaggccgtgcttcttcctgggcgaccgcgtggacccaccggcgtccgacaccgacccgatgctagagtgggcgcgcaaatcacactggtccatgggcgataatatagagaagtgccttcgtttgcaggtccatatcaagggtttcgttaacaagt

SEQ ID NO: 7480 - DNA, 310 bp, Zea mays
  unsure (1)..(310): unsure at all n locations; Clone ID: LIB3279-045-P1-K1-A1
ctctctctctctttctcgcgctcgctttgcttcctcgtcgaggtccaagttcctgcattgatggcgaccgaggtggctgagactcccgcgccgttggcggaggcggtccccgagacccccgcggaggcaccggcggcgcccgccgccgaggcgaagcctgccaaggccaagaaggcctctgcgcccaagaagcgtgccaacccgacccacccggcgtacgccgagatgatctcggaagctgtcacgtcgctcaaagagcggacggngtccaaccagtacgcgatcgccaagttcgtcgaggaccagcaca

SEQ ID NO: 7481 - DNA, 435 bp, Zea mays
  Clone ID: LIB3279-045-P1-K1-A10
gccctcgaccccgccgccgtcgccgcgccctccggcgagagcgacgcggccaggtgcccgcactcgatcgcgctcaccgcggaggagctcggcgcgcggggccgcgtggtggagctgccctgcgggctcgcgctggggtcccacatcacggtcgccgcgacgccccgggcgccgcacgaggagcggaaccccgcgatcgcggtgctcagggacggggagcggcacgccatggtgtctcagttcatggtggagctgcaggggctcagggcggtcgacggcgaggacccgccccgcgtgctccacttcaacccgagcctccgtggggactggagcggccacccggtgatcgagcaaaacacctgctaccgcatgagctggggcgccgcgcagcgcttcgatgggtggaggtcacgcccggatgaggagactgtggat

SEQ ID NO: 7482 - DNA, 441 bp, Zea mays
  Clone ID: LIB3279-045-P1-K1-A11
cgacgctccatcgagtgtgtgcggcggcgggaggagacggaagagaacgatgcaggcggtggcacgggcgcgtgggcttgcggctgcggctgtggctgcgcggccgtcggcgatggaggcagggcaccgcgggcaggtgcagcaagcccggggcattgtggtgcaggtgagggacgggaacctggagcgggcgctggcggtcatggagcgcaagatgaggtccagcggcatggagcgccttatccgagcgcgcacccactaccacgtgaaagactcggagaagcgcgtgctcgcgcgtaaggcgcttatgcagcgcgtccggtcccaggagctcggcaagaagctccgcgagatcctcatcaagaaaatcaggggccagtgaggacatcagcgcattggccatttacgggcagcatctgtgtgggtgctccctttttgagc

SEQ ID NO: 7483 - DNA, 450 bp, Zea mays
  Clone ID: LIB3279-045-P1-K1-A12
ggccaatgtccagaggcttaagacatacaaggccaagctggttatcttcccaaggcgtgctcgcaaggtcaaggctggtgactctactctggaggagcttaccactgctacccaggtacagggtgactacatgccaattactcgcggtgagaagcgctctgtagaggttgtgaaggtcacagatgagatgaaggcgtttgcggcctatggcaagctccgccttgagcggatgaacaagaagcacctcggtgcccgccagaagaaggcagctgaagcagagaaggaagacaagaagtgaagcagccaaactttgtagcctgttttgttctgttcagtcatagcgagatgctacttccatcaagtgcttgttccaagttttttttgggtgctggaaatagagaccagtcaaatattttggtgtcctactgtttgataccttgtattttgttg

SEQ ID NO: 7484 - DNA, 417 bp, Zea mays
  unsure (1)..(417): unsure at all n locations; Clone ID: LIB3279-045-P1-K1-A2
ctgttgtgatgattggtatggatggtaaatcaaggtgctttggtttcatcaattttgagaatccagatgcagcttcccgtgctgttcaggaacttaatggtaagaagataaatgacaaagagtggtatgttggaagagctcagaagaagtcagaaagagagatggatctaaaaaggagatttgagcaaagcttgaaagatgctgctgacaaatatcaaggactgaacttatacctcaagaacttggatgatagcattggagatgatcaactntgtgaattgttctctaactttggcaaaattacttcgtacaaggtgatgcgtgaccaaaatggtcttagcaaaggctctggatttgttgctttctcaactcgtgaggaagcatctcangctttaactgaaatgaatggcaaaatga

SEQ ID NO: 7485 - DNA, 319 bp, Zea mays
  Clone ID: LIB3279-045-P1-K1-A3
cccacgcgtccgaaagagtgatgaaagcatgcaaagagagttgtgtttcttccccggaagtgcttccgagaataaatttttcttatctgattgtctaaaacctataacgggtgtatcgtagtggttgttatcgttaaacttttaacggtcattctatttcaaaaaaaaaaaaaaagaagaatacacacaaaacgagaaacaaaccaaaaacaaaaataaacaaacaaataaaacggcgcggccgctttagaggaacacaagggggcggccgcttctatgcatccaattttccctcccctggcgtgcccaatattaattt

SEQ ID NO: 7486 - DNA, 260 bp, Zea mays
  Clone ID: LIB3279-045-P1-K1-A4
gcgcagcctccgacgccgcatggagatcgtgcgctcccaccggcaggttgccgccgcagccgccggtggcggcgcgggggccctgccgacctacaaagcggcgccgcagctcgaggtgcggctggaggagttcgagctcttcgccatcgaccgcctccgagttctcaaggggatttcggatggactctcacgggggaagaggccggaggaggtggagaaactggtcaatgaattgtggaagacacacatggggcaccagg

SEQ ID NO: 7487 - DNA, 411 bp, Zea mays
  Clone ID: LIB3279-045-P1-K1-A5
ctcgctgtttctaacccagccgccaccatgtcaggcctctacaaccagggcttctcccctgcgagaaccctctacgtgcagattaggagcaaccccgacgctgatagccagtacttggccgagcttctcgccgagcaccacaagttggggccattcatgcaggtgctgacgatatgcagacggctgctcaaccaagaaatcatgcgggtgtcaagcatgggtcatgaccatggatttagtgatcttgaccgacgccggtttagaagtactagccctatgtcttcaccgattgtccggcctaatctacatggaaatggttttggcccttggaatgggatgcaccaagagagattgggctttcctcctactggaacaagtatggactggccaggagcaccaccgagccctggc

SEQ ID NO: 7488 - DNA, 447 bp, Zea mays
  Clone ID: LIB3279-045-P1-K1-A6
cccacgcgtccgaagaactggccaccattcttccccatcatccaccatgatattgccaatgagataccagcaaatgtgcagaagttgcagtatcttgcatttgcaagctggcttggaattgtgctttgtttgtcctggaacttcgttgctgtcatagtctgctggatcaaggagggagattcaaagttgtttttccttgcaacaatctatgctttgcttggaattcctctgtcatatttgatatggtacaggccactctaccgtgcaatgaggactaacagtgctttcagttttggatggtttttcctgtgttacctgatccacattggtttttgcataattgctgccattgctccaccaattgtatttcatgggaaatcattaactggtattctggctgcgattgacactttctctgaacatgtgataattgggatcttttacttt

SEQ ID NO: 7489 - DNA, 344 bp, Zea mays
  Clone ID: LIB3279-045-P1-K1-A7
caagcgaccaccccccacccccatccacccacccacccgcccgccgacgcttggatcccctcccttgctttgccgtgtccccgcccaaaccccgtagccgccgccacagcaatcgctgccgccgctggaggccgggccgtgggggctgaaatgaaggaggtggtgctccacgtgtatgacgtgaccaacagtgactccgagaagacgaacaacaccatcctccagatcaaccgcatcttcaaggaccgcatcggcctcggcggcatcttccacagcgccgtgcaggtctatggcgaggacgagtggtcgttcgggttctgcgagtccggcagcggcgtgtttag

SEQ ID NO: 7490 - DNA, 445 bp, Zea mays
  unsure (1)..(445): unsure at all n locations; Clone ID: LIB3279-045-P1-K1-A8
atcgttccctcctcctctcttttccccaccgccccctttcttggcgtctacccggcgcgaccaggaccgaatcctaaggccgccggccgccggccgccggccgccgccgccacctgctcccgttggacacgagtttggagtaaagaaaccaaccctgcatctgtattctgtctgtctgtgctttggattccagaacaaaattcgaataagccttgcatctcgctgacttgggatataactatgccgaaggacaggagctcccgcgtttcctcttacgagagccgccgggctggtgcctccccatacttctcatcgtcgcatggacagagcagttcttctcgccggtcagaggagtcttgtgtggcagcagcggcggcagcagcaaagcaagctgcagagtgggaggatgttcngtgcccggtgtgcatggaccacccgcacaacg

SEQ ID NO: 7491 - DNA, 411 bp, Zea mays
  Clone ID: LIB3279-045-P1-K1-A9
ctcaagctcaacccctacctcggcactgcccggaagatggccacccttgctgaggctgcccgagtcaaggcccggaaggagaagcttgattccaagaggaccaagcttacctcggagactgccaaggtcaaggctgccggcaaggcgtggtacaagaccatggtctcggacagtgactacaccgagtttgagaacttcaccaagtggctcggagtgacgcagtgaagcggcctttgaggcctagttaagttttgagtagttgtgtcgctgaacttgtattgagacgaaatagtatttttatcaatctgtcttatcctgcgtcttcacaacaagttgcctatctgtggactttaagcctgcatgttcgttttatttctccattgccgtgggagcatagtatttgcatgttcg

SEQ ID NO: 7492 - DNA, 281 bp, Zea mays
  Clone ID: LIB3279-045-P1-K1-B1
cggacgcgtgggtggaggatgggcagcacctaacatatactttttggggtttgctggtgttgttaagtttggaaacatacggattggtggattgtcaggaatacataacaaacaccattatcatttaggacactatgagaggcctccatacaataaagatactatacggtctgtgtaccatgtaaggcattatgatgttctcaagctcatgcatttgaaggagccactagatgtattcttgtcacatgattggcctctgggcattaccgagtatggaaact

SEQ ID NO: 7493 - DNA, 396 bp, Zea mays
  Clone ID: LIB3279-045-P1-K1-B10
caacaacattcccacgccactcccagagctcctaacccggaaccacgaaggggatccatggcggctgagggttggctacgacctgcggcggaggtataactgccccgcctgctcttccggacttcccctcataccgcctgctacttccgggcctgtcaccgacgcgcaaacgctcagtggtccccggaactaggcgccggcggcgggccagccatggagctcatgggcgtccctaagaagaaagtctccaagtacaagaaaggcttgaggaagggacccaaagctttgaagcctgtgccagcgattgttcggtgcatgtgctgctgtcgaatgaagctaccacactcatatagctgcagtggagaaagaggaaactcaagcgagtcgaactcataa

SEQ ID NO: 7494 - DNA, 285 bp, Zea mays
  Clone ID: LIB3279-045-P1-K1-B11
cggacgcgtggccggacgcgtgggaaatactagcgtcatgaactgcctttagctaacattttccataagttgttctcgagcagctatgtgttgcatgtgggctacttccaaacttatatctggttcggtttggattgtgatgaactaatggctctttgaatttatattatgacgttgacgatatttggcgacatctgggttcttggtagtcatctgcctttatcctttggatcgagggttaatccagagagcacttcgtctgagatcggtttacgccatgctgcc

SEQ ID NO: 7495 - DNA, 449 bp, Zea mays
  Clone ID: LIB3279-045-P1-K1-B12
cgcctccatgcctgtggcgcccgacacctacacctacaacaccgtgttgaagggcttgtgctgtgctaagcagtgggagcaggccgaggaactcatgcgggagatgatccggaacagttgccatccgaatgaggtgaccttcgccacacagatccgtgctttctgccaaaatgggttgcttgaccgagctgtggagcttcttgagcaaatgccaaagtatgggtgcacgcctgatgttatcatatacagtacgctggttaatggattctcagagcatgggcgtgtagatgaggcactcaagctattgaacaccatgttatgcaggcctaatacggtttgttataatgctgcattgaagggtttatgtattgctgggcgatgggaggaagttggagagctcatagctgaaatggttaggaaagattgcccgccaaatgatgcaacattta

SEQ ID NO: 7496 - DNA, 399 bp, Zea mays
  Clone ID: LIB3279-045-P1-K1-B2
cggacgcgtgggcggacgcgtgggcgcgccgacgacgccgtgcccagcgctcgagctcgtcgcctgccgcgagctcgcgccgcaacgccaccatgaagttcaacatcgcgaacccgtctaccgggtgccagaagaagctggaaatcgatgacgaccagaaacctcgtgccttttatgaccgaaggatctcccaagaagtcagtggtgatgctcttggtgaggaggttaagggttatgtcttcaagatcatgggtggatgtgacaaacaaggctttccaatgaagcaaggagttctgacttctggtcgagtccgccttctgctccacagaggcactccctgcttccgcggttatggcaggcgtaatgctgagcgcacgaagaagtctgtccgtggttgta

SEQ ID NO: 7497 - DNA, 455 bp, Zea mays
  Clone ID: LIB3279-045-P1-K1-B3
ggccgcgcctgcgacacccatccgccgccacgccatggccaagtacaacgtggtgcagaagaacaagcgccagtgcaatcaggaccgcaagcgcgccgcgcatggggagcccgggaccggcaagctcaagcagcggaccgcgcccgtctccatgtccggcaagcggaagaagaagctcgagcgccgcctcaaccggaagcagaaagaggctgcgatgattaaggcgctggagaacaacatgggggatgtcgacatgatctcagttgaagggtcttcagaagctgcaaagggcaagtcccaagtgaagttcagtgtgaagaaaaactcaagaatacagataaagagattaaagggcaaaggcaggaagaaagccaaaaattcaaaaccacctgccaaggagagagttgatgccatggtagaatgacagttgatgccatggtaccatgacggacaag

SEQ ID NO: 7498 - DNA, 408 bp, Zea mays
  Clone ID: LIB3279-045-P1-K1-B4
gtggcatggcacaggttttgaacacggctccagtagcaccagcaaatctccctatgccaaatccagcaccggcaatttcatctgtggcgccttcagaacaatctgcacccagcaaggaggatgttgaattagcaatggctatcaatgcctccattcaatcagctattgcagagggagtatcagtgcccaatgttcaaccaaatgcatccacccccaacaacaatggctgggctgcccctccaagtaattctcacaacggatggggaccaccagccactcctgcaccatcaaagacgagcggtcagtcccaggtccgggtagacgccccaagcagcagcacttacaatggatgggatgtgcccggaacaagctctagtcaaagttcatcgaaaccccaccaaacccaaa

SEQ ID NO: 7499 - DNA, 421 bp, Zea mays
  Clone ID: LIB3279-045-P1-K1-B5
gcgaaggcgaccctccctccttcgctccttccgcgccgcctcccggccgtcgccgccatggtgaagtactcgcaggagccgggcaaccctaccaagtcggctaaggccatgggcagggatctgagggtccacttcaagaacacaagggagacagcctttgcgcttcgcaagttgtctttgaccaaggctaagcgataccttgaggatgttattgctcacaagcaggcaattcccttccggagatactgtgggggtgttggtcgcaccgcgcaagctaagtcgcgccactccaatgggcagggccgctggcccgttaaatcagccaggttcatcctggatttgctgaagaatgctgagagtaacgctgatgtgaaaggctaggatgtggacaacctctatgtttcacacatccaggtgaatc

SEQ ID NO: 7500 - DNA, 433 bp, Zea mays
  Clone ID: LIB3279-045-P1-K1-B6
gcggtggaatagttcagacttggtctccgatgatgcacaatcaccaaagccacaaaggtcaaggagcacgcagcataggggtttccacagaaaatcctttagccgttcaatgtcatgtgactcccaatctaagacgtctgtttcatcttcctcgagagctcacacgaaagttgacctgagcaagttagaactgactgcactgttgagatattggcgccacttcaatctcgatgcatgccctaatccatccagggagcagttagttgatgctgttcaaaggcacttcacggcccagcaattggatgagttgcaggtcattgtcagctttgtgcacgctgcatagaggctgaagacaactatgaaagtggcctgacagtgaagcatgaagttcaactaacagattcaagataggatgcaacatgtttgatgaatg

SEQ ID NO: 7501 - DNA, 382 bp, Zea mays
  Clone ID: LIB3279-045-P1-K1-B7
cttccgtcgtgcgcttcgtctgcacccacaaaggcgacggcgacggcagggggaggagatgaagctgaagcagctggagggcctcttgggtggcctgacccagttctccgaccccaagctggagctggagcagtatgcgacgggccctcacatcgcgtcgcggatgctctacatggcagagaatagtttcaatgacataactggcaaagtggtagctgacttcggctgtggctgtggcactctggctgtggcgagtgctttactggatgctgaacatgttcttggtattgatattgacccacagtcacttgaacttgctcaagaaatgctgctgatctggagctggacatcgatttagttggtctgacataaagaacttaaa

SEQ ID NO: 7502 - DNA, 308 bp, Zea mays
  Clone ID: LIB3279-045-P1-K1-B8
aaaaccctaacccttcgccgtccctcggacccccaaccagcagctgccgcggccatccgccggcgagatggcgctgtacctgctgttcgagtcggcgtccggctacggtctattccacgcgtacggcatcgatgagatcgggcagagcgtggaggccgttcgctcctccgtgctggacctcgatcgcttcggcaaggccgtcaagctcaccgacttcaaccctttctgctgtgccgtcgatgcactcaatcagtgcaacgctatatccgaagggatcatgaccgatgaactgaggagtttcctggagc

SEQ ID NO: 7503 - DNA, 352 bp, Zea mays
  Clone ID: LIB3279-045-P1-K1-B9
ggcagcgcatcccgcagagccgttgcgtcaagcagcaggccagcaacctcgtccatggaaccaagcgagcagcagtatagccgggcgagcagactgttctctaacaacaatggcaggccgccatccaacgcccaaagaggtaaccctgggccgggcgagtctagggccacctccctttcccgggcaggggtcgcgagaaggctccgggacgagccactccaccgcaacctggagctcctttcccttggcagcggcaagaagaaatagcgggaaggaagccgatctgatagcggaagggaaaagaatgcctgttggcgactctgtaaatgacggggcatgttacctgttcttc

SEQ ID NO: 7504 - DNA, 398 bp, Zea mays
  Clone ID: LIB3279-045-P1-K1-C1
caccgccggcccaattcggataacaagctccctccgcctcgccgcgtctcctcccagccgcaggagccgtcgccatccgatccggaagagggaggaggggggagggaggaggatctgtgtcccgattcgattggagctctcgtccccggcggtccaggatggtgcggggcaagacgcatatgaagcggatagagaacccggccagtcgccaggtcaccttctccaagcgccgcaacggcctgctcaagaaggcgttcgagctctccgttctctgcgacgccgaggtcgcgctcgtcgtcttctccccgcgcggcaagctctacgaattcgccagcggaagtgcccagaaaacaattgaacgttatagaacgtacacaaaggataatgtcagcaacaag

SEQ ID NO: 7505 - DNA, 434 bp, Zea mays
  Clone ID: LIB3279-045-P1-K1-C10
gccgtcgctgccgcgctacttcggcccctttgccggcgacgagcaccaccaggtagctgctaatggagatcgacagcctcagagaaggatttgatcgagttgctgagaaacgttcattatcttctgctaaagctctggaagctgttgatcaaatagtgaatgaaattgagcaggctattgtgaagctgcagatgatgaatacagattctactggaaatgttgaccacccatccatccttgcagaactgaaagctaagctcaatgaaatggcaccactaaaccacacttgaaggcagccaaaaggagctcaatgttgctctgagcaaatatctcaaactccttgagaagtctttcaatccagatatatctaaggcatacagaaatgtggattttgaggtccatacagtaaacaatatcatagcgaatcatttcta

SEQ ID NO: 7506 - DNA, 408 bp, Zea mays
  Clone ID: LIB3279-045-P1-K1-C11
aatgggtaaaaacagtaaacaatgagagcgagagttggaaccgatgatgagataccggaggaaaccaatctcacagaaaccaatatcttgggtgttttttactggacaatcatagttagttgtgctcatcgttgtgtacatgaaacactgagtagtaagtcagctatgtttcacaaaacatatatcaaatcggaaccagtggtgagcgggtgtgtttcacaaagttaggtttggatacaagggtcatgtttgttttacatttaaatcatattttacgactgcactaccatggaaaaaaaaaagaagctaaatgatgtctaagcaaatatataaaactccttgagaagtctttcaatccagatatatctaaagcatacaaaaaataaaggggcggccgttttaaaggat

SEQ ID NO: 7507 - DNA, 348 bp, Zea mays
  Clone ID: LIB3279-045-P1-K1-C12
gggctggcttctcctccccctcttaccaagtcctcttcgggttagggttacttagggttgggtggaggggcgatggcggcggctgatgtggagtaccgttgcttcgtcggcgggcttgcctgggccaccagcaacgagtcgctggagaatgccttcgcctcctacggcgagatcctcgactccaaggtcatcaccgaccgggagacggggaggtctcgcggcttcggcttcgttaccttctcctccgagaactccatgctcgacgctatcgagaacatgaacggcaaggagctcgacggccgtaacatcaccgttaaccaggcccagtcccgtggctgttgcggaggc

SEQ ID NO: 7508 - DNA, 274 bp, Zea mays
  Clone ID: LIB3279-045-P1-K1-C2
aaaaaaacaaaaaatataaataaaaagaataaataaaaataaaaagagtaataataaaaaaggggggagaagtcatcctgtgataatggaagagtgatatacgtgataaaagaggtaaatatggggggctgcctcgttagagagttttaattataggtaagtgtagtataatgctcaggaaagttttttattaaaactttaatttaataagggggggcggtttttaaaaattaatattttttgggagcggtttgggtaaacaaaattttttttt

SEQ ID NO: 7509 - DNA, 384 bp, Zea mays
  Clone ID: LIB3279-045-P1-K1-C3
cttctcttccctcgttcgaagaagctcgcagcagccgcctaatccagcggcagttgaggatggcggcggcgccgccgccgtcgccggacgggcaggagaaggtgatcgcggcggcgcagcacatcgtcaagtcgctcgcgaactccaagaacgccgccgacgacatgatccgcatcctctctcgcttcgacaaccgcttctcgctcatgtccgacctcttccctcctccccctaccgccgtcgattccatactggaggcggacgaggggacctctcagggggaaggggacgagcccgatctcgaccccgaaggcgacgcggcggcccgcgccgaggcggagtgggacgcggcggccgacgtggttgagcgctgggagtccccca

SEQ ID NO: 7510 - DNA, 449 bp, Zea mays
  unsure (1)..(449): unsure at all n locations; Clone ID: LIB3279-045-P1-K1-C4
caccgactccgaggaggagctcaaggaggcgttcagggtgttcgacaaggaccagaacggctgcatctctgccgcggagctccgccacgtgatgaccaacctaggcgagaagctgaccgacgaggaggtcgacgagatgatccgcgaggccgacgttgatggcgatggccagatcaactacgaggagttcgtcaaggtcatgatggccaagtgagtaaagcctgcggtaatggtatagtaaccccgctcggaaggaggaaaccgtgcgttgcatattagtaaggcaatgcaatgcagctcttgtttccttcttcccgtgaagaaaccgtactagctgtagctgctgaacgtttgagtccctctgctgccacccttatctccattgtgccgtcgaacctccttgcttnccctgtgtgaatctgtacggattttcgtgttctgaacactga

SEQ ID NO: 7511 - DNA, 360 bp, Zea mays
  Clone ID: LIB3279-045-P1-K1-C5
gcgccatgagggctttctaggagctcttggtgcatttatgagttatgagaagcatggtcttgatgacttaagggtacatcatttggttgaacgcttcccaatgggtgctccatatgttggtggaaagattcacgggccacctcttggagatctcaatgagaagatatcatggatggagaagtttgtgcaaaagggtactcagattatagcccctgtacctatgggagttccagctacgacaggtatgggaggctttgaaaggccgactgctaaggtgacatcttgcggtcagatgcaagtgcagcgcttaatgtcggtgttctccatcttgtacccacattggatgtatttccattggtg

SEQ ID NO: 7512 - DNA, 418 bp, Zea mays
  Clone ID: LIB3279-045-P1-K1-C6
gtccttctccaccgacttgcgtgacgcctaaccaagccccgcaccgccccgcccccgcccccgcctcccttccgccgcaggggacggggtcggcacggggcgatgaggagcagcgaggccatggagctcctgggcttccatccctactccaggccctccccttccgaggtgaaggctgcgtatagaagaatggtgatggagtcccatcctgatcgtgtcccaacgcatctgaaatcgcaggctgagtcaaaattcaaggagatcgcagaagcatattcttgttcgaagcgacggaagaagatcagggagtaggatggaagttcatgttatgcgttctggtgttccgactagccacggaagatcaaatagaacgttggttaaagccccgtctctcctcataacgtttgcagcagtttct

SEQ ID NO: 7513 - DNA, 445 bp, Zea mays
  Clone ID: LIB3279-045-P1-K1-C7
cccacgcgtccgggtcgctgttgaaaatatcaagattagcgagcaactgcagacactaatagctcctgctatacttcctcggtcatttttgagccttcagatattgcagttccttaaaacctttcggactcaagttcctgttagtggtcctgaaagacgatcacctggaggattatattatctgtcttaccttgatcgtgatatgctcctgggtcgttcagttggtggggggggaatatttgttttcacaaaggcacaacctcttacataaaggttttctggtaaccgagagcatatcatctgatggcataacagctgtccttgagcttgccaacttacaaggggtatatataccttgcaatgcaaatatgtgattatcacctcattctagtttttaaagagattgccatgatctactttgaattcaaagagattacatgcagca

SEQ ID NO: 7514 - DNA, 416 bp, Zea mays
  unsure (1)..(416): unsure at all n locations; Clone ID: LIB3279-045-P1-K1-C8
ccgcattcgttccaactcctgagcactttctcctcgtcccagacaagccaatcgaagccgagatacgaccatggactccaccggcaccggagcagggggtaaggggaagaagggagcggccgggcgcaaggtcggcgggccaaggaagaagtcggtgtcgaggtccgtgaaggccggtctacagttccccgtcggacgcatcgggcgctacttgaagaacggccgctacgcgcagcgtgtcggcaccggcgcccccgtctacctcgccgatgtcctcgaatacctagccgctgacgttctggagctcgccggtaatgctgccagggacaacaagaagactcgcattattccgcgccacgtgcttntggcgatccggaacgacgaggagcttgggaagctgttgggcggcgtgacca

SEQ ID NO: 7515 - DNA, 395 bp, Zea mays
  Clone ID: LIB3279-045-P1-K1-C9
cggacgcgtgggcggacgcgtggggggcgctcaccaccgggaacgaccgcgtcacgctgaagcgcggcgccaactacttcatctgcagcttcccaggccactgccaggccggcatgaagatcgctgtcaccgccgcgtgaggcccccggccgatcagccgcgccggcgacgacgaccgccggacacacgggctcgatcggtggccagcttattattatttttatttccctctccaaagtaaaagcgtcgcgtccttaacctgcgtgttggtaggcggtgttaggtgtgtggagaccggccggcactatagagaactaaatcgaatgatggtgtactcagtacgtactgacgtgtatgagtttgtgttgatgtggacaacaataaaagcatgtgta

SEQ ID NO: 7516 - DNA, 327 bp, Zea mays
  unsure (1)..(327): unsure at all n locations; Clone ID: LIB3279-045-P1-K1-D1
ctttgcaaagaacaacgagttcgctacctggttgaaggaggaaaagggcaaatatttctgagatttgtcttcagagtctgctcgtgatcttttcttgaagtttgtgaaacaatggaacaaaggcaagctgccatcacaatactatgaggggattacgagtggcccacgatcagcgcacaattggaacatcaaagcatgatancgtttctggtaatcgggtccttcgcttgagatgttttttgctttctggcgagattttctaatagtgcatctagcactgcttttaatattctgggttggtggatttaagctgatgttcagaatgtc

SEQ ID NO: 7517 - DNA, 424 bp, Zea mays
  Clone ID: LIB3279-045-P1-K1-D10
cccacacgtacactaacgcgtaaccatatacttattgtatcccggattgttaatgctgcggatactcaatctgtcaaccggtctttgttctccgcatcaactcccatgtctacttctcttagcttgcatcaacacataacgataagcaacatcatatcgcacacgacgacatacactatctccatgccaacagattctacacgccctcttgctccaatacttcactccacaagcgcaggctaatttgaggaagaacgagtgtacacttgctttgctaccaacacacgacatttatctgctctgaaactgtagcgcttactttattttccgcccttctgaaagtatagtcctttcgaaacataaaagatacagtacctcctactgacaccactcttggtttaaatgtaacctgcacgtgtttgtt

SEQ ID NO: 7518 - DNA, 352 bp, Zea mays
  Clone ID: LIB3279-045-P1-K1-D11
gccgccgccgccctctaaggagaagagggtcccgtcgtatccttgcctcgatggcgggggggaagaatcagtacaaccccgtgcgtgatatcaaggtgcaaaagctggtcctcaacatatccgtatgggagagcggtgaccgcctcacccgcgccgacaaggtgctggagcagctcatcggtcataccctcgtattctacaaggcgaggtacacggtgcgctcgttcggcatccggcgtaacgagaagatcgcctgctacttcacggtcaggggcgacaaggccatgcagctgcttgagagcggactcaaggtcaaggagtacgaactgctcatgaggaacttcagcgacac

SEQ ID NO: 7519 - DNA, 416 bp, Zea mays
  Clone ID: LIB3279-045-P1-K1-D12
ccatttgagaaggagagggaaaatgatgacctcgtggcttctgggccgccggggcccctgcggcttctcctggagttccaccgccgaccaagtcacgcagggcatctccgccgccggcctcaccgccatcgtcactggggcgtccagcggcatcggcgcggagacggcgcgaacgctggcgctgcgcggggcccacgtcatcatggccgtcaggagccttcccgctgcccaggccgtcaaggacgccgtcctcgcccaggcgccgggggccaagctcgacgtcatggagctcgacctctcgtccatggcctctgtccgcgctttcgcgtcccaattcatcgacaggggtctccccctcaacatccttatcaacaatgcaggagtaatggcaataccttttgcgctttcaaaggatg

SEQ ID NO: 7520 - DNA, 371 bp, Zea mays
  Clone ID: LIB3279-045-P1-K1-D2
aagtgacaatagcttaattcgtgttgatcgtctagaatatcacatcagggaggagcttaacaaaacagcccctcgaaccatggttgttttgcgacctctaaaggtggtaataactaacttggaagaaggaaaagtactagaccttgatggcaaaatgtggcctgatgcttctgatactgatgcttcctcccactataaggttccgttctcaagaactgtctacattgagaaaactgattttcgcctaaaggactcaaaagactactatgggctagcccctggtaaatctgtcatgctaaggtatgcgttccccataaaatgcacagatgttatctctggtgatagtcctgatgatattgttgaaattcgag

SEQ ID NO: 7521 - DNA, 350 bp, Zea mays
  Clone ID: LIB3279-045-P1-K1-D3
cgcccccaagccggccaaggccgccgccggcaagtcaaagaaggcagcggctgccaagccagagaaggccgctgctgctgggaccaagcgcaaagtgcccgagaagaaggtcgtggcgaagccgaagaagtcccccgccgccaaggccaaggccaagccgaagaccgtgaagtcccctgcctccaagaaggcacggaaggcctccgcatgagatgggttgctttaggtctaagctctgattgtggttggtgtcagttaggtactgtacaaactaagtgtgtgcccaaagtgtctcatgcggtgtgttatgtgcttagcaagttctatctatcagagtgttttagtttaac

SEQ ID NO: 7522 - DNA, 448 bp, Zea mays
  Clone ID: LIB3279-045-P1-K1-D4
gcgattggttccgttgataggccaggttgtggggctaaaattctccgaggggatggtgcattggaccagtacataacaagaaccaatgtgatgaatttacaggaaactaacgatggtttggccggggagctcgaggaagcgtacatgctgtctagaattgttagcttgtaatttgaaaggctggggaggaagcgtatatgctgagttctgaccaacttcgtacatcgtgtaacatgtctaccccaacacaggccggctactttttgctcacaaaatcacctgtactctgtctccattcctgttaagctctaacgagcagatagatccggggcaccttttccatgtaaacaggagttgccttttgattgagcaaccgtcctgcggagtaaattgttgcccatttttccccgctgcccccaactgggcagctcgattgtggttgacagag

SEQ ID NO: 7523 - DNA, 413 bp, Zea mays
  Clone ID: LIB3279-045-P1-K1-D5
aaatgcggttattgacgattaccacgacttcatcggcacattcgagtacttgtggacgcgcgggctgatctctgacgaaacctacgagaagctgcggcttgcctgccagttcgacgtatctgagcatgcgtcgaaggagtgcaacaaggtcttcgacatcgccgaggccgaggaaggcaatatcgatgcgtacagcatctacacgccgacttgcaagaagacttcactccacaagcgcaggctaatcagaggaagaacggtagtacacttgcttcgctaccaacacacgacatttctttgctctgaaactgtagcgcttactgtattgtccgcgcttctgaaagtatagggcttgtgaagcataagagttcaagtaccttctcctgacaccacgcttggttcaaatgtaacct

SEQ ID NO: 7524 - DNA, 380 bp, Zea mays
  Clone ID: LIB3279-045-P1-K1-D6
accacctggccaaccggagcgtgagaaccgtacggtgtacaccgattgagatgacagccacgtacgacttcgagacgtacgcggaaatggagcggttcatttgagagcggctgctgaacacgcagcatacctatagcggagcgctaccgggcgctcttatcactccgaagcctccgcggagatgcgccgggccgtgctctgctgcaaggtttagactatggcgcctctgtgagatacatacacgtcagcaccaaagaaagagctgtaagggatccttgtaactagctcgcccatgaggctgcattcgcacttagacagatgcaggatgctgaggctattcctgcactggtggcagtactcaaagagctttcgctacatcc

SEQ ID NO: 7525 - DNA, 432 bp, Zea mays
  unsure (1)..(432): unsure at all n locations; Clone ID: LIB3279-045-P1-K1-D7
ccatgtcctccgctaccaacctccgtttattgtcgtggaactgcgccgaggacccgctggatttcggtgcgttcgccgacaccgcgtttctcctgctccagcggcgcgcggcgacgcagaaacgcgcggtgtcgccggaggccgttcaggtgcgcgccgttgacaagctgggtgttggcgcggcggagggagatgagaagtcacgcgccgccaagaaaggttttttaggggtttcccattcctttttttgcagattaaatatttgattttttttcggttaacgttggtggtggatgcgccaagaatgcttcctcgtggcattataatactcgggaacatattctacgctctccagccttcggcgagcactttaaatctgggaaatcanataatcattcggataataagactgtcaaaataatgacatacaat

SEQ ID NO: 7526 - DNA, 358 bp, Zea mays
  Clone ID: LIB3279-045-P1-K1-D8
ggtataggcaaactattcttgaacaatgaaaacattgaagcagtcattctgaatacatgtgattttctatgtatcaatctgccttttttttctgttggaatgttgttgaagagtacacatttggtttgtctacagttaattttatgcaacttggtattgttctgaacgtctgtctttactacatgttttgagaggaagtctttactatagattagctgggatattctttcagcatgcgttcactagagggttttcaattttggttacccttctcgatatgtttggcttcaatctacaagacacacccaggtttgatctgcgacgcttagaagctgtagcacctgacatcttattaccc

SEQ ID NO: 7527 - DNA, 266 bp, Zea mays
  Clone ID: LIB3279-045-P1-K1-D9
cccacgcgtacgcggacgcgtgggcggatcctccgcgtattccggcttggtggggctggacggacccactctgccggccgctcgttgttctccccgtcatcacccctgccttgttctctcggattccagcagcacgtaaagctcgtcaacagcgtctcccacccggacgccatgcactcccgacgtcacaaccgatgctacgaggcatgcggtgcccctcgaggtggtggccatcgaggaggaagaggagggggaggaggaggagg

SEQ ID NO: 7528 - DNA, 394 bp, Zea mays
  Clone ID: LIB3279-045-P1-K1-E1
cggacgcgtgggcggaggtacaccggggaggacttgttatcagtgactcgcaacacgatcgccggcaagaaaacagaggatagtcggatcactaaggcataacaaggcatacctgtttatgggacagagtgacggcaacacctagatggacaatggtggctgttcatagaattgcgacaatggcgacgcggcgacgtcagcgtgatagatcgataccagaggttctgccgttgagacaactcacagtggagtgctgcaacacattcattccgggcatgcatgatacaagactgcgctaagatatgtgtctctcaataattaatttccatgtgcataaggcccagctggtctaatcaaatcaaaggttagggaaaccatgccatcttagacgaga

SEQ ID NO: 7529 - DNA, 377 bp, Zea mays
  Clone ID: LIB3279-045-P1-K1-E10
cttcgaaggggttcgaggacttcagctatggcatctgtgggacgtgcaggacgaggagggaaaggagatggagggaagggagaagggtcgctggctcgcagggcgtggaggcagtacctgctccagctccagcaacatcctctccgcacaaagatgatcacggcggggtgcctcgccggcgtcagtgactccgtggcgcagaagctctctgggttccagaagattgagaaacgcagactcctgctcaagatgctctttggttttgcgtatggtggcccatttggacatttcttgcacaaaattttggattacatcttccaagggaagaaagataccaaaaccattacaaaaaaggtgttgctggagcaagtgacatc

SEQ ID NO: 7530 - DNA, 443 bp, Zea mays
  Clone ID: LIB3279-045-P1-K1-E11
gccgccgccgccgcctaaggagaagagggtccggccgtctccttgccccgatggcgtccgagaagaagcagtccaacccgatgcgggagatcaaggtgcagaagctggtcctcaacatatccgtaggggagagcggcgaccgcctcacccgcgccgccaaggtgctggagcagctcagcggccagacccccgtcttctccaaggcgaggtacacggtgcgctcgttcggcatccggcgtaacgagaagatcgcctgctacgtcacggtcaggggcgacaaggccatgcagctgcttgagagcggcctcaaggtcaaggagtacgagctgctcaggaggaacttcagcgacaccggctgcttcgggttcggcatccaagagcacatcgaccttggtatcaagtatgatccatcaacaggcatctatgggatggacttctacgtc

SEQ ID NO: 7531 - DNA, 159 bp, Zea mays
  Clone ID: LIB3279-045-P1-K1-E12
gcccttgaatttgtctatggaagagttggcccttttactagtgtcgatgttgatctggtgtaccttgctatgaactggttaacgtttgagctggtttgggattttttgtgcatattgtgatacctcaagtagttcatcatttaaatgtttagccgtaat

SEQ ID NO: 7532 - DNA, 446 bp, Zea mays
  Clone ID: LIB3279-045-P1-K1-E2
gaaggagtcggagggctgctaccgctcacaagctctatcttatccaactatctcacgtcggtgctcacgtaccgtgatacaaccatcttcaccttcgagtccgttgaatagggttatgagggcattaatgttgtgattcagattaacctagcttttaattagctttcggccaagatctactagctgaatggttcaccccatcgatgacggtgtcgatcgcttacaaggaagatatagcgtgttacgatcgcccgtttgtaggcgaggtactatgtggttacgatggtcgtgatgcatcctactgccatggaggtcatggtcaagcctaaccatgtcatggagattaggccaagcatacagcgttgattgtcacaccccatgtgttcgtcgcgaactaagcagcgagtgtggaactaatcaaggtatgtcaagtgaggatcatgatc

SEQ ID NO: 7533 - DNA, 447 bp, Zea mays
  Clone ID: LIB3279-045-P1-K1-E3
cccacgcgtccgagaaaggtggattggctcactgaaaaaatgcgtacaaataacttcaccgtatcagctatgcacggtgacatgccccaacaagaaagggatgccattatgggtgagttcaggtctggcgcaactcgtgtgctaataactacagatgtttgggctcgaggactggacgttcagcaggtttcacttgtcataaattatgatctcccaaataatcgtgagctttacatccatcgcattggtcgttctggtcgttttgggcgcaagggtgtggcgatcaatttcgtgcgcaaggatgacatccgtatactgagagatatagagcagtactacagcacacaaattgacgagatgccaatgaatgttgctgatcttatttgagcagcaagaggatcgggaggggagcttcttgtgttggcttgaggcccttggcgcgagtgt

SEQ ID NO: 7534 - DNA, 456 bp, Zea mays
  Clone ID: LIB3279-045-P1-K1-E4
ggcgactccaggttcgtgggcgatgctgcgcgcgggaggtaggcagctccttgccccggggctccggcggctcggtctgggcaccggcgccgccggtgaggtgggcccggccgccgcggcggcggggatgagggcgtaccacgagcgggtggtggaccactacaacaacccgcggaacgtcggttccttcgacaaggaggaccccaacgtcggtactgggctggtcggcgcgccggcctgcggcgacgtcatgaagttgcagatccgcgtcgacgaggactccggtaaaatcgtcgacgcctgcttcaagacctttggctgcggctccgccatagcgtcctcgtccgtcgctactgaatgggtgaagggaaaaccaatggatgaagtcttgacaatcaagaatactgagattgcaaagcacttgtcccttccaccagtaaagctccattgcagcat

SEQ ID NO: 7535 - DNA, 411 bp, Zea mays
  unsure (1)..(411): unsure at all n locations; Clone ID: LIB3279-045-P1-K1-E5
ctaagggtgcacagtccattctcatgttcggtcaccattcactgtttcctttctcattctgcgctcctcacactcacgactagctaaaattaaattaaaaaaacatgtctcaaggggattcgaacacgcgacccctcaattaaatgtgctcatagctatcactacaccacatgtgtgtttatctctatatctatatagtaaaaacatatactatgtccctcccaaagcccacctgctacccttgcacaatgtgtagtagtaaataagtatcaacgagattattaaattatatttctggattgtgggagtagtatttaaagaagagccttgcttgcgattttttttgtttgaataatgttttcaacttaaattccttttttgcatgtgcgnagcaaaaaaaaaatgctgaga

SEQ ID NO: 7536 - DNA, 401 bp, Zea mays
  Clone ID: LIB3279-045-P1-K1-E6
gtcaggtcagtgctccgtgttgcgttttcttaagaacacgaaaaaaaaagaggggagagtgtctttcgggtcctctttttctttgattgtcgaaaggccgctcctttaggagatttgcgcgcttctcgtcgagattagccgccggtgctcggatcgatctgtttgcggtggaggaattttgaggccaagaagagagttggaatcggatcgggagttcttgtggtcacagggtgcgaaaaaagcgagtgatttttgggaggatttcttgttgggaaaaaatcggttgttcagcggattagaggcggagatgggagccggggctgaggtcatgcatcaggtcgtgccgctgctggagccgccgctccaccggtgcgtcgttaagagcgtcgatgtcatggagg

SEQ ID NO: 7537 - DNA, 357 bp, Zea mays
  Clone ID: LIB3279-045-P1-K1-E7
cagcaggacaccactcatcttccttcccccccgcctcgtttccatcgccgccactctcttgctcccccgtaccatccctcgccaccgccaccgccgtcgctatgcagagcctcctcgtgcccactgctgcatcggccccggtggcggctccgcgggctcggcggaatctccctatgcgcctctccgtccgcgcctccgcgacggcggcagcggcaccgcggcgggagacggatcccaagaagcgggtggtgatcacggggatggggttggtctccgtgttcgggaacgacgtagacgcttactacgaccgcctgctagccggggagagcggcatcgggcccatcgaccgcttcgacg

SEQ ID NO: 7538 - DNA, 435 bp, Zea mays
  unsure (1)..(435): unsure at all n locations; Clone ID: LIB3279-045-P1-K1-E8
gcgggccgtacgccaccacggcaacggagaagaggactttcagctgcggcggctggccggcgcggcgacggggatgggggatgggcgcacaggcggcgccaaccgtccggcgtggctgcagcagtacgaactgattggcaagattggggaggggacctatggcctcgtcttcctcgcgcgccttaagccgccccacccggcacctggccgacgcggcccccctatcgccataaagaagtttaagcagtcaaaggagggggacggagtatcacccaccgcaattagagagatcatgctcctgcgcgagatcaaccacgagaatgtcgtcaagctcgtcaatgtgcacatcaaccacgctgacatgtccctatacctcgcattcgattacgcagagcacgacctctatgagattatcangcatcacagggagaagct

SEQ ID NO: 7539 - DNA, 382 bp, Zea mays
  Clone ID: LIB3279-045-P1-K1-E9
tgtgcttgagctggaggctgttggcaggactgacatccctgtggcagagggatcccatgcaacgatcaagaaagccaccaagctgaggatcacaagctttgtccacggttcagacggcctgaggatcgcaagcttcgtccacggttcagacggccactgtggatcgaggtgcggcaggtcggggcgccgccgcggattgtaggctcggccgagactacttcgtcaccaacgtcctcgtatgttctcatatatgggtggaagataaagatttgtccagggttgatggtgaggtatttcgaattgatggccaaaacgcccatgttcgcacaaccaaggggaaggcggtatgtgttgctctgcttttgaagtctgtcacaaaccc

SEQ ID NO: 7540 - DNA, 452 bp, Zea mays
  Clone ID: LIB3279-045-P1-K1-F1
gtactatggtcagccgccaatgggcccgcagcaaggctatcctcaacagccagatccctatgctaggcctccatacagtggacctggtcaatggcctcccaggggtgctccggctgcagatggctcttaccaggcgccagctgcatcttatgggccgccttctcagcacccttctgcttatgggcaaacgtacagtgcagcaactggatctgatggatatgctcaacagggttacccacagcagggtgggcaggcaccagctccatatggtcagagtgcaccagcagctccaggctatcctcagcagcaaggtggctatgcacagtacccacagacccaaccagcatatggtgagcaagcagctcaaaccaatgcgagctatgggtaccagggagctccagcagatcctaactatggaagtgcctacccacagccaggatatggtcctcctg

SEQ ID NO: 7541 - DNA, 453 bp, Zea mays
  Clone ID: LIB3279-045-P1-K1-F10
ccaagctcgacccgtcgcaggtggtggaggtgttcgtccgtgtgaccggcggcgaggtcggcgcagcgtcttcgctggcccccaagatcggcccgctcggtctttcccccaagaagatcggagaggacatcgccaaggagacggccaaggactggaagggcctccgcgtcaccgtcaagctcaccgtccagaaccggcaggccaaggtctccgtcgtcccctccgccgcggcgctcgtcatcaaggcgctcaaggagccagagagggaccgcaagaaggtcaagaacatcaagcacagcggcaacatcagcctcgacgacgtcatcgagatcgccaggaccatgaggcacaggtccatggccaaggaattggccggcaccgtcaaggagatcctcggtacctgcgtcagcgtcgggtgcaccgtcgacggcaaggacccccaggacctgcagc

SEQ ID NO: 7542 - DNA, 208 bp, Zea mays
  Clone ID: LIB3279-045-P1-K1-F11
ttttgtagtaaacagaatttggtataccaaggggatctatatatcaatgtatgccataaattgtctgaaaaaaaaaaaaaaaaaaaaaaaaaaaaaaaaaaaaaaaaaaaaaaaaaaaaaaaaaaaagacaccagcagcgaaacggccacagactcacacaggcctacatgcaaccgtcaagctcacctttcagaacctctaaaccaa

SEQ ID NO: 7543 - DNA, 405 bp, Zea mays
  Clone ID: LIB3279-045-P1-K1-F12
aaaaaccacaaatccaacaaaatctaatatgtacccgcacaaaaataattagccatatatactttttaatttaggaacctagcgaggcgccacccatcgtgtttcctctgaggctctgcgatcgtcgttgtcttgttgcatgcactgaggctgaacgcgctgctgctgctcctctgcctgtgcgcgttccccgccccggcgcggtcgcagaacacgaccatggccacggccgcgccggtgtccatcgaggggttcaactgcaccgccaaccgcacgtacccatgccaggcgtacgcgctctaccgcgccggcttcgcgggcgtgccgctcgatctcgcggccatcggtgacctcttcgtcgtcagccgctttatggtcgcgcacgccaacaacctttccacgacg

SEQ ID NO: 7544 - DNA, 399 bp, Zea mays
  Clone ID: LIB3279-045-P1-K1-F2
cggacgcgtgggtgttctagcaagcctctcaatgtggggggttattttttatggtggttacaagctttttagtggaaagaaggaagccaagactgaggcgggatcaccacaggcataggtggcggagatggagttgtacccatatctgtggcctggcaacaatgttaaataaaaggaatgctttatgttgtgctttcaagttgataaattgtggcaacaagagattttgctttacctaggcaatatattgagaagctactcttactcatccaccatgaataatctttgctgcagtggagcttcatgtcggcgaacaatgcaaacgttgtacttctttcatgcgattgagtagttgatgttttacttctgttgccaccaacagttgaacgctgtacttgc

SEQ ID NO: 7545 - DNA, 389 bp, Zea mays
  Clone ID: LIB3279-045-P1-K1-F3
cccacgcgtccgcggacgcgtgggcgcgtgcctagcgtcggctaccgcgactgcagcgtcggcggctgggaccagcggatgtgcgttcctctctctagaagctccgtcccgtcttcacagccttttcctcccaacaacgcataatattagctagggtttcaacgcatctgacggcggaagctagggcgtcgccaccgtcaatgtcttggcactcccgctctgttcatcaatcgcatcgacaggtgctccatgattctctataatatccgaaataaattaggattaaagcaagaataggaagttattcaaaactcaaaagtaaagggtttccggtcttccagttaaatgaccaaatgacctgtagaatgacagcaagcaagcaaaataaa

SEQ ID NO: 7546 - DNA, 418 bp, Zea mays
  unsure (1)..(418): unsure at all n locations; Clone ID: LIB3279-045-P1-K1-F4
cccacgcgtccgagaggactccattgtacattctgattcgcgttctttggccacacttcttcttattcgtgacattcagtctaagcgtctcccatcgaaggagctgaagtcacctcatcgttacaatggcttctctcacagtgcctggattagagaaatgcaacatgcatcagacaaatctataatcatcagcgaaatacttgattctagaacaagaaaccttgtatctgtctccaaaatcagcgattatgttctatcaaatgagcttgtaagtatggcactagcaatggtagcggaagacaaacaaataaacagagttcttgaagaactttttgctgaggagggaaatgagatgtgcattcggtctgctgaattttacctttatgagcaagaggaatngagtttctttgatattatg

SEQ ID NO: 7547 - DNA, 445 bp, Zea mays
  Clone ID: LIB3279-045-P1-K1-F5
cccacgcgtccgcccacgcgtgcgccgccggcgcctccacttcgcgttctcgcctcatctcctcccgctcaggatccggcggggaaggtaaggcaagatgtacaccgcgaggaagaagatccagaaggataagggccttgagccctccgagttcgaggactccgtcgcccacgctttcttcgacctggagaacggtaaccaggagctcaagagcgacctcaaggacctttacatcaacggtgctatccagctggatgttgccgggagcaggaaggctgttgtgatccacgtcccataccgcttgcgcaaggccttcaggaagatccatgtcaggatcgtcagggagctggagaagaaattcagcggcaaggatgtggtaattgttgccacaaggaggatcgtgaggccgcccaagaagggttcagctgttcaacgccctcgcacc

SEQ ID NO: 7548 - DNA, 445 bp, Zea mays
  Clone ID: LIB3279-045-P1-K1-F6
aataaaaatccagcagcatttctccgccgcccatacgacgacgacggccactcggcgcagtgatttgggcgccccgcaaagcggtggctccaccggccagcgcatcaaaggccctgtggaatatggcgccgcgccgcttgccggggccggggccggggccgggcccgggccctcctcttatatacggcgtggcgagcaaacccaaaaccctcgcaggcagaaggcaaacgcggctgctagcgcggcgcccctctcccactccgactccccagccgccgccagcccgcacacccctccctcgcgcgctcagggtttcggaatggaagccgaggcggcggccaagaggacgcgggagagcggggaggacgccgccgcggcggggatctccgccgtcatcccgggatggttctccgagatcagccccatgtggcccggtgaggcgcac

SEQ ID NO: 7549 - DNA, 390 bp, Zea mays
  Clone ID: LIB3279-045-P1-K1-F7
cccacgcgtccgaaccagcattttatttcacgtttcagtaacattttcatccaaaatatggcggaattgccgaacgagttaaacctcccgttgcataattcaccatttccaccaccaccaccaacaaatccagctgcagaaaatattgctggtataccaaaacctgtacaaaacaatcttcctgggatcttgggtgatgcacagctgactgcatgggaattgtggcataagcaggagtactcattcctgaaaattgcttatttccgcagagcactgccaataaaagagcaaacagttattgcgtacattcttgatgctgctcgagaaggatgtgagatcgactggactaggttttgcagggaagtagggctgacacctgatatagccacc

SEQ ID NO: 7550 - DNA, 403 bp, Zea mays
  Clone ID: LIB3279-045-P1-K1-F8
cccacgcgtccggtggaggcgcgggcgcgtccggcggcgtgtcgcagccgcaggccggcgctgcgtgcggaggcgccgccgcgccgcccaggcagcgggtacgggctcggcgcggccaggccaccgacccccacagcatcgcggagcggctccggagagagaggatcgcggagaggatgaaggcgcttcaggagctggtgcccaacgccaacaagacggacaaggcgtcgatgctggacgagatcgtcgactacgtcaagttccttcagctccaagtcaaggtgctgagcatgagccggctaggtggcgccgctgccgtcgcgccgctggtggccgacatgtcctcagagggtcgaggcggcgtggcggtcgcggccgggagcgatgatgggctggcggtgac

SEQ ID NO: 7551 - DNA, 396 bp, Zea mays
  Clone ID: LIB3279-045-P1-K1-F9
cggacgcgtgggcggacgcgtgggcggacgcgtgggcggccagggagcgttcggcaacatgtgccgcggcgggcgcatgttcgcgcccaccaagatctggcgcaagtggcaccgccgcgtcaacatcaacctccgccgcgtcgccgtcgcctccgcgctcgccgccaccgccgtcccggccctggtccaggcgcgtggccaccgcatcgagactgtccccgagatgccccttgtcatttccgactccgcggagtccattgagaagacctcccaggcgctcaagatcctcaagcagatcggcgcccacgccgacgccgagaaggccaaggactccgtcggcatccgccccggcaagggtaagatgcgcaaccgccgctacatcaaccgcaagggccc

SEQ ID NO: 7552 - DNA, 348 bp, Zea mays
  Clone ID: LIB3279-045-P1-K1-G1
aagaagaggacttcattgaaagacttatgcacagattcgacagcaagagattctgcagagactgcagaaggaatgttattcgcgaattcaaggagctcaaggaactaaaacgcatgcgaagggaacctcgctgcactagttggttttgtgttgcagataccacatttaagtgtgaggtgttcgaggatgctattcttgttgattggcatcaatctttattggagcaagatggaatataccatcatttcgagtgggctattggaacagatgaaggaaaatctgatattctaaactttgaaaatgtgggcatgaatggacaagtccacaggaaaggcctcgatcttgatc

SEQ ID NO: 7553 - DNA, 446 bp, Zea mays
  Clone ID: LIB3279-045-P1-K1-G10
aaataacatataatttctatgccaatccatctttacttgaacattttctatccatcttaattgttttgctcattttatttgatgttaatattaccaacaatttggatgtatcttgtagaagaaagtcaatacatgacgaaggacgccccaaggacgccataggagaaatacaaaataaataaaggtaccaaacactggaacgaaccacctggtggtgctctctgcgaaggcgtggatggtccgcgacatgggcgcagaagcggtccctcctctgtgtacgtctggacgatcgacacctgggtctcgaatggtctgcgatggcgcagagcgtcgtcttcttcgtagccgacctagattttgcctcccgggaaggacccgtcgaggaggagagatcctagggtgtgtcttggcgtgggtagaccacctaagacacctcttgtcgacgt

SEQ ID NO: 7554 - DNA, 450 bp, Zea mays
  Clone ID: LIB3279-045-P1-K1-G11
cccacgcgtccggttgttcagtgtatatgggaacgtgcaggagagttttttcctgcaatgaagaatgtttcttttgatattgatcagaatactcaaatcagaatagggcatcgtccatacatgcctgatggaaagccagttattgactttattcctaatctctcaaatattttgattgcaactggacacgaaggaagtggacttactttggcactaggcactgctgaaatggtcactgatatgattcttgggaatcctggaaaagtgagctactcacctttttccatcaaacgcagattttcaagatgatcgtttatccggaaaccctccttcagctcttcaagtgacaaactaccgtccttgtttttgtccattgtatggaacatctctttgaaattgccaatctcttccattcgtaaatcatggcgacgacctgcattaatcattggc

SEQ ID NO: 7555 - DNA, 419 bp, Zea mays
  Clone ID: LIB3279-045-P1-K1-G12
gcctgacaccaaatcagttgctgagcctgctgctgctccagcgcctgacaccaaatcaggtgctgaacctgctgctgctgctccagtgcccgagaccaaactagttgctgaatctgctgctgatgctgttgctgctccggcgcctgaaaccaaatcagatgccgagcctgctgctgctccagtgcccgagaccaaaccagttgctgaatctgctgctgatgctgttgctgctccagcgcctgaaaccaaatcagatgccgagcctgctgctgccgctgatccagcacctgaaatcaaatcagatgctgccgccgctgatccagcacccgggaccaaggcagatgctgccgacactgatgccgcgcctggaaccgagccagacgccgctccactagagaacaccgctgccgacaaaggcg

SEQ ID NO: 7556 - DNA, 444 bp, Zea mays
  Clone ID: LIB3279-045-P1-K1-G2
atgattgtacggcaatcactcagagaataagggctatgcttcagtcagctgatgaacaggtcaggagcttgaagaagcagagtacatttcttagccagttggctgcaaagacaattccaaacagcattcactgcttgtctatgcgtttaacaattgattactatatcctgccccttgaggaacggaaattcccaaggagtgaaaatttagaaaacccaaatctctatcactatgcgcttttctctgataatgttttggcagcctctgttgttgtgaactcaaccataatgaatgctaaggaaccagagaaacatgttttccatcttgtgactgacaagttaaactttggagccatgaacatgtggtttctgctgaacccacctggcaaggccaccatccatgttgagaatgtggacgaatttaagtggttgaactcatcatact

SEQ ID NO: 7557 - DNA, 423 bp, Zea mays
  Clone ID: LIB3279-045-P1-K1-G3
ggcttctcgctcggatccggaccaacggaacaattccagttccatgcgaattcgaggctggtccatccattacgagctccgcgatttccctgaggcactcgtttccaacgaagcgcggtggggggaggcattcacccgtccaacaaagcgcgagttcgtcggcgcttcaaagccacgggattctttgccgtcgagttcactccatcccacccccccgcaccaagaaagctccacctcccccaccgcgcacaagaaaaacctagcagctataacccctaatccccaccagtaatcccaccatggcctcgtctctgccgccgcgcagctcctaccagaagaaggagaacgcggtgccggcgcgccgggagatgggttacaacaaggcgacgccgcgccggaacgtgctatcggctctcaacaacg

SEQ ID NO: 7558 - DNA, 446 bp, Zea mays
  Clone ID: LIB3279-045-P1-K1-G5
ctcccgcgcattcgctttgttgtgttagagatttgagctctattcgagtcgaggactccctgtgttgtcaattgagctcgagtcttcacttgtgtgcgtggttgtgctgcgatttgagtcttgtgtgcgttgcttctcccaaccttactccgtgctttcattgtgatctttattgtaagggcgagagactccaatatgtgaagattcctcgcaaacgggaacaatcaactaaaagaaaagccgtggtattcaagttgatcatcggatcacttgaaaggggttgagtgcaaccctcgtccattgggacgccacaacgtggaagtaggcaagtgttacttggccgaaccacgggataaaaatcacgtgtctggtgttgctctatctatgattatttgtgttcacaagaactcacttcaagctacttagccatactaacacttataact

SEQ ID NO: 7559 - DNA, 300 bp, Zea mays
  Clone ID: LIB3279-045-P1-K1-G6
cccacgcgtccgatgtggaccaagctgggcagaagaagcaggactatgagaagactaaggcaaatattgagaaggagagcacaagctcaaagaaggctaagactgatgacgacaatggctcgaagtccgaggtcgatgatgaggatggcggtagtgacgaggaaaacgacgacgacgagtaaatagtatctccgctgtcgtgaggtagcaaatcgattgttaggtcccaaattagctcactggtttgctatctttaatgttaagttgtttggacaggtgtttatgaaggggatctattag

SEQ ID NO: 7560 - DNA, 435 bp, Zea mays
  Clone ID: LIB3279-045-P1-K1-G7
cttccagcagctctagcctgttaaggttctcctgtggatgcatcgagacaacagcatgctggcgccaagtttgagggcagcattgggctactatcagagaaaccaaataatcccatacctaactgttcatctggaagttactcatcatgacaagtgcctgaaatttttcctctttcctgttaccttgtgtcagaacattatgtagctgtagatatattgattatggaaggatgaagttgccaaattgacctgaggagattcctttctccagccaggaaaaattctgaacatcaaggagtttctgtttgcaagtttcactatttaaaagcagttatgttgcttgtgcggaggtaagtactggaccgaggtagtattatcagtttcatggatatggactgttgtgatagtttcgatagaggtgtcaaacatcaatta

SEQ ID NO: 7561 - DNA, 235 bp, Zea mays
  unsure (1)..(235): unsure at all n locations; Clone ID: LIB3279-045-P1-K1-G8
cccacgcgtccgaccacgcgttcgcgtggaggtgtttatnattttatgctacctcatggggaaacaaaattaagggggccgccttctttatactatcctagaatccatatcctcccatgcctaactgtacatctggaatatactcatcaagacaaatgccactaatccttcctctacaatgttatgacttgtaaaaacatgatgtaactcaacataattggattgtagaacattc

SEQ ID NO: 7562 - DNA, 377 bp, Zea mays
  Clone ID: LIB3279-045-P1-K1-G9
attgcctagaggactcggcgagagctccattcgattcgagactcgagagcatagccgtgcactgggaagaggaggtctaggagcagatgagcgggctggagctggagctgggcctgagcctaggcgtcctcatcgacgtcgtcgacgagcaatggatgcgcgacaccctccccgccgatgacatccccgtgccgccggccatggcagtcaaaactgaggacgccgaggatccagcgcccgccaatcaggaaagccaaccagcacaaggggatgtatggcgtgattttgccttggaaaatctctgattctttatgctctacattctacaagtgcctctagagatggagattctatgctaagggtttaggagctgcatg

SEQ ID NO: 7563 - DNA, 345 bp, Zea mays
  Clone ID: LIB3279-045-P1-K1-H1
gagttcccggactcgctgagcccggagcagtgcaaggccctggaggctgtgctcccgcccgaggccggtgtcgaagtacaccgacatggagctggacgagtgctaggagacgatgccctatgacgtgaacatcgaagcggatatgcggaggcgtgagcaggagcaccaggaggtctacgaccaggatgaggacatgccgggcggcttcgcatatggtgcagagcgcccagcagtagggagaagcttgttagcagtgataaattattcgacggcggcggaaaaatttgagcgactactgattggttcaaccgttcatgtttacacgcccgtattaatgtgatgact

SEQ ID NO: 7564 - DNA, 113 bp, Zea mays
  Clone ID: LIB3279-045-P1-K1-H11
gatcgcgagcggcagtcgcgactatttttactactacactcgcttcactagggggggtattgataattgatactctcccttcccccaatcagaatctccatattctcttcttc

SEQ ID NO: 7565 - DNA, 319 bp, Zea mays
  Clone ID: LIB3279-045-P1-K1-H2
gagtagcttacccaatcccgtgcggagcgacgttagtcgtatccaatagcagcctgacgcggggcttaatttatcaacctacacgatcccaaccgttcgctcctcggaccggctccctaactcccgctgatcgcaatccctacttcctggcgttataaggacctacatgcgcatcatctgctcgccttcgacgtgcactccgacttagccctgaagatgaaccccttcctaccaaaaaccagtatatgcactagctacttttttacatccagcccttagctttcaaccacttcccattgattcatcactttcatagtcc

SEQ ID NO: 7566 - DNA, 201 bp, Zea mays
  Clone ID: LIB3279-045-P1-K1-H3
gactcaccgttccagtcgagtccgcagcaacgttattctcttccaatagcagtctccgcgggggctgaagttatcaagcttcacgatgccaccctctcgttcctcggacagactccggaagtcgctcccatcccagttcctgtttcctggcgtgataaggacctcctcgcgctggatctgcccgccttcgtagcgcacccc

SEQ ID NO: 7567 - DNA, 393 bp, Zea mays
  unsure (1)..(393): unsure at all n locations; Clone ID: LIB3279-046-P1-K1-A1
gcggcggcgatggcgctctcctcctcccggccgaagcacctcctgcgccccatcctgcggggtttccacgcctcagcgcgggccctggcgcgggtggagccgcacgagttcttcaagcccagcgagtacctgggcagctgggagcccgcggcggagcctctggaggcgtgggcgcggctggaccgtctgctcaaggggtacccaagcgaggtgcgggagctgcggcagcattacgcctacgaggtgcatctgttgcatgccgagcggcaccggaaggccaacaccagagcctaggcctgccgcgccgacaaccaagagcgcaaggccggcaaggttgtatncggcaataagcgctccgaacagcgatcggcgcatgcagaagactttccctat

SEQ ID NO: 7568 - DNA, 399 bp, Zea mays
  Clone ID: LIB3279-046-P1-K1-A10
cggacgcgtgggttgatgagaggttatctgcccttggcaattgcatagcctgcaatgaccatgttgcacttacgcaccctgaccttgacaaggagactgaggagttcattgcagatgtgcttggggtcgaggtgtttaggcagactattgctggaaatatccttgtggggagttactgcgccttctctaacaggggtggtttggttcatccccatacatccgttgaagaccttgacgagctctccacgctcctccaagttcctcttgtcgcaggaactgtgaacagaggaagcgaggtcattgctgcaggcatgacattgaacgactggactgccttttgtggctcggacacgacagccaccgagctctcagtcatcgaatgcgtgttcaagctgagag

SEQ ID NO: 7569 - DNA, 447 bp, Zea mays
  Clone ID: LIB3279-046-P1-K1-A11
aaggctgctccttctaaggagccaaaggcaaaggatgtcaagaaggaggctccaaaggaggcccccaagccaaaggtggttgaggcaccagcagaagaggaagcaccaaagccaaagccaaagaatcctcttgacttgctgccaccaagcaagatggtccttgatgactggaagaggctatactcaaacacaaagaccaacttccgagaggttgccatcaaaggtttctgggacatgtacgacccagagggctactctttgtggttctgtgactacaagtacaatgatgagaacaccgtctcctttgtgaccctgaacaaggttggtggattcctgcagcggatggacctgtgccgcaagtacgcctttgggaagatgctcgtgataggctctgagccacccttcaagctgaagggcctttggctcttccgtggccaggatgttccc

SEQ ID NO: 7570 - DNA, 439 bp, Zea mays
  Clone ID: LIB3279-046-P1-K1-A12
atccgagcttacttctagggttcttggccccgctccaccgtcgcccatggcagacgatgccaaccgagcggccttcatggagctgcagtcccggatgatagataccaccgcgaagatcaagcagttacaaacccaaatgcgttctaaagaaggggaaaagaagcgtgcctaccttactttggaggaacttcgccagttgccagatgataccaacacctacaagactgtcggaaaagtgtttattctggagccaaagtcagttctgttcaatgagcaggagcaaaagcttaatgacagtgagagtgcgatagcttcaatgcagacatccaaagactaccttgagaaacagcagggcgaagtggagaacaatattagggagctgcttcaacaggacccaggacttgcgcgtcagatcctctcaatgaccgttcaatgagag

SEQ ID NO: 7571 - DNA, 445 bp, Zea mays
  Clone ID: LIB3279-046-P1-K1-A2
actagcagctagctctgtttccgctctgcgcggcgtcccggccgacgacgacacgatgcctctctcggcagcttattccatcctcctcctcctccatgccctggtctccctcacccttgtcctcggcgacatgacgagcacgacacctgccgccgctgtcccggccgcggtggacgtgaacacgacggcgttcaccatgcatgactctgctgcgtcggcgtctccccatggtgccgaaaaccttgagatgtactactgcttcctctgcacggagcgccacccgctgctgattcactactgccccatctactgggacgagtgccacctcaactgttgggatggtgacacgccgacctccatggacacggtgcaaggcaaggagtgctacgtcatgaagctgtacatgtccggtcgctacgtcatcgtccaacgcctgagctgcgac

SEQ ID NO: 7572 - DNA, 354 bp, Zea mays
  Clone ID: LIB3279-046-P1-K1-A3
cccacgcgtccgctgagggctccggctcctctcccgttctgatcgccaattcgccttccaccgcctgcaacccttcttcccttctcggtcatcgtgacggcatcacatgcgtcagcctgctaagtcttaagatggcgtcaaccaatggtcagacagaagctccagcaccatctgtccccaaaaatcccgctatggcatcatgccgaaagaagaaaacagatgatgttaccttccttgaagatctgaaagaccacatggatgagttcattcatgcctccatggatgagcacaagacctgctttaagaagacaattcagaagatgtttgggatgtcgaaggctgttgcagagagat

SEQ ID NO: 7573 - DNA, 102 bp, Zea mays
  Clone ID: LIB3279-046-P1-K1-A4
ggtgggaggggtggcagtttctatggcggccgccgtggcggcggcggcggccgccgtgtttttggcggtgttagaggcggaagaggccacagggggagaagt

SEQ ID NO: 7574 - DNA, 442 bp, Zea mays
  unsure (1)..(442): unsure at all n locations; Clone ID: LIB3279-046-P1-K1-A5
ccacttccacattggtagccatcgctggctggctccaagtactggactccctcctgagtcctcatctgaggatcgggaggaagcaatggcggctgagaggcagcggcagcagcagcagcacgagggcgcggtggcagcggcggagccgagcgtggcgcggcggctgtggcgcgtggtgcgcgccgtgctgtacatgctgcggcggggcctgccgtcgggccgcaagctcggcatggacctgcagctcctcctccaccgcggcaaggtcgcgggcggccggttcctcgcctcggcccagcacggccgccacgccgcgaccttctcgtcccacgctggcgccggcgccggcgcggggggttcgttctcgtgcggcgcgctggacccnagcgtgtgggtgcacgagccctcgcgcaggcggcgcgaggtcgagttcagctgcagc

SEQ ID NO: 7575 - DNA, 441 bp, Zea mays
  Clone ID: LIB3279-046-P1-K1-A6
cggacgcgtgggcggacgcgtgggtgtttcctcccttcccatcccccactgctcagcagtcagtcagcactcgccacccacacgcctccgctccgcccacggttccactccaactctccgatctccaggaatccgcggctgaggcgccggcgatggcggctcccatggtcgacgccgaatacctgcgccaggtcgacagggcgcgccgtcacctccgcgccctcatctccaacaagggatgcgccccgatcatgctccgcctcgcatggcatgatgctggaacttatgacctgaagacaaaaactggtggtgcaaatggttcgattagatatgaagaagagtacactcatggttcaaatgctggtttaaagattgctatcgatctccttgagcctatcaaagcaaagaatccaaagataacatatgcagacctgtatcagc

SEQ ID NO: 7576 - DNA, 371 bp, Zea mays
  unsure (1)..(371): unsure at all n locations; Clone ID: LIB3279-046-P1-K1-A7
acccgtacgcgacttgcgagtcgcgacccggtttcggcttcgcggtgagccgcgacggctccctaacgtaaacgccggcggcgcgcgcggaaagctgcacggcagcacgggcgcggcctcgtctccgcgcctgggctgcaagggcggcggctcggcgcggtgggaggcggggggcggccatccggtcaggtccagcccaggactccaggtgaccaggtcggcaggtccgcgctccgcaacggttctggcgttctgcggctgagtacagacgacagaggaattggggatttacattagcgatttacaaggcaacttggaagacaagcagggtttcatnccgcaatgtcagctccaacagcgatagcaacatg

SEQ ID NO: 7577 - DNA, 281 bp, Zea mays
  Clone ID: LIB3279-046-P1-K1-A8
tccacttccacattggtagccatcgctggctggctccaagtactggactccctcctgagtcctcatctgaggatcgggaggaagcaatggcggctgagaggcagcggcagcagcagcagcacgagggcgcggtggcagcggcggagccgagcgtggcgcggctgctgtggcgcgtggtgcgcgccgtgctgtacatgctgcgggggcctgcgtcggccgaagctcggatggacctgcactctctcacgggaaggcgggcggcggtctgctggcacacggcg

SEQ ID NO: 7578 - DNA, 326 bp, Zea mays
  Clone ID: LIB3279-046-P1-K1-A9
gcggaaggagtcggagggaaccgaaaactcagggtctcgaatttcctaggagcggaggcgatggctgggaagggaggaaaaggattgctcgccgcgaagacgacggcggccaagtcggcggagaaggacaaggggaagaaggcccccatctcacggtcctcccgcgcgggcctccagtttcctgttggacgaatccaccgtcagctgaagcaaaggactcaggcaaatggccgcgttggtgccactgcagccgtctactctgccgccatcctggagtacttgactgccgaggttttggagctggccgggaacgctagcaaggatct

SEQ ID NO: 7579 - DNA, 449 bp, Zea mays
  Clone ID: LIB3279-046-P1-K1-B1
cccacgcgtccgggcgctgcagatcatggagaagctggagatcgtgcgcaagatggtgtcgagcgcttgcggcggcacccctcttgacagaggcacggtgttcgccaggaaggtggacctcaccggtgtcgacggtcaggcgctcgccggccacggcctcgggagcaacttatcagtggtgatcttcgtgctgctccacaacgtcttcagcaacgtcaagtcggacatcgatggcatggtctctgcttccactccttattagccatcgtcacctagctacctacgtgtctacagatttgcagtcactagcctcaagtctccaagtgattggatctctgctacagtgctcttactactgccctagcgcaaatcttgatgtgtccgttctagctactactagtatctaccttggttatgttggatcatgcatgtgattgggttctgctagt

SEQ ID NO: 7580 - DNA, 443 bp, Zea mays
  Clone ID: LIB3279-046-P1-K1-B10
cagcactgaacacttgattgattcagtaggtagctagctagctgaatcacaatggatcctaccaagttccgtccgtccagtagccacgacacgacggtgacgacgacgaacgcgggcgctcctgtgtggaacgacaacgaggcgctgactgtggggcctcgcggtcccatcctgctggaggactaccacctgatcgagaaggtggcgcacttcgcgcgcgagcgcatcccggagcgcgtggtgcacgcgcgcggggcctccgccaagggcttcttcgagtgcacccacgacgtgacgtcgctgacgtgcgccgacttcctgcgcgcgcccggcgtgcggacgcccgtgatcgtgcgcttctcgacggtgatccacgagcgggggtccccggagacgatccgcgacccgcgcgggttcgcccggaagttctacacccgcgaggg

SEQ ID NO: 7581 - DNA, 391 bp, Zea mays
  Clone ID: LIB3279-046-P1-K1-B11
acttgatataactgaagatgaagcttatttccatacaaggcagagtgcatttctatatcatcttggagtgcagactatgccgaaaactcaccattgcttgaacatgagattgacagtagaatatttcaagtctggatcaagtcatgtggatcagttaaatgaccagaagcttgaaagtcctgccttacatcactatgtaatgttttccaggaatgtacttgcagcttccaccactatcaattcaacggttatgaactcccaggattcggaccacatcgttttccatgtattcactgatgcacaaaacttttatgcgatgaagtattggttcgataaaaattcatacttggagtcgactgtacgcgtaactaacattgaggacaaccagaag

SEQ ID NO: 7582 - DNA, 443 bp, Zea mays
  Clone ID: LIB3279-046-P1-K1-B12
cttcctccgtgatccaagttctagcagcgcagcgctcggtttcgacaatatgtcggggcgcggcaagggcggcaagggtctgggcaagggcggcgccaagcgccaccgcaaggtcctgcgcgacaatatccagggcatcaccaagccggcgatccggaggctggctaggaggggcggcgtcaagcgcatctccgggctcatctacgaggagacccgcggtgtgctcaagatctttctggagaacgtcattcgtgacgccgtcacctacaccgagcacgcccggcgcaagaccgtcaccgccatggatgtcgtctacgcgctcaagcgacagggccgcaccctctacggcttcggcggctaggtcgcttcgtcatctggtggcgaactgcatgtgtgtcggcggtggtcgtgttgtgtgcctaatctagtgtagtccgttctct

SEQ ID NO: 7583 - DNA, 452 bp, Zea mays
  Clone ID: LIB3279-046-P1-K1-B2
attcccccagaccagcagcgtctgatctttgctggcaagcagctggaggatggtcgcaccctcgcggactacaacatccagaaggagagtacccttcaccttgttctccgcctcaggggtggtatgcagatctttgtgaagaccctgactggaaaaaccataaccctggaggttgagagctcggacaccatcgacaatgtgaaggcgaagatccaggacaaggagggcatccccccggaccagcagcgtctgatcttcgccggcaaacagctggaggatggccgcaccttagcagactacaacatccaaaaggagagcaccctccaccttgtgctccgtctccgtggtggtcagtaagtcatgggtcgtttaagctgccgatgtgcctgcgtcgtctggtgccctctccatatggaggttgtcaaagtatctgctgttcgtgtcatgagtcg

SEQ ID NO: 7584 - DNA, 453 bp, Zea mays
  Clone ID: LIB3279-046-P1-K1-B3
gaaaactagaaaaggctcctcccgaccgcaacgcccctcatctccctcgaccccgacatgcccgacccgatggcgcccaaggcggagaagaagccagcggagaagaagccggcggccgaggagaaggcggagaagacgaccgcagggaagaagcccaaggccgagaagcggctgcccgcgtccaagtcctccggcaaggagggcggcgagaagaaggggaagaagaaggccaagaagagcgtggagacctacaagatctacatcttcaaggtgctgaagcaggtgcaccccgacatcggcatatcctccaaggccatgtccatcatgaactccttcatcaacgacatctttgagaagctggccggcgaggccgccaagctggcgcggtacaacaagaagcccaccatcacgtcccgcgagatccagacctccgtgcgcctagtcctccccgga

SEQ ID NO: 7585 - DNA, 415 bp, Zea mays
  Clone ID: LIB3279-046-P1-K1-B4
gcctgcaaaaaccacttgcaaaccacacaaaccgaaaacgccagctcccctgcctccattgttagcaacttttcccttctgtcttcccatcacagtcacccttcttgcccccacgcagccgagcgtgcctacccctcctcgacccttctctggggccgccgttggacgctcatggagaggagtcgtccgggcgccgcgccgacaccatcgccagaggaggaggtggcggcggagggccatgcgcatggtgacgatgtgacggggcatgaggaggaggcgacgccagtggtgctcaagaagggcccgtggacggcctcggaggatgccatgctcatggaccacgtccggcaccacggcgaggggaactggaacgcagtgcataggatgaccggcctgctgcgctgcggcaagagct

SEQ ID NO: 7586 - DNA, 265 bp, Zea mays
  Clone ID: LIB3279-046-P1-K1-B5
gaagaaaacgataggctcagagctattctcggtgagtggagtgctcgagccgcaaagcttgaacgtgcattggaggcagagcgggtgtcaaacgtcgaattgaggaaaaatattgcaaagtttagaggtcatttgtacaaagagcaggaggcctgacttcggtatgttatagctggttccagaattgtacctaaggcacctgactaaaggcacaatttttggatatagaagggtatctcggtctggatccaaaatataaatgtac

SEQ ID NO: 7587 - DNA, 421 bp, Zea mays
  Clone ID: LIB3279-046-P1-K1-B6
ggaccacaagagcaaggaggcccggaagatgcacgcctgcggccacgacgcccacaccgcgatgctgctcggcgccgccaggatcctccatgagcgccgccacgacctgcagggcacagtagtcctccttttccagccgggagaggaggtcggcattggcgccaagaagatggtggaggcgggcgccgtggagaacgtcgaggccatattcgggttccacgtcaccgtaatgctccctaccggcgtggtgggctctagggccggcccgttgctggccgggtgcgggttcttcgaggcggtgatcaccggggccggtggccacgccgccaccccccacaacatcgtcgaccccgtggtggcagcctccagcgtcgtcctcagcttgcagagcctcgtctcgcgggaggcggacccgctggac

SEQ ID NO: 7588 - DNA, 238 bp, Zea mays
  Clone ID: LIB3279-046-P1-K1-B7
cggacgcgtaggattaactattatcgagtactttatagccaatggttctgagagggcagttgatgacattcttgatcattattctaagatctcggttctttcgagttttgagtatgttgagcctaatggtaaagacgttggaataaatgtgaggaaaaaagtaaaaaccatggtgggcatcataaatgacaaggagaaaataaaggccgtgagagataaagcagccagtaatcgggat

SEQ ID NO: 7589 - DNA, 445 bp, Zea mays
  Clone ID: LIB3279-046-P1-K1-B8
cccacgcgtccgggagactgctggaggagttatgacagtgctgatcccgaggaacaccaccatccccaccaagaaggagcaggtattctccacctactcggacaaccagcccggtgtcctgatccaggtctacgagggtgagaggacccggacacgcgacaacaacctgctgggcaagttcgagctctccggcatcccccctgcaccccgtggtgtgccacagatcaccgtgtgctttgacatcgacgccaacggcatcctgaacgtgtctgccgaggacaagacatcggggcagaagaacaagatcacaatcaccaacgacaagggccgtctctccaaggaggagatcgagaagatggttcaggacgctgagaagtacaagtctgaggatgaggagcacaagaaagaagtggaggccaagaactcgctggagaactactcctac

SEQ ID NO: 7590 - DNA, 447 bp, Zea mays
  Clone ID: LIB3279-046-P1-K1-B9
gccatctgcaattcagcagagaggaattgttcccttctgcaagggtcttgatgtcattcagcaagcacaatctggtacaggaaagacagcaaccttctgttctgggatcttgcagcagctggactatggcctggttgaatgccaggccctggtccttgctcccacccgtgagcttgcacagcaaatcgagaaagtcatgcgcgcgcttggtgattaccttggtgttaaggtccatgcatgtgtgggaggaacatccgtccgtgaggaccaaaggattcttggcagtggtgtgcatgttgttgttggtacacctggtcgtgtgtttgatatgctgcgcagacagtccctccgccctgataacatcaagatgtttgttctagatgaagctgatgaaatgctttctcgtggtttcaaggatcagatttacgacatcttccagcttctccc

SEQ ID NO: 7591 - DNA, 441 bp, Zea mays
  unsure (1)..(441): unsure at all n locations; Clone ID: LIB3279-046-P1-K1-C1
ggtaggcgagaagagtcgggtcgaggtagtttttcatcatcagataaaaaaagcgagtttgttgtacgaccattaggcgaaaaataagtgggaggggctgtgtagcccaaatttgtgatgtaaactggagacagacagcagctaaaaacaagcagaaattgctgagtgattttgtaactgatttgcagctatgctgaatgcagtttgcacgcgactaaacaggaatctaaaaaaaaaaaaaaaaaaaaaaaaaaaaaaaaaaaaaaaaaaaaaaaaaaaaaaaaaaaaaaaaaaaaaaaaaaaaaaaaaanaaaaaaaaaaaaaaaaaaaaaaaaaaaaaaaaaaaaaaaaaaaaaaaaaataaaaattttaaaggggggggcctttttaaagatccaaattttccttccccttgcttgcaaatttttattttttttttgg

SEQ ID NO: 7592 - DNA, 418 bp, Zea mays
  Clone ID: LIB3279-046-P1-K1-C10
cccacgcgtccgcctttttttttttttttggtgatgaacaaatattatagaacgtcctatatatatgtactagtaaaaaacatctcatatgaatcgaattaagcaaacaaagggggaaaacaattgaaggaaaggaatgaactttggtcagctagatgctatgagccagcagtgacggtcgatagattaggccaccatctgctcctgctccgaccactgcgcaaatatgtcgccggcgtggccgtccttgacaagagagttcacccacgagacgtctggctcggcgggagccggcgcgggggccggggactgcccacggaacgcgaaagacgcggacttgcggaacttgtgcagctcgtcgccctggacgccccagtccagcctgccgtccggagacccccagtcggagagcatggac

SEQ ID NO: 7593 - DNA, 448 bp, Zea mays
  Clone ID: LIB3279-046-P1-K1-C11
cggacgcgtgggcggacgcgtgggccgcgccgccgtcaccgactcaccgtcgtctcttgctcactcgctcgttctctccatccagatcggagcgctcggttcggataggggcgtctcggaggtgaaggcgggcgcgtcagccatggcggacgaggagcacccggagaggagggaagaggcctccgagcttgccccctttgatccaaccaagaagaagaaaaagaagaaggttgtcatccaagagccttctgatgaagtggacaagcttgcagagaagacagaatcactagcagtcgcagaacctgctgaacttaactttactggaatgaagaagaaaaagaagaagcaggtggatcttgattcatctattgatgaccttgtagatggggaggacactcaaggtgatcaagttgtagaggaacaaggggacggtattgtgcttggaggt

SEQ ID NO: 7594 - DNA, 438 bp, Zea mays
  Clone ID: LIB3279-046-P1-K1-C12
ctccctgaagatcatttctcaagtgtacatcgagcagtgcctatatttggactctttagaccttgcacctgtattggcctatttgagtttggctacatgtaatgaccttccagatgtcaatcaaactggaagctgctttgagtcgtcaacggcaaatcagtcactggatcatctgctcaattgtttcgacaaacttctaaatggaactgttagcaatccaccatcgaaattgaacaagaatggaaaagctttacgatcaaaagaccagcagaaaggagcatctgaagcgaaaggcacatttaatgtgattatgctgggtgcttcaattctgaagtttatcattgacacaaatatgaagccactcaatgatgacaaaataaggtgcctcaaatttgcatcatcctacataaaatatgcagtatcatccataaaaaagca

SEQ ID NO: 7595 - DNA, 450 bp, Zea mays
  Clone ID: LIB3279-046-P1-K1-C2
cctcaccttcctccttctcccagctgcggcgccaccctcgggccgtccgccgtcggcggccacgaccctggtgtaatctgctccatacgtggcggcgccagcaaaagccacgctgctgccagtgccagccatggatgcagtggcggccagcgacaccgtactcctccttgccgccgtagctatctccctgctcattactgccactttctggagcaggcatcgtcgtcagggcgaagcgccgagcccgccgtcgctaccgctgctgggccacctccaccagctcggcaacggaaagccgctgcaccactcgctggcggcgctggccatcgcgcgcggcaccgggggcgccccggcgccgctcctgtcgctgcgcctgggcgcgcggcgcgcgctgctggtgtcggagcacgccgcggccgaggagtgcttcacggcgcacgacgccgcgct

SEQ ID NO: 7596 - DNA, 452 bp, Zea mays
  Clone ID: LIB3279-046-P1-K1-C3
gaaaaggcctcgttgatacattccgtaaacaacacccgaatgcagtggcctacactttctggggtgaaaaccagcgcattaccaacaaaggctggagactggattactttcttgcgtcagagtctattgccgacaaggtccatgattcttacactctgccagatgtagcgctcagcgatcacagtccaattggccttgtgctgaagttgtaggcacttatacatctctcagctatttgacaactaaaccaggaagttttaacatcgtcctagataaaagacttgtagaaagattttgcttatgtaggctgaaaactattcaaactcgggtggtacttcgcgtggtctcctgtcgtctgtggaggttgtggatagactattcacgttgtgttcgagacgttaaaacatagcctagaacaattagctgatattctatagcttgtgaatacatct

SEQ ID NO: 7597 - DNA, 427 bp, Zea mays
  Clone ID: LIB3279-046-P1-K1-C4
agcgactcccaacatgtcggccattacaattcacatgaaattgaatacaggaaagctgtagatgatacgttgaagaaggctcttgttaccttctgccaccgaagccaactatatgactcaaatatggctggtgaccaggagtataagatagcacactcagtgtgcagtctacacaatgccgcagccaattcaaatgagagcttaagaagggttgctaacagtcctagtgatcacttcttcttgccaagttctaaggatcatgatgaatctcgggaacccagttctctaattgaggatcagaggcgccacatctcacatccaccctgcatggagcctaaaggagtccttggccaaatcctgtttgatgtttgtgttccaaataatgttgaaggatgggacattaagccaacagtgtccccgaatggac

SEQ ID NO: 7598 - DNA, 448 bp, Zea mays
  Clone ID: LIB3279-046-P1-K1-C5
gcggcggcggcggcggctcctgctcatggcaggagctcaatgcggcacaggaccgcgcgccgggccgctcctcctcgtcctcgtcctcgtcctgtgcggcttccttgtgctgctcgtgcctgcggctcggcgcggggacgacgacgagacggaggagttccccgtcgcgtcttccgcttcgtcgtcgtcgtggcactggcacgccgctgatgggcgccgccgtgccctgccgcggccggccgccgcgacgtggccgtggcgccccgcccagccccgggcgcgcgggaggtggaactccgcggggcaggacggcaagcacgaggtccccagtggccccaacccggactccaatcggtagccgtagccagagaggtgggtggtcgtgaactccgatccgccgtctgtgtttgtttcggcgaacggcgaccaagctccctccctgtcccct

SEQ ID NO: 7599 - DNA, 449 bp, Zea mays
  Clone ID: LIB3279-046-P1-K1-C6
gaagacgttaatacagaccaggcttgtgaggtggttagctttccagatgactgtagcaccattgatttcacaaattcatcaacacaagacattgcaggtggagacgaacaagtaaatctggatgcatatgatgatagcgattggttgcataggaatgagacattccaggcaaacaacattgtcacaagtaaagaccttctgacaccagcagaagattatctgtgttcagccaaatggacataattagtgctcttttgcaaaagcattttggattttccagtctcaaagcattccaaaaggaagtcttggatgcttggtttgctcacggagattgtgttctcctagcagccacaagatcagaactttgttggtgcaaaatctaaactcaccggatatcattccaactccactatgatataaaaggatggcgttcatggcatactattaca

SEQ ID NO: 7600 - DNA, 444 bp, Zea mays
  Clone ID: LIB3279-046-P1-K1-C7
gcaagatagtgccgctaggggtttctctcatgagttggcagtcatgtgccaaatatcaggaatggattttgctcttgagcctgtgctgcctccagtgactgcaaggccagaacatgttgagagagcgttaaaggcacgttatcaagatgcaatgaacatactgaggccacagggaagggaacttgatctgctgatcgtaatactgcctgacaacaatggttctctttatggggatctcaaaaggatctgtgagactgaactcggattggtctcccagtgttgtctgactaaacatgtttttaagatgagcaagcagtaccttgcaaatgttgcactcaaaataaatgttaaggttgggggaaggaatactgtacttttagatgctttgtcaaggagaatcccccttgtcagtgacagaccgaccataatatttggtgctgatgt

SEQ ID NO: 7601 - DNA, 251 bp, Zea mays
  Clone ID: LIB3279-046-P1-K1-C8
gcatgatcgtgccgctaggggtttatcacatgagttcgcagccatactccatgtgtggggaatgctttttgctcttgagcctgtgctacctccagtaactgctacgccataacatgtggagagagcgttaaatgcactttatcaagacgcaacgaacataactaattccacattcaaggtaactttgaacttttatcataatactgccttacaacaatggttatatttatgtttatcacaaaaggtatctt

SEQ ID NO: 7602 - DNA, 389 bp, Zea mays
  Clone ID: LIB3279-046-P1-K1-C9
gtccgccgtctcggtccgcacgtcccccacggccaccgtaaccaccaccacctccactccatccccgccaacgtccggatccaccgccccgatctcccgcaccccgccgcggggccccaggagcgcgccagggacatcttcgtggtcgtcatcgggctcctctttggcgtcgcctgcggagcgctcaccgctgcttccgtgtacctcgtctggtccatggtcgccggagctgctgcggtctccgcgtacgacgagctctacgacgacgaggacgaggcgtccgacatcgagagccccaagaaggtcggctacgtcatcatccaggagctcgaggtcgatgaaggcggtaagaactagggccggatttggtggcgctcgtgctcccggga

SEQ ID NO: 7603 - DNA, 451 bp, Zea mays
  Clone ID: LIB3279-046-P1-K1-D1
gtcaagaatgaattcaagtcaatgtttctgagctttgccagtgccaagaatgccgccatggagatcccacctgaaaactacctcattgtcacaaaaaatggaaatgtgtgcctgggcattcttgatggaacggctgccaagctgagtttcaacgtaattggagacatcacgatgcaggatcagatggtgatctatgacaacgagaaatcgcagctgggatgggcgcgtggggcatgcactaggagcgccaagtctattctgtcttcctttccctgagctcagttctatgtacttctgatagagtttaagaaaatcactatatcaaacctcctcgcaatgcatgaatttcctaactgaagagggagggagagagagagagagaatgttcctgtttatgtagagatggagtccaaaatttgtgtgcctgatgagttcttccccatatgatatt

SEQ ID NO: 7604 - DNA, 235 bp, Zea mays
  Clone ID: LIB3279-046-P1-K1-D10
tctgcctgtacaacccgcacggcaacgtgcagggccagagcccctattagcttgctgaggtcatcaggtcatagcgacggagccccactgtcgccggcggcggcagcggagtacgtaggttcatcactcttctctagttcggtcacggaaaggctgttttgtggtgtgatccggtggtgttcttggtgttgttgagaactgctttggtttggtgtatcagcttttgttgccgggt

SEQ ID NO: 7605 - DNA, 447 bp, Zea mays
  Clone ID: LIB3279-046-P1-K1-D11
gctagttcagcatttgcttgttggtgaaaaggatgtcaggcttctggttgatctcgaaaagaatatcattgcagaaggtaccagaatttgaggaggcagcatttagtgctcctttgaacaaagttgtacgatgtaagacaaaatttggatggcatctagtgcaagttcttgctgagagggatcaatgcgtactgcaagacattgacccagaagagcttcactcaaaattgcaagaccctagttttctcgaagaagctcaattgattgatgttcgggagcctgatgaagtggagaaagcttcacttccaggcttcaaggttctaccgctccgccaatttgggacctggggaccagttatgacagacgagtttaatcctcaaaaggacacttatgttctgtgccaccatggcatgcgctcaatgcaggtggctaaatggttgcagtcac

SEQ ID NO: 7606 - DNA, 362 bp, Zea mays
  Clone ID: LIB3279-046-P1-K1-D12
atggtttcctatgttactttgcagattattttatatctaaaattcctactaagtgcaacgatccaaaaacctgatatgtgtaggaattataatgctactagctttgatgttgcgcttaaacctcaaattatatttgatggttcaaactacaagagatggcgtgcaaagacgagtttatgactgacaaccatgaacatatatcacgtggcaggagataggcatgaagggatgacttccaactctttcgaggagaagtcattgaggtcgtcgataacctttttagaggtgccatgataagcgctctcgctgaaaatatagttggttcttacatgcacttgttcattacccaagagatgtgagat

SEQ ID NO: 7607 - DNA, 450 bp, Zea mays
  Clone ID: LIB3279-046-P1-K1-D2
ggaaaaaggtgtctgaacatgttagtagtcggtcagaaaaagattgtattgcaagattgataaggctaccttttggagaacagttcatgggacacaaggaggatagaatgaggtttgagaatactgatgacaatactgatgagcctggagcaaatgtctcaaaacgactacgtctcactccactagcagatgcaagcaatccgattatggctcaggttgcatttttatcagccattgtgggttccgatgttgcctcagctgcagcgcaagcagctatttctgcccaatcccgtgttgaccttaatgacggcgagattgaaacttcaataaatagcattaagcaagaagaatcatctcacacaaatgggctctcagccaacgtgttactgaaagaggcagctgctaatgcacgggcacaactcgagaaggaaaggaacagcatagagcaat

SEQ ID NO: 7608 - DNA, 444 bp, Zea mays
  Clone ID: LIB3279-046-P1-K1-D3
gcgaattggtattggtatatgttatgacatccgtttccaggaattagcaatgttgtatgctgcaagaggtgctcatttgttatgctatcctggtgcattcaatatgactactggaccactgcattgggagttgctgcaaagggcaagggctacagacaaccagctgtttgttgcaacatgcggcccagctcgagataccagtgcaggttatgttgcttggggacactccactcttgttggaccttttggagaggtgattgcaacaactgagcatgaggagacaactataatagcagaaattgactactcactgattgagcagaggaggcaatttcttcctctgcaacaccaacgccgtggcgatctctatcagctggttgatgtccagaggctgggttctcattagcacagggacgaagcaggaagacagttgactctgcaggc

SEQ ID NO: 7609 - DNA, 445 bp, Zea mays
  Clone ID: LIB3279-046-P1-K1-D4
cggacagcttgcgttcaagaagcttgcaactgcaacgctggaaactttgatgccaaggattgaaggcaagggtgagtttggacaggcacggtggcgactggtttatgctccgcagatcccaagtttactctctgtggatccaacagttgatccgctaaaatctctggcaaacaatatctcttttgccacggaggtcgaagtgcagctcggaaaacgccttcaggcctctgtcgtcaggcaaatgaaagattcagaaatggcgatgcagtggacgctgatatatcagctaaccagtaggctccgtgttctcttccagtctactccatccaataggcttctcttcgagtattcagcaacatcacaggaatgattcattttttgttattgcgcacagcaagaattggtgtagcagctgcgtgtacaaagataggtggcctgataatcg

SEQ ID NO: 7610 - DNA, 392 bp, Zea mays
  Clone ID: LIB3279-046-P1-K1-D5
ctcacggccgtagacctggtcaccaacacgctgaacgtaacgattccaccttccaaaacgatgacggtgtgaacgctaagctccgtggaccaacacactattgctctccatagagcaccaccctgcatgttcctcatactccccacctatgtggcgagtaaagccaggagggtagcactgcaccaccctgtgacactcattgcgaaacaaccaccgaaacaaaatcccatggtagatcaagttgccaccaactgatccagaaactactcaccaatgatgaatatgggagacttggcgtgaacacagaccctatggctacggaacttgtttttctgcacccagtgactagactgctccgaccgcagtgatctattctattaacacgctgtgct

SEQ ID NO: 7611 - DNA, 285 bp, Zea mays
  Clone ID: LIB3279-046-P1-K1-D6
cctgtacacgcctccgccaccctaccaactactcaataaccctagctaaaccccacgccggcggggggaccttcttcggcggcaggatggacaaccctaagggaaccaaatttcccggccttcccaaaggccggaatgccctcgttaaggtggcccttcttcgcggcgccgggctttaccccgttcttaacaagttctacaacgttgagggccgacaccgggccattgttttcaaccggcttgaggggatcaaggacaaggtgttccccgaaggaacttacctta

SEQ ID NO: 7612 - DNA, 445 bp, Zea mays
  Clone ID: LIB3279-046-P1-K1-D7
cccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggcgggtacggtggtggccgtggaggcggcggctacggcggtggcgggcgccgtgatggcggcggcggctacggcggtggcggcggctacggtggtggcggcggcggctacggtggtggtggcggcggctacggcggtggcaaccgtggcggcggctacggcaactccgacgggaactggaggaactgagcggtggggcccgcgcggccaagttatcctgttcgctaccgtgttgtttaccctagtccagagtgtttatcttcgttcgtctcgtgtttgttgttgcccatctgtgtttttga

SEQ ID NO: 7613 - DNA, 425 bp, Zea mays
  Clone ID: LIB3279-046-P1-K1-D8
ggatcccacaccaccggtctctctcggggagtgtaatccagcgagcgttgagttgaaagccgcgcaagtggagatgagtactctgaagaaatccgacaagaaggctgccctcgacttcgcagcatggagtttcaatgtcaccacatcggttggactcatcatggtcaacaaggccttgatggctacgtatgggttcagtttcgccacaacattaaccgggcttcattttgtgactactaccttgatgactatcttatttcgttggttaggcctgagtcagccatcccacttacccctagcagatctagttaaatttgtgatattttcgaacttgtcaattgttgggatgaatgtgagcttgatgtggaactctgttggcttttatcagatagcaaagctgtgcatgatacctgcatcatgtcttc

SEQ ID NO: 7614 - DNA, 442 bp, Zea mays
  Clone ID: LIB3279-046-P1-K1-D9
gcacagaccactacttgcgattcatgcttcggaagaaactacaagacattaagaatgatgataagatgattcaagctgagggtgtggagtctctttctgaatatgagcttcgacaagcatgtcgtgagcgtgggcaccttggtttgttgtcaacagaggagatgcgtcaacagctcagagactggctggatctatcactcaatcattctgtgccatcgtctcttctaatactctcaagagcttttactgtatctggtaaaatgaaacctgaggaggccgttgtagcaaccttatcttccctgccagatgaagttgtcgatacagttgggactgtactgccttctgaagattctgtttcagagaggaagagaaaattggaatttctggagatgcaggaagagcttatcaaggaagaggagaaaaggcaagagaaagaagacaa

SEQ ID NO: 7615 - DNA, 323 bp, Zea mays
  Clone ID: LIB3279-046-P1-K1-E1
gaatggagcaacgaaggtaagcaatgtgaggagagatggacagccattacattaatttatagagtcgacgatgatgatgctgcagccaaaagaaagatgaaaagtgaggaagaaggcaggcagctgcacgccgccgacagccggcggctattcgcagtcaacagatgagacgaacatgcgtcacctcaatcgtcatattttcagtcacttaattaattacgtatttagtataatataatacctacggtacggctgacgatgccaaggtctttccgttcaaaatatcatttccttccgaatttattaatcaagctcttttcatc

SEQ ID NO: 7616 - DNA, 444 bp, Zea mays
  Clone ID: LIB3279-046-P1-K1-E10
gggcaggaagaaatcgagcctcactcgatccatcgcctcgccgcagcacacacgaggccggcggcgccatggccatgaagctggacatgtccgcgctcgagaccaacttcgccaacctgaccgcctccgccggcgacgacacgtacttctccgccgaggcccccgacgtgccgtccatggtgctccccatctgcgacgacttcgacggcttccaggcggccaccaaggatatggtgaagaataagaaggggacgaccacgcttgccttcatcttcgacaagggcgtcatcgtcgccgctgattccagggccagcatgggcggttatatatcctcacaaaccgtgaggaaaattattgaaataaatccttacatgctggggacaatggctggaggtgctgctgattgccaattttggcataagaacctaagaaccaagtgtcgtc

SEQ ID NO: 7617 - DNA, 423 bp, Zea mays
  Clone ID: LIB3279-046-P1-K1-E11
gcctgaaagacctgtacaagtcctttgtttctgagtaccctatcgagtcgatcgaagatccatttgatcaggatgactggagcacttatgccaaactcactgatgagattggacagaaagtgcagattgtaggagatgatcttctcgttaccaaccccaccagggtcgccaaggccatcaatgagaagacctgcaatgctctcctcttgaaggtgaaccaaatcgggtctgtgaccgagagtatcgaagctgtcaggatgtccaagcgcgccggatggggagtgatggcaagccacaggagtggcgagacagaagacaccttcattgctgacctctcagttggcctgtctacgggccaaatcaagacgggagctccttgccggtctgagcgcctggccaaatacaaccagctgcttatgatcg

SEQ ID NO: 7618 - DNA, 442 bp, Zea mays
  Clone ID: LIB3279-046-P1-K1-E12
tctcttcattcgttcccggcctcaccccgagccagtcgtctcgctagggtttcgccgccgccgccatgcctcgccgcagctcaggaaggtctgccccacgcccagctccccgtgctgcttcactgaggaacccgccacagccagcacgccaggctcctcctccagctcctgttcgagatggtggtggctccatgtttggaggaattgggtccaccattgctcaaggtatggcgtttggcacgggtagtgccatggcacacagggctgttgactctgtattaggtccccggaccatccagcatgagactcttgccacagaagctcctgctgctgcccctgctgctccagcgatgaatgctgatgcttgcagcttccattctaaggctttccaagattgtctcaacaactatggcagcgagatcagcaagtgccagttctacct

SEQ ID NO: 7619 - DNA, 448 bp, Zea mays
  Clone ID: LIB3279-046-P1-K1-E2
gtgattatgcccaaaaaaaaaaacagcactagtagctattaaccaatatctcagtgtacgttgagtgacaccaaccaactcatggatgaagacatcaattacgacagataccattcgtccaaacatcctaaacattatcatcgtttccaagagcgctgttcttttttatctgaagacggcaaggcaaaggaagcagatgctaccagcaggtctcaaattacgatccgagatctaaaacatgagcaccacaacatatagcatgaacacaaggcaggaagaggaagaacgagcccaccggatggatgcggatccatcagtcgtcgcgcttcctgagcttgtcgacgcgctgctgcatctgctcgagcctgacgacgagctgggtgacggagaagaggatccagtagaagagcagcgcggcggctatgaggagcgcgttccgctgcgactt

SEQ ID NO: 7620 - DNA, 446 bp, Zea mays
  Clone ID: LIB3279-046-P1-K1-E3
caaagctctcaaagataggctgatggcaaagaacgtggcagaggaaattgcagagaagctttgcgaatctgtcgcagctagccttgagggcaagaagctaggatctttcactagaatatcatcaacagtccagacagctatggaggatgcgcttcttcgtattttgaccccaaggcgctctattgacatactgagggatgtgcacgctgccaaggagcgtgggaggccatatgttattgtttttgttggggtgaatggagttggcaaatccaccaatcttgcaaaggttgcttattggcttcttcagcataacctcagtgttacacttgcagcatgtgacaccttcagatctggtgctgttgagcagctgagaactcatgcaaggaggcttcagatacctatatttgagaagggttatgagaaagatcccgcagttgtagcgaggg

SEQ ID NO: 7621 - DNA, 397 bp, Zea mays
  Clone ID: LIB3279-046-P1-K1-E4
cttctcctccccctcttaccaagtcctcttcgggttagggttacttagggttttgtggaggggcgatggcggcggctgatgtggagtaccgttgcttcgtcggcgggcttgcctgggccaccagcaacgagtcgctggagaatgccttcgcctcctacggcgagatcctcgactccaaggtcatcaccgaccgggagacggggaggtctcgcggcttcggcttcgttaccttctcctccgagaactccatgctcgacgctatcgagaacatgaacggcaaggagctcgacggccgtaacatcaccgttaaccaggcccattcccgtggcggtggcggtggcggcggtggctacggcggcggtcgcggcggcggcggctatggtggcgggcgccgtga

SEQ ID NO: 7622 - DNA, 386 bp, Zea mays
  Clone ID: LIB3279-046-P1-K1-E6
cccacgcgtccgcccacgcgtccgtcctgaggtaccactcgaccaagagcggggatgagctgaccagcctcaaggattatgtgaccaggatgaaggagggccagaacgacatcttctacatcactggtgagagcaagaaggctgtggagaactccccgttccttgagaagctgaagaagaggggctatgaggtgctgttcatggtggatgccattgacgagtattctattggacagctgaaggagtttgagggcaagaagctcgtctctgccaccaaggagggcctgaagctggacgagagtgaggatgagaagaagcgcaaggaggagctcaaggagaagtttgagggcctctgcaaggtcatcaaggaggtgctgggcgacaag

SEQ ID NO: 7623 - DNA, 430 bp, Zea mays
  Clone ID: LIB3279-046-P1-K1-E7
cccacgcgtccgcggacgcgtgggccaaatctcagttgtcgcctgtcgtcgtcttcgtgtagcccggcccgttccaaaacctccgtagccgccgccgccaccccggcgaccgaagatgatctccccggacgcagcccgcaacgtagtcggcatcatcggcaatgtcatctccttcggcctcttcctgtccccagtgctgacgttctggcggatctacaaggccaaggacgtggaggagttcaagccggacccttacctggcgacgctgctcaactgcatgctctgggtgttctatggcatccccgtcgtccaccccaacagcattctcgtcgtcaccatcaacggcatcggcctcgtcatcgaggccgtctacctcactatcttcttcctctattccgacagccagaagcgcaagaaggcgttcgcgatc

SEQ ID NO: 7624 - DNA, 441 bp, Zea mays
  Clone ID: LIB3279-046-P1-K1-E8
gcatatttttaaaactagatgagtctgattatgcatagaagagataagacttattttatcgtggttgttagacgagacatggtggacaaatatatctgtacgtgacgcacgacacacgaagcttgagctgagctgagactcaaataagatcattaacctctccgtgctattatcgaccccaaacatcttgtttgacttggatcccgaaggaattcgtactgttatcaccaccaaacatcttgtttgacttcgctttgttgctgaagcgtccccaatcctctgggactcaaatgtgatacaattactagtctcaggaggctagtaaacacatttatacatcagatgatttcagatctgcttaaacgagacaaacctataaaggtggcgatcaactttaagagttggtccacaactcgggacatatcatcagagtggggctga

SEQ ID NO: 7625 - DNA, 438 bp, Zea mays
  Clone ID: LIB3279-046-P1-K1-E9
cccacgcgtccggcagaatgggatcaccaatgataatgctacagaagatggttctgagcaagatttgcagatgcatcctttactgtttcattatcctcgagatgtggtttcgtcatatagtcatccggttcaaaatcttattaatcagtcaagaaaatatgatcttttcccctttgagaaagttcaagttgagagaagtaacaaccagactacaggttccaccaaaaatggtactgtaaatgctaacactatcgacttccatcctctcttgcaaagaacagaagttgatgtgcataatgatgtaccagaatatgatagtaaccttgattaccatcagtctgataataacatgagcaaagttccagtagatgaccagtcaacggctgggcaagcatccacaggcccttctgagagggagacaagtattgacttgaacat

SEQ ID NO: 7626 - DNA, 265 bp, Zea mays
  Clone ID: LIB3279-046-P1-K1-F1
tcagtaccgttctaatttgggggggggccccgttcccccactgctcacaatagtcacactcctcacccacacacctccctcctccaggggcactccaacacccgctctactgattattatcctcaagatctggttatgtcatatactcatcccgttaaaatcttataatcagcaagaaaatatgatctttcctctttagaaaattcaagttagagagaagtcccaccagactcccgttccacacaataatgctctgtaaatgcta

SEQ ID NO: 7627 - DNA, 445 bp, Zea mays
  Clone ID: LIB3279-046-P1-K1-F10
ggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggcgggtacggtggtggccgtggaggcggcggctacggcggtggcgggcgccgtgatggcggcggcggctacggcggtggcggcggctactgtggtggcggcggcggctacggtggtggtggcggcggctacggcggtggcaaccgtggcggcggctacggc

SEQ ID NO: 7628 - DNA, 433 bp, Zea mays
  Clone ID: LIB3279-046-P1-K1-F11
cgccgaaacgccgacctaaacgcccacaattcgcctctccgatccggcacgacaccgccgccgatccccatcgtcacggtagccatgtccaaccccggctcgtcgcccgcctctgctcaccacgaccacgaacacacccctctctgccgctcctgcggggcgcccaccacggcgccgaccccggcaccctggtcagggaccaccgactccccgccgccggcgtaccgccccatccgtctcccagctatcaacgcgcccaccaacacagccgccatagtcctctccccggtcccacagccgctccccgtgccttccgccgcaccgccccacgccttcctggtccctgccaagcggatcacctcaccggacgacatcgcccgcttccatgcctccgtccacggccttcacttcctcgggttcgtcgccgcgctgt

SEQ ID NO: 7629 - DNA, 447 bp, Zea mays
  Clone ID: LIB3279-046-P1-K1-F12
atctgcaggccccgaagcgaggtggcagggcaccggtgccggccaagaagaagacggtgtgtattgcgctttcccgcgttcttgctcgaggtgtgggcggcgccatgatggaaatgtgtggtctgattgtgttgggtttggttgggtgcaggataaagtgacgaaccctctgttcgagaaaaggccgaagcagttcggcatcggcggcgcgttgcctcccaagaaggacctgcaccgattcgtcaagtggcccaaggtcgtgcgcatccagcgccagcgtctcatcctcaagcagcgcctcaaggtgcctccggcgctcaaccagttcacccgcaccctcgacaagaacctcgctaccaacctgttcaagatgcttcttaagtaccggcccgaagacaaggctgacaagaaggagaggcttctgaagagggcccacgctgagaatga

SEQ ID NO: 7630 - DNA, 396 bp, Zea mays
  Clone ID: LIB3279-046-P1-K1-F2
gccaaatgtgttgagattggtctacctcaactcatccttcttgtgatctttacaatgtacctgccacatgctgttcacatgctgaagtctatcttcgatcgatttgctgtcctgttcactatacccatagtgtggctctatgcatatcttctcactggtggaggagcatacaggaatgcaccaccaaagactcaatttcattgccgcactgaccgttctggattaattggtggcgcaccctggataagagtaccgtatccctttcagtggggtgctccaacttttgatgcgggtgaagctttcgcgatgatggcagcatcatttgttgctctcgtggagtccactggggccttcattgctgtctctaggtatgctagtgctacaccaatcccaccc

SEQ ID NO: 7631 - DNA, 431 bp, Zea mays
  Clone ID: LIB3279-046-P1-K1-F3
cggacgcgtgggtgagctcccattcatgattgatcttgattatcactcccaaattgaatatcgctggggaggagaaggtttaaggaagacattaattcgttgggcagctgagaaaaacaaagaaagtggacaaaaaatatttattgaggatgaagaatgctcatccacctactgcatttcatttaaagtgtccaatactgcagctgcacctcctgtgaaggagattaggaggacaatgagaatacaagcactgcgttgccatgttttgtacagccatgatggtagcaagttgaatgtaattcctgttttggcttctcgctcacaggctttaaggtatttgtatatccgatggggggtagagctgtcaaacatcaccgtgattgtcggtgagtgtggtgacacagattatgaaggactacttgggagcgtgc

SEQ ID NO: 7632 - DNA, 443 bp, Zea mays
  Clone ID: LIB3279-046-P1-K1-F4
gcacagacgagacgacagagatgaaggacggaacgtcgtcggggggaggggcgttcgctgcgggcagcgatccaaggcagccgtcgacggcgaagccatacgcgccgccgaagctgtcgccccaggacctacccatcgactatgcaggcttcctcgccgtcgccttcggcgtcctcggcgtcatgctccgctacaaggtgtgctcgtggatcgcaatcatcttctgcgctcagtcgttggcaaacatgaagaactttgagaacgatctgaagcagctttctatggccttcatgtttgctgttatgggtctggtgacgaactattttggccccgctcgtccaggcagtacaaagcgctaaactgcggaagaacatgtgctacattcttcataggactgtttggtgcttccgatagctttgccatcggtgctgacattatgtatg

SEQ ID NO: 7633 - DNA, 446 bp, Zea mays
  Clone ID: LIB3279-046-P1-K1-F5
gttccagaggggtttgaagaggaagcccatggcgctcatcaagaagctgcgcaaggcgaaaaaggatgctcctgtcggcgagaagccagagccagtgaagacccatctccgcaacatgatcattgtccccgagatgattgggagcattgttggtgtctacaatggcaagaccttcaaccaggttgagatcaagcctgagatgattggccactatcttgcagagttctccatttcctacaagccggtcaagcacgggaggcccggtattggtgccactcactcctcgcggtttatccctctgaaatgagttgttacccagatctgtagcgtcccaagggtgtccagtggcattgccctttcagctttgctgcttgtttcgaacaagttacatacccaagacattttgttctgtttccagcactagatttcaaagctaagcattgcat

SEQ ID NO: 7634 - DNA, 450 bp, Zea mays
  Clone ID: LIB3279-046-P1-K1-F6
atttacagctaaagcaaaatgctctatcaagttccttagaataaacaagccaatccctgtcacaactttctccatttgatagaattctattatagaatagtgaagaaaatcttctagaaaacctgtccttaggccccttctgaattgatagatctcttttaggtccgttttgtgctaaaatgtcaacttgtttaatattaagtgaatcccaatatcttggatcaaatatatcaggctgaaaagaatcaccagcatccgaagaaggattcaagtcttcgctgttattgcctatctgagtatttgtgttgtcagggagagcttcctcaacttcgacattattttctagaggatctatacgatcaatgtcaatattattatcaattgattgcccctggtcaggtgtcggattatcagatgacacttgtgactgttttgtaacaaacatatcca

SEQ ID NO: 7635 - DNA, 432 bp, Zea mays
  Clone ID: LIB3279-046-P1-K1-F7
ccccactgctcagcagtcagtcagcactcgccacccacacgcctccgctccgcccacggttccactccaactctccgatctccaggaatccgcggctgaggcgccggcgatggcggctcccatggtcgacgccgaatacctgcgccaggtcgacagggcgcgccgccacctccgcgccctcatctccaacaagggatgcgccccgatcatgctccgcctcgcatggcatgatgctggaacttatgacctgaagacaaaaactggtggtgcaaatggttcgattagatatgaagaagagtacactcatggttcaaatgctggtttaaagattgctatcgatctccttgagcctatcaaagcaaagaatccaaagataacatatgcagacctgtatcagcttgctggagtggttgcagtcgaagtgactggggg

SEQ ID NO: 7636 - DNA, 352 bp, Zea mays
  Clone ID: LIB3279-046-P1-K1-F8
tccccacttctcatcattcagtcagcactcgccacccacacgcctcctctcctcccgcggggccactccaactctccgatctccattaatcctcggctgatgctccgtctatggctgctcccatggtctactcctaatacctgctccaggtctacaggtctcgccttctccttcgcgcccttatctccaacaagggatgctcccctatcatgctcctcctcgcatgtcatgatgctgaaacttattacctgaatacaaaaactggtggtgcaaatggttctattagatattaagaatagtacactcatggttcatatgctggtttatagatagctatcgatcttcttgatcc

SEQ ID NO: 7637 - DNA, 434 bp, Zea mays
  Clone ID: LIB3279-046-P1-K1-F9
ccaagccccgccgctgctccctcgtacgcacgtacgcaccgcgtcgccctttatctgctcccgagggccgctggtcggctgctgaatcgtcgccgttgttgctgggactgcagcgttggcgggccttgtagcgaggagggggtgcggaggcgccgcgactgttcgcgggatgagcttcggcggcagcagctccctcgcatcaggtgcgaagaggccgttcgagtacgggagaacgcatgtggtgaggcccaagggcacgcacaaggccaccattgtctggctccatggacttggggacaatggagccagctggtctcaactactggaaactcttccccttcctaatataaaatggatatgccccactgcaccttcaagacccgtgtcagtgtttggcgggttcccctccacagcatggtttgatgttgctgatc

SEQ ID NO: 7638 - DNA, 428 bp, Zea mays
  Clone ID: LIB3279-046-P1-K1-G1
gcgtcctcgccctgctcatctacctcggcatcacgatacgccagtacctgagacacgaacaggcgggaccagcgatctccgtggacgcagggtcgtctacgtcgaagcgcagtctccgaaaattcatctctttcgccgatgacaagcagccgccaccgaagaaaaagcgggccatgagcctctcgagaagttcaatgccaacgatgccgatgagtaaccgtcctggggctgatattgatgtagaaagctagtgcttgtgtatacgtttttttacctgggatacatcatctttgggccaatctatgcgtccttcatatatattatgtataggaaattagagccaaaggctgtgtagtggattgtatttgttggttcttagcatcccaaccgcccacggttgacaagtcgtacgagtttggcagaactgt

SEQ ID NO: 7639 - DNA, 443 bp, Zea mays
  Clone ID: LIB3279-046-P1-K1-G10
ctcgctctcccgccgacgcgcacgtcctccgcgccgagcccagaggcagacagaggacgcggccatggcgtccatcccgtgcaccttccagctgagcacggcggcgtcgaggagggtgtcgccgcgggcggcggcgcaggggagaggccaaggaggagggggagcggtgctgaggacgccgctgctgggcgcggggaggcggggcctggggtggctgcggccgtcgcggttgagccgcgtggtgccgtcgagcgagagcgggcgggcgggtcccacctgctggttcaagttcggcaacaaggacgccgagggtgccggcatctacggcagccaggcccgggacgacttcgaccgcgacgacgtcgagcagtacttcaactacatggggatgctggcggtggagggcacctacgacaagatggaggcgctgctgaaccaggaca

SEQ ID NO: 7640 - DNA, 420 bp, Zea mays
  Clone ID: LIB3279-046-P1-K1-G11
cccacgcgtccgcggacgcgtgggacccaatctcccctacaccagaaaaattcccagttctttggtccgcgtcagagaggcggcggcgatgtctgggcgcggcaagggcggcaagggtctgggcaagggcggcgcgaagcgccaccggaaggtgctccgcgacaacatccagggcatcaccaagccggcgatccggaggctggctaggaggggtggcgtgaagcgcatctcggggctcatctacgaggagacccgcggcgtgctcaagatctttctcgagaacgtcatccgcgacgccgtcacctacaccgagcacgcgcgccgcaagaccgtgaccgccatggacgtcgtctacgcgctcaagcgccagggacgcaccctctacggcttcggaggctaggctaggcgcctcttctagtc

SEQ ID NO: 7641 - DNA, 447 bp, Zea mays
  Clone ID: LIB3279-046-P1-K1-G12
ttcacaagtggaatctgcccaatttgccggaaggaacggaagtgtggatcaagcgagacgatttatcaggcatgcagttgagtggaaacaaggtccggaagctggagttcttgatggcagatgccggagcacaaggcgcagactgcgttattactgttgggggtatacagagtaaccactgccgtgccacagccgaggctgctaagtatctcaatcttgattgctacctgatactacatacctccaagcttcttgtggataaggaccctggtttggttgacaatcttcttgtcgagagactagttggggcacacgttgatcttgtgtcaaaagaagaatatggaaaaattggtagtgtggctctagctgacctgctgaaaaaaaggcttctggaataagggaggaagccgtatgtgattcctgctggtggatcaaacatattgggaa

SEQ ID NO: 7642 - DNA, 435 bp, Zea mays
  Clone ID: LIB3279-046-P1-K1-G2
cccacgcgtccgccggactcgacaccttcctcttcacctcggagtccgtgaacgagggacaccctgacaagctctgcgaccaggtctcagatgctgttctggacgcttgccttgctgaggaccctgacagcaaggttgcttgcgagacctgcaccaagaccaacatggtcatggtctttggtgagatcaccaccaaggccaatgtcgactacgagaagattgtcagggagacatgccgcaacattggtttcgtgtcgaacgatgtcgggcttgacgctgaccactgcaaggtgcttgtgaacattgagcagcagtcccctgatattgctcagggtgtgcacggccacttcaccaagcgccccgaggagattggagctggtgaccaggggcacatgtttgggtatgcgactgacgagacccctgagctgatgcccc

SEQ ID NO: 7643 - DNA, 450 bp, Zea mays
  Clone ID: LIB3279-046-P1-K1-G3
gcctgcaggtgccgtaccgattcgccgtttcggcccaggcgtccgcccacgcgtgcggcccctgacaatggcagactctgggtattctaactgttgggccacagatctccagattataaatgaatgtagcagtttgcaggaatattctgttgaagtgagcataccctgctcgaatggcattgtatctagaagtggctctaactacaattgtcctgtgcattttacatttggcattgaattgatcagcaacgatccagtacagggtttagatatgtttgataagccagttgcctggaattgctcagaatcattccagcctcatgggaaccgcgatcctatcccttttgatctgctaaagattactagtgccttgatcgagcatgactcaaattggcattttgaaagactatctgaggaaatagatcttttcagagagttacctgatgacaa

SEQ ID NO: 7644 - DNA, 449 bp, Zea mays
  Clone ID: LIB3279-046-P1-K1-G4
tctacacaagcagaagccggactaggcccatcaccaagacccactgaaccctcgccgtttcgtcgcacccaccaacacgagagatgagctccggcggcgcggacaagcccggcagtggcggcggcgcggtgaagacgccgtcggacttcctcaagtccatcaggggccgccccgtagtcgtaaagctcaactccggcgtcgactacagaggtatattggcttgtctggatggttatatgaacatcgcaatggagcagaccgaggagtacgtgaatggccagttgaagaacaagtatggcgatgccttcataaggggcaacaacgttctgtacatcagcacgacgaagcggacccttgccgatggcgcgtagccggattggattccctctgtcctcctcccgtggtgtgccgtgcaacttcgaagccgttagcttcggttgcgctctgac

SEQ ID NO: 7645 - DNA, 425 bp, Zea mays
  Clone ID: LIB3279-046-P1-K1-G5
agccgcgatgccgccgccgcagcccccgcaccggcatgccaagacggactcggaggtgacgtccagcatggcggcgtcgtccccgccgcgtgcggcctactacgtgcagtcgccgagccacgacgacggcgagaacaagacggccgcgtcctccttccactcgtccccggcggcgtccccgccgcggtcggcgtccaggcactcctcctcctcctcccgcttctccgccagcgcaaagggcaccgcctccgtcgccggaggcgtccccaccggcggtggccggcgacgcggcagcgcgtgggcgaaggaggcggccatcgaggaggagggcctgctcggcgtggacgacggcggcggcggcgacggagacggccgcggcgggatccccaggcgggcgcgctacttgctcggcttcgcgggcgcct

SEQ ID NO: 7646 - DNA, 342 bp, Zea mays
  Clone ID: LIB3279-046-P1-K1-G6
tgttttggttttttttttttttttttttttttgcgggggggggcacttttccattcattaatacactacacttgctgtttcagtttcactgtgcaaaactcacagttaaatcatgcaaaaatgcgtaatagtacagtttttttttttaaaaaaaaccaactggtaataacaccctgttttgacataggccctgtgccataaaaagagtagtacttgcctttatgcccacttatttttcccccaactccattttttttttggaacaccccaaggggctggggtgataaaaagtttttatttcccccttttttccccaccaggagtgaatacactttttttttt

SEQ ID NO: 7647 - DNA, 384 bp, Zea mays
  Clone ID: LIB3279-046-P1-K1-G7
tctgcagcccccaactacccccagcctcggaaggaaccttccagaagcgcaagactctaaaggccgtcgccttcccattcttcctcgccgcgggggtcgcctgagatcacataaacaatggtgaaggctgttgctgtgcttggtagcagcgatggtgtcaagggcaccatctttttcacccaagagggagatggccctaccgctgtcaccggaagtgtctctggcctcaagcctggcctccatgggttccatgtacatgcacttggtgacaccaccaatggatgcatgtcaactggaccacactacaatcctgcgagcaaggagcatggggcaccaaaagatgagaaccgccatgctggtgatcttggaaacgtgacagctgga

SEQ ID NO: 7648 - DNA, 367 bp, Zea mays
  Clone ID: LIB3279-046-P1-K1-G8
cccacgcgttcgcccacgcgtccgtccacgcgttcgcccacgcgttcgcccacgcgttcggtgggggtttagctgcaccagccattgctgcaagatttggtgctctagctccaacactgggcacacttgtccctttcataggggctagtggatttgctgctatggctgctgcggcaggatctgtcgctggctctgtggcagttgctgcctcatttggagctgctggggctggcttgacgggtaccaaaatggcaagacgaattggttaagggaaagaatttgagttcaaacctattggtgataaccataatcagggtcgccttgctgggggcatactggtttctggatttgctcttgatgaagagga

SEQ ID NO: 7649 - DNA, 338 bp, Zea mays
  Clone ID: LIB3279-046-P1-K1-G9
gttagcttcggttgcgctctgactctgatgcatcccttcaaatctctgtacccgcgccccccccccacaaacattgtaccgagtctggagaaggtagaaacacaagtttctataatgcagcagcggagaggatccccagttcgacgcagaggggttccagcccttcctcttccaacaaggagagggctgacaggccagaatcagaacggtagatgtctggtatccgatcatccgggaacttcgtgaagcctccatactgttgcagcagtgaacgaaaaacataccctgagctatccgagaatgggattaagctgattgaagaggttctgaggtcaatt

SEQ ID NO: 7650 - DNA, 134 bp, Zea mays
  Clone ID: LIB3279-046-P1-K1-H1
gttagcttatgttgcgctctgactctgatgcatcccttcaaatctctgtacccgggcgggccccccacaaacattgtacagtaactggattcggtagaaacacaagtttctataatgcagcagcggagaggatc

SEQ ID NO: 7651 - DNA, 283 bp, Zea mays
  Clone ID: LIB3279-046-P1-K1-H10
ccgcaccctcttcccgccgcgccgccgccgtctctgcctccccgccgccgggcaagatgggtcgcgtgatccgcgcgcagcgtaagggtgcgggatccgtgttcaagtcccacacccaccaccgcaagggccccgcccggttccgttccctctacttcggcgagcgcaacgtgtaccttaagggcgtagtcaccgactagatccacgaccccggcctgcttcgcccttgctcgccaatgttactttccgtcaccctttttagtacatgctcttgattggtgct

SEQ ID NO: 7652 - DNA, 308 bp, Zea mays
  Clone ID: LIB3279-046-P1-K1-H11
cgaaaaagacgagtggtttgtcgtgaaggtcatacatttcgataaggagacaaaagagggtgaagttcttgacgaagaaccaggtgatgacaaagagagcactcaaaagaagtacatgttgcctatgtcttacattttttcattttcgaagaaaggggatccttcgagtgccccatattttggtcagggtatacaagttttagctgtttttcctggcacaacagcattatacagagcttccgtatctttattattttaagatggatagaccaaatgaattactaattctcatttattatcgtatttac

SEQ ID NO: 7653 - DNA, 89 bp, Zea mays
  unsure (1)..(89): unsure at all n locations; Clone ID: LIB3279-046-P1-K1-H12
ggggggggggagantntttctgttgtctttctatcttgtatattttatattttctcctaaataacttctcctggtcgtgttcatattta

SEQ ID NO: 7654 - DNA, 96 bp, Zea mays
  Clone ID: LIB3279-046-P1-K1-H2
cggacgcgtggggtcacatgcgtccttaacacaaggcgctgggcactcagatacctataaatacgcctcgaacagtgcccgtgagaggctagatca

SEQ ID NO: 7655 - DNA, 136 bp, Zea mays
  Clone ID: LIB3279-046-P1-K1-H4
atgttgtcttcggggaggagtcgggtttgttgggaaggaaaattagattagtatcagtggttgggaatgggatgggaacgtggctgtgaatctcagggttgtatgctcgttgataaagaaatggatggacttcccg

SEQ ID NO: 7656 - DNA, 133 bp, Zea mays
  Clone ID: LIB3279-046-P1-K1-H7
tcacaccccccgagctcaacttaccttcacttcaactccaaacacagtcctgaccggagggagagctttcttgaaggcccgtaaaattcccaataatttgatctgccttgggaaccaacaagatgttttccaa

SEQ ID NO: 7657 - DNA, 178 bp, Zea mays
  Clone ID: LIB3279-046-P1-K1-H8
caacatatccttgctcagagagccgttgatgctgattactgggtttcttcctccgggggggggcctgtattgttaacatgcgtactgttatgtaaatttccaagagctctccttcctacttggccaagctgcattgggatgtggtgcaagcaactgttaataaattccagggaatctt

SEQ ID NO: 7658 - DNA, 279 bp, Zea mays
  Clone ID: LIB3279-046-P1-K1-H9
acgcgcccagcaaaacgcccaaaaccactctatgcccctgctagctccatctctcctgggcctgtcctgcatgcctccctctcctccattactactttttcttagcgctgcttgttcatactgcagctgccttagctacagccgcagctcccttaattttgacgttagtatatgctacaaactgaacaaagtaaaaaaaaagttcttgaatcaaacaaaccaccgcttctctagtggcaggtgttgccgcttgtattcctttaaatccgaaaacaatgc

SEQ ID NO: 7659 - DNA, 314 bp, Zea mays
  Clone ID: LIB3279-047-P1-K1-A1
ccataactcatgccttctgtagatacctctgtggtaaatatagtccagcgatttgttgattgttttgcatttatacagccaacggagcaattagtcagcaccaattagcagcggcagccccgcctggatggtgggaattggatggcgatatgaaaaattttgaccttggctcggtgagcgtctggacaaggttggttaaggggtcttttatttggtcttaggacctgagggattgaaccctggccgccaatttttttcctatttggtggcctggaaaagaacggttggtaacctgaaaaaggcgttttaaaagt

SEQ ID NO: 7660 - DNA, 470 bp, Zea mays
  unsure (1)..(470): unsure at all n locations; Clone ID: LIB3279-047-P1-K1-A10
aaacttttctatcaatgcctgggtactggttgtagctagtctcggaatactcccagttctacccaaccatatctcgagtaaagcataccgtctttcattgctaggaacaatatgctcgtctgcatattctttatatggcacttatgggaaaccaagagcatggaatatgcctgcaattcagtcctggttgcagtctattattgtagctaaggactttgttcacttgatgttctctcttatgatgttcacatctaatgtgcactttaagattgctctacttcctgtgctttgctgggcgcttgatcatgttgctcgattcctaaggcgtaattttacacactcttctttatacaggaagtacttagaggacccttgcctatgggtagagacaaacaacactacactcagcctactntgttcgaatgctgaaatcaccctggggtttctcatgatcatctcgcttttctcgg

SEQ ID NO: 7661 - DNA, 470 bp, Zea mays
  Clone ID: LIB3279-047-P1-K1-A11
atctccgacgaagacgacgacgacggtgacggggaggcggacgacgacgacgacgatgacggggatgacgacgacgacgacgacgaggactcagacgacgaggaagaggtcgacggtgaagacgatcaggaggaggagctgggaaccgagtatctggttcagcctcttgggcgggctgaagacgaagagcactcgagcgactttgaaccggaagaaaacggtgagggtgccgacgatgaggagatcgatgaagaggacgatgacggtgaggactctgtgaaggcgcagacctctacgaagaggaagaggtcaggcgacgaagaagaagaagacgacgacgatggggatgatgatggtgacgatgatgacgatgggaggccaccatcaaagcgatagtatggttagctctagttttgtagctgtgtccttgggtgtttgggaggtaggtagtgctgctgatgttggtttag

SEQ ID NO: 7662 - DNA, 470 bp, Zea mays
  unsure (1)..(470): unsure at all n locations; Clone ID: LIB3279-047-P1-K1-A12
gctacacactcccgtttacgtgcacacctccaaaccctcatcacgatccggctccaaggtctcgagatgaagtcgagggcgaggtccggcggtggcgactccaggctctcggtgaggaagaccaaggttgagaaggacccaaacaagcccaagaggcctccgaccgcgttcttcgtcttcatggaggagttcaggaaggactacaaggagaagcaccccaatgtgaaacaagtctcagtgattggcaaggctggtggtgacatgtggaagtccttgtctgatgccgagaaggctccctacgtatctaaggccgagaagctgaaggttgagtacacaaagaagatggacgcctataacaacaagcagtctggaggaggacccacattgtctggtgattctgacaagtccaagtccgaggtcaacgacngngacgaggagggtgatgagtgatggatgacgggtgaaactct

SEQ ID NO: 7663 - DNA, 406 bp, Zea mays
  Clone ID: LIB3279-047-P1-K1-A3
atagctctgatactgtcacgcaagcaaaacttgcgctgtaccatgcactgtttcaaaaggagcgtgggatcgccgctgagactgtatcacatcaccgccaccatttccgcgcgcaacacaagattaattagcacctccggaaaggctgcatcctctaaagtatccaaagtcagaccaggcggacctgaagttccaacctgaggaacttcatccccttgatgaagctttggcagctaagtatgaacatgctggataggattccaagctttggttccaataggcggacttcactgacatggtggcacatcatgctcacaataggataactcattccagactatgttggccatccctacaagaaagaattcaatttttaatgtcatacctgcagagctttgttcctcac

SEQ ID NO: 7664 - DNA, 476 bp, Zea mays
  Clone ID: LIB3279-047-P1-K1-A4
agaggaaggagactgacaagcaggcagaacggccgctgtaccaggttcttgaacaaaaggaagaaaggatagcccctgggactctatatgggtcaagccatacgtatgtgctgggaacacaagataaatcatcagctccgaaaagggtggatctgcttaagaatcaaaagtcagacaaggtggacgtcaccatccaacccgaggaactggaagccatggatgatgttctggcagccaagtatgaagaagctcgagaggaagagaagcttcggaaccaaaaggaggacttcagtgacatggtggcagagaatgctcacaagaggaagaggaagcaagagaaggaaggcaagtcgaagaagaaggaattcaagttttaagggcaggcgggcgatgtgtaggtcatgaggcaccgttgtagctgttccaaatatgactggctgtatggtttagttgctgcgatctgacagttccgttcc

SEQ ID NO: 7665 - DNA, 446 bp, Zea mays
  Clone ID: LIB3279-047-P1-K1-A5
caacaacgaccgcgatggcatagagtggtggttcaaggtcctggtcctggtccacggtatggacatgtgatggccttggttgggcagcgattcttattgacaattggtggcaatgatggaaaacggcccctggcagatgtatgggcccttgatactgcggctaagccatatgaatggagaaaacttgagccggaaggtgaaggaccaccaccatgcatgtatgcaactgctagtgcccgttctgatggtctccttttgctttgtggtggaagggatgccaatagtgtgcccctatcgagtgcatatgggcttgctaagcatagagatggtcgctgggagtgggcaatggcccctggtgtgtctccatcacctagatatcaacatgcagctgtttttgtcaatgcacggcttcatgtctcaagaggggctcttggggtggtcgcatg

SEQ ID NO: 7666 - DNA, 370 bp, Zea mays
  Clone ID: LIB3279-047-P1-K1-A6
caacaacgaccgcgaagacatagattggtggttcaaggccctgttcctggtccactttggagacatgtgttggccttgggtgggcatctattctaatcgacaataggtgctaatgacggaaaacggaccatggcatatgtatgggcccttgttactgcggttttcccatattaatggagaaatcttgagccttatggtggaggaccaccaccatgcatgtatgcaactgctagtgcccgttatgatggtctactttagctatgtggtggaagggatgccaatagcgcgcccctattaagtgcatatgttcttgctaagcatagaaatgatcgctgggaggaaactatggcccttggagtgaatccattat

SEQ ID NO: 7667 - DNA, 328 bp, Zea mays
  Clone ID: LIB3279-047-P1-K1-A7
cccacacccacctacctacctacctaccaccaacgcctcggctcccctctccagcgagccgcgaccgcgcggcaggggaagcttagcacggacgggaccagctgacgaccaggccatggggaagtacatgcgcaagggcaagatgtccggggaggtggccgtcatggaggtccccggcggcgcgctgctgggtgtccgcacccgctcccgcacgctcgcgctgcagagggcgcagaggccgctcgacaagggggacgcggatgacgccgccggacagtacctcgagctcaggagccggaggctcgagaagcctcataaggaccatcag

SEQ ID NO: 7668 - DNA, 195 bp, Zea mays
  Clone ID: LIB3279-047-P1-K1-A8
ctttctagagatgatggacacaactatagtgatggagaatctattggtgcatatggaggttaggatgaccgggaagaataactcagcaacggcggttccaattaaccccttgtccatgagaatatggtttcccacggccaagttacgcgcttggaaatcctttaagaaggacccaagcggccaaaaggggggcct

SEQ ID NO: 7669 - DNA, 396 bp, Zea mays
  Clone ID: LIB3279-047-P1-K1-A9
ccttgctagcgcccggtccggtgagctccataccatccagggagtgtgaggaaccgtcgtcgttgctggcgatccaagagaccaggagatgggcagcggcaggaacggcgctgtggtgaggcggtacgttcggtccaaggagcccaggatgaggtggagcgccgtcctccaccgcagcttcgtgcaagctatcgactccctcggcggccaacacaaggctacgccgaagctcattctccagttcatgggcgccagggggcttaccatatctcatgtcaagagccacctccagatgtacagagctgcatgccttggcgcagaaagaggaggagggacgccagcccagctgctgcaaaggaggtactcatgcagcggtgatgagcgaggaggccccaa

SEQ ID NO: 7670 - DNA, 462 bp, Zea mays
  unsure (1)..(462): unsure at all n locations; Clone ID: LIB3279-047-P1-K1-B1
ggcgagtaaacgctgtgaaccacctagcgaaggagtttgaagacagacggcaggtgttcgaagacgacgcgggcttccttgtcgcagtcaggtccggccaggttggttcaaatacgaacccagacgaggaactccggaagctcaaggaccgctttgaaacatggaaaaaagactacaaatctcggctgaaggagacgaaggtaaaccttaataaggttggcaccggcacccatgatgataaatcgcggaaaagatggtggggaaagaagagctccaagtgaaacgtgtgagaggtgccccagatcatttttctactgccccgggccaaggaaagcggccaagaatgctagggcaggcacgaagaacccgcctcggttctcgcaccgcagaagcccggcaagataatgatgagctccatcgcgggtggtcgcgcctgtactcgtncagagtgtcaaacagatc

SEQ ID NO: 7671 - DNA, 448 bp, Zea mays
  Clone ID: LIB3279-047-P1-K1-B10
tgcactcaggcacctatcaacctggttcatgtttgatgtatgttcaacagctccattggaaccaatcacccttctcttcacacatccggggaacggccttgcttttaagatactcaacatgtcgaggctatggcgtcttcaccgcgtcagctcgctgtttgcaaggttcaacaccgatccagctttctcaatatttcgatgacgaatgacaactggcaccactttgatcgcctttcttctaccagcaagctggagaaggacataagggtcaactatttctggactaggtgctcaaagctcatttctggcagtctctcagaaactcagaaacaaaaaaaaaaaatacaggtcttgcttctccataaaaaattgttacagcttgcaaagcgtctacgtttgttgattgggagaaaccttttgataacaatgtgaaagattccgtgacgac

SEQ ID NO: 7672 - DNA, 404 bp, Zea mays
  Clone ID: LIB3279-047-P1-K1-B11
cggacgcgtggggccgcggtgctccggaacgccggatctcggcgcctcttctcctgcggcaccctccgtgctgctgcaatctcgggacccgccgtgctaccagatgcgcccgtggcggcgtcggtggcggcccagccgcccccgctggcctggacactctgggcgatgtacatgggcaccttcacacgcacgaagccccatgtgaacgtcggcacccttgggcacgtccatcacggcataaccagtctgactgccgctatcaccaagggaatatcaactacaaagaatttgcttgcagatgatgctatggtgcctatctcctctcctttgactcctccactaggtgacagtgaagaaactgacaaaaagggggctgtggtaaaacgccgaatggtccaagccat

SEQ ID NO: 7673 - DNA, 446 bp, Zea mays
  Clone ID: LIB3279-047-P1-K1-B12
gtaggaagttccaaagaaaactaaaaagaacgtagagagtttttgaaaaagattatagaagtaggaaaaagatggggaagctttgcatgaaagtgatgagttttgttgctcgtccttctacgaccattgttgagcaaattcgtgatgttattagtattcatatttactttctaattaattttaaattgttggtatgctcgtaggttaactttatctctagggctaagcttcaattcgacatctgcccattcttcagtcttaatgtcgttgccgccgagtacaatagtgattccccggtgcatccacaccaaggatttcatcaccaccagccccatcaacgactacaatggtgaagagtttgtcttctactctacaaggaagtaccgtgccaaaaaactcaataatagagtaccacaccaaccaaaatggctaattgttgccactag

SEQ ID NO: 7674 - DNA, 469 bp, Zea mays
  Clone ID: LIB3279-047-P1-K1-B2
gtcgagtaaactctgtgaaccacctagcgaaggagtttgatgaccgacggcaggtgttggaagacgacgcgggcttactagaagcagtcaatgtccggccagttttgattcaaatacgaacccagactaggaactccggaagctctaggtccgatttgaaacatggaaaaacgactacaaatctcggctgaaggagacgaaggtaaaccttaataaggttggcaccggcacccatgatgattaatcgcggaaaagatggtggggaaagaagagctccaagtgaaacagtgtgagaggtgccccagatcatttttttactgcccctggccaatgaaagcggccaataatgctagggcaggcacgaagaacccgtcttggttctcgctcctcataagcccggcaagataatgatgagctccatcgggggtggccgcgctgatactcgtccagagtgtcaatcatatcaaat

SEQ ID NO: 7675 - DNA, 397 bp, Zea mays
  Clone ID: LIB3279-047-P1-K1-B3
cggacgcgtgggcggacgcgtgggtgaagatcgggttccacgtggaggagtactcgaaccccgtctacttcgcggtgctggtggagtacgaggacggccacggcgacgtggtgcaggtggacctgatggagtccaagatggcgcgcggcccgtcgacggggcggtggacgccgatgcgcgagtcctggggctccgtatggcgcatggacaccaaccaccgtatgcagccgaccttgttcatccgcatacgcaacgagtgcggcaagacactcgtcagcaacaacgtcatgccgggcaactggcgccccaacaccttctaccggtccttggtacagtatagctagctgatcgggatccctgccctgccctgtccgctattggagctgactggctgggg

SEQ ID NO: 7676 - DNA, 454 bp, Zea mays
  Clone ID: LIB3279-047-P1-K1-B4
cccacgcgtccgcccacgcgtccgcaagagcaaagtccctgggaagatgcatggatgtggacatgatgcacatgttgctatgctgttgggatctgctaagattcttcaggagcatcgtgatgagttgaagggtacagtagttcttgtcttccaaccagctgaggaaggtggcggtggggccaagaaaatgatagaagacagagctgtggaaaacatagatgccatttttgggcttcatatagctgactctgtgcctattggtgtgctggcatccaggccagggcctattatggctgggagtggattctttgaggccgtaataagtggaaagggaggacatgctgcacttcctcatcacactatagatccgatattggctgcctcaaatgttattgtgagccttcagcaacttgtttctcgagaagctgatcccttggactcacaggttgtgaca

SEQ ID NO: 7677 - DNA, 455 bp, Zea mays
  unsure (1)..(455): unsure at all n locations; Clone ID: LIB3279-047-P1-K1-B5
ctgcggcggagcacggaggcgaaggaggaggagcagcagcagcaggcggcgccgaggagcggcatcccactcagtgcttgcaaccatggctaggggattgaagaagcacttgaagaggctcaatgcgcccaagcattggatgctcgacaagcttggcggagcttttgctcccaagccatcttctggacctcacaagtccagggagtgccttcctctgatcctcatcatcaggaacaggctcaagtatgctctgaactaccgtgaggtcatttctatcctgatgcaacgccatgtacttgttgatggcaaggtcaggactgacaagacctaccctgctgggttcatggatgtcatttccatccctaagacaatggagaactacaggctgctttatgacaccaagggccgnttccgtcttcacccaatcagggatgaggatgccaagttcaagctct

SEQ ID NO: 7678 - DNA, 434 bp, Zea mays
  Clone ID: LIB3279-047-P1-K1-B6
cccgcctctcccgtgaggccgtgacgcgacgccggatcgtcctcgtctcctagctcgtggaatgaagggaggtggcgtcatcagggccgccggcggaggtgccggcggtgcgggtctgttgcgaacgcgactgcggcttcccgtggtgctcctctcctgctccctcttcttcctcgccggcttcttcggctcgctcctcttcacccaggatccggaggaggcggatatgccggtgccgagagagcggctgttggaggcggcgtggccggagatgccttacggcgagtccggcgaggctgcgccgtccttgatcccataccagattttgagctggcagcctcgtgctttgtactttccacaatttgcgacatcagaacagtgtgaaaatatagtaaaaacggcaaaggagagacttaagccatcaacattagccc

SEQ ID NO: 7679 - DNA, 477 bp, Zea mays
  Clone ID: LIB3279-047-P1-K1-B7
tctcaccttcccaggcggcacaaaacagacgagccgcattgctcctgaccgaccggtcggacttcccttctctgtgtgtgtcttcatttctactccacctgccccacagctactcgggtgccagggagaaccagccgttagcttctctactccctctcttgtttcacgttccttcagcgcgttctggtggccagcgcatcgcagccaccgcgctcaactgtaaggcacgcgctagcggcttttcgggcgtctctatgcacagagaaacgggcaccgcagacctcgccggcagcgagctcatcccttcgggcgggtgagctgctgtcggacgggaactgaccgcagtccgagcacgacaggttgggtgtctggatcttgactgtctttaacttttaaaacttggatctagtcctcatttactcgaatcccttactgtgtatgaatgaatgtctgagatggatctaatgcaatattcgg

SEQ ID NO: 7680 - DNA, 372 bp, Zea mays
  Clone ID: LIB3279-047-P1-K1-B8
ctccaccttaccacgcggcacaaagcagacgagccgcattggtcctcaccgaccggggggactttccttctctgtgtgtagctccatttctactacacctgccccacagttactcaggtgccaggcagaaccacccggtagcctcgctacgtccctctgttgtttcacgttccttcagagcgttctggcggccagcgcatcggagccaccgcgctcaactgtaaggcacgcgctagcggttatgcgggcgtttctatgcacagtgagacggtctccgcagacctcgccggctgcgcgctcatccctccgggcgggtgatctgatgtccgacggtaactgacctctgcccgagctcgacaggctggatgcctg

SEQ ID NO: 7681 - DNA, 473 bp, Zea mays
  Clone ID: LIB3279-047-P1-K1-B9
cccacgcgtccgcccacgcgtccggtgtctgcgtgcagggcgcgagcgcggagggcacgcccaagaggctgacctacgacgagatccagagcaaaacgtacatggaggtgaagggcacgggcacggcgaaccagtgcccgaccatcgacggcggcgtggagtcgttcccgttcaaggccggcaagtaccagatgaagaagctgtgcctggagccgacgtccttcaccgtcaaggcggagggcatcgccaagaacgccccgcccgagttccagaagaccaagctcatgacccgcctcacgtacacgctggacgagatcgagggcccgctcgaggtcggctccgacggcacgctcaagttcgaggagaaggacggcatcgactacgccgccgtcaccgtgcagctcccggggggcgagcgcgtgccgttcctcttcaccgtcaagcagctcgtcgccaccggcaagcccgagagc

SEQ ID NO: 7682 - DNA, 368 bp, Zea mays
  Clone ID: LIB3279-047-P1-K1-C1
cgctcaagttctcgcgcccacagccaaatttttctccactcaatcgcggcataagctgcactgcagccatggacgccagcggagccggtagcaaggcgaagaagggggcggctgggcgcaaggctggcggccccaggaagaagtcggtgtcgcggtccgtcaaggccgggctgcagttccccgtcggccggatcgggcgctacctcaagaaggggcggtacgcgcagcgcgtgggcaccggcgcccccgtctatctcgccgccgtgcttgagtacctcgccgccgaggtgctggagctggccgggaacgcggcgaaggacaacaagaagacgcgcatcgtcccgcgacacttgctcctggcgattcgt

SEQ ID NO: 7683 - DNA, 470 bp, Zea mays
  Clone ID: LIB3279-047-P1-K1-C10
cccacgcgtccgccctacactcccggcggcggcggcggcggcgcagcagcggcagcagcatccgaagatggtgaagttcctcaagcccggcaaggccgttatcctcctccagggccgcttcgccggctggaaggcagttatcgagcgcgtgttcgaggagggcacccgcgaccgcccctatggccactgcctcgtcgcaggcctcgccaagtacccaaagaaggtgatccgcaaggactccgccaagaagactgcgaagaagtcgcgcgtcaagtgcttcatcaagctcgtcaacttcactcacctcatgcccacccgctacaccctcgacgtcgatttcaaggatgtcgccaccggtgggcccgacgcactctctacccacgacaagaaggtcgccgtctgcaagacggccaaagcgcgccttgaggagaggttcaagaccggcaagaacaggtggttctttaccaagc

SEQ ID NO: 7684 - DNA, 412 bp, Zea mays
  Clone ID: LIB3279-047-P1-K1-C11
cccacgcgtccgccaaaaccccaactcgccccgcatcgatggcgcccaaggccgagaagaaacccgcggcgaagaagccggcggaggaggagcccgcggccgagaaggcgcccgccgggaagaagccgaaggcggagaagcgggtccccgctggcaagtccgctgccaaggaaggcggcgagggcaagaggggcaagaagaagggcaagaagagcgtggagacctacaagatctacatcttcaaggtgctgaagcaggtgcacccggacattggcatctcctccaaggccatgtccatcatgaactccttcattaacgatatcttcgagaagctcgctgctgaggccgccaagctcgcgcgctataacaagaagcctaccatcaccttccgtgagatccagacctccgtgcg

SEQ ID NO: 7685 - DNA, 389 bp, Zea mays
  Clone ID: LIB3279-047-P1-K1-C12
agatgatgaaacatatgaagaaattgcgcgcaccacgaaacgcactatccccttcctttttgtccgaggtgatggtgtcatattggtttctccaccccttcgtacggcatgaagtttgaagttagatcatgctgattgttaattatgataactggtgtatttggccactagatggcgttgcatggagtgtatgttatgggcctagccgctactttttctgatgggatgtatgtttaacatgtgatacaatcgtgtaaacaactgcttgtgcttggatttcaaagtcatgtacatcattaacttcttgattaacgatttcttcgagaagctcgattataaagacggccggccggtctagatgtatcaagcttacttccgtctgcttgcga

SEQ ID NO: 7686 - DNA, 331 bp, Zea mays
  Clone ID: LIB3279-047-P1-K1-C2
cgctcacgttcgggcactcacagtcaaaactacttctactcaatcacgacacaagctgagcaggagtcatggaccccagtgaggtcggtagctaagcaaatcagggggcagttgtactcaatgtatgactccagaagaagaagaaggagctaagctacgataaggacttgctgcaattcctggtcaggcgattcggacgctacgtaacgatggggctgtacacgcaactggtgtacacaggagacatgctatatcaagacgtcgaggttatgaacgtcttctacgaaatgcaagagctggtattaaactcgaggatgatcaacatgaagac

SEQ ID NO: 7687 - DNA, 442 bp, Zea mays
  Clone ID: LIB3279-047-P1-K1-C3
cgctcaagttctcgcgcccacagccaaatatttctccactcaatcgcggcataagctgcgactggagtcatggacgccagcggagccggtagcaaggcaaagaagggggcggctgggcgcaaggctggcggccccaggaagaagtcggtgtcgcggtccgtcaaggacgggctgcagttccccgtcggccggatcggtcgctacctcaagaaggggcggtacgcgcatcgcgtgggcaccggcgcccccgtctatctagacgtcgtgcttgagtaccttgccggcgaggtgctggagctggcctggaactcggtgatggacaacaagatgacgcccatagtgccgcgacacttgctcctgtcgattcgcaactactttgatctcgacaagctgatgtctggcgtcaccatcgcgcacagtggtgtccttcccaacatcaacc

SEQ ID NO: 7688 - DNA, 439 bp, Zea mays
  Clone ID: LIB3279-047-P1-K1-C4
cggacgcgtgggcgccaagaacatacagactttgtgtgtggcgatcgaaacgagagttacctgcactcatgttgagatcaaaatgtgttcggtcttcactgatcaaggctgcattatgttcttgatcttggacaacatgtatttgtccatcctcaaactcagctgatatatcatcttctccaccgtttacagcagaagcttggttcagatcaggtggtatcgcagcttcttcagttcaaaattcagcagtacatacatttttattcaaaactgtcatttcaagcatatgcgttattactcgatcgatcacctgatcacaaatttcaccgaccacaatagatggagaggactctcttttggagtagtatccagttaagtacacgatggacgtgatatgcatactatatattttgaataaaccaatgtataaagttgtttt

SEQ ID NO: 7689 - DNA, 473 bp, Zea mays
  Clone ID: LIB3279-047-P1-K1-C5
agagaaggcaaggatggcgttgaagaaaggtagacgcgtggtgcctaagcttactgctgagccaatggatgtagatgtgaagaatatggatgacgctcatgacacagccattgatgtggaacctttagcaatggctttcgagtccttgccaactgaggaaagtccagataagtcagttgctaggctcgatgatctcatattagaagctataaggaagcttaaggagccttctgggtccagtaaggcagccattgctgcatacattgaggaccaatactggccacctgctgattttcagcgcctgctatctacaaaactgaaggcattggttaattccggaaaattaatcaaggtaaaccaaaagtacagaattgcaccaagtccacccccctcgggcagaataggcactaaggtatcctctgctgaaggcatgaaggcagaaaataataatgctaaacggctaactaagcatc

SEQ ID NO: 7690 - DNA, 474 bp, Zea mays
  Clone ID: LIB3279-047-P1-K1-C6
cagcgcccgtcgcctccctttccccttccctccctccctctccccgcgggccgccagaggcaatttcgccctcgattcgaccccgattcgtccgcccgcgaccgggattccctccgccaagcgcggatctgaacgctgcgctccgtgtcgtcgctcgaatccgccatgaagggggccaaatccaagggcgccgccaaggccgatgccaagctggcggtgaagagcaagggggcggagaagcccgccaagggcaggaaggggaaggccggcaaggaccccaacaagcctaagagggctcccagcgctttcttcgtgttcatggaggaatttcgcaaggagttcaaggagaagaaccctaagaacaagtctgtcgctgcggtgggaaaagctgctggcgacaggtggaaatccctgagcgagtcggacaaggctccctatgtagccaaggctaacaagctcaagctagagtacaac

SEQ ID NO: 7691 - DNA, 458 bp, Zea mays
  Clone ID: LIB3279-047-P1-K1-C7
cccacgcgtccgagatgaacctgtacagcatgaagagaagcgactagccacttggggaaccgacgtgcctcaggatcttgttcttaatgagaagaagctggaggaatctctaaagaaggagactgcaaggagaaaagaggagaaggatgaaagaaagaggaagtataacgtgaagtggaacgacgaggtgactgcagaagacatggaggcttaccgaatgaagaggattcaccatgacgatcctatgaaagattttctcaactgaaaagtgtggtagataactagatgttcatgccactgtatcacattggttgcaccgtgccttgcatcaatgttgtgttactgtggggtggctacgcctgtcctaaggatatggccagcagaccgtgcatgtggcagtgtgtgttgcacttaaattatgatatgggatgggtaaggctggagatagcttaaccaga

SEQ ID NO: 7692 - DNA, 447 bp, Zea mays
  Clone ID: LIB3279-047-P1-K1-C8
ggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagatgtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggctgcgggtacggtggtggccgcggaggcggcggctacggcggtggcgggcgccgtgatggcggcggcggctacggcggtggcggc

SEQ ID NO: 7693 - DNA, 472 bp, Zea mays
  Clone ID: LIB3279-047-P1-K1-C9
cgcacgcgtgggtgcttttgagtatgcataccttaacaagggaatgaaagtgacagcagcgcataaagccaacatcatgaagcttgctgatggtttgatcttggagtcttgccgcgaggttgcaaagaagtacactgaaattcaatatattgaaatcattgtgaacaactgctgcatgcaccttgttgcaaagactgaacaatttgatgttatggtcaccccaaatctttatggcaatctgccggctaaagtagctacacgtatcgctgcaggctctggtgtcatgcctggaggtaatgtggcgcacgaccatgctatgttaaagcaaggtgcttctgcaggaaacgttgaaaatgagaaaattgtggataagaagagagctaaccctgttgcacttgctgtgtcttctgccatgatgttgacgcacttgcattccccatcttttgctgactcggtggagacggcagttaat

SEQ ID NO: 7694 - DNA, 462 bp, Zea mays
  Clone ID: LIB3279-047-P1-K1-D1
ctgacatcagcattccttggctttttatattcaccccatctagatacagcaccccccagatgggttcaccttgctcatggactgcttctctttctttatcagacttttgatgctgtggatggaaaacaagcaaggcgtaccaactcatcaagtcctctaggcgagctttttgaccacggatgtgatgcgcttgcgtgtgcttttgaatccttggcttttggaagcacggcgatgtgtggaaaggctaccttctggttttggttcatttcagctgtcccattttacttcgcaacctgagaacacttttttacaaatacacttattcttcctatagtcaacggaccaactgaaggccttatgctgatctacttgtgccattttttcacctttttcacaggagccgagtggtgggcacaggattttcagaagtcaatgcccctgctgggttgggttctctatctc

SEQ ID NO: 7695 - DNA, 411 bp, Zea mays
  Clone ID: LIB3279-047-P1-K1-D10
cgacccgtaccccgcctcccggttcaaccaaatccgtctcgcctcatccccaccagcgcggagccgccctatcgtcctgtcgagagaagcaatggcgggccgcggcaaggcgatcggcgctggtgccgcgaagaaggcgacgtcaaggagctccaaggctgggctgcagtttcccgtcggcaggatcgctcgtgttcctcaaggccggcaagtacgccgagcgcgtgggcgccgtcgcccctgtctacctcgccgatgtcctcgagtacctcgccggtgaggtcctggagcttgctgggaacgcagcgagggataacaagaatacccgtatcgtgccgcgtcacatccagctcggcgtgcgctacgacgaggagctgaccaagctgcttggtggggccaccatcgggagcg

SEQ ID NO: 7696 - DNA, 440 bp, Zea mays
  Clone ID: LIB3279-047-P1-K1-D11
ctccgaattcgaccccgccgctaaaccccgcaccggttgccgaggcgtctcccgctccagctccgactctcacgcgactagggttctgtgcgtccacttccccgtcggcgcaatggaggtcaagaagtgaagccaggagccacggtttcttgcaaagttggtgatggcttggttatccacctttcacaggctgcactgggggaatcaaagaaagcgagtgagaatgccattttgtctgttaatattgatgataagaaactagtgcttggaaccttatcagttgagaagcatcctcagatctcttgtgatcttgtatttgataaggattttgagctaccacacaattcaaaaacacgtagcgttttcttccgtggctacaagtcccctggtcctcttgttgagtctaattctggtgaagatagttccgatgaagagctaaa

SEQ ID NO: 7697 - DNA, 452 bp, Zea mays
  Clone ID: LIB3279-047-P1-K1-D12
caccgatgcgccgcgtccgtggacttcggcgccggtgggagccccctactgcccccgaccgtgaacgccgcctcgctgcacgcgcacttcgaggccgtcgccgccgagacggtgggcgcgagcgccgtccgggccgccatggcgccgtgcatgggtagcgaggacttcgcgtccttctcggaggccgtccccgcctcgcacttctactttgttgggatacggaacgaggggatcggggccgtgcacgccgcacactccccgcacttcctcgtcgacgacgacgcgcttccgtacggcgccgcaatgcacgccaacctcgccatcgggtacctgcggaaccgcgcggcagccaacgacgggcccgtcgtcgccccccacgacgagctttaggttcactgcagctttttcacgagcgacctacgattggggcggcggcttcgcactcatggggc

SEQ ID NO: 7698 - DNA, 452 bp, Zea mays
  Clone ID: LIB3279-047-P1-K1-D2
gacgccacgcgtccggagcgacagacagagatagagagaccgtctctccggcatatcccaacttcaccgcagaggggggtgagggcgaccgatggcgcggattgttttcatcatggacttcgcggataatctgatcctccgtctgatggaggacccggacaagcgcaaccaggttcgggaggagcttgtctacatgatgaaggagctgggcgagcgcactaaggcggcgtctagcctccctatgcgcccctacggcttgtggaccttctaccgcttcaactcgcaactctcctgagatccccagatcagccaggccacacgtccgtccggacccatacatcgaccttatagcccgccactctggctcgacggcgtctgcctgaacacccgtgccgatctttgccctgaacgtctacttgagcatcattaccacactgatttcacacaaactg

SEQ ID NO: 7699 - DNA, 388 bp, Zea mays
  Clone ID: LIB3279-047-P1-K1-D3
ctgacatcagcattccttggctctttatattcaccccatctagatacagcaccccccagaagggttcaccttgctcatggactgcttatctatctttatcagactattgatgctgtggatggaaaacaagcaaggcgtcccaactcatcaagtcctctacgcgagctttttgaccaccgttgtgatgcgcttgcgtgtgcttttgaatcctaggctcctggaagcacggtgacgtatggtaaggctaccttctgatattggatcatctcagctgtcccattttacttcataacccgagaacactcttgtacaaatacacttattacttgctatagtcaacagaccaactgaaggccttatgctgatctactagtgccattttttcacc

SEQ ID NO: 7700 - DNA, 472 bp, Zea mays
  Clone ID: LIB3279-047-P1-K1-D4
gcctgcgctcgcctcagctcctttcttccccgccccttggcttttgcttggttgcatcgggccggtcgagccggagaggaaaagctagctagcagctaccagctctcggccggcggtggtagtctgcctgcagctggggttagctgcaagggttgggagctagccatggggaggggtcgggtggagctgaagcggatcgagaacaagatcaaccgccaggtcaccttcgccaagcgccgcaacggcctgctcaagaaggcgtacgagctctccgtgctctgcgacgccgaagtcgcgctcatcatcttctccaaccgcggcaagctctacgagttctgcagcggacagagcattaccaaaacacttgagaggtatgaaaaaaacagttatggaggaccagatactgctgtacagaacaaggagaacgagttagtccagagcagtcgtaatgagtacctcaagctgaaagcga

SEQ ID NO: 7701 - DNA, 431 bp, Zea mays
  unsure (1)..(431): unsure at all n locations; Clone ID: LIB3279-047-P1-K1-D5
gtaaacatccagagagacagctatgcctcttatattgggcactatccaatgctagcatattttgccattgctgagaacgaatcgatcggaagagaacgttacaatttcatgcagaaaatgctgcttccttgtggccttcctcccgagagagatgaagattgaagagctagctggtgctgcatagtttctgtgtttccagtggttcctgtagtgtttgcttttagctaccatcgtactatgtgcgagcatgcctttcacgtttcttccattagtctcttttgtgatacatagaacccgtatgtattgttaaccaaatgctggcctgccccattgttgtgtttttgtggtgtgttcagccaatgtgaaagaaaaaaaaatagcccatnttaaaaaaaaaaattaagaaatataaaaaaaaaatattaaattaa

SEQ ID NO: 7702 - DNA, 469 bp, Zea mays
  Clone ID: LIB3279-047-P1-K1-D6
cccacgcgtccgcacagcgtcgtcctcttcgtctccagtccaagcaagcgaagagcacccctcgagatctctccctccccgcgccgccatggacgcagttgactcggtagtcgacccgctccgggagttcgccaaggacagcatccgcctcgtcaagcgctgccacaagccggaccgcaaggagttcaccaaggtcgccgcgcggactgcgatcggcttcgtcgtcatgggattcgtcggcttctttgtcaagctcatcttcatccctatcaacaacatcatcgtcggctccggctgatccgttcacctcaggctagtggctgccggagtggacaatggcgtcactaccttggaggcagcaccgttttcagctctgatttccgcaaagcaattcctttaggacttgtgttgttaaagggcaactcccttatcttttcctctcttgaggtcgtgtgagagatctggaact

SEQ ID NO: 7703 - DNA, 365 bp, Zea mays
  Clone ID: LIB3279-047-P1-K1-D7
gccgccgccgaaggacggaaggagaagagggtacggccgtctccttgcccccatggccgacgagaagaagctgtccaacccgatgcgggagatcaaggtgcagaagctcgtcctcaatatctccgtcggggagagcggcgaccgtctcacccgcgccgcaaaggtgctcgagcagctcagcggccagacccccgtcttctccaaggcgaggtacacggtgcggtcgttcggcatccggcgtaacgagaagatcgcctgctacgtcacggtgaggggcgagaaggccatgcagctgcttgagagcggcctcaaggtcaaggagtacgagctgctcaagaggaacttcagcgacaccgggtgctttg

SEQ ID NO: 7704 - DNA, 467 bp, Zea mays
  Clone ID: LIB3279-047-P1-K1-D8
gcacgcgacgctctcgtcggcggctgggccagcgcgggagctcaagtccgccgctcaggagcagctggagtacatgctcaccgaagatgacgacgccccattgatagcccttgacaacgacactgtgaagtctcaagtgaaggattgtgccactgctttactaagccagttcagtgctttcatgagctctatcctgacgaaacaaaaggaggcgcctcctcttgatggtgagcacggccagcttcagcaggagttacaattttttctttgagatatctcttgggtctctcaggtcctgagcaagctcgagatgatgaagtgcattgttgtctactgggtcggagtgtccactgatatggtagaaactgttgacgcggtatgcactggggatgactgtctgaagaccaagctgaaggtggtagaggtgtctgcaaaagtcctggatgcttgtgcatttggcaatgtca

SEQ ID NO: 7705 - DNA, 319 bp, Zea mays
  Clone ID: LIB3279-047-P1-K1-D9
caaatacggtaccgacaatcctgtgtagagtccagaaaagatgcagggaattttgtgagatccataactaataggagatggaagtattacgaataataatactacactgcttagacaggctgaattttcttcaattccgatagattaagagaaaggaatcctgcttcaattgttggagctcacttttgggcttttgaagccgagcctttatattttgttcttttcttacgctgaggcacctaataaatgacttgccttgtatgttttcgagaaacttacattatgcttttttatataacaataatactgtctattcagt

SEQ ID NO: 7706 - DNA, 476 bp, Zea mays
  Clone ID: LIB3279-047-P1-K1-E1
cccacgcgtccggagagttgggcgcagagaatccccaagcaaacaaacagggtagagggagaggagaggagaggagaggagaggttgggtctgggacaccatggctccgatgaagctgtacggggcggtgatgtcgtggaacgtgacgaggtgcgcaacggcgctggaggaggctggctccgactacgagatcgtgcccatcaacttcgccaccgccgagcacaagagccccgagcacctcgtccgcaacccgtttggtcaggttccagctctgcaggatggtgacttgtacctcttcgaatcacgagcaatctgcaagtacgctgctcgcaaaaacaagccagagctgttgagggaaggaaacctcgaggaggcagcaatggtggatgtttggatcgaggtggaggctaaccagtacaccgctgcactgaatcccatcctcttccatgtcctcatcagtcctatgcttgagggaa

SEQ ID NO: 7707 - DNA, 477 bp, Zea mays
  Clone ID: LIB3279-047-P1-K1-E10
accacgcgtccgtccacgcgtccgagccaccactcagcagtcccggacgactagcggagtagtatccaccggcgacgggaacgggaggcggcgcggccggacattcgaagcgatggcgttcacgatgcgggcagtgaaggtgccttcgtactcggcctcgctggaggaggccctgcaccgagtgttcattttcttgatgcaggcatgccgttctatccccaccgtcatggacatctacaacctcgtcgtcgtcgtcacgccctctcagctccgctcgaccatcgatatggacatccgctgataccagaacgttaccaaccccaatgaggttgttatgcttgtgttcaacgcgactgaggagctgcacatcatagtttaacatgcatagcagcgccatcatgtgattgcgctgtatgtgatttgccaacatggcctggagcatgttctgaggtcgattgatctagggtacttttactt

SEQ ID NO: 7708 - DNA, 477 bp, Zea mays
  Clone ID: LIB3279-047-P1-K1-E11
gccgccgccgaaggacggaaggagaagagggtacggccgtctccttgcccccatggcccacgagaagaagctgtccaacccgatgcgggagatcaaggtgcagaagctcgtcctcaatatctccgtcggggagagcggcgaccgtctcacccgcgccgcaaaggtgctcgagcagctcagcggccagacccccgtcttctccaaggcgaggtacacggtgcggtcgttcggcatccggcgtaacgagaagatcgcctgctacgtcacggtgaggggcgagaaggccatgcagctgcttgagagcggcctcaaggtcaaggagtacgagctgctcaggaggaacttcagcgacaccgggtgctttggtttcggtatccaggagcacatcgaccttggtatcaagtacgatccgtcaacaggcatctacggaatggacttctacgtcgtgctggagcgtgccggcttccgtgtggcgcg

SEQ ID NO: 7709 - DNA, 465 bp, Zea mays
  Clone ID: LIB3279-047-P1-K1-E12
gccgcaggctcaggacggaaggagaagagggttcggccgtctccttgaccccatggtgcgagagaagaagctgtgcatcccgatgcagtagatcacggtgctgaagctcgcgctcaatatctgcgtcggggagagcggcaaccgtctgacccgcgctcaataggtgctcgagcagttcagcgatcagacccctgtcttctacaatgccaggtacacggtacggtccttggggatccggcgcatccagaagatcgcctgctacttcacggtgaggggcgagaaggccatgcatctgcttgagagcagtctcaacgtcaaggagtacgagctgctgaggttgaactccagcgacaccgggtgctgtggtttcggtctccacgagcacatttgccttggtattcaagtcgatccagaaacaggcatgtacggaatggacttctacattgtgctggagcgtgccggcta

SEQ ID NO: 7710 - DNA, 398 bp, Zea mays
  Clone ID: LIB3279-047-P1-K1-E2
ggacaatgtgtgattttttctcctttatgccatgttttggaatttttgtagctgcctaggccgtgaggtaatgcgctgctgtggtggctcattagcatgaagaggaagacgctgctggcgctgagtctttgtctttattagtattctgcttaaaactatgtatgaccgaatggtggtatttattcgtgtcatccttgactctcattgtgctgcacaacctcaatacccacaatcaccctatacgcaacaatattggttatgttacacctcatacttgatatttacgggcgcccgttctagagaatccaagcttatgtacgcctccgtgcgaagttttaacttttatataggggcgcttaatttcaattcactggccctcgttttacaatcgtctttac

SEQ ID NO: 7711 - DNA, 469 bp, Zea mays
  Clone ID: LIB3279-047-P1-K1-E4
ggacctccagatcccgaccgtgaacaccgtgggcgcgctcgtgaaggcgggcatccccgcgctggtgtacagcggcgaccaggactcggtgatcccgctgacgggcagcaggacgctggtggggcggctggcggccaggctccggctcaacgccacggcgccgtaccgggcctggttccaggggaagcaggtgggcgggtggacgcaggtgttcggcggcggcgcgctgtccttcgccacggtgcgcggcgcgtcccacgaggcgcccttctcgcagcccgagcgctcgctcggcctcttcagggcgttcctcgccggacagcagctgccggaatcgttccagtgacgacggaacgtgcctcttccacgtctagtgtatgttcattgtaagcgtatgtacgtgcagctgaccgtctgtcgtcatcatccgggcgctcgacactggcaaaacaacccaaatgggttcttc

SEQ ID NO: 7712 - DNA, 384 bp, Zea mays
  Clone ID: LIB3279-047-P1-K1-E5
agagaacgctgttgagcagggttgccgagacaacattggcaagcagcttgacaacagagcaggaaggcatacgctccacactgactacactggcacatcgttggagaagacacagcgcggaactgtggcagcagtcacaagttagctaccaaggtgagtagacagctctacgcattcagatggatgacgtggctgctaacgcacgagttgcagctgcgggacagcctcagcctgtgggacacactaggcggacgatccctgagggagcccaggctacacagttgaggctgtgcagcgcgaagctaattctcgcccggagacagctcttgactggggattgaactgatgctttcacggtggttcagaactacagactcacaaaca

SEQ ID NO: 7713 - DNA, 478 bp, Zea mays
  Clone ID: LIB3279-047-P1-K1-E6
ggcgcggcggcggtggtggtggcggactggcgggcgccgccgcgatcctcttcgaacggctgcggtcgtgcacatgcggtgtcggctcggccccgtcctcggacgccgagatgtggtcacgctttccttgcattgaagctagaggattcatctttgggccagccattgcgctagccataggagcaaagttcataccactacgtaaacctaagaagcttccaggtgaggtattttctgaaagttatgtacttgagtatgggatggattgtttggagatgcatgttggagctatcgaacccggggagcgcgtagtggttgtcgatgatttggttgcaactggtggaactctttctgctgcaataagacttctcgagcgcgcaggagctaacgtggttgagtgtgcatgcctcattgggcttcccaagtttaaggatttctataagctcaacgggaaaccggtttacatcctggtggagtc

SEQ ID NO: 7714 - DNA, 473 bp, Zea mays
  Clone ID: LIB3279-047-P1-K1-E7
gcggctgcggcggagcacggaggcgaaggaggaggagcagcagcagcaggcggcgccgaggagcggcatcccactcagtgcttgcaaccatggctaggggattgaagaagcacttgaagaggctcaatgcgcccaagcattggatgctcgacaagcttggcggagcttttgctcccaagccatcttctggacctcacaagtccagggagtgccttcctctgatcctcatcatcaggaacaggctcaagtatgctctgaactaccgtgaggtcatttctatcctgatgcaacgccatgtacttgttgatggcaaggtcaggactgacaagacctaccctgctgggttcatggatgtcatttccatccctaagacaatggagaactacaggctgctttatgacaccaagggccgcttccgtcttcacccaatcagggatgaggatgccaagttcaagctctgcaaggtgaggtcc

SEQ ID NO: 7715 - DNA, 471 bp, Zea mays
  Clone ID: LIB3279-047-P1-K1-E8
attttcgtctcctccccacagcagcccggcgaaaaccctagtaagcaaaccaccggagcagcggcgcttgcgcgggcggagccatggcggacgacgattacaacgaaattgacatggggtatgaggatgagcccccagaaccggagattgaggaaggagctgaagaagagcctgagaacaacgaagatgcccctgatgacgtcataggtggtgagggtgaagataaggaacaggaaaagaccatgcgtgaacgcaaaacaacaaaatacatgacgaagtacgaacgtgcgcgcatcctgggtacacgagccttgcagataagcatgaatgctccagtcatggttgagcttgagggtgaaactgaccctcttgagattgcaatgaatgagctgagagcgcgcaagatacccttcacgatcagacggtacttacctgatggaagctatgaagactgaggagtagacgagctca

SEQ ID NO: 7716 - DNA, 461 bp, Zea mays
  Clone ID: LIB3279-047-P1-K1-E9
accacgcgttcgtccacgcgtccgagccaccaccagcagtcccgcacgactagcggaataatatccaccggccacgggaacgggtggcggcgcggccggacattcaaagcgacggcgttcacgatgcgggcagtgaaggtgcctccgtactcggcctcgctggaggaggcccggcaccgcgtcttcgttttcttcaagcaggcatgccgctctatccccaccgtcatggagatctacaacctcgacgacgttgtcacgccctctcagctccgatcgaccatcgctaaggagatccgttaaaaccagaacgtcaccaaccccaaggtggttgatatgcttctgttcaacgcgacggaggagctgaacaacatagtcgaacatgcatagcagcgccatcatgtgattgcgctgtatgtgatcggccaacatggcctggtgcatgagctggggtcgaaggatct

SEQ ID NO: 7717 - DNA, 473 bp, Zea mays
  Clone ID: LIB3279-047-P1-K1-F1
cccacgcgtccgcggacgcgtgggttttttttctcgagcggtgccacacggccacattgccacaagcccacaaccagacggggagagagcgaaaaacggggcgaccgagctagctcgccgtcgtttccggctcccctccctcctcccataccgttgccctacccccactaccgcgccccgcggccccgccgggtcctcctccctccgctcgctcggaaccagaggcctcgcgacgtctcgcgccatgcgggctcgcgatctgctagggtttcctccggcgggcgcggccatgtcgtcggcggcggcgctcctcctcctccccctcctcaccgtcgctggccaggggccggtctgccagaggccgcccgtcgccgccgtcatcctgcagcaggcgtccacctgtcgagcggtggacgccccagggctccggtgtcaccgcgccggcttcgtggaggaggatgatggggccctgc

SEQ ID NO: 7718 - DNA, 312 bp, Zea mays
  Clone ID: LIB3279-047-P1-K1-F10
cccacgcgtccgcccacgcgtccgagaaaggatgtgctggaaaattgcagagaagagaaaccaaactgttatttgggtgaaacccctgaacaatgattgttacaagagacgagctcatggtacaacgccacctctatgcaaaagtggcgatgatccagattcagtatggggtgtgccaatggatgcttgcattactccgtatcctgaacaaatgcacagagatgggggatgtgggctagcttcctggcctgctcgattaacaaccgttacaccacgtacactgatttgtatgtactgcggacacatctagaa

SEQ ID NO: 7719 - DNA, 462 bp, Zea mays
  Clone ID: LIB3279-047-P1-K1-F11
gttccaactcctgagcactttctcctcgtcccagacaagccaatcgaagccgagatacgaccatggactccaccggcaccggagcagggggtaaggggaagaagggagcggccgggcgcaaggtcggcgggccaaggaagaagtcggtgtcgaggtccgtgaaggccggtctccagttccccgtcggccgcatcgggcgctacttgaagaagggccgctacgcgcagcgtgtcggcaccggcgcccccgtctacctcgccgctgtcctcgaatacctcgccgctgaggttctggagctcgccggtaatgctgccagggacaacaagaagactcgcattattccgcgccacgtgcttctggcgatccggaacgacgaggagcttgggaagctgttgggcggcgtgaccatcgctcacggcggtgtgctccccaatatcaaccctgttctgctgcccaagaaga

SEQ ID NO: 7720 - DNA, 234 bp, Zea mays
  Clone ID: LIB3279-047-P1-K1-F12
agaacacgctaacaagacaacaaggatcatggggcgcgggcgcggccacctcctgctgccggcagcagccgactgcctgtgggcgctgtcgtgcgcgctgctgctgcacgcgtcccctcacggcgccggcgccagcggactgctgagggtcgagctcagcaggcgccgcggtggactcgaccagcgcgcgctggcggcggtcaatgccgcgaggcagcacgaggcaagccgtct

SEQ ID NO: 7721 - DNA, 476 bp, Zea mays
  Clone ID: LIB3279-047-P1-K1-F2
cccacgcgtccgcccacgcgtccgcccacgcgtccgctcatcttttcgcgtttagaacctctaaaatttcccccactcgccagtcgcagcagcacctgtagccatggacgccagcggagccggtagcaaggggaagaagggtgcggccgggcgcaaggcaggcggccccaggaagaagtcggtgacgcggtccgtcaaggccgggctgcagttccccgtcggccggatcgggcgctacctgaagaagggccggtacgcgcagcgcgtgggcactggcgcccccgtctacctcgccgccgtcctggagtacctcgccgccgaggttctggagttggcagggaacgcggcgaaagacaacaagaagacgcgcatcatcccgcgccacgtgctcctggcgatccgcaacgacgaggagctcgggaagctgctggcaggcgtcaccatcgcgcacggcggcgtcctccccaacatccact

SEQ ID NO: 7722 - DNA, 477 bp, Zea mays
  Clone ID: LIB3279-047-P1-K1-F3
caaactattccctatccaaccatgccatcccttaagcatggttcatgttccagaaaaatcccaaaatactctcgtcccatattctgcctataactctcctgttcatattaagtcagacgattcattcgtcactattctcaccaacagtgaacttcgctgtgctacaccacatacacccagctataaatacacccagctaccctctccctctccacacacacgcaacaccctcagccaaggcaaacaccccactcactcagttactccgctctgccagctacacgcatagtgtcgcttcgtctccagtccaccctcctgttatcggagcgttcgtaccgtctcgtggaggccagatctacaagcctacgccaggagccagaagccagttccgcgagctctctttccccttcgccggataagcacggcaagctcactggatccctttgatgcataaattacctatgatttttcaaccac

SEQ ID NO: 7723 - DNA, 473 bp, Zea mays
  unsure (1)..(473): unsure at all n locations; Clone ID: LIB3279-047-P1-K1-F4
aaagtgagaaaagggagtgtgtacaggagggcaattgccaatggtatcactgagattctgtcagtatacagatcagctgttctgcaggttgagcaaaaccttttatcagatccgttgcctatcctcgcgacagtaactcacgggttgaacaagtttgaagtccttctgcctccactgtatgagcttgttatggaaatccagcataaagacatcaagggtggccagcttcttaatcttttgcacaaacggtgccattgtggggttccagaactgcaaagctgcattcagaggctactttggcatggacaccaggtcatgttcaaccagctgacatcttggatggtttatgggattcttcaagatcagtacagcgaggttttcattagaaggtcaacgtgcctacagggctcctcatgctattttgttcctgtttttgatgtctcatntttgtcagctgtaatctggtagaccta

SEQ ID NO: 7724 - DNA, 480 bp, Zea mays
  Clone ID: LIB3279-047-P1-K1-F5
gttaaacctgaccaattcaaggcgattaacgatgaggggatgccaatttaccagaggcctttcatgaaggggaagctgtacatccatttcacggtggagttccctgactcgctggcaccagagcagtgcaaagctctcgagacagtacttccaccaaggccttcatccaagctgacagacatggagatagatgaatgcgaggagacgactatgcatgatgtgaacaacatcgaggaagagatgcgcaggaagcaagctcacgctgcccaggaggcgtacgaggaggacgacgagatgccgggcggagcccagagagtgcagtgcgcgcaacagtaagcagactatcatcaaggcaattgggaggggtggtgcccttaaagcgtgggagtgatctctggttttgctgtcgccgagctgggaaataggaagctgaatcgacctcttaagcggagaatgtatccttttttgctgcaacataaa

SEQ ID NO: 7725 - DNA, 477 bp, Zea mays
  Clone ID: LIB3279-047-P1-K1-F6
gcggcagcaaacccaactgcaaacatctttttccatgaagcctggaaacttcagctagagctggcaaatggcacaggccacgaagatcccactttcagtagcatcgccaaggatatgcatgagaggttcgacaagtactggaaagattgcagcctcgtgttagccattgctgttgtcatggatccacgtttcaagatgaagctcgttgagttcagttactcgaaaatctatggggctggggctgcaaagtatgttaaggtggtcgatgatgctgtacatgagctgtataaggagtatgtggctcagccactcccactgaccccagcctatgttgaccaaggcgaagggaataatggaccagccaatgcgaacaacagtcaaggggctcctgcttccactggtgatgggcttctagacttcgatatgtacctttctgagatccaaagtagccagccctcgaaatctgagctggagcag

SEQ ID NO: 7726 - DNA, 470 bp, Zea mays
  Clone ID: LIB3279-047-P1-K1-F7
agagaatgctgttctgaagcggggcgttgcgatacaacacgaacgccaaaaagagtttgatgtgaggactcaggaagtcgacagccttaaacagttggtactgcaatatcaggagcagataaaaactcttgagataaataattacgcacttagagtgcatttgaagcaggctcagcagggcaattctatgcatggacgtttcccgcctgacgtcttctaatgtctgccatggctcaacagaataattatgcatggacgttcgttaatatttgatgctgtacagttggattttgaactaagcagtgtcaaataaaaaaaatcgaggtagtacctattaagataagtagactcaggacctcaagttcgactcaaatgctgcatatacgatcgtaccccatcattggagtcgacaacactaaggtccaactacctggaagctgagatgaaatagcatgttagggtttgcagtg

SEQ ID NO: 7727 - DNA, 464 bp, Zea mays
  Clone ID: LIB3279-047-P1-K1-F8
cccacgcgtccggtgggtgatgatgcttgtcttattctgtgggatgctcgaactggcactgacccagctgttaaggttgagaaagctcacagtggagatgttcattgtgttgattggaatccccttgatgttaactatatcttaactggttctgccgataactctgtccgaatgtgggatcgtcgcaatctgggttcgggaggagctggttctccaattcacaaatttgagggccataaagctgctgttctttgcgttcagtggtcacctgacagagcatctgtttttggaagctctgcagaagatggtttcttaaatgtttgggaccatgagaaggttgggaagaagaaaaattctaatgtcccagctgggcttttctttcagcatgctggtcatagggataagatcgtacacttccactggaattcgtcagatccttggacaattgcagtgtctcatatgat

SEQ ID NO: 7728 - DNA, 431 bp, Zea mays
  Clone ID: LIB3279-047-P1-K1-F9
gcgcgcgccgccacacctgccgttgctaccgtcccgtacctcgcttgctttcccgtcggcgaaatgacgaagcgcaccaagaaggctggaattgttggcaaatatggaaccaggtatggcgctagcttgcgtaagcaaatcaagaagatggaggtatctcagcactccaagtacttctgcgagttttgtgggaagtttgctgtgaagaggaaagcagttggaattaggggatgcaaggactgtgggaaggtcaaggctggcaggtgcttacaccatgaacactgctagtgcagtcactgtgaggagcacgattcgtcacttgagagagcacactgaagcgtgatttagcttgctacatcaagggtctcctagttgctgttgtctgaaatggcgagctactctagttggatcacgaaactggcttaaagttg

SEQ ID NO: 7729 - DNA, 475 bp, Zea mays
  unsure (1)..(475): unsure at all n locations; Clone ID: LIB3279-047-P1-K1-G1
cctcctcgtccccgatctcctcccacccgcatccaagggtttccttctcgaccgtgcggaacgagccagagaacaggtatggcggcggcgcggcacctcagatccggcctccccctcctccgcgcccacctcgcatcctccgaatccgcggccgtcgctcaggtttcgaggggcttcgcgtcgcaggccgctaagcccaccgggaaggagatcaaggttccaaaggctctgtttggcggcacaggcaactatgccagtgcactgttcctcacagcagctaaatctaatgcattggacaaagttgaatctgagattaaagctattgtagaggcttccaagaagagcccgttgttttctcaattcataaaggacttgtcagttccaaaagcgaccagngtgaaggctatagccgaaatatttgctgacgctgggttttcagatgttacaaagaatttcttggctgtcctggcggaca

SEQ ID NO: 7730 - DNA, 416 bp, Zea mays
  Clone ID: LIB3279-047-P1-K1-G10
accaaccacaccaccatacatctgaggctgtcagctggggctggttggcaacaagacaagaagaattggctgcctctcaacaacattcacatctactacctacctggctgctttgagaattacagggcctctactatctgctgctgtgttaaatctacctcctggtttctccaataattgccgctgttctgtactcttctcttatgttctgtctgtcagtgtgtatgagatgatgctcatcttatgttatgtaaggcttaatcatgtgtctagttgcactttctgtcttgtaatgttatcagctatatgaataataagtgttatgtaagctcctatagccaaaataaaacaatggataactacaggctgctttatgacaccaagggccgttttcgtgtttacccattctaggatga

SEQ ID NO: 7731 - DNA, 479 bp, Zea mays
  Clone ID: LIB3279-047-P1-K1-G11
cgatgagcatgtgaatgaatttaaatcaatcgagaagtttaagatattcaacactaacaacttgtgggtgaaccttaaagctatcaagagactcgtagaggctgaggcacttaagatggaaattattccaaaccccaaggaagttgatggtgtgaaagtccttcaactcgaaaccgcagctggtgcagctattcggttcttcgacaaagcgattggaattaatgttccccgctcaaggtttctcccagtgaaggctacatctgatctgttgcttgtgcagtctgatctttacaccttggttgatggctttgtcatccgcaacccatccagagcgaatccagctaacccttcaattgagcttggacctgagttcaagaaggttgccaatttccttggtcggttcaagtccatccccagcatagttgagcttgacagcttgaaggtttctggtgatgtctggtttggctctggaattacac

SEQ ID NO: 7732 - DNA, 477 bp, Zea mays
  Clone ID: LIB3279-047-P1-K1-G12
cggacacgtggggttccaactcctgagcactttctcctcgtcccagacaagccaatcgaagccgagatacgaccatggactccaccggcaccggagcagggggtaaggggaagaagggagcggccgggcgcaaggtcggcgggccaaggaagaagtcggtgtcgaggtccgtgaaggccggtctccagttccccgtcggccgcatcgggcgctacttgaagaagggccgctacgcgcagcgtgtcggcaccggcgcccccgtctacctcgccgctgtcctcgaatacctcgccgctgaggttctggagctcgccggtaatgctgccagggacaacaagaagactcgcattattccgcgccacgtgcttctggcgatccggaacgacgaggagcttgggaagctgttgggcggcgtgaccatcgctcacggcggtgtgctccccaatatcaaccctgttctgctgcccaagaagacgg

SEQ ID NO: 7733 - DNA, 438 bp, Zea mays
  Clone ID: LIB3279-047-P1-K1-G2
cactcttatagatatggctcttcgggaggcgtaagttggacaagttactgtcgatgcgggaggggacaacgaccacgggtgcttggttatcctccgtgctataacggcatacctatcagaagagccagagcccatacacacctcctcactcactggtgctagataggcgagagaaatccttgaaggacatgagagtcggcgcatatgtgagtttcgaatggagccagcaatattcaaaaccacagcactttgtctgagaagagagaatttactacgagacacacgatgagttaccattgaggagcatctggagatgttcatgtacatgatctcccacaatgctagtagccaaatgctacagaatgctttgcaacatagtggcgagactatccatagaaaaagctcctaagcgtttgttatggtgcccccactaactca

SEQ ID NO: 7734 - DNA, 442 bp, Zea mays
  Clone ID: LIB3279-047-P1-K1-G3
actaccactctttgtcttcggctacggtgccgattcggaagcgccctccctggcccggcgcgagaccctaactacatccagcatgaagggcaaggctgacacctccaataatgacgagggcagcctacctgcggtccgcaccaccagatagcgcaagacggcctccgcgagcattaagcccaagcgccaggcctccgacattttaggtgaatgacggaactcaggctcgagtatgaggcgctgcactctgtcaccaagaacgttacgaccgtcagcatggcagtaatggataagaggggtgctatttcaaaacaaaagaaacagccatatgtcgaccaagctgggcataagaagcacgactatgaaaagactaatcggaactttgataagaaggagagcacactctcaaagaaggctcagactgcggttgaggatggctcgt

SEQ ID NO: 7735 - DNA, 475 bp, Zea mays
  Clone ID: LIB3279-047-P1-K1-G4
cggacgcgtgggaggagagcagcgatgacttggctaacccaccgaaggtagaggagaagcttggtgctgtccctcatggcctgtccaccgactctgaggttgcccagagggaagccgagtctatctctaggaagactctcaggagctcagccgagaagtttgagttccaagctgaggtttccagactcatggacatcatcatcaactcactctacagcaacaaggatatcttcctgagggagctcatatctaatgcctctaatgctggataagattaggttcctttcccttactgataaggaagttctgggtgaaggggacactgcaaagcttgagattcagattaagttggacaaagagaagaaaatcctctccattcgggataggggtattggtatgaccaaggaagatcttattaagaaccctggaacgattgctaaatctggcacttcaggaacaggagctgctcgagtct

SEQ ID NO: 7736 - DNA, 354 bp, Zea mays
  Clone ID: LIB3279-047-P1-K1-G5
ggcgaggctggcggctgttgctgcgtattgcacgagcgagacgccaggtcagcggccgaccatggaggccgtggttcagcagctcagcagcacccagtgagtgagttacaagctgctgccgaggtgtagtgtctagcgaagtagcgagtgacacggtgatggaatggaagctaggctggctgggtagaggacgtcgtcttctcggccctgaaagccagcgccgccatggtcagattatgatggattgtgggagcgatggtagtgaactgatgttttgtaatgacggggcaatgacccagttgccactgacatgctagtggagtgttgattattgtagttaaccagtctactgat

SEQ ID NO: 7737 - DNA, 484 bp, Zea mays
  Clone ID: LIB3279-047-P1-K1-G6
ctcgttcctgtcgcgcagccacgacctccacttccacatcttccccggcggcggcgcggtcagttgaaccatggcggactccaaggccacctcggcggtcaccctccgcacccgcaagttcatgaccaaccgcctcctggcccgcaagcaattcgtgcttgaggtgatccaccccggccgcgccaacgtctccaaggcggagttgaaggagaggcttgccaaggcgtacgaggtgaaggaccccaacaccatctttgtcttcaagttccgcacccacttcggaggaggaaagtccactggtttcggcctcatctacgacaacctcgaggctgccaagaagttcgagccgaaataccgcctcatcaggaatggtcttgctactaaggttgagaagtcccgcaagcaaatgaaggagcggaagaacagggccaagaagatccgtggtgtcaagaagaccaaaagctgtgacgccaagaagaagtaa

SEQ ID NO: 7738 - DNA, 349 bp, Zea mays
  Clone ID: LIB3279-047-P1-K1-G7
gtgaagccgccgccgctgcagtgtccatagccaccgcaggagactgagatggggggttttgtcaagacccacaagagcaatgcgtacttcaagcgtttccaggtgaagttcaagagaaggcgcgctggcaagacagactacagggccaggataaggctgattaaccaagacaaaaacaagtacaatacacccaaatacagatttgttgtgcgatttaccaacaaggacatcacagcacaaatcatctctgctagtatagcaggtgatatggttcttgcttctgcttactcgcatgagttgccacgatatggtcttgaagttggtctgaccaactatgcagctgcctact

SEQ ID NO: 7739 - DNA, 455 bp, Zea mays
  Clone ID: LIB3279-047-P1-K1-G8
cttttctccagttttcagcccgacgctgcgcagctcatgcgcaaattgcaaggcacataccctgtctacttcttgacgaacggagggacggagctatacgccgacgtgaggaggaactcgctggaggaggccgtcaagctgtgccttgccggtggcctgcaaggaatagtttcagaagcccgcgggatcttcaggcaccctgccgccgtgccaaagatcaaggaggctaacctctccctgctaacctatggaacattgaacaacgtgccggaggcggtttacatgcagcacctcatgggagtgaacggtgtcatcgtcgacctggtgccggagatcaccgaggcagtctccgagctcatcgccctgcccgagcccgacctggaagtgggcagcttgagcaaccaggcggtagctagaggagccacaactccgaatttctcgcaaagcgagatctc

SEQ ID NO: 7740 - DNA, 423 bp, Zea mays
  Clone ID: LIB3279-047-P1-K1-G9
gcgaaggaggaggagcagcagcagcatgcggcgccgaggagcggcatgccactcagtggttgcaaccatggctaggggatcgaagaagcacttgaagaggctcaatgcgcccaagcattggatgctcgacaagcttggcggatcttttgctcccaagccatcttctggacctcacaagtccagggagtgccttcctctgatcctcatcatcaggaacaggctcaagtatgctctgaactaccgagaggtcatttatatcctgatgcaacgccatgtacttgttgatggcacggtcaggactgacaagacctaccctgctgggttcatggatgtcatttccatgcctaagacaatggaaaactacaggctgtgttatgacaccaaaggccgttttcgatctcacccaatcagggatgaggatgc

SEQ ID NO: 7741 - DNA, 476 bp, Zea mays
  Clone ID: LIB3279-047-P1-K1-H1
cttcgcccctacagatcgaaccaaggaggcagcaaccagcgcacgccactgcggcgctaggagctcgcagaagcgccgccccacgagagggagtccagagcatggaagagatccggtggcagagcaggtcggtcggagatgggagtcccggcgttctaccggtggctggcggaccgctacccgctgacggtgtctgacgcggaggaggaggagcccgtggagctcgagcccggcgccttcgtccccgttgacctccgccgccccaatcccaacggcctcgagtttgacaacctctacctcgacatgaatggtatcatccacccatgcttccaccccgagggccggccggcgcccaccacctacgacgaggtgttcaagtcgatttttgattacatcgaccacctcttcggcctcatccgccccaggaagcttctctacatggccattgatggtgttgctccaagggcaaaaatgaa

SEQ ID NO: 7742 - DNA, 450 bp, Zea mays
  Clone ID: LIB3279-047-P1-K1-H10
caacaacattcccacgccactcccagagctcctaacccggaaccacgaaggggatccatggcggcggcgggttggctccgacgtgcggcggcggtatcgctgccccgcctgccttccggacttcccctcataccgcctcctccttccggccctctcaccgaggcgcagtcgctcgtggtccccggcctcggcgccgccgccgggccagccatggagctcatggccgtccctaagaagaaggtctccaagtacaagaaaggtttgaggaatggacccaaagctttgaagcctgtgccggtgattgttcgttgcaggtgctgcggccgagtgaagctaccccacttctattgctgcagtggagaaagaggaaacccaagcgagtcgaactcataaatgttttgttttcctactttgctcactatgctacgtctgaaatctggacatcgtaat

SEQ ID NO: 7743 - DNA, 262 bp, Zea mays
  Clone ID: LIB3279-047-P1-K1-H11
cggacgcgtgggcggacgcgtgggagcagcgtggcacccctgcccgcaccgccgctgggctgtgcgtcggagccaccagcccaggctgccgccgagtctcgtgcccgcccaaggctaggcaactgcacaggaaccggggccgacaaccgtgggggcctcgcccgcgagccgcaggggctgcaccggcgctctgccgggtggccgcgcccgcgccggggggcgcctcacctgcgccgacatggcccacccggggcctgccccc

SEQ ID NO: 7744 - DNA, 189 bp, Zea mays
  Clone ID: LIB3279-047-P1-K1-H12
gccgagtccacccaatcccccgcgcggcgacgctagtcgcctccgatggcagcccggcgcgggccccacgtcatcaagcttcacgatcccaacccgcccctcctcggacgggcgccgggggccgcgccggccgccgtccccgcgtcctcgcgcgatgagggcctactcgcgcagcacctgcgcgcctcc

SEQ ID NO: 7745 - DNA, 313 bp, Zea mays
  Clone ID: LIB3279-047-P1-K1-H2
attcgccgcaactgatggcccctgcgatgccgtcctcagcgtacgtgactcaaggcatgggcgtgtccatatccgacgacgacgaggccgccgtcaaggtgcagcgtacagatccggcgcaagcgctcgcgcggccgcgatatgcgcttcggggcgcctaccggcggattgtatgtccggccgcacgtgtgggcgtgccactcctactaggcggagtcggcggatctctacccctgtacgagtcctaccgactaacgccttcgcgctaatccacactgcctcagatttgataacctgaaattagacgtgtatg

SEQ ID NO: 7746 - DNA, 407 bp, Zea mays
  Clone ID: LIB3279-047-P1-K1-H3
cttcgcccctacagatcgatccaaggaggctgtaaccagcgcacgccactgcggcgctaggaggtcgcataagctccgccccacgagtgggagtccttagcatggaagagatccggtggcagagcacgtctgtcggagattgtagttccggcgttctacctgtggatggcggaccgctccccgctgacggtgtatgactcggtggacgatgtgcccctggagctcgtgccctgcgcctttgttccagtttaccttcgtcgtcccaatcccaacggcctcgagtttgacaacctcttcctcgacatgaatggtatattccacccattcttacacctctagggcctgccggtgcccactatctacaacttggtgttcatgtctttatttgatttcatcaaccatttctt

SEQ ID NO: 7747 - DNA, 467 bp, Zea mays
  Clone ID: LIB3279-047-P1-K1-H4
gcctgagcacatcctgcgcgccgtcaaggccgggctgaaggacaagggcctggacgccttgcttgcgctggttgaggacgagacgctgtcgtcgttctcgtccctctcctccgcgtcctcctcgtccgacgaggaggcaggccgggcgcagctgaggcgcccgtcgtcggggagctacgggcggcgggcggctgacgagccggtggtgtgcagccccgcgagctcactggtggccgtcttggtgcaggccctcgcgcacagggtgagctacgtctgggtcctcgacgaggacaacggctgccgcctcgccggcatcgtcacgttcgcggacgtgctgagggtgttccgggagcagctgctgtgaggtctgacgagtgcttactgtttcctggctcccatcttgtggtgtcatggaattgaaaagaatatgagctcttgtttctgaaacatttttatttgaagagtat

SEQ ID NO: 7748 - DNA, 432 bp, Zea mays
  Clone ID: LIB3279-047-P1-K1-H5
gcaccggcagcgctccacaggcccaacctgccgtccacggcgcgaaagaagagccgcgaacccgggagtcctgcctgtcctcgtcctcctcccccttgccatccgccgcccatggcgtccgcgtccgcccccgccgtggtggtggtcttcgacttcgaccggaccatcatcgactgggacagcgacgactgggtcatcaccaagctcggcgccgccgacgccttccagcgcctgcgcccaaccatgcgctggaacccgctcatggacaggatgatggcggagctccacgccagggggaagacgcccgaggacatccgcgactgcctcaggagcgcgccgctcgacacgcacgtcgtttccgcagagaagacggcggcggcgctggggtgtgacttgaaagtggtgagcgacgcccacaccttcttcatcgag

SEQ ID NO: 7749 - DNA, 416 bp, Zea mays
  Clone ID: LIB3279-047-P1-K1-H6
cccacgcgtccggtccgagtctgagctcatctccacgcgccgccgccgccgctcgacgcccaccgcgcagccatggcggaacagactgagaaggctttcctcaagcagcctaaggtgttcctcagctcaaagaaatctggcaagggtaagaagccaggcaagggtggcaatcgattttggaagagcattggccttggtttcaagactcccagggaagcaattgaagggacctacattgacaagaaatgtccattcactggaaccgtttctatcagaggcagaattattgctggaacatgccacagtgctaagatgaacagaaccatcattgttcgcaagaactatctccactttgttaagaaataccagaggtatgaaaagaggcactccaacattccagctcacatctccccatg

SEQ ID NO: 7750 - DNA, 432 bp, Zea mays
  Clone ID: LIB3279-047-P1-K1-H7
gaagttcgctactttcttcgtaatattctatggcacatactacacaattgatgtttcatgaatatatacatatctaccaaaaaaagggttacacctgcagagttgctgcggctaattgtacaatttacataacccctgaagcgatggaagggcgaatcagctctccaaggtctctagggctgctatctggagttgtcctttgaagcatctggtgtggaggtgctatcagaattccttgcctctgacttttcgtttgagtacgtcgacaatattgtgacccagacaagctccacacagtcgacccatagaagtctttgctcaacagggaccacaccatatgtaattaagtgtgcaaaaggccacaacttccatccagcggtaagcatgggccaaaatgtagacttgagttcactgtagatagtggtaggtgat

SEQ ID NO: 7751 - DNA, 473 bp, Zea mays
  Clone ID: LIB3279-047-P1-K1-H8
cccacgcgtccgagggccacttgtcgctcgcccgcccgcgtcgtcgtctccgccggccggccggccggcctcccaaaccctagcgaggcgagcgagagagaaactagacgccatgttcgggtacaggaaggcggacccggacctcgaggccggcgggtcctcgctgctgtacccggggatgacggagagccccgaactgcggtgggcgttcgtccgcaagatctacgtcatcctcacggtccagctcgccatgacggcagccgtctcggccttcgtcgtcaaggtgcccgccgtctccaacttcttcgtctcctccaacgccgggatcgcgctctacatcttcctcatcgtcctgcccttcatcgtgctgtgccctctgcactactaccaccagaagcatccggtcaatctgctgctgctcggcctcttcaccgtcgccatcagcttcgccgtcggcatgacatgcgctttca

SEQ ID NO: 7752 - DNA, 428 bp, Zea mays
  Clone ID: LIB3279-047-P1-K1-H9
gtttagatcgcggcgccgcatctagaactaggctggaggtgctatcaaccggcgtggctgggaactacaatggtgcattgcaagtgatgtcggtggagtttcaggtgccttccccactggtgccgaccagggaaagctacttcgtgaggtactgcaagcagaacgccgacggtacatgggccgtcgtcgacgtctcgctggacggcctgcgccccggcgcagtcctcaagtgccggcgccggccgtcgggatgcctgatccatgaaatgcccaatggctactcgaaggtgacctgggtggagcacgtcgaggtggacgacaggtcggtgcacagcatctacaagctgctggtgagctcggagctggcattcggtgcacgccgattaggtgggacgcttgaccgccagtgcgagcgccttggcagtgtc

SEQ ID NO: 7753 - DNA, 441 bp, Zea mays
  Clone ID: LIB3279-048-P1-K1-A1
agagaaggaaaaatatccccaaaccctagctcccgatctcgatggcgaaccctcgcgtgttcttcgacatgaccgtcggcggcgccccggcgggccggatcgtgatggagctgtacgccaacgaggtgcccaagaccgcggagaacttccgcgcgctgtgcacgggcgagaagggcgtgggcaagtccgggaagccgctccactacaagggctccaccttccaccgcgtcatccccgagttcatgtgccagggcggcgacttcacccgcggcaacggcaccggcggcgagtccatctacggcgagaagttccccgactagaagttcgtgcgcaagcacaccgcccccggtgtgctctccatggccaacgccgggcccaacaccaacggctcccagttcttcatctgcaccgtcgcgaccccttggctcgacggcaagcacg

SEQ ID NO: 7754 - DNA, 449 bp, Zea mays
  Clone ID: LIB3279-048-P1-K1-A10
ggcgagaagttccccgacgagaagttcgtgcgcaagcacaccgcccccggtgtgctctccatggccaacgccgggcccaacaccaacggctcccagttcttcatctgcaccgtcgcgaccccttggctcgacggcaagcacgtcgtcttcggccaggtcgtcgagggcatggacgtcgtcaaggccatcgagaaggtgggcacccgcaacggctccacctccaaggtggtcaaggtcgctgactgcggacagctctcctagatctctctgatctggtctgttcggccgccctccctccgtcatcgtcgactccccctgcgtccgttcctttggatctgaataagatggtggtgatctgagtggtggtcttagtttatcatgtatcgctcgcagtttaatttagcggtttaggtgtggatctgtgaaccccatggcgcctctgcttgatt

SEQ ID NO: 7755 - DNA, 77 bp, Zea mays
  Clone ID: LIB3279-048-P1-K1-A11
aatattgggggatagcaagattaccaacgcgtgcttgcccatacatagctattttttagtgacacctaaattcactt

SEQ ID NO: 7756 - DNA, 424 bp, Zea mays
  Clone ID: LIB3279-048-P1-K1-A12
cattcaccgcattgaccctgaatcgattttagcatacaagaatgccttttctggatgctacaaggttccacggtctcctacaccatacagcggaaagctttttacaaggagtgaaagtgagactaagagaaaatcacttatccaggacgatcgtgatttgccaatcagttttcttgcagacagtgatagcatgttcattgcttgccaggggatcactatacactacaaagtttccgatccagcagccagcctaccttcatcccctggcttcttttcagagagagatactcatcacgatgtaatttcatcaagcatttctcctagaagacagaggcatgagagtccaccatctgcttcctctaatacccgtcgcgttctgaataggagctttagccatcaataccataatacttcgctatatgca

SEQ ID NO: 7757 - DNA, 493 bp, Zea mays
  Clone ID: LIB3279-048-P1-K1-A2
gcctgcacgcaccgggctcgcgcgttccgggattgacgcgcatggcactccaggcggctggcttgcttactgctcatcctccttatggctctgtcgtccgccggctcgttcgtggcctgcagcctccggccaagcggagctagcatccatgccccgaggtcgacgccgcacctgaagccgggtgctgcggcggcgtcgttcacgaggacgccgcagcgccgggcgaacgcgaccaagggcggcgtgtccaccgtgtgcgagccgctgggccccgaccggccgatctggttccccggcagctcccctccgccgtggctggacggaagccttccaggagactttggatttgaccctctcggactaggttcggagccggagctgctgcggtggttcgcgcaggcggagctgatgcacgggcggtgggcgatgctggcggcggcgggcatcctggtcccggacctgctggcgcggtggggcttcatcgacgcggtgt

SEQ ID NO: 7758 - DNA, 314 bp, Zea mays
  Clone ID: LIB3279-048-P1-K1-A3
cggacgcgtggggtatcttcggatttggatcatgagcatacagagcatggttaagacgaagcttgagccagacgaaagatgattatgacgaaggacaaggtgatcacgaagctgtgcgcagggaagcttcggcatgacagcagaaaaggggaaccgacttaaagatgaaaaggcaaattagacctcgaaagattactatagagttattagcaaatgtaaagggcatgaatgtaattttacatgggctgcgtcccttgcttataaatagatgaacggtacccccgtactgttcacgttgacttggcaaataataa

SEQ ID NO: 7759 - DNA, 340 bp, Zea mays
  Clone ID: LIB3279-048-P1-K1-A4
cctcaaagagaggtccatcctgaaagagaggcctcctcttcaggatgtgtctaacacccgcaatgagaggtccatcctgaaagagaaatctgccctgtgtagccatgaagctattaagaacccagtgaatatttttgctgatgacgaagagaccaaagggtgccatgaatgggctaaagatgggatggagggcactcactttactggaaatgattctcaaaagttggataaagatgtgccacacaaacgtttcaagaaaaaaggggggaaagttaccttcacattggttgggttgtcacattgaggatattggcatgggaaggttattggttttggtccc

SEQ ID NO: 7760 - DNA, 287 bp, Zea mays
  Clone ID: LIB3279-048-P1-K1-A5
gtgactcctcgcctgtgtcgtcaaatcctccacaccctggactgggagtggctgctgctcgggcccggcgatgagcggcggcgggcccggaggtgcgtgcgggccggactcccgcgtggagaccatctcccggctggcgcagtggcgcatcgataccttcggcccctgctgctaccggcgggcggacccctttaagctcggcatctggaactggtacctgtcggtggagaagagccggtccatctttgtgcgcctgttcccagagcccggcgcggcggccaaagagc

SEQ ID NO: 7761 - DNA, 440 bp, Zea mays
  Clone ID: LIB3279-048-P1-K1-A6
ccaaaggcccatcaaccgagagccttcgtcttccttctctcatcctttgctcctcttcaaacgctcgagaaagagagagagagacgaaaccctccttcgaaaccctagcatagccactgccttcccgcacgctaggaaggggaagatatgggcgccgaggaggacgccgctgcacgccgcgagcgtctccgcgccctccgtgccgccaaggacctcctctccacccccgacggcgccccaaccccttccaccgacggagaacaccaaaatggcaaccatgagatggcagaagagccagaattaccaggtcctcaggatgcacctggtgaggctggtaaagaggatggtagccccactgaggaggccgaagaggttgaagatgatggtgagcttccagccatgaagttcagaaactaccttccccatgatgagcaacttcg

SEQ ID NO: 7762 - DNA, 288 bp, Zea mays
  Clone ID: LIB3279-048-P1-K1-A7
gggtgaataccgagtcttgcccttctaggcaagaagaatcagctgtgcagatgtgtgaatcaacaaacccagatgatgtctggtacaagaagatgaaggcctgtgtgacaccccttccagatgtaaaagatgaaaacgacgtagctggaggtgcaatcaaacccttcccagccaggctcaacgcagttcctccaagaatcgctaatggtttggtcccaggcgttttatgccaagccttccagaaagacaataaaatgtggaagaagcatgtgaagtcttacagcagtg

SEQ ID NO: 7763 - DNA, 339 bp, Zea mays
  Clone ID: LIB3279-048-P1-K1-A8
cggacgcgtgggcagcacagcagccaggaagagcaagagcaagatgctgcgcgggggcacgggcatgctgggggtggtgaacttcataaccttcctgatctcgatccctatccttggcggcggcatctggctggcgtcgcgggccaactccaccgactgcatccgcttcctgcagtggcccatcatcgtggtggggctcgtcctcatggtcgtctccctcatgggcttcgccggcgcctgctaccgccagacctggctgctccgcctctacctcttcgccatgttcttcgtcgtcctcgcgctcctcttcttcgtcgtcttcgccttcgccggcaccga

SEQ ID NO: 7764 - DNA, 401 bp, Zea mays
  Clone ID: LIB3279-048-P1-K1-A9
ggaagggaaccgctttcggtggcttcaagagccggacccaggtcccatggcttgttgacaagtacatgaaaaaggaaattaaggtggacgagtacattacgcacaacatgaacctggctgacatcaacgacgccttccacctgctgcacgaaggtggctgtctgcgttgtgtgctggcaatgcagatttgaaattcctaagctaagcagtttttgttttggaactagaactcctttttgcctcgttaggcctggacccgctgtataatgctatgttgtgttggatggctgacgatggttactgctgtgttgctagcaatgtggtacttgatctgtatcacggttgcaaataagtgctgtttctaaaacactccctctcggtgaataaggggttgtttggtt

SEQ ID NO: 7765 - DNA, 363 bp, Zea mays
  Clone ID: LIB3279-048-P1-K1-B1
cccacgcgtccgggccccaagaatgcccgtgaggcagtgaggcactttggcaaggctcctggagtgccgcacagccacaccaagccgtatgtgcgctccaagggaaggaagttcgagaaggctcgtggcaggaggaacagccgtggattcaaggtttaaaacaaattgtggccctccgtgttgccatcagcatagtgcaaccgttgtgtttgatcagtcgacagtaattagtcatcactctgtaccgagattagtagcacaatttgttgtcctggtttgaattttggaagatatttgatgtcgtctccttattatctactcgttactggttgagcacgaaaaaaaaaataaaaaataattata

SEQ ID NO: 7766 - DNA, 395 bp, Zea mays
  Clone ID: LIB3279-048-P1-K1-B10
gtttttaggcaaggttctttatctttgtaattgacaactgaatgtgtatgcactatgcagactatgtatttgattctggtggagaaatcaggcgctgaggatggtctttcctcagtggacttgatgttttacaacagcatattgtcacttccatttctgtttttcctcattatagcaacaggagaattcccccattctcttacagtattatctgcaaaggtcagtgatacaaatgcagtataatcaaaaatttaccagcacatttaagctagcaatctctgcgtgttcccttgtatcacccctttaactcaagaatgacaattaaaggtagttctccagagtttctgaagcaaatggtttcacacttcgctgctattcattaacacaatagtact

SEQ ID NO: 7767 - DNA, 410 bp, Zea mays
  Clone ID: LIB3279-048-P1-K1-B11
cggacgcgtgggatttcccagtgtttcatcagtgtataattgtcttcattatttcttacacgtgcactaaattaatgctccgttcgtttttgtgtttcgctaggtgtcaaggtcacagattgcagcccttgtagctgatgtcttctccaatgtggcagtcgctgagaacaaagtcgtcgaagtttcaacttcctcgtcagcaacagcaaagaacatagccgaggctttcacgtgttcgaaattcatgattacatgaaacttgaagcatcatctttctcagttttgtacaacacatgtacgttgtctctacagagctatccctgaagacagaagaagaacagagtacctagaagctgctgcgaaagcccaagccgaaaaggaaacgttggcctcaaaacaagctattaaaa

SEQ ID NO: 7768 - DNA, 458 bp, Zea mays
  Clone ID: LIB3279-048-P1-K1-B12
cccacgcgtgcgcggacgcgtgggcgccgccgcagcaactgtcaccgtcgctatggcccgcatcaaggtgcacgagctccggaggaagagcaagacggacctgcaggcgcagctcaaggagctgaagtctgagctctccctcctccgcgtagccaaggtcaccggcggcgcacccaacaagctctccaagatcaaggtggtgcgcacctctatcgcgcgcgtgctcacagtgatctcgcagaagcagaagtcggcgttgcgggaggcgtacaagaagaagaacctgctccccctcgacctccgccctaagaagacccgtgccatgcgccgtcgtctgaccaagcaccagctttctctgaagacggagagggaaaagaagcgtgagaagtactttcccatgaggaagtatgctatcaaggcataggtcagaactgcgagatgctgggctttgcatatta

SEQ ID NO: 7769 - DNA, 201 bp, Zea mays
  Clone ID: LIB3279-048-P1-K1-B2
gccacgcgtacgctcacgcgtgcggacgccgaggttgagcttatccatgccgcagacgatggtgcgcctgtctatacctcgcccggctttatctgccaggatctacacctggtgaagatgggtctactcatgtgtaccaactgagcctatgtgggctacaaggaccatcagtcgcatatgagcaaacttgcagacatttgc

SEQ ID NO: 7770 - DNA, 440 bp, Zea mays
  Clone ID: LIB3279-048-P1-K1-B3
ccgcattcgttccaactcctgagcactttctcctcgtcccagacaagccaatcgaagccgagatacgaccatggactccaccggcaccggagcagggggtaaggggaagaagggagcggccgggcgcaaggtcggcgggccaaggaagaagtcggtgtcgaggtccgtgaaggccggtctccagttccccgtcggccgcatcgggcgctacttgaagaagggccgctacgcgcagcgtgtcggcaccggcgcccccgtctacctcgccgctgtcctcgaatacctcgccgctgaggttctggagctcgccggtaatgctgccagggacaacaagaagactcgcattattccgcgccacgtgcttctggcgatccggaacgacgaggagcttgggaagctgttgggcggcgtgaccatcgctcacggcggtgtgctgccca

SEQ ID NO: 7771 - DNA, 355 bp, Zea mays
  Clone ID: LIB3279-048-P1-K1-B4
ctcactagtactcagccgccgcaatcagggacaggtagctcgagcgcgcgctccacctgctccgacgcgatgcgggccaagtggaagaagaagaggatgcggaggctcaagaggaagcgccggaaaatgaggcagagatctaagtaggcgcatcttgtgacgaggatggcgagcttctcctgcatcatggctgaggctcgttgggatgatggtctccctttgcagacgtcctttgctgtagacgtaggcgatgtaaaccgtcctttttgattcattctagcatgttctgagactgggtttatattgtaatttgaggataattatatgatgctctaagttaaatcagattcctggc

SEQ ID NO: 7772 - DNA, 321 bp, Zea mays
  Clone ID: LIB3279-048-P1-K1-B5
gtgacgggtgtgatcaaccttcaaggccaacacaggtgcatgcgcactcatttccttctgtacgtcggggtactgctcatacagctacagcgacagaagagtctgctgagctagaacccgctattggcacactaaccagactattatgcgagacaaccactgacctgggaggatcacacgctgctcatgcataaaaacgcataagttgcgacttttcgtggccaataggggcattatttgggcgctcgatcttgaggacatatcttcaaacggctcatcaaaactcatttaactgtgcagtgcgagtgacgctagcgaatt

SEQ ID NO: 7773 - DNA, 186 bp, Zea mays
  Clone ID: LIB3279-048-P1-K1-B6
ctgtcacgtctgatcaaccctcaaggccaacataggtgcatgtacactcagttccctttgtacggggcagtacgtgctcatacagttaatacgacaaactattctgcttagctaaaaccttctattgccacactatccagactattatactagacaaacaatgccttgagaggatcacacactact

SEQ ID NO: 7774 - DNA, 394 bp, Zea mays
  Clone ID: LIB3279-048-P1-K1-B8
gttcgtcctgcgaatccagtccgtcgacttccccgacgccgccgtggcagcagtcgccgccgacgaagtcggcaccagcagcggcggcgttaccacctctcgtccgctctccagccaccctcccccctctaccaccacatcgtccatacttactctcgagctccccggcgcaaaccccgtcgcgcccagccgaagccctaggatcctccacacccgcggcgtcatccacctctaccactcgtcgtcctccacttccacctcctcctcctacgcctcggcggtcgcagccacctcttcctcctcatccgggccggccaccccgcagcccgcctccgactcgcacctgcccctatgtcgcggcacgcgcctcctggtgctcgccgttccgacgcgc

SEQ ID NO: 7775 - DNA, 420 bp, Zea mays
  unsure (1)..(420): unsure at all n locations; Clone ID: LIB3279-048-P1-K1-B9
cccgctcccagctcgtgttccgcttcttgcagccgtcgccgcgaagcgctccagagaacttccgtcaacatggggaagacacgtggtatgggagccgggcgcaagctcaagacccaccgcaggaaccagcggtgggctgacaaggcatacaagaagagccatttgggcaatgagtggaagaaacccttcgctgggtcatcccatgccaagggcattgtcctggagaagattggtattgaggccaagcagcccaactccgctatccgtaagtgtgctcgtgttcagcttgttaagaatggcaagaagattgctgccttcgtgccaaatgacggttgtttgaactacattgaggaaaatgatgaggtcttgattgctggatttggtcgtaaggggcacgctgtgngagatattcctggtgtc

SEQ ID NO: 7776 - DNA, 455 bp, Zea mays
  Clone ID: LIB3279-048-P1-K1-C1
cccacgcgtccgatcgcctcccaagtccacaacttacgccgccgctcgctccaccgcgcaagaggctgctgctgccgctcacccacccccgctcgcgcagaaggccgccgcagctctcactactggtgccctaaacgccgatacccctcttcgcctccctttccccacccaaaaccccggccttcagggttccggcaccatgccgcagggagatcacatcgagctgcaccagaagcgccatggcaagcgcctggaccacgaagagcgcaagcgcaagcgcgaggcccgcgaggtgcacaggcgctcgaaggatgcccgcaatttgattggtgctaagggcaagaggttcgccaagaaacgctatgctgagaaggcacagatgaagaagactctgaaaatgcacgacgaatcaaataaacgacagaaggttgatgatgatgtccaagagggtgctc

SEQ ID NO: 7777 - DNA, 361 bp, Zea mays
  Clone ID: LIB3279-048-P1-K1-C10
ctgcatcatgtccaagcacttcaagtctgataagccaaggaggcatagcggtctggatggcgagcgtgaggcatctgccgaggtgtaaaagcatgtctgtagcaaggatatatctgttctgcaagacctcctgattttagtaagtaccgaggtagtatgttgcaggatataacatggtcctgtgctgttgtagcccgagtttaggtgctgtctatgcagtatgatgtgcaggagcatatcctccagcacatggctaacccgatcacatctaagtcacatgtagcgtaactgtaatcctattcatactatatgaagaatgtcagtgtagcaacccttgaaaaaaatggacctttcggacctt

SEQ ID NO: 7778 - DNA, 335 bp, Zea mays
  Clone ID: LIB3279-048-P1-K1-C11
cccacgcgtccgcttctcctccccctccggttcgggttcgggttcgtgaggttctccggggttcggtttcgtgggtgagcggatcgagatggcggcgtcggatgttgagtaccgctgcttcgtcggcggcctctcctgggccacggacgaccactccctccacaacgccttcagcacctacggcgaggtcctcgagtccaagatcatcctctatcgggagacgcataggtcccgcgtcttctgcttcgtcaccttatccacggaggaggcgatgcgcatcgccatcgagggcatgaacggtaatgctctgtacggactgatcatctccgtaaact

SEQ ID NO: 7779 - DNA, 407 bp, Zea mays
  Clone ID: LIB3279-048-P1-K1-C12
ctcttacgatgaggatccttatgctgaagagtttgtcattaacaccagcgtgcgttaggcttaaattgacgcacggtttttacctgctccttgtctcaaatataaggaaaccgcttgagagtaatgactcggtgcctatagctgggctgtgctatctgatgcacaatgaaattggttaacggcggcatagtgacgagctggacctgtgtgaattttgctcgtaatgtgcaagagagcgttgatattggatcctgccacgaacttgctccgatgtgccatgcctcccgaatggactttgagcttgtgcctatgcttacacgatatatacacgcatcctgataaagtggagcgagctatcaaagcctgcttccatgacgcgatgtacttactcggaccacagcgcatag

SEQ ID NO: 7780 - DNA, 382 bp, Zea mays
  Clone ID: LIB3279-048-P1-K1-C2
cggacgcgtggggcgccgccggacaattcgttgctcgcgatcctcgcttcgggatccggaagagatggccaagtcgaagaaccacacggcgcacaaccagtcgtacaaggcgcacaagaacggcatcaagaagcccaagcgccaccggcagacctccaccaaggggatggaccccaagttcctgaggaacctgaggtattcaaggaagggcaacaagaagagtggtgaggctgaggagtaggaaggaaagcatggttgtgttttctatgttttagctcagttgtaaggtggaactaaatggtgttatctgatggcaaggaccttttgctccgaaatgtttttatgataatcatgttttgaagagttacggtttactttcatt

SEQ ID NO: 7781 - DNA, 444 bp, Zea mays
  Clone ID: LIB3279-048-P1-K1-C3
cgccctctcgctccagccgcttcacagcgccgccgctcgcctctccgaccgccgcgagaatgccgttcaagaggttcgtggagatcgggcgcgtggccctggtgaactacggcaaagactatggccgcctcgtcgtcatcgtcgatgtggtcgaccagaacagggcacttgtggacgcccctgatatggtcaggtgccagattaacttcaaacggctctcacttactgacatcaagattgacatcaaacgcgttcccaagaagtcaaccctgatcaaggctatggaggaagctgatgtgaagacgaagtgggaaaacagctcatggggcaagaagctgattgtccagaagaggagggctgcgctcagtgactttgacaggttcaaggtcatgctggcaaggatcaagaggggtggtgctatcaggcaagagctcgccaagctga

SEQ ID NO: 7782 - DNA, 424 bp, Zea mays
  unsure (1)..(424): unsure at all n locations; Clone ID: LIB3279-048-P1-K1-C4
cccacgcgtgcgcccacgcgtncgattcaataccgtccggttggatttgcttgctactagtggtgaaagttgtgccgtgcagactgggctggctctcgcaactaggcaggcaccggatggctttggccttgggcgatgagcgtcccgagcagcgaagcggtgcacactgtacggtatggccgtggcaaagcgagggggtagggagaatagcattgaaaaagctgtgaaagcttccatatttttctttagaggaggacctttgaataaaaaaaaactaagatgtgaggaggaactaaatggagtcataatggtggaaaggacctttggctccggaatgcttttagtgcaatcatgtagtgtagagtcacggtctactgccgttaaaaggtgatgctggcttggatcaagaggggtggtgctatca

SEQ ID NO: 7783 - DNA, 301 bp, Zea mays
  Clone ID: LIB3279-048-P1-K1-C5
agccttccgccaacccttccggcgggcctttaccggttaggcctcttggttgccccaactggcggtgggtcttgcctttgtcctggggggttgggggggggcaccactggcaagttagcaaaggcccttgttggacctaaaataacggtttcaatggccgccgtattgggttaccatggcattatggccagttggggaatggttaaataaagtaatattggggtcaaaaaaaaaggagcttttttccttttcctaaaataatcaagttcacttcaaaatggggaggtttaattttaacttt

SEQ ID NO: 7784 - DNA, 462 bp, Zea mays
  Clone ID: LIB3279-048-P1-K1-C6
cggtctctaccaaaaaaacagcgacctctaacgcttagctagctctttgtgtcagcgcctgagcatcgagctattggcatggcgcactccaccaccttggccctggtgattgtcgttgtgctggcgctcacctttggtgccacggtcagtgtctccgctcccgtgaacaagtcgtgcgtcagcggtagcgccggcgccagcgtgagcattggctacggcggggcaagagccagcgccggcgctggcgtgtcccttggcgccgacgcgtaccggagcacgtgcccccgtgccgaggagatcatccgtgcggccgttgagagggccgtcgctgccgacccacgcatggcagcgtctctcctgcgcctccatttccatgactgcttcgtcaacggctgtgacggctccgttcttctggacgacaaggccgttcttcatcggcgagaagacggctgtgcccaacgc

SEQ ID NO: 7785 - DNA, 441 bp, Zea mays
  unsure (1)..(441): unsure at all n locations; Clone ID: LIB3279-048-P1-K1-C7
cccacgcgtccgggcctctgtcccttgcaagttcaatctcacctccaaccatgggtaaagagaagtcccacatcaacattgtggttattggccacgttgactctggcaagtcgaccaccacaggacacctgatctacaagcttggaggcattgacaagcgtgtgatcgagaggtttgagaaggaggctgctgaaatgaacaagcggtccttcaagtacgcatgggtgctcgacaagctcaaggctgagcgtgagagaggtatcaccattgatatcgctctgtggaagtttgagaccaccaagtactactgcacggtcattgatgcccctggacaccgtgacttcatcaagaacatgatcactggtacctcccaggctgactgtgctgtccttatcattgactccaccactggtggttntgaggctggtatctacaaggatg

SEQ ID NO: 7786 - DNA, 449 bp, Zea mays
  unsure (1)..(449): unsure at all n locations; Clone ID: LIB3279-048-P1-K1-C8
gaagcttcttgtctagctagccgcgcccgcgcgccatgtcctccatgaagagaagcattgcgtctagcgtcatcgtcgtcctactggtgctctcccttgaagccaccttcgcggacgctgtccgcgtcatacccgacgccccggccggcggcgccatcgtccgccttccgagcgacggcgaaggaagaggagcgactactgcggcggcggcggcggcggacgacaagaagcagctccggtggtgcgagcacccaatctgcttccctgagtccgacatctgcttctgcccctactacacccgcgacgaccggacgacgacggagagcggccgcggcgccaaggacgagctagtgcatgacagtctcgtagtgccgncgcgcgcaccagcaccaccatgcgagcacccgttctgcatttttatcaagggagagccggtgtgcaggtgtctc

SEQ ID NO: 7787 - DNA, 293 bp, Zea mays
  Clone ID: LIB3279-048-P1-K1-C9
ccagaagacgtcttgctgctcgtcttaagcttgcctgatttctctggttccttgtgactattactaccgtttgtgcgagcacgcaaatgtatttgttgcattattgctgatagcatctgttcgttggccagatgagtagagagctgaaaaaatgttaagaacaccatagagagaagtccatccgttctctctcaacttaaggagcaaacagcaacacttaattttttttctgctttactgtttattagtcgcgttacatttgtgaacagttattgtaatatctttttttaaaa

SEQ ID NO: 7788 - DNA, 269 bp, Zea mays
  Clone ID: LIB3279-048-P1-K1-D1
ccctcttattttctctagtactcttggaccttggtgtcacaatacaatgacaaatctataccaaacattaaggagtgtaatgtaaaatatattcttgtatgattattaaagtctcaagaagagcatgtcatagaagaagtaaagtcaataaatgactttatattagtaactctaacttatgtatattgcataataatatcttatgtaatagagaatatatctcatggaagagaaatattattcgctaagaatgagaacattctttaagg

SEQ ID NO: 7789 - DNA, 371 bp, Zea mays
  Clone ID: LIB3279-048-P1-K1-D10
gttggaactacctgatcacactacttattgtagccgctctgctctacacgctggggctagatgtgaacgccatctgtatcggcatgctgctggcaacgctatcccaaactgatgtgcttgtgtttataacgtcggagaccgactgggaaaaacaggtggaggttggtcaagagatgttgaagatacaggtcatggaagagaacatacgactccaggggtccagactaaaccctcatgccggccctcaactgcactgtgtatctctagttttccactgaccaaaagaacaaaacgagggacactactgcttcacgtacaagccgatctgaggctgaaggatcatatatgggctgatggtatcgaaacacaaa

SEQ ID NO: 7790 - DNA, 455 bp, Zea mays
  Clone ID: LIB3279-048-P1-K1-D11
ccccaatcacgccacccgacaccgcgctccgcagattcgtagtcgccgctaggcttccggcgagatggacgtggtgaaggcggcgcagttgtcggggcggacgctggaacgggtagtggtgcatcccttggtgctgctcagcatcgtcgaccactacaaccgcgtcgcccgcgacacccgcaagcgcgtcgtcggcgtcctcctcggcacctcatcccgcgggtccgtcgatgtcaccaactcctacgccgtgccgtttgaggaggatgacaaggatcctaggatctggttccttgaccacaattaccacgagtcaatgttctccatgttcaagaggattaatgccaaggagcatgttgttggctggtacagcactggcccaaaactaagggagaacgacttggatgtccatgcattattcaacagttatgttcctaatccagtcttggtgatta

SEQ ID NO: 7791 - DNA, 455 bp, Zea mays
  Clone ID: LIB3279-048-P1-K1-D12
cggacgcgtgggttcgtgcgccactgccacttccggtcttccgcccgccatggccgaggcccccacgtatcagatcctggtgcgtctcctcgacgggcgcaccacatgtcttcgcttctccacgcccaccgtctccggcgccgtgctcctcgaagctgtcgcgtctatatctcgcgtccccgccgccgccctccgcatcgtcaccggccgcttcgacgtctcgccctccaacgtcctcacctcaccagctgatggccagttcccctccgcctccgcgctcctccgccttcgaggaggcaagggcgggttcggctccctcctcagaggggccgcctccaaggcggggcagaaaaagactagcaactttgacgcctgccgcgacatcaacggtcgccgcctccgccacgtcaacgctgagcgccgcctcgaggaatggaaggccgaggccggggacc

SEQ ID NO: 7792 - DNA, 399 bp, Zea mays
  Clone ID: LIB3279-048-P1-K1-D2
gcttctgatccgctttagctatggtgttgcccgcagacctagcctactgacaatattatacgcaagtggacatgaagggcgaggtacccgtcgtcgtgtctgatgatgaaggtaacgggctgagcgtgtcgtgcgcggacgcagaggaagcctctactgcatctgtctcggctgaacagatcgacatggaggcgtacgctgtgcagtactcggggaggacccgcatggtgcgcatactttttgtcgccaaccggtagcggcgtggatgcgatgcaactcgaggcgctgcgggtggctcactactagatcaagcgcgttgaggacgtgcagctgcaacgtgacgtctttaccaagattggcggtcgatctaaaggatccaagcttacttacacgtgcatg

SEQ ID NO: 7793 - DNA, 449 bp, Zea mays
  Clone ID: LIB3279-048-P1-K1-D3
gtcttcgtactcgcctacctccgcggctcaaacctttcccccttctcccaattcccgccgccgctccatcccgtaacgcgacaccatgagggagtgcatttcgatccacatcggccaggccggtatccaggtcggaaacgcgtgctgggagctgtactgccttgagcatggcattcaggctgacggtcagatgcccggtgacaagaccattgggggaggtgatgatgctttcaacaccttcttcagtgagactggtgctgggaagcacgtgccccgtgctgtttttgttgaccttgaacccactgtcatcgatgaggtgagaactggcacctaccgccagctcttccaccctgagcagctcatcagtgggaaggaggatgcagccaacaactttgcccgtggtcactacaccattggcaaggagattgttgacctgtgccttgatcgca

SEQ ID NO: 7794 - DNA, 457 bp, Zea mays
  Clone ID: LIB3279-048-P1-K1-D4
gcagattctacatagcagaagtcctcctggcgctagaatacctgcacatgctcggtatcatataccgtgatctcaagccagagaacgtccttgtccgggaggacgggcacatcatgctctcggacttcgacctctcccttcgctgcgcagtcagcccgacgctgatcagatcctcgaaccctgacgcagaagcgctcaggaagaacagccatggctactgtgcgcagccagcttgcgtcgagccgtcctgcgtcgtccaaccgtcatgcgcagccccgaccacctgctttggcccgcgcctgttctcctcgaagtccaagaaagaacggaagccaagacctgaagctgccaccccggtcaacccttggcctgagctcatagcagagcccagcgacgcacggtcgatgtcgttcgttgggacgcacgagtacctggcccctgagatcatcaaaggcga

SEQ ID NO: 7795 - DNA, 463 bp, Zea mays
  unsure (1)..(463): unsure at all n locations; Clone ID: LIB3279-048-P1-K1-D5
gcattcaagataccaagtacagagattgacaaatcagcgagcaaattcttctcttactgggatcctgacaagaaggaatacctgctgcaattgtccttcaagccaaggccgccagaaggtagtaaaccaccaccagctcctcctggaactttgcctaatgggactggngctcctggtgctccaccaaggccaccggngcaagctcccccaccacccccgtcacaaattccaccgtcccctcctgcacctatgggaatgccccctaggattcctccaccacctattggggctgttcaacctccgccacctccagcacgagtggcaaatggtctgcggccaatgattccaccgccacctaacttcactcccggagcacccncaccgcgccctacaatgcaaggctttcctgggcaacagcagtagttgactgcttagcaggcaatgttccagtaattggcagtca

SEQ ID NO: 7796 - DNA, 377 bp, Zea mays
  unsure (1)..(377): unsure at all n locations; Clone ID: LIB3279-048-P1-K1-D6
cccacgcgtccgcccacgcgtncgatgacgcgtgggcggacgcgtgggctctctctatgataatcggagaaataaaaatacgacttgacatgatactaaaactatctacaaaaagacggtggtcacccatggccaaaaaggcctatggccacgcatgatgaaacggtacttatagaggcagcatacagtctaccggcgctggcttccctagcaaacctaacgcaccttgttccgcgccgtcgtgcatggaaggaagaacacgctggaactcattgaggacaacttgacgctgtggccccgttgtccagctagagataacactgtcttatgcgtatgcgcacatattaatcctccttcaacgaaactattatccatgt

SEQ ID NO: 7797 - DNA, 446 bp, Zea mays
  Clone ID: LIB3279-048-P1-K1-D7
gtcatctcctcctcctcagaaacccaccaaccccgtccagccgccggctgtctcggccgtcgccgccgccgccgccgccctatcccggtccttcaggtgaaccaggttggccatggccttcaacaagatcaaggtcgccaaccccatcgtcgagatggacggcgatgagatgaccagggtgttctggaaatctatcaaggacaagcttatattccctttcgtagacctcgacatcaaatattttgacctcgggcttccacaccgtgatgctaccgacgacaaagtcacagtggaggctgcggaggccacactcaagtacaatgtggctatcaagtgtgccaccattacaccagatgaagcaagggtaaaggagtttggcttgaaggctatgtggaagagcccaaatggcacaattaggaatattctgaatggcactgtgttcagag

SEQ ID NO: 7798 - DNA, 434 bp, Zea mays
  Clone ID: LIB3279-048-P1-K1-D8
gagatgatgtttggtgggcgttatgtaattatgatgatggcagttttttcaatctacacaggattaatatacaatgaatttttctctgttccatttgggcttttcggtaaatctgcctatgcatgccgtgattcttcttgcagtgatgctactaccgaaggacttcttaaagtaagagatgcatacccttttggtgtggaccctgtctggcatggtagccgcagtgagctaccgtttctcaactcactgaagatgaagatgtcgattcttcttggagttgcacaaatgaaccttgggattgtgattagctacttcaatgcaaaatttttcaggaacagtattaatgtgtggtaccagttcattccccagctgatcttcttgaacagcttatttggctacctgtccttgctcattattattaagtggtgcacggg

SEQ ID NO: 7799 - DNA, 308 bp, Zea mays
  Clone ID: LIB3279-048-P1-K1-D9
ctcgtaaccgtagaagcaatatcttatgatctaatccagaacaaagcaaagggaaggtgtggagctatggcgcgaggcaatggtgtccgcgaaggacggcgattgtcgctgcaacaagaaagaatgcgatttcttggagatccactgctccaatgcagtgtaggacaagatgaatcagttggtttctcatgggaagttagtacaccaacccattaaggtcccccgccgctgtgttcctaacctctgtgattgcgtacctatctgttgagagaagaccactggcaccgaaccctgtgacggatcataat

SEQ ID NO: 7800 - DNA, 404 bp, Zea mays
  Clone ID: LIB3279-048-P1-K1-E1
gtccgggtgagggagtatgatgctaggcgcagccgttctcgctccagaggcagaaacggctctaagtcaagaagcagaagccacagccactcgtactcaagaagcagaagctgcagttatagcaagagtaggagcccaagatctagatctgcttcagagtcaaaatcacctgttaaggcaagatcaccatccagatcccctcctgtttctccccggcgtgacaagtctgcaagcaggagtcctgccaggagcaagagtctgccccgatcttgttctccggcaaaatcagagtgaatcggattctgcacttgaaacgttcagaaaggcagagctcgagctaaaagattgctgtacggattatgagcactgtgctagtagcattgctgtcccttccatatttttac

SEQ ID NO: 7801 - DNA, 457 bp, Zea mays
  Clone ID: LIB3279-048-P1-K1-E11
ccaccccacccacggaaagcttcgagctttctctctataccccagggagaaggaaggaagccggcacagtctactggccttgtggtgccggcaactgactaggatcgagaaatagggttcttggagagcggccggtccatggcacagcggggcgagctggggcggcagctcccgctgagaggccccctcaaagccctagaggcagacatccaccacgctaacgccatggcagatgctattcagaggaattatggtggcgcatgtgtgcagatgaggctgtcgttcagctccctggctccattgtttttgtacttcatccaatggctggactgcggctgctgttatgcccttcccagctatttaggattgtttcacattctcatatgcaaggtttatgctgatggagatagctcagtgtcgacatatgaaaggcgggcaagccttaaggaattctacg

SEQ ID NO: 7802 - DNA, 403 bp, Zea mays
  Clone ID: LIB3279-048-P1-K1-E12
cggcctgctgggtggcttcgccaggcgcgggctcaacctgacggacctggtggcgctggcgggggcgcacaccatcggcgtggccagctgctccagcgtcaccccgcgcctgtaccaggggaacgccaccagcgtggacccgctgctggactccgcctacgcccgcgcgctcatgtcctcgtgccccaacccgtcgccggcgtccgccaccgtgggcctggacggcggctcgccggccaggttcgacagcgggttctacgcccgggtgcggcggggccagggcacgcttgcctccgacgccgcgctggcgcataaacgccccggcgcgcagattatggccgacctcgccacccgagccaggtggtacgccgactactccatgtccacgaagaatatgggccgg

SEQ ID NO: 7803 - DNA, 212 bp, Zea mays
  Clone ID: LIB3279-048-P1-K1-E2
cggctccgtccgccgtggacgcccacgccctttccccttccgtcgaggccgccgacgggtccgggctcgtacgccgtggccgacccccactcctactctaaaggccgacgctgttgccctcgcctgagttccctcccaatttccatagattgtacattgttctaaaagcttgtgaacgataatgtatccttgatagatttctggtattattc

SEQ ID NO: 7804 - DNA, 403 bp, Zea mays
  Clone ID: LIB3279-048-P1-K1-E3
ggacggaggaacgcgagatagatcgagcgccggcgatgccgccaccgcacccgacggacgcggaggcggggcccgagcaggtggcgccgacggaggcggtgcccttggcggctgcggcgccggcgccggtcaagaagaagcggaacctccccgggacgccagatccggacgccgaggtgatcgcgctctcgccggggacgctgctggccacgaaccgcttcgtgtgcgaggtgtgcggcaagggcttccagcgggaccagaacctgcagctgcaccgccgcggccacaacctgccctggcgcctgcggcagcgcgggcccggcgcggccccaccgcgccgtcgggtgtacgtgtgccccgagcccggctgcgtgcaccactccccgacccgagccctcgggga

SEQ ID NO: 7805 - DNA, 462 bp, Zea mays
  Clone ID: LIB3279-048-P1-K1-E4
cccacgcgtccgcccacgcgtccgcccacgcgtccgcccacgcgtccgcttggctcttgcctcctgcatctctagagaggcacatcccagctccaagcttcgcgccttgttggatcgtggcgtccaagcaacggtggtagcggagcgcgaggcagtggccgcagaaggaagcgcgaagcatccatggaccaacgccaggtggttagcgagaattatgccaatcccataacatgcttcttccatgtgctattcaaggcgggggcgctagccttctacatcctattctcgctctttgtgaagagcttcgtcatcatcttcgtgatcacggtgctcctcgcagcgcttgacttctgggtggtgaagaacgtcagtggcaggatactagtcgggctgcggtggtggaatgagatcgatgatgacggaaacagtgtggggaagtttgaatgccttgatggggagtct

SEQ ID NO: 7806 - DNA, 464 bp, Zea mays
  Clone ID: LIB3279-048-P1-K1-E5
ctccgcttccaagatgtcgaagcgagggcgtggaggttcggctggtaacaagttccggatgtcactgggtctaccagtggcagctactgtgaactgtgccgataacactggggccaagaacctgtacatcatttctgtgaagggaatcaagggtcgccttaacaggcttccttctgcctgtgttggtgacatggttatggcgaccgtgaagaagggaaagcctgaccttagaaagaaggtgatgccagctgttattgtgaggcagcgcaagccatggcgccgaaaggatggtgtctacatgtactttgaagacaatgctggagtgattgtgaacccaaagggagagatgaaaggttctgccatcactgggcccatcggaaaggagtgcgctgatctctggcccaggattgctagcgcggcaaaatgaatcgtctaaagggaagcagtttggcgaatttcattta

SEQ ID NO: 7807 - DNA, 365 bp, Zea mays
  Clone ID: LIB3279-048-P1-K1-E6
gcgcgagtcactaagactcgcggtcgctgaaatcctgttgcctgcctaccgatcattcataaaacgttttgggcctctcattgagaatagcaaagcacctgggaaatacgtgaagcacactcccgagcaactcgagctgctgctaggcaatttattcgaggggaaacaagaacgtgcttgatagtttggtaccgcccgcagcaaggatgtgctgctcttcagcttctatgtaaaatacaaaataataaaaataaaaaagatctggaggccctgttagcgttagcattgcttgtgttctccccaatccttgtttagccgcattattatttgtacagaagaatatatgtgtcagctgtgccttggtt

SEQ ID NO: 7808 - DNA, 445 bp, Zea mays
  Clone ID: LIB3279-048-P1-K1-E7
cccacgcgtccgccggccgtcacatcagccacacgccgacgcgccgccagtcgccgcacgagggggcccgtgatgccgaagaagatgggcgtgaactccaaggcggaggcggcccgcgaccgccgctccgccgcggaggccgaccgccgcgaccgccaggagcgcgccaaggaggagcagtactgggccgaggctgagggccccaagtcccgcgctgcgcgccgccgggaggaggacgccgagaagcgcgccgaggccgcggctcgcaaggccgagaaccgccgcctcgccgaggcagaggccgccgccgtcgccgcttccgcatcggcgccgtccaaggccgcagcgcgcaaggcgtcccgcgttgccgctccgccccccaaggttaccgaggccgagctcgtgcgcctccgcgaggaggagcggctccgcctcgagcgggagg

SEQ ID NO: 7809 - DNA, 443 bp, Zea mays
  Clone ID: LIB3279-048-P1-K1-E8
cacgcccccgctcctctcgtctctatcttcgcctcttccatcgcaggattcagcggccatgggcggcggcaacgcccagaagtccaagatggcgcgcgagaggaacgccgagaagaacaagggcggcaaaggcagccagctggaggccaacaagaaggccatgaacatccagtgcaagatctgcatgcagaccttcatctgcaccacctccgaggccaagtgcaaagaacatgcggaggcgaggcatcccaagaacgacctctaccagtgcttcccccacctcaagaactagtaagcagcagaagcatatgctctgctcagctaaaagacaagtactacatatatatatatatacgctgtgtgtcaattaatgggttctaggctgctgctgatgcggctgcttcgttcgtgttgccccgtctgattatgtactggaacccttg

SEQ ID NO: 7810 - DNA, 387 bp, Zea mays
  Clone ID: LIB3279-048-P1-K1-E9
aaagcaacctccagtcttccaacaatcctgaaaagccagcagctaaagcagatcctgccaaggcaaccgctaatggtgttccaaatggtactggtcacactcacagttacagtggaactgtaccaagccaacaaagttcagcactgacgcctgatggaacttatagggcgcccttgctaggtggagttccttctgctggttacctagacacgacatattatgggtatgacagcacaggggcacaatttgcatggtatgatggctctgcttatgcaaatggacagcaaagaacaaccacaactaatcgttttccatcctcgtcattcagtggtaatggttcatctgcaatatatcagaacaagagctccaccacgcaacagatgggta

SEQ ID NO: 7811 - DNA, 390 bp, Zea mays
  unsure (1)..(390): unsure at all n locations; Clone ID: LIB3279-048-P1-K1-F1
cacagctggctagcatacagacgaataatctcttcttcacctcactaacaccagctagcaactctttctctcctgcaataatggccgctcgctcctcctcctcccagccgcagctggtcgcggcggcggcggtcctggcagcggcgctgctgctgctggcggcgggggccgggacggcgtcggcggcggtgagctgcggcgaggtgacgtcntcggtggcgccgtgcctcgggtacgcgatgggcagcgcggggtcgccctccgcggcgtgctgcagcggggtgcgctcgctcaacagccgcgcgtcgtcngcggcggaccggcaggccacctgcaactgccttaagagcatgacgggcccggttcggcggcggcctcagcatggccaac

SEQ ID NO: 7812 - DNA, 453 bp, Zea mays
  unsure (1)..(453): unsure at all n locations; Clone ID: LIB3279-048-P1-K1-F10
ctcattcatctccattcgaaacaccctcgcacccacactctcccttcgtccccagcctaaatccccgcaacgatggctcgcacgaagcagacggcgcgcaagtccacgggcggcaaggccccgaggaagcagctggcgaccaaggcggcgcgcaagtcggcccctgcgaccggcggcgtgaagaagccgcaccgcttccgcccgggcaccgtggcgctgcgcgagatccgcaagtaccagaagagcacggagcttctcatccgcaagctgcccttccagcgcctggtccgcgagatcgcgcaggacttcaagaccgacctccgcttccagtcctccgccgtcgccgcgctggnaagagccgccgaggcctacctcgtcggcctgttcgaggacaccaacctctgcgccatccacgccaagcgcgtcaccatcatgcccaaggacatccagctc

SEQ ID NO: 7813 - DNA, 457 bp, Zea mays
  Clone ID: LIB3279-048-P1-K1-F11
cccacgcgtccgcggacgcgtgggtgcagttggatactgttgcaggtaacaactactcttctccggactctcggggtttcccgacgtccaccacccatcctcgcttctctcgagtcctcaatccatcctccggctgctccctcccagcgacgaaaccctagcccgtcacctcgacgcctagcccgccaccttgccgctcgtcgctgcaggtttatggcgcctgtgtgatcggatcagcagtccgctccgtctccctcggcccacgcatctgatgttcctctcccgcatcgtactccgcgacctggattccatcgactctccggcctccatggcgtcctcgaagaaggttgtgacccgtgacgagtgggagctgaagctccgcgacgtcaagatccgcaaggaggacatgaaccgcctcgtcatgaacttcctcgtcaccgagggcttcgtcgacgcc

SEQ ID NO: 7814 - DNA, 458 bp, Zea mays
  Clone ID: LIB3279-048-P1-K1-F12
cccacgcgtccggattttttgaccaaccctccaaccggtgcggcttcgatctttcctctcctatcacctgaatccctcgagtattcatcgccggcgcagcgcggtctcttcccttcgctggagaagggggaaggggacacgaacggagcagaaggccatggacacgatgcggggcgcgctggagcgggccaagatgctggtgggcatggaggtcgacgaggagtccgcgttgccaccgcccgaggagcagtccttcttcgacgacatcaatcggcactgcaccctcaacaccactcagaggctctatggtttcgcgatatgcttggctgccggactgacgtgcacattcttgtcaatgcttgtcttcttcaatccagtgaaatttggggtagcattcacccttggcaatttgatggcccttggaagtacagcatttctcataggccccaaaagacagt

SEQ ID NO: 7815 - DNA, 455 bp, Zea mays
  Clone ID: LIB3279-048-P1-K1-F2
gctttagtcacattatgatcaacatgtcgtgttagtatattttttatatttgaaagtataatgtgttatctaactataaggtgatcttcgtctctattggcattatgataaaactagcaaaaaatgtcgtgagtctaatgttatcattagagtcaaatgttatcattaaatatatatagataggactgtacttgcgttggactctaggcttaagctatgtatatatatatatatatgctagtattaggacatcatattataataagtattatttcaagaagaccatccgattggtgcggctacgtcaaacgttcgcgccatgactgcaacattctagtggccaatgttgttgacttcaggcaaatcacgatggagatgctctctcgactagagctcgggacgacagggctcaagaccctcacgcgcgaggtgatgggcttgctcatcgacaagcc

SEQ ID NO: 7816 - DNA, 417 bp, Zea mays
  unsure (1)..(417): unsure at all n locations; Clone ID: LIB3279-048-P1-K1-F3
gctttagtcacattatgancaacatgtcgtgttagtatattttttatatttgaaagtgtgatgggttatctaactataaggtgatcttcttctctattgtcattatgataaaactagcaaaaaatgtcgtgagtctaatgtnatcattaaagtcaaatgttatcattaaatatatataaataggactgttacttgcgctgtactctaggctnaacctatttatatatattaatatatacnacnattaggacattttattataattagttttatttcaagaataccattctattgctattttacaagctacgttaatacgaagactgaaaacatctcatggcgcaagaagctgacttcattctaatcactatgtaaattctctttttctatagctcgggacgacagtattaagaccct

SEQ ID NO: 7817 - DNA, 436 bp, Zea mays
  unsure (1)..(436): unsure at all n locations; Clone ID: LIB3279-048-P1-K1-F4
caaacgcagcagagcccctagcgccgccggtctcttcagcctcgcagcacaccgccgccagcccgagtgaccgctgcagcctagggtttccggcggcgatggcgggtaaaggagggaagggtctgctggcggccaagacgacggcggccaagagcaccgacaaggacaaggacaggaagaaggcccccgtgtcgcgctcctcccgcgccggcctccagttcccggtgggtcgcatccaccgccagctcaagtcgcgtgcctccgcgcacggccgcgtcggcgccaccgccgccgtctattccgccgccatcctcgagtacctcaaccgncgaggtcctcgagctggccggcaacgccagcaaggacctcaaggtcaagcgcatcaccccgcgccacctgcagctcgccatccgcggggacgaggagctcgacaccc

SEQ ID NO: 7818 - DNA, 375 bp, Zea mays
  unsure (1)..(375): unsure at all n locations; Clone ID: LIB3279-048-P1-K1-F5
aacactttgacacaaaaataatggacgaccaggccattctaggcggggggccggcttttatcacgcaactggccgtccagtttagattgcaaaagaagttcacgatcgctgacgtgatgcataatatcagcaggagaatcaagatgttatcgccggagaaatccactgggtagttctntaatctgtcgacagacagtcagttaccattctgtactggctactgcagatagcacacatgcgagttgtgattctgtaccatgttcttgttatgatacttccagcgcctgtcattgaaaagttacatctgcgtcgaacagttaattacttccctgtactgattatagcgtataataataaagtgccgattttgagtct

SEQ ID NO: 7819 - DNA, 465 bp, Zea mays
  Clone ID: LIB3279-048-P1-K1-F6
gagttatcctaaggaggtactcactgagaaggttcttttccagaactctgatcctgcatgcattaataaacatttagtgctccagaataacaataaaacaccagttaaggatccagagaaaaagcagcaagcggtcaacgaagaagctcgcaaagaaggtggtaatgacaactcatctcatgaaacaggagcttcatctccgagaagatgtgatcctccttcgaatcaggacgttgaggctgaccaggacgatagccttacaacttctaatcaatctggtggttctgatgaaatagaagctacatcttctaatgactctgccaagcaatcatcacccccttggcgtggtatgggacacagcaaaaaaggattgcacgaaaaggagccagctgtatcaagtaaatctggaaaaggattgggaaacaggatcaacatatgcatacttcacgaaggaaaaaaaatatg

SEQ ID NO: 7820 - DNA, 372 bp, Zea mays
  Clone ID: LIB3279-048-P1-K1-F7
cgaaccccaaaccccaaaccctagcttcgctcgttgcggcgagccggcgatggcgaagtctctgcgatccaaacgcgagaagcggcttcggacgttgcgccgggagatagcggagccgttctacgacaagaaggaggccgccaagctcgccgcgcaggccgcagccctagctgctgccccgctcccggtccgcgggcccccgccgtcccaggatgccggcacctcccgcgcagctagctcggcctcggctatggatgtggagatgtctggtgcagggaacagcaggtctaagaccttcctgaggccacttggcagcattagcaagaagaaggtgcagcttcatttgaagatcaagaaagacaagagaaaagc

SEQ ID NO: 7821 - DNA, 376 bp, Zea mays
  Clone ID: LIB3279-048-P1-K1-F8
gttttggaatcctgctgctggagctgatcaccggtcagactgcactggagtttgggaagtcatcaaatcagaagggagccatgttagactgggtgaagaagatgcaccaagagaagcagctggacatacttgtcgacaagggcctggggagcaaatatgaccgcattgagctggaggagatggtgcaagtagcactgctatgtactcagttcctccctggtcacaggcccaagatgtcagaggtggtccggatgctggaaggtgatggacttgcagagcggtgggaggcgttacaacacactgagtcacacatattcaaggtgcccgagttctcctttagccgctgccactctgacctgacggacgactcgtcact

SEQ ID NO: 7822 - DNA, 447 bp, Zea mays
  Clone ID: LIB3279-048-P1-K1-F9
ccgccgcgcttcgccctctcgctccagccgcttcacagcgccgccgctcgcctctccgaccgccgcgagaatgccgttcaagaggttcgtggagatcgggcgcgtggccctggtgaactacggcaaagactatggccgcctcgtcgtcatcgtcgatgtggtcgaccagaacagggcacttgtggacgcccctgatatggtcaggtgccagattaacttcaaacggctctcacttactgacatcaagattgacatcaaacgcgttcccaagaagtcaaccctgatcaaggctatggaggaagctgatgtgaagacgaagtgggaaaacagctcatggggcaagaagctgattgtccagaagaggagggctgcgctcagtgactttgacaggttcaaggtcatgctggcaaggatcaagaggggtggtgctatcaagcaagagctcgc

SEQ ID NO: 7823 - DNA, 87 bp, Zea mays
  Clone ID: LIB3279-048-P1-K1-G1
cccacgagtctgagggcgcgtgccccaattacaacgttcgcatgtcctacctttccctctgtaggaggcccccaatggatcggaacc

SEQ ID NO: 7824 - DNA, 462 bp, Zea mays
  Clone ID: LIB3279-048-P1-K1-G10
cccacgcgtccgagggccacttgtcgctcgcccgcccgcgtcgtcgtctccgccggccggccggccggcctcccaaaccctagcgaggcgagcgagagagaaactagacgccatgttcgggtacaggaaggcggacccggacctcgaggccggcgggtcctcgctgctgtacccggggatgacggagagccccgaactgcggtgggcgttcgtccgcaagatctacgtcatcctcacggtccagctcgccatgacggcagccgtctcggccttcgtcgtcaaggtgcccgccgtctccaacttcttcgtctcctccaacgccgggatcgcgctctacatcttcctcatcgtcctgcccttcatcgtgctgtgccctctgcactactaccaccagaagcatccggtcaatctgctgctgctcggcctcttcaccgtcgccatcagctttcgccgtcggcatga

SEQ ID NO: 7825 - DNA, 411 bp, Zea mays
  Clone ID: LIB3279-048-P1-K1-G11
gccacgcgttcggttttgatccttaaagctgagcttcccttacccgagcgccacctccggccgtcctaccatggcgctggctataatgtgatacgcggaggtgcggacggtcggtcgtgactcgtgaggaataggaagagggtaggagaggagaagaagagccaacgccgggcgggaggggagatggccagcggctagggggagatgcgggcgctggcgctcacgcccacgtggtccgtcaacaccgtgctcaccctcctcgtcgtggactcgctcctcatggaacgctccatccaccgcctcattaattggctgaagaaaactcatcggaatccactttacaaagcaatggagaagatgaaagaagaaatgatgctgctagggttcatatctctgattgtggctgcgacg

SEQ ID NO: 7826 - DNA, 429 bp, Zea mays
  Clone ID: LIB3279-048-P1-K1-G12
tctctctctagaatgccgacgccttcggctctcagcaagcgcggcggcgacggcggggacggcatcctggccgccctctcccgttcgcaggtggcggcgcacgggcgagaggcggcggccgtggcgaagaagctgctgcggagcacggggaaggcggcgtggatcgcggggacaaccttcctggtgctggtggtgccgctgatcatcgagatggaccgggagcagcagctcaacgacctcgagctgcagcagcagacgcttctgggcggggccccgccgccgccgccgaccaagtagatagatccgtgcatcgaccctttcgtccccccccctctccctctctagaggtatctgttactatcaagttcatcattcgggttactatcaagttcatcattcgagttactattaagttcatcattcgagtcg

SEQ ID NO: 7827 - DNA, 458 bp, Zea mays
  Clone ID: LIB3279-048-P1-K1-G2
cccaaacaagcccaagaggcctccgagcgcgttcttcgtcttcatggaggagttcaggaaggactacaaggagaagcaccccaatgtgaagcaagtctccctgattggcaaggctggtggtgacaagtggaagtccctgtctgatgccgagaaggctccctacgtgtctaaggcagagaagctcaaggctgagtacaccaagaagatcgacgcttacaacaacaagcagtctggagaccccacggcgtctggtgattccgacaagtccaagtccgaggtgaacgacgaggacgaggagggtgacgagtgatgtatgacggatgaaactctgtccaagtgtttgcagtcagggaaaaaatctcgtcgttgtcggcctaaccgggttttctcgaaggactttctagatgcagtagattagtgccgtcttctgagtagtttccttgcaagtgtcgtcccgt

SEQ ID NO: 7828 - DNA, 454 bp, Zea mays
  Clone ID: LIB3279-048-P1-K1-G3
gaacacacccacaacaaaagaagggtactactacagaatgatattcgagaaattctttcccaagcctgcagcaaggtcaactgttcctggaggtcctagtgtggcctgcagcactgccaaagctgttgaatgggatgcatcctggtccaagaaccttgatccttctgggcgtgctgctttgggtgttcacgatgctgcgtatgaagacactgcaggggaaactcctgcctctgctgatcctgtctcagacaagggccttcgtccagctattggcgaaagcctagggacacccgttgcttcagccacagctgtctaaccttatgtttatcacccagcaatgcttgaaacagcaaaggttctccattgcttgtttcagtttccttccgatcatgtttttagttccatcaatcaagcaatggagacatgcttgtgcttcatgcttggcagcatcgtg

SEQ ID NO: 7829 - DNA, 444 bp, Zea mays
  Clone ID: LIB3279-048-P1-K1-G4
gaacattggtatattgcttgtagccttgcaggctgaagcttttattcaggcaacggtatgtacagtattcacatgtatgcgaagaggcagcaagaacccgtaagttctaagagaagctgaaggaaacgaaggtctactaatggtggtatcatcttcatccccctatgctatccaagtgccgtgcgtaacaagaagtgcacaacgtatctctcttaacacatgcagcacaagtgaaatgcctccatgctgctccagagaaggcgtgccgcttcagatatcattggcgtgcacgacctgatgctggtttgctccttcttggttatccagaggcatgtactgagccatgatggcacggatctccgaatccatgtagctctggtggaatgatggcgaagatttcagtaacaaatgcatcatattattacagtagcaactagcaaatca

SEQ ID NO: 7830 - DNA, 468 bp, Zea mays
  unsure (1)..(468): unsure at all n locations; Clone ID: LIB3279-048-P1-K1-G5
gaacattggtatattgcttgtagccttgcaggctgaagcttttattcaggcaacggtatttacagggttcacatgtatgcgaagaggcagcaagaacccgtatgttctaagagaagctgaaggaaacgaaggtctactaatggtggtatcatcttcatccccctatgctatccaagtgccgtgcgtaacaagaagtgcacaacgtatctctcttaacacatgcagcacaagtgaaatgccttcatgctgctccagagaaggcgtgccgcttcagtatatcattggcgtgcacgacctgatgctggtttgctccttcttggttatccagaggcatgtactgagccatgatggcacggatctccgaatccatgtagctctggtggaatgatggcgaagatttcagtaacaaatgcatcatattattacagtngcaactagcaaatcaagttctgcatgcgaccacttgca

SEQ ID NO: 7831 - DNA, 442 bp, Zea mays
  Clone ID: LIB3279-048-P1-K1-G6
gaagttgctcaaatctgagttgcaagcaatgcgtgattgcgacccttcatctgcccggcactggggtgtacgcaacacacgaactgtgaatcggacggggcagccaactggctacaggctcgtacctggttcgaactgcctgcctttggctctgcctgaggcgaaatatctgaggagggctgggttcttgaagcacaacctctgggtcactcaatacaagcgtggcgagatgttccctggaggggagtttcccaaccagaatcctcgcatccatgagggtctgccaacatgggtcaagaatgataggcctctggaggaaaccgacattgttctttggtacgtgttcgggctcacccatatccccacgctataagattggccagtcatgccggtggagcacataagctttatgctcatgccacatggattcttcaactgctcg

SEQ ID NO: 7832 - DNA, 448 bp, Zea mays
  Clone ID: LIB3279-048-P1-K1-G7
ggcccgtcccaggccagcagggagatacggtcgccgtcgcccactcctcccccggtggttggccccaagaagcgggtgcggttcgtgctgccggcagcgagcccgaagccgaatgccggcgtgcaggaggagctgcaggagctgtccgacgcgcgggaggccggcatggcgttcatcctgggccactcccacgtgaaggcgaagagcgggtccagcttcctccgccggttcgtgatcaacttctgctacgacttcctgcggaggaacagccggggtcccaactacgccgtctccatcccgcacgcctccacgctggaggtgggtatgatgtactatatctgatctgatgactgaacccctgaaactgagggggagaaatataggagcaggagaggaaatggaacaaaaagttttcagctgtatatgctagatcttgtaagtaactgct

SEQ ID NO: 7833 - DNA, 449 bp, Zea mays
  Clone ID: LIB3279-048-P1-K1-G8
caactacaaaaaccaaaatgcctcatctccaccactactcacccgtgctactgctcctcgccgtcttcgtctacctatcgacacgctacgtgcacggtgaccatgccgacggcggccaccaggaccttcccgccctgctctccttcaaggcgtacaacccgaacgccacggccctggcgtcctgggtcggccccagcccgtgcaccggcacgtggttcggggtcaggtgctacaggggcagggtggcgggggtcttcctggacagcgcctcgctggccggcaccgtggcgccgctgctcgggctcggccgaatcagggtgctcgccgtcaggaacaactccctgtccggcaccctccccccgctggacaactccacggcgagcccgtggctgaggcacctgctcgtctcccacaacaagctcagcggaagcctcagcatctcgctggcc

SEQ ID NO: 7834 - DNA, 418 bp, Zea mays
  Clone ID: LIB3279-048-P1-K1-G9
cccacgcgtccgcccacgctccgcccacgcgtccgcccacgcgtccgcggacgcgtgggcagtggtgcacagacaacgggatcactctgccaccggttgagaaccaagatgaagatctggttacaaacaatgagcgggagacatttcgtaaactgtttgagaggatcgtatcgtcgtcgtcagacctgtctgagcagagggaagccattaaagagctcaggctgcggactaagtgcaacagttcactaagagcagcgataggagagagaccggattcaatctcgcagatgatttccgtagcgtccagcccagagctagaaaacagtgcagaagttgtggaggatacggtgacagctatccttaatctctctatccacgagagcaacaagaagatcattggagacgacccactggcagt

SEQ ID NO: 7835 - DNA, 389 bp, Zea mays
  Clone ID: LIB3279-048-P1-K1-H1
ttttgcaaactatgtcagtctaagaataccaactattaacatcggtacaagtacaacctaggtattgcttaaaaagtttgacaccgacggtagcatgatccatttgtaactggtcacggtaactgagaaccaaaaactactgtgacgcaacaaaatggtaacagatgcccatcccccaaaaaagactccgccgaatgtcaacaaagcagaaatactagtcccgacatcattgtgacttttagcaaaattatggccagaacagcaccaagtagagaacaccaatggtacacggccatttaccagcagagcggtacataactagtagtcatactggcgtccagtttttttctggtgcccaattcctttcgatcgagtagcatactccccgt

SEQ ID NO: 7836 - DNA, 405 bp, Zea mays
  Clone ID: LIB3279-048-P1-K1-H10
gtctgagctcatctccacgcgccgccgccgccgctcgacgcccaccgcgcaggcatggcggaacagactgagaaggctttcctcaagcagcctaaggtgttcctcagctcaaagaaatctggcaagggtaagaagccaggcaagggtggcaatcgattttggaagagcattggccttggtttcaagactcccagggaagcaattgaagggacctacattgacaagaaatgtccattcactggaaccgtttctatcagaggcagaattattgctggaacatgccacagtgctaagatgaacagaaccatcattgttcgcaggaactatctccactttgttaagaaataccagaggtatgaaaagaggcactccaacattccagctcacatcttcccatgctttcgt

SEQ ID NO: 7837 - DNA, 358 bp, Zea mays
  unsure (1)..(358): unsure at all n locations; Clone ID: LIB3279-048-P1-K1-H11
ctttcgaggacccaaacgtgcggcttgacttctactcacgtgtgatgggcatgtcgttgctgaaaaggttggattttgaagagatgaaattcagtttgtattttctaggttacgaggatgtgaccttagcccctgatgatcatatcaagcggactgaatggacttttaggcaaaaagctactcttgagctcacccacaactggggcacggaaaatgaccctgaattcaaaggttaccataatgggaactcagaccctcgtggttttggtcatataggagtaactgtggatgatgtccacaaggcatgtgaacgctntgaacgtcttggggttgagtttgtgaagaaacctgatgatgg

SEQ ID NO: 7838 - DNA, 420 bp, Zea mays
  Clone ID: LIB3279-048-P1-K1-H12
aggcgaccggttgaacgcaaattgaaaacgtcatccgcacactcgccaaggagagcccgcaaggaggcgactatgagggccaagtggaagaagaagcgcatgaggaggctgaagaggaagcgccgaaagatgaggcagagatccaagtaggctgatggggattgtggatggtggtgtcggcatagttgtgttacgtttcttcgatgcgtgagttcatggagagatgtcacatcctagttcgtcgtcaccgtttgccatgggtccaatggctcgtcttggaaacctgcacttcagtaggccatctatcgtggtttctagctatatccagagttttgtgctaagacaaataaatccagtcgttttgtgaacccaataatgatggagctttatttgctgcttatatccacctaccttttaagt

SEQ ID NO: 7839 - DNA, 456 bp, Zea mays
  Clone ID: LIB3279-048-P1-K1-H2
agcgatggccctcccccggcagccgaaatgagcggcggcaagaagatgttgctgttggggtcctttacggaggacgagactaagttgtttcagggtcagcctctcaaaagtccaaataaaagcgtcaacaaagaatgtgaacggacggagatccagtttggcaccctgaacttttcagtgctgagtttagagaaggtatctacttcaagtgttgttcttcctgcaaaatcagcaaacagcgagaccagtgccatcgcaaaggagaatacatgcagtaatgaaaagaaagctgcaggatcaagccttccaaatggcagatccattctggctaatggatgcccccctgttaatgttcctgccaacaatggtttatttgagaatgtgaagaagacagaggctgttgtcccaccagttgtgcctgtaaaaagcatcagcattccaacaccacaaatgaca

SEQ ID NO: 7840 - DNA, 457 bp, Zea mays
  Clone ID: LIB3279-048-P1-K1-H3
gctggcaagacagactacagggccaggataaggctgattaaccaagacaaaaacaggtacaatacacccaaatacagatttgttgtgcgatttaccaacaaggacatcacagcacaaatcatctctgctagtatagcaggtgatatggttcttgcttctgcttactcgcatgagttgccacgatatggtcttgaagttggtctgaccaactatgcagctgcctactgcactggccttctgttggctcgccgtgtgctcaagacccgtggtttagataaggaatatgagggcaatgttgaggccactggtgaggatttctctgttgagccagctgatgagaggaggcctttccgtgctctcttggatgttggccttattaggactacaactgggaaccgtgtctttggtgccctcaagggagctttgtatggtggcctggatattcctcacagcgaga

SEQ ID NO: 7841 - DNA, 378 bp, Zea mays
  Clone ID: LIB3279-048-P1-K1-H4
atttggtccaagagcatattgccttcagagtatggccgctcgcggaaaaatgggaaatgccgcaagaaaccataaaggaggctgacaaaagtggacttatcaagcttgagtatactttcaagttcggagataaattcgttgagccagatgatgactggctaaaaagcattgaaaatttaagtgatgaactggttggggcttactcgaaggccgaaagatactgcattgtcagcagccttcggaggtcgaaaaaagaaaagactgaaccgggtgtttgacgcaatcgggttcgtctaccctgactatcgttatcccattcgagggcagaaaagaaaaggcacaacctctgcgaaagaagaagctgcaactgctcctagt

SEQ ID NO: 7842 - DNA, 306 bp, Zea mays
  Clone ID: LIB3279-048-P1-K1-H5
cgtttcccacgcccgcaccgccaggcgcgccgcgctccacggcgacgcctgcctcgccaagctctgcggggtcatcgccggcgacgagaagcgccacgaggtcgcctacaccagggtcgtcgccaggtgcttcgaggccgaccccgacggagtggtgcgggcgctcgcggccgtcatgcgagccaaggtcaccatgcccggcgagcgcatgacggacggccgcgacgacagcctcttcgaccacttctcagcggtggcgcagcgcgccggggtgtacacggcggcggactacggcgacatggtgga

SEQ ID NO: 7843 - DNA, 267 bp, Zea mays
  Clone ID: LIB3279-048-P1-K1-H6
tttgaacccaaattgagaaagttttccgcgcactcgctgactaccttggtgtggaagtccatgcatgcgttggaggaacatctgttcgtgaggaccaaaggattctcgccagtggtgtgcatgttgttgttggtacacctggtcgtgtgtttgacatgctgcgtagacagtccctccgccctgataacatcaagatgtttgttcttgacgaagctgatgaaatgctttctcgtggtttcaaggatcagatttatgacatcttccagc

SEQ ID NO: 7844 - DNA, 422 bp, Zea mays
  Clone ID: LIB3279-048-P1-K1-H7
cgtttagaacctctaaaatttcccccactcgccagtcgcagcagcacctgtagccatggacgccagcggagccggtagcaaggggaagaagggtgcggccgggcgcaaggcaggcggccccaggaagaagtcggtgacgcggtccgtcaaggccgggctgcagttccccgtcggccggatcgggcgctacctgaagaagggccggtacgcgcagcgcgtgggcactggcgcccccgtctacctcgccgccgtcctggagtacctcgccgccgaggttctggagttggcagggaacgcggcgaaagacaacaagaagacgcgcatcatcccgcgccacgtgctcctggcgatccgcaacgacgaggagctcgggaagctgctggcaggcgtcaccatcgcgcacggcggcgtcctccccaaca

SEQ ID NO: 7845 - DNA, 451 bp, Zea mays
  Clone ID: LIB3279-048-P1-K1-H8
gtggagatcgggcgagtggcccttgtgaactacggcaaggagtatggccgcctcgtcgtcatcgtcgacgtcgtcgaccagaacagggctcttgtggatgcccccgacatggttcgttgccaaatgaacttcaagcggctttccctgactgacatcaagattgacattaaacgtgtcccaaagaagactacactgatcaaggcaatggaggaagctgatgtgaaaagcaagtgggagaatagctcatggggcaagaagctgattgttcagaagaggagagcatcactcaatgactttgacaggttcaaggtcatgttggcgaagatcaagaggggtggtgccatcaggcaagagcttgctaagcttaaaaaggtggctgctgctgcttagattgctttggtggttcctctatgcttcgatctcttgaaatgtaatgcacgaattactttga

SEQ ID NO: 7846 - DNA, 406 bp, Zea mays
  Clone ID: LIB3279-048-P1-K1-H9
aaagaatgacgctgccgacagctaacccgggcttccgtctcggctgccaggagtctcccgcgatgggattgaggtcggcgccgcagttggcactgcgtcgtcccggcgcggtctccgggcacaggagtaggactggcagagggaagtttccagtggcatccacaagtctagatgactatcttccaatgcgaagcactgaagtgaaaaatcggacattaaccggtgatatcacaagcctcagactaatcactgcagtgaaaaccccttatttgccagatggaagattcgatcttgaagcatatgattctttgataaacatgcagatagagggtggttctgaaggcgtaatagttggtggaacaacaggagagggtcacctaatgagctgggatgaacacattatgct

SEQ ID NO: 7847 - DNA, 254 bp, Zea mays
  Clone ID: LIB3278-019-P1-K1-A1
gaaatggtagagagctctaccattattggtccagtgagagaagaaagtctacgtcttcttaagaattttcaggaccagttggattcatgggagcgttttgtagcaacacaaatggatctgacttctgagtataattgggacttcgaccattacctagaggaggatataccagccgcgctggagtttattaaacaacacaagcaggcaaaagatggcaagttgctttgcattggacactcaatggggggaatttt

SEQ ID NO: 7848 - DNA, 329 bp, Zea mays
  Clone ID: LIB3278-019-P1-K1-A10
gccacaaccctttcccttctctgcttgcttgctgctgcagtgctgcctccccctggcccagcatcagggagcagccatgccaggggaccacggctccaagggcgacatctccttcgccggacgcttcacggccagcgccatcgcagcatgcttcgcagagatatgtaccatcccgctcgacacggccaaggtcaggctccagctgcagaagaacgtcgtcgccgccgccgcctccggggacgccgcgccagcgcttcccaagtaccgcggcctgctcggaactgcccccaccatcgctagggaggaagggggccgatctctttggaagg

SEQ ID NO: 7849 - DNA, 436 bp, Zea mays
  unsure (1)..(436): unsure at all n locations; Clone ID: LIB3278-019-P1-K1-A11
cgctctgngacggnggcggcgaagggacgagcggcggaggaggagggagacgaggagggggctgactacnacctggacgacgaggacgccatggaggaggacggccgcgccgcccgtgcgctccccgtgccccgcatcgtctcccccgccgtggtgcgcacccgcgggcgcttcgttggtcgcagcccctccgttctcacctccagccgctaccgcttcgacttcaccactaacaacggagaccatggtcccatcccactaccgcagcgctctatcgaaggctgggcaattcttgtttctggagttaaagacgatgctgaaaaagaagatctttacaatgctttcagtgattttgggcatgtcaaggacttgcatctcaatttagaacgccgcactggatatgccatgggatactcgctcattgaatacgaaaact

SEQ ID NO: 7850 - DNA, 361 bp, Zea mays
  Clone ID: LIB3278-019-P1-K1-A12
cccgaagctgatgccattttcaacccaatcgtggatgttatgcctgtcatacctgtactcttttttctattagcgtttggttggcaagctgctgtaagttttcgatgaaatctttactattctgcctgccaaattgaatgatgtattcattccaaaaaaaaaaatggataagagccgagaaggcttatattatgaaccttcgattctaaaatgaaaattcttctacattgaatgtatagctgcagcaataaatattgatcagcctttctaccccctgcgcctacgttgaacaggtacctttaggtacccacacaatacctaaactaatttttgatattgataagagtgctttattataaag

SEQ ID NO: 7851 - DNA, 438 bp, Zea mays
  Clone ID: LIB3278-019-P1-K1-A2
cgcacccgccgccgcattgggtgccgaggagggacgcaatggagcagtacgagaaggtggagaagatcggggagggcacgtacggggtggtgtacaaggcgctggacaaggccaccaacgagacgatcgcgctcaagaagatccgcctcgagcaggaggacgagggcgtcccgtccaccgccatccgcgagatctctctcctcaaggagatgaaccacggcaacatcgtcaggttacatgatgttgtccacagcgagaagcgtgtatacctcgtcttcgagtacctggatctggacctcaagaagttcatggactcttgcccggagtttgctaagaatcccactttgattaaagtatacctattctagatactctcgggtgttgcgttctgccattcttataaagttcttcacctgatttgaatccctcataacttgt

SEQ ID NO: 7852 - DNA, 459 bp, Zea mays
  Clone ID: LIB3278-019-P1-K1-A3
ggagcatttggttgagcctgaccatcgtcgagttgtggaattaaacttccgcatttgtttggtttatgaactagtttccaagatcggagaagcaatttcatactgtgcaaaagcaatttcgctatgcaagtcacgcatacagagcctgaaaagttccaaggatgctttgttggctggtatagatggtgatgcatctgctgctgaagctgaaggaggctcagaaaaatctgccgttgaaaaagagctagagcagcttactagcatattgcctgatcttgagaagaagcttgaggacctgtctgaagcaaacccaagcgctgacatggatgagatggtgaaggcaattgtgtccagggtaactgatgtgatgccaaaagctgcatcttttacttcttcccagatggcaacctcaagcaatggattcgactcctcggttatgtctacagcagcgacaaccgg

SEQ ID NO: 7853 - DNA, 411 bp, Zea mays
  Clone ID: LIB3278-019-P1-K1-A5
aatctattcattttattatcttttttttataaacatggcattcctggtatgaatatgcagggacttcattcgttgttattttggctcagctaaccatcaggaggtctggaggatcacaagtgccttggagaaccacaagtatgaaattgctgactgggaccttggtgccggaatatacgtagacttctacgttttgaagaactcaatgcaagaaagaaatgccatggatgattcgggttcacttgaggagatgagtgaatcatgcagaagtttctttggccgattaaacgagtcgttgttagtctggggaagcaaattacctgttgagtcaagggcatgctactcgaagatggcagaggagctatgtgcccttctggtggacaccccaagcgagacgctgaacctacccat

SEQ ID NO: 7854 - DNA, 385 bp, Zea mays
  Clone ID: LIB3278-019-P1-K1-A6
cccacgcgtccgcccacgcgtccgcggacgcgtgggcgccaccgtgcactcgtacccggaccagtggctgggcggcctggacgcgcaggcgcagctgcggttcctgggcgcctggctcgacgcccacatcgccgacgcgcgggcggtgctgcgcaagccgctgctggtggccgagttcggcgagtcgcgccacgacccgggctacagcggcggccaacgcgacgcggtgttcggcacggtgtacgccagggtctacgactcggcgcgcgccggaggccccgcggcgggcgcgctcttttggcaactcctggcggaggggatggacttttacggggacggttacgaggttgttcttctgtaggttccctccctccgcggagttatt

SEQ ID NO: 7855 - DNA, 406 bp, Zea mays
  Clone ID: LIB3278-019-P1-K1-A8
aaaggcctcaattagattagacaaaaaagacgcgattggatcactggcgagggaggcgtgtttaggggggtggcgaccgaagttagccgccgagctcggcagcgttttgcgtgattgattgcgtccctaatcctcactctttatgcttcgttcgctttgtccctttcatcatcccctgtgcttgtctcgcccgctctctctcgccttccacaaccctctccctcttcatctcatttccgctgcggctgcaacaataaaataataagtctcgtgcaggcgaaggacgtacgacgacgcggacgcaccgtcgaagtctacaggctgcgcaatccctttctccctcttatccccaaggcgaggagctgaggcggggcccttctgctgctgttcttgtttccccgctctc

SEQ ID NO: 7856 - DNA, 459 bp, Zea mays
  Clone ID: LIB3278-019-P1-K1-A9
ccggtctcctccgcccgttgccttcgtcccctccatctccggctgcgacgccggcgagcccgacaccgcgaatcggatccgccgacaaggcgagagggaagagatggggctcacgttcaccaagctgttcagccggctgttcgccaagaaggagatgcggatcctgatggtgggactcgacgccgccggaaagaccaccatcctctacaagctgaagctcggcgagatcgtcaccaccatccccaccatcggattcaatgttgaaactgtggagtacaagaacatcagcttcactgtctgggatgtcgggggccaggacaagatcaggccactgtggaggcattacttccagaacacccagggtctcatctttgttgtggacagcaatgatagggaccgtgttgttgaagcaagggatgagcttcaccgaatgctgaatgaggatgagttgcgtgatgc

SEQ ID NO: 7857 - DNA, 460 bp, Zea mays
  Clone ID: LIB3278-019-P1-K1-B1
acccccacgcgtgctatcaccattgcccactagatattctggatcttttagtggacttatcaagagccgtctacggaaaagtccagaacaccgaccaagcgctgcataactgctaaagcatgtgcaccttcagccttatgtgcttcaggtccagtagaagtatagtccttctggcaacatgactccaatctatcaagctgtcacagacaatgttcagaagatgacatttcctagtgatataactgattcccgctgtagagtgtcatgatgaaactcgcttggaaatgagaggactgtaacattctgcaaacccttttctgagcagatctttattagctctacacggtgcttaaaataatttacaactatccatagtgtcaaatagctatctgttggctgcattcaaattgttgttgtagtttcaagtatagtccttgatcaaagacatcaggcttttata

SEQ ID NO: 7858 - DNA, 403 bp, Zea mays
  Clone ID: LIB3278-019-P1-K1-B11
tggagagagtctcgccatggtgatgggtcacctcgacagagatctgcatctccccgaaggggatctacaccccctcgaagaagatctatatcccctcgaagatcctcacacaagaggagggaatcaccaagaaggggagactcacctaggaggaggcactcacctaggaggagggagtcaccaaggaagagagactcaccaaggaggagagactcaccaaggaggagggattcaccaaagaggaggagggactccccaaggaggagggataggtcaaaatcaaggtcaccttcaagaaaacatgacacttctagacataaaaaagaacatgacagatctcggtccaggtctccccactcaagggatcatcacagacgatctttaagaaggcattcactaagac

SEQ ID NO: 7859 - DNA, 296 bp, Zea mays
  Clone ID: LIB3278-019-P1-K1-B12
cccacgcgtccgcggacgcgtgggggagtacgagcgcattgagaagcctttcccgggccagggcggtaggttctcgcccaagcgtcttcacgcgatgctgctggtggtggacaagcgccgtaaggggcaggacggcgcctccgaggaggacgaggactgcggcagctgcagcgactacagctccctgcccaaggcccacgccagatcctgcgccggctactgtggtggcgccacgtgcgaagaatacaaggacgtggacgtggtgagcaccaccttaaagttctcgttctcgctgg

SEQ ID NO: 7860 - DNA, 365 bp, Zea mays
  Clone ID: LIB3278-019-P1-K1-B2
aattgtgcctctaaccgaatatcactagaggcacttttcacctcgattacacccacctcggacgggagtctacttgtatgctctccgttaaatgccagtctgaacgctccgctccagataattgctccaattctccatgaagggagccatatccaaggtcacacacaaggcgccttccaagcttatccttaaaagaaatggtgtgagaacatccttccaagaggcatctatgtgccacgttggattgtccacctcaagcctggtttcggtgtcagcgattatctcgggtttaccggcgaatatcgttagctacttcaagtgggtacagaacattccaggtttcatgctatgctgatgagaaagtg

SEQ ID NO: 7861 - DNA, 91 bp, Zea mays
  unsure (1)..(91): unsure at all n locations; Clone ID: LIB3278-019-P1-K1-B3
ccgcagnacggnccgaaccccggccgacccagcgnccgnctatccccaccaaccgggccgcaagcagacagcgggggccagagagaacgag

SEQ ID NO: 7862 - DNA, 448 bp, Zea mays
  Clone ID: LIB3278-019-P1-K1-B4
gttcgagagcatgctaatcccgtgctggtcgaatcggctcatacaaagaaagctcaaacagtccaccggctctgcaaaccgatcatgacaaaatcaaagccggctccaaagccacagactacgtcaccacaacctgaaacccaagcatctgagcctcaaacaccagagcaacaacaaagccggtctggcggaactggtgagccgaggagtgagggaggtgtgcagcaggcctccggtgagcaaatggacatggacaatcctgaatctgctgatgctgccgcataagttgggttgccatctctatcttatgatcgatcaaaattttctgttagtgtctggtaggtggatgagttaaggcgacactagcattctcacaagcgatttcgttttaggcagttggattgaggtatatgcatcttgtccagcgttgtttagaaaaatagttagg

SEQ ID NO: 7863 - DNA, 444 bp, Zea mays
  Clone ID: LIB3278-019-P1-K1-B6
cccacgcgtccgcgaaaacaatggagccggtgcggaagagcgtgtgcgtgaccggcgctggcggcttcgtcgcgtcggagctggtgaagctcctcctctcccggggccaatacgcggtccgcggcaccgtgcgcgaccctggtgctagcaagaatgcccatctcaaggtgctggaaggagctgaggaaaggttgcagcttctcaaggctgatctgatggactacaacagcattgcatcatcagttgccggctgtgagggtgtcttccatgtatccagtcctgtcctttcccatcgaccctccaaccctgaggtggaggtcatagctcccgctgtaataggtacaaccaatgtgttaaaggcttgctatgaggcaaaagttaggcgagttggggtggtgtcttcatgtggagcttgtgtatgctaatcctatttattcgaagggt

SEQ ID NO: 7864 - DNA, 452 bp, Zea mays
  Clone ID: LIB3278-019-P1-K1-B7
agcttatatacctatatgaatactagctagaagttagagcctagatgatggttgcttccgttggcgtgcaagctcgagtgctcctaaatggtcgtcgtattagcttatacgacaacgacccggtgcaagagataatattgtttacacgtgcgagtccaaaattgttggctttgggccggagcagttaacacgagaagtgtattttatcacttccgcctcttgcatatgttgtagattctcgccgagaagggagtagtagtattacctgatacctatgctaattcaggtggcgtggtcgttagctacttcgagtgggtacagaacattcaaggtttcatgtgggctgaggagaaagtgaacgatgaactagaaaagtacatgagcagtgcttttcaacacatgaaggccatgtgcaaatctttggtgctgccgaagtgtgccatgacattgga

SEQ ID NO: 7865 - DNA, 428 bp, Zea mays
  Clone ID: LIB3278-019-P1-K1-B8
ctgcaaccatgagtggtgttacgtgctgccttcgcttccctggtcagctgaattctgacctccggaagcttgcagtgaacctgatccccttcccacgtctgcacttcttcatggttggatttgctccactgacctcgcggggctcccagcagtaccgcgctctcaccgtgccagagctgacccagcagatgtgggactccaagaacatgatgtgtgctgctgaccctcgtcatggccggtacctcacggcatctgctatgttccgtgggaagatgagcaccaaggaagtggatgaacagatgctgaacgtgcagaacaagaactcttcctacttcgtagagtggatccccaacaacgtgaagtcgagtgtgtgtgacattccaccaattggcctgaagatgtccctcacatttcgtggcaactcaacc

SEQ ID NO: 7866 - DNA, 458 bp, Zea mays
  Clone ID: LIB3278-019-P1-K1-B9
accctttcgctcttagtctcactccctctgtcagtgtgttcttgtcagaatactgttcttgatgggggggtggattgttaattattaattccaaatactaaatattttacctgaatgcattttgcaagggtagtttcttaccaatgttcatgtcgcgcagtatgcacgggtttttgtcttacgtcctgttatagagggcttcacttcaataattgtagcttcgggtttctaacttcactataaaagatcttcaacagattagtaaggcgggttcaagagtgtgtggtttgcacgtacacttcactttctgtaatataattaatatatgaggttttttaattacctttgatgattatcgggtggaaaatgatacatgaaacccgtatgtcattgtaaccaaaggtattgtggtttgcttttgagcaacttctttaaaaggtttaaaatagtgtttttga

SEQ ID NO: 7867 - DNA, 457 bp, Zea mays
  Clone ID: LIB3278-019-P1-K1-C1
tatcagagtatgggatttggcaactttgcagtgcatacagactctttctgatcataccgatgttgttatgtccgtgctttgctgggatcaatttctattatcttgctctttggatcaaacaataaaagtttgggccgctacagagagtggaaacttagaagtaacatatacacacaaagaggatcagggtgcacttgccctcagtggtatgcctgacgcacagtcaaaacctgtgctactgtgttcattaaatgacaacactgtccgcttatatgatctgccatcgttcagtgacagaggcagattattctccaaaaaagaaattagggcaatacagatgggtcctggtggtttattttttaccggggatggaactggtgagctcaaggtttggcagtgggtagatttagcccaaacctaatgaacatagtgtgctagattagttttctctcatgta

SEQ ID NO: 7868 - DNA, 445 bp, Zea mays
  Clone ID: LIB3278-019-P1-K1-C10
cggacgcgtggggtgattccaccggtcatggcggctccgatccgagcacctccggcatgggcgggcgcgggttcctccccggcggcgaggccctagcagcggcctctcctggtgggcacggcctgccccggcgacgcggtagcagccgtcccggcccgtgcgcgggtgcggcggtcaaagggcgagcaggaccgacctggctcgggcggcaccagccactgccggcgcggggcacggccttcggcttaggcccctggaggctcggcctccagcgtgggcacgaccttggcgattggagcagccctcggtgcgagtgcgcaaccccggcgcgtgctccagcgggtgcgggcagcatccggcggcgcacacggcgcggtgggcgtggcccctgcctggctccccggtgacccacggcgtgcggccccggcggcttgggtgcggatcc

SEQ ID NO: 7869 - DNA, 447 bp, Zea mays
  Clone ID: LIB3278-019-P1-K1-C11
cccacgcgtccgctcctcattcctgaacccctcccccaagtataccagactaccaggcacagccgcatggcctcccgggtcacgaggctgctcctgcaccgccgcctcaccaccgcagcggaagcctccgcgcgccgcgcgccgcaggctccctgtgccggcgccgctgtctccaaggatgttgttaaggctgaagcttcatctttgaaaaattcaaggtggtacattactaggtcaaacacttcaggtcctttgactactcgttatgagtgccgcaaagtatttccttgttctgtaaggccatctgcatcttactctacacaagcttcagaccagaagggaaaacaggaagggaaagacttgtcaaatgtagaacacccctttgatgatattacctacaatatacctgagaagccagtgacatttactgaaggtgcttcttatagt

SEQ ID NO: 7870 - DNA, 447 bp, Zea mays
  Clone ID: LIB3278-019-P1-K1-C12
gagcaacttaggtcaggaattcttcagcagaagtcgtttatacataatcaacagcaattgcagcagcaaatccagatgctgactccacagcagcagcagcagcttatgctgcatgctcagcaaaatatgtcttcaccaacatctagtgatgtcgacaacagaagattgaggatgatgctaaatagaaatgctgttcttggccgggatgggcagacaaacagtggtagtgatattattccaaatattggctctcctagtcaaagtggtggcgatatagatatgcttataaagaaacttgctcagcagcagcaactattacaacagcaaagcaatagccaacagctcccacagcaacatcagcttcagcaacctgctgtctctagccagcaatctcaaagttcaaatcaacatcttcaacaagaaaagccaggaattggaagtatgcct

SEQ ID NO: 7871 - DNA, 170 bp, Zea mays
  Clone ID: LIB3278-019-P1-K1-C2
gctagctagcatacagacgaataatctcttcttcacctcactaacaccagctagcaactcggtctggtctgcaataatggccgctcgctcctcctcctcccagccgcagctggtcgcggcggcggcggtcctggcagcggcgctgctgctgctggcggcgggggccggga

SEQ ID NO: 7872 - DNA, 457 bp, Zea mays
  Clone ID: LIB3278-019-P1-K1-C3
aatctattcattttattatcttttttttataaacatggcattcctggtatgaatatgcagtcacttcattcgttgttattttggctcagctaaccatcaggaggtctggaggatcacaagtgccttggagaaccacaagtatgaaattgctgactgggaccttggtgccggaatatacgtagacttctacgttttgaagaactcaatgcaagaaagaaatgccatggatgattcgggttcacttgaggagatgagtgaatcatgcagaagtttctttggccgattaaacgagtcgttgttagtctggggaagcaaattacctgttgagtcaagggcatgctactcgaagatggcagaggagctatgtgcgcttctggtggacaccccaagcgagacgctgaacctacccatggggtgtcttctaacgatgctcaacgctccagttccggacgatagc

SEQ ID NO: 7873 - DNA, 447 bp, Zea mays
  Clone ID: LIB3278-019-P1-K1-C4
ccgacgaggtgagctagatgtttggagaggtaaaactggtgcttaccaatcaattattggcgaccactattgtgaataacattgcactgagctttaatcacgatttagtaatgaagtctatgtttcaagtatagagttgcaatcatatgatgtgctctctttttttccaaaccaacaagacattaatgagattcatgaactgattgtgttgttatcgtattcctttggcatagatgattggtgtatgggcaatgtgcctctaggagcaaatggtaaaggcaacaaagatgatttataaatatgtacaaggctgagttatttatttttttccttgcattgctgttattttccatttcccacacctggggttctcatgttacctccaattatagcaaaagtttgctaagatgggtgaagtgcttcttgcaggcacatactggaggtttt

SEQ ID NO: 7874 - DNA, 410 bp, Zea mays
  Clone ID: LIB3278-019-P1-K1-C5
ccatcacataaaaccagtgcaagcagaagcagcgcaatggcgagcagcaccatggccctctcctccacagccttcgccggcaaggcagtgaacgtgccgtcgtctctcttcggcgaggcccgcgtgacgatgcgcaagacggcggcgaaggcaaagccggcggcgagctccggcagcccgtggtacggccccgaccgcgtgctctacctgggcccgctgtccggcgcgcccccgagctacctgacgggcgagttcccgggcgactacggctgggacaccgcggggctgtcggcggacccggagacgttcgccaagaaccgggagctggaggtcatccactcccgctgggccatgctgggcgcgttgggctgcgtgttcccggagctgctcgcccgcaacggcgtcaagtt

SEQ ID NO: 7875 - DNA, 444 bp, Zea mays
  Clone ID: LIB3278-019-P1-K1-C6
cggacgcgtgggttcagaaaatactaccagctctggtttgctaattgaggatacactacacttgaactacagggaggaccatgtacccgtgaatgcttcagttattattggctgtggtcaaaagcaaagtggtgattatctggatggtattgcaccggatggactccttggccttggaatggcagatatttcagttcctagtttccttgcgagagctggactagttcagaattccttctcgatgtgctttaaggaagatagttctgggagaattttctttggagaccaaggagtgccctctcaacagtctacaccgtttgttcctctgtatggcaaacttcaaacttatgctgttaatgtcgacaaatcttgtattggacataaatgtcttgagggtactagcttcaaggctttagtcgatagtggaacatcatttacttctct

SEQ ID NO: 7876 - DNA, 328 bp, Zea mays
  Clone ID: LIB3278-019-P1-K1-C7
ctcctccccagtcgccgccagccgcgcgcacacccaccgagagctcgggctttctttctccgttcctccctcgcgcgctcagggtttcacgatggaggccgaggcggcggccaagagggcgcgggagggcggggaggacgccaccgcgccggtggcgggggccgaggcggcggtcgccggtgctggcgagcaggcggggatctccgccgtcatcccaggatggttctccgagatcagccccatgtggcccggtgaggcgcactccttgaaggtggaaaaagtgctgttccaaggcaagtcagactaccaaaatgtgatggttttttca

SEQ ID NO: 7877 - DNA, 458 bp, Zea mays
  Clone ID: LIB3278-019-P1-K1-C8
cggacgcgtgggattcgttccccttctcgcctccacgagccttcacaaattgccctctcaggtcttctcctaatctcactctagccctagccaaatcccagacccatcccagccctagcgacaccaaccagctcgccagcgaccatggggaacccggagaagctgatgaatcagatcttcgacctcaagttcacctccaagtcgctgcagcggcaggcgcgcaagtgcgagaaggaggagaaggagcagaagctcaaggtcaagaaggcgatcgagaagggcaacatggacggcgcccgcatctacgccgagaacgccatccgcaagcgcaccgagcacatgaactacctccgcctcgcctctcgcctcgacgccgtcgtggcccgcctcgacacgcaggccaagatgcaggtcatcggcaagtccatgcagtccatcggcaagtcgctcgactcctc

SEQ ID NO: 7878 - DNA, 399 bp, Zea mays
  Clone ID: LIB3278-019-P1-K1-C9
ccctgctggttggtgatattattatagctgaaacaaacagctcgattcggatggttgccacttgctgtagctgattgcaggcttttccttcgttcaggtactgggcactggcggtgccatcgttcgtggttgtgaccgtggtgctgtctatgggcatctacatgggcctcaacttcgctgccactcctcctccgacttccttcagcactatcttcgatgaaaagagtagggagcacacagccttttctcctgcaactgaggatgagaggcccatcgaacccatctcagacatcggtattgatcggatcaactgtcttatgtttggtgatagatgatttcccccggtggaatatgcgtttaccatggagcgccggattggaaacagatgcaaacgcgaag

SEQ ID NO: 7879 - DNA, 434 bp, Zea mays
  unsure (1)..(434): unsure at all n locations; Clone ID: LIB3278-019-P1-K1-D10
gcttgacgctgaccactgcaaggtgcttgtgaacattgagcagcagtcccctgaggttggggagggtgtgcacgggcacttcaccaancgccccgaggagattggagctggtgaccaggggcacatgtttgggtatgcgactgacgagacccctgagctgatgcccctcagccatgtccttgccaccaagcttggtgctcgtctcacagaggttcgcaagaatggaacctgcccctggctcaggcccgatgggaagacccaggtgacagtggagtaccgcaacgagggtggcgccatggttcccatccgtgtgcacacagtcctcatctctacccagcacgacgagacagtcaccaacgacgagattgctgctgacctgaaggagcacgtcatcaagccagtcattcccgagcagtaccttgacgagaagacaa

SEQ ID NO: 7880 - DNA, 444 bp, Zea mays
  Clone ID: LIB3278-019-P1-K1-D11
cgcaagctacgaagctatgaacttcgaccccagctcactggtctacagcgatgtgggcaggggggtcctggcaggcttctctccttcggacttctcggtcgcaattaccatctttggtggccgtgggttcgccaaatcatgggcgaagggtgcagacatcgattcctacatgtgcggtgatcctgtagagcaagagcttcctggtggcggtctgctgatgtaccagagctttactgctgttccttctggctctgtatcgccgaggtcgaccttgcagacggatggctggagcagcgatggaatggagatggcctcaaatgacgagatgtgtattggctgctggaatgcggtgaagaaggtggtgaagaaagatttggatgcttaaagatttggataacttaggtggttcttcacctaagttacgaagaagtctgagacctctgg

SEQ ID NO: 7881 - DNA, 446 bp, Zea mays
  Clone ID: LIB3278-019-P1-K1-D12
gtctccggcaaccgggaattttggcatgagaatatgcggccgtggcgtggcgtcggctgggactgtcgtcccgtgccctcgcgtccctttcccttcttcccatccacgccagccaagttcaccgccgcgctcttcggcggcaactactgttggatcgtagggcgaaggaaggaaggaaggggagccatgggaaacgcgtcgtccatgctgacccagtacgacatcgaggaggtgcaggagcactgcagctacctcttctcgcagcaggagatcgtgtcgctgtacgagcgcttctgccagttggaccgcagcgccaagggcttcatctccgaggacgagttcctctccatccccgagttctccctcaacccgctctccaagaggttgctccgtatggttgatggattgaacttcaaggattttgttgcgtttctttctaccttcag

SEQ ID NO: 7882 - DNA, 357 bp, Zea mays
  Clone ID: LIB3278-019-P1-K1-D2
gtcgctcatacgggaggccatggagggggagaaagggcaagagatgctccggcgcgtgactgaactcagggacagcgccgtggccgctgcagggcctgacggacggtctatgcgcaacgtagacaggctcatcgaagaggtgctcctagcctagattgagcactggtgagcatcctagcagtcatgtgtcttcgcgtctggcactccaatcgattcaaatcctttgtgttttgatgtcaagcgtttactttcggtacccataaaagtattttctcgtacaaggtggtgattacacgcaaagcacattgttataagttcagtttgtaagatctatgggtaaaaccaagcgttttgtat

SEQ ID NO: 7883 - DNA, 410 bp, Zea mays
  unsure (1)..(410): unsure at all n locations; Clone ID: LIB3278-019-P1-K1-D3
cccagtcgctcaaaaccctagagctctcgcctgctcgcctccgccgccggagcgagctccccatcttcatccgtcaaccatggcgacccagatcagcaagaagaagaagttcgtcagcgacggtgttttctacgccgagctcaacgagatgctgacgcgggagctggcggaggacggctactctggcgtggaggtgcgcgtcacgccgatgcgcacggagatcatnatncgcgccacgcgcacgcagaacgtgctcggcgagaagggccgtaggatcagggagctcacctccgtcgtccagaagaggttcaacttccctgagaatggcgtagagctttacgccgagaaggtcgtcaaccgtggcctctgtgccatcgcgcaggccgagtccctccgttacaagctcctcg

SEQ ID NO: 7884 - DNA, 450 bp, Zea mays
  Clone ID: LIB3278-019-P1-K1-D4
cccacgcgtccggcgtcaggtctgctatatgcctcggagtcgctcggggccttgcgtacctgcacgaggagatcgcggcgccgatcgtgcacagagacatcaaggccagcaacatactgctcgacaggaactacgtccccaagatcggggatttcggtctggccaagctgtttcctgacaatgtcacccacatcagcacccgcgtcgcgggaacaacaggctaccttgcgcctgagtacgcctggcatggccagctcaccaagaaagcggacatctacagctttggtgtccttgtcctggagatagtgagcggcactagcagctccaggagcatactcatggatgacaagattctcctagagagggcatgggagctgtacgaagcgaagaggctcaaggaactggtggatccagcccttgtagactgccctgacgaagaagccatcaggt

SEQ ID NO: 7885 - DNA, 450 bp, Zea mays
  Clone ID: LIB3278-019-P1-K1-D5
gccgtggcccagcgctagtttccagaagcagccgcgagcttccaccgccttcttcccgtgcattttctcgagcgacggagcgatccgttcgggccgtccaccacagcgagagagagcggcagaggcgcagagcgcaaccgagcgagagagagaggacggcgacggcggagatgatggggtggggagaggaggtggtggctctgtccctgcgaggctacggctatggcaacgaggaggacgaccggccggagaagccgcggcggtacggggtgacggagatgcggagccccttctactccttccgccccgcaaaccaggcgctccaggaaatattggattctcttagtccattcgttgatggtttgaagttctctggcggatgccatagtttgatgggaaaggagttggttagagagatcactgatctagcacacaggcatgacatttatg

SEQ ID NO: 7886 - DNA, 428 bp, Zea mays
  Clone ID: LIB3278-019-P1-K1-D6
attcagggcaagctctatggataggaaccaaatcacctcgatgggcggtagatgcactgccgtccttgaactttaagggaggtagcaagggtacaaggaaagaaaccttgctgtcatgatcgatatgatatgagcttggcggccatggtaaacctgcccgagctctctgcccctcttgctaaattgatattgggtctgtctctcgtgcggctggctcctgattcagacaacaaaattcaggttggggcatttttgactggtaaggaactaaggatgcaggatgtaaatagtttccaaattgatgcttatcacatcctgtaggcttttaatgattccccacattttctctgttgtactactgatggatgggttgctcgctgtttttttggggcctggtaggacctttatggaagatgcattggtagact

SEQ ID NO: 7887 - DNA, 119 bp, Zea mays
  Clone ID: LIB3278-019-P1-K1-D7
cggacgcgtggggaaccatgcgaagctttcggtgatagtgtccacaggagcattaccctggaccgaaactgatctttataacttaccaccaatgctcgaacatgttgctggttgctggt

SEQ ID NO: 7888 - DNA, 464 bp, Zea mays
  Clone ID: LIB3278-019-P1-K1-D8
cccacgcgtccgcggacgcgtgggccttcggagagtcccaagagatgggtggcgcggcggcgggtacgaagtggatccaccacatccagcgcctcagcgcggccaaggtgtcggcggaggcggtggagcggggccagagccgcgtcatcgacgcctccctcaccctaattcgcgagcgcgcaaagctcaaggcagagttgctgcgtgctctgggtggcgtgaaagcttcagcgtcgctcttaggggtccctcttggtcacaactcatcctttttacaaggccctgcatttgctcctccacgcatacgggaggccatttggtgtggaagcacaaactctagcacagaggaaggcaaagaattgaatgatcctcgggtgctaactgatgttggagatgtccccattcacgagatccgtgactgtggtggtcaagatgacagattaatgcatgtaattagtgagtct

SEQ ID NO: 7889 - DNA, 451 bp, Zea mays
  Clone ID: LIB3278-019-P1-K1-D9
gcccaccgccgtcgccgcccaaccgcagtaaggaggaaggagcaggaagatgccggcggggcacgggctgcggtcgcggacccgcgacctgttcgcgcggcccttccgcaagaaggggtacatcccactcaccacgtacctgcgcacctacaagatcggcgactacgtcgacgtcaaggttaacggcgccgtgcacaagggcatgccgcacaagttctaccacggccgcaccgggagcgtctggaacgtcaccaagcgcgccatcggcgtcgagatcaacaagcaggttaatggccgcatcatcaagaagcggatccatgtccgcgtggagcatgtgcagccctcccgttgcacggaggagttccgcttgaggaaagccaagaatgaccagctcaagggggatgccaaggcccgcggtgaggtgatcaacaccaagaggcatcctgtggga

SEQ ID NO: 7890 - DNA, 450 bp, Zea mays
  Clone ID: LIB3278-019-P1-K1-E1
cccacgcgtacgcggacgcgtgggcgcttacgaatcagccagatacttgtgttgccaccttatcagggtgaaggccatggtcttggtcttcttgaagcaatcaattatattgcacagtctgagaacatttacgatgttacaatagaaagcccttctgattacctgcagtatgtgcgatcatccattgactgcctccgtttgctcatgttcgatccgatcaaacctgcactcggtgctatcgtctcgtctttgaaggggaccaacctgtcaaaaagggcccaaagtttgagaatggttccaccagctgacctgatggagactgtccgtcagaagctgaagatcaataagaaacagtgcctccggtgctgggaaattctgatcttcctaagcctcgactctcaggatcataagagcatggacaacttttgggcctgcatatatgaccgcatg

SEQ ID NO: 7891 - DNA, 317 bp, Zea mays
  Clone ID: LIB3278-019-P1-K1-E10
gacaatgagcagatgatcccagagtgagtagaggctgtgaccaacctgcactagcaaagggattatttactagtgccggaatagcactttgaatagagttcattttatttgagtgttggtggttagccttaggttttatatatagtttgatacactcgtccgagggttttttgtagtgtggttgctgcgcattttgctttggactgatggacgaactttgcctgttgtatgccgtaaatctacctaatacacggtaatgctgttgtttcccatgaaaaaaaaaaaaaaaaaaaaaaaaaaaaaaaagaaaggaaaaa

SEQ ID NO: 7892 - DNA, 449 bp, Zea mays
  Clone ID: LIB3278-019-P1-K1-E11
cctcccaattcacgacaacccaaacaaacaacccccctacacacacacacggagggccggggcgggtggccgtttcgattcgatgcttgtggccgcccatcagcgaacgagtcgcagccggatcccgactcacccgagggcgctcggccgcctctgaagccggaaggagcgcgcgcgtcggacatgggggagctcgcggcggcttcctcgcccccgccgcccgccgtgctgcaggtggtcttcgtcgacggcgagcagagcgtggacctgggcacggtcgccgtgcagccgtcgctgagcggtgtgaagcggctgcaggccgtggtggcggaccgcgtgggcgtcgcgccgtaccagatctcggcgtccctggcgcggccccgccgcgcgcgccgcgtgcccctcgacgacgccaccgacctcgccgccgccgttgcgcgggagggcag

SEQ ID NO: 7893 - DNA, 448 bp, Zea mays
  Clone ID: LIB3278-019-P1-K1-E12
gctaagctctgaagccaagggttgtagaaaactgccgctatcagtagccgccactgcaaagtcaagcggagtactcctacatggattagagtggcagtgcagcaagatgagacctgtctgaagaatttggaagctgaaggtgagcgttggcggaaaccaagtctccaactgcacgcaaagcacaagatttagttccctccaatgtctcatcttcaaatgtctcaaatcaatgcaaatctcgaggcgttagtaggatcattattatcctccaaatacggtgttcctagttaagcaaagtaatgggctctttgtttgcaccaatttggcgtttcgtgttagacaatttcatatcgggtgaacatttccaaattcactactgacaatgtcatatatttgtggtttcagattggactgaggggccatcatttgttttttatgaagtaattgg

SEQ ID NO: 7894 - DNA, 458 bp, Zea mays
  Clone ID: LIB3278-019-P1-K1-E2
ctccgatccccaattcctccttcggatctcgcattcagcgcagcgcaggtgtgaaggaagggggacgcggaggaagatggggctcgcgttcgggaagctcttcagccggctcttcgccaagaaggagatgcggatcctcatggtcggcctcgacgccgccggtaaaaccaccatcctctacaagctcaagctcggcgagatcgtcaccaccatccccaccatcggtttcaatgttgaaactgttgagtacaagaacattagcttcactgtctgggatgtcgggggtcaggacaagatcagacctctttggaggcattacttccagaacacccagggtcttatttttgttgtggacagcaatgaccgtgaccgtgttgttgaagccagagatgagctccacaggatgctgaacgaggatgagctacgtgatgctgtgctgcttggttttgccaacaagg

SEQ ID NO: 7895 - DNA, 455 bp, Zea mays
  Clone ID: LIB3278-019-P1-K1-E3
cttgaggttcatgttgagaaggggatgcaacacaaccagaagatcaccttccctggtgaagctgatgaagcgcctgatactgtcactggagacattgtattcgtcctccagcagaaggatcactccaaattcaaaagaaagggtgaagatctcttctatgagcacaccttgtctctgaccgaagcactttgtgggttccaatttgttcttacacatctggacaacaggcaacttctcatcaaatcagaccctggtgaagttgttaaacctgaccaattcaaggcgattaacgatgaggggatgccaatttaccagaggcctttcatgaaggggaagctgtacatccatttcacggtggagttccctgactcgctggcaccagagcagtgcaaagctctcgagacagtactttcaccaaggccttcatccaagctgacagacatggaaatagatga

SEQ ID NO: 7896 - DNA, 448 bp, Zea mays
  Clone ID: LIB3278-019-P1-K1-E4
cccacgcgtccgcccacgcgtccgaaaatcataatgagagtgggattgccaatctttacagtctgcactcttggattgggatagggacgattactttgtatggtattcagtggatagttggattcgttacattcttcttccctggtgctgcgccaaacgtgaagaagggtgttcttccttggcacatactctttgggctctttgtctacatcttagcactggctaatgcggaactcggctttcttgagaagctcactttcctcgagagctcgggtctcgacaaatacggcacagaggcattcttggtgaacttcacagcgttggttgtcgtgttgtttggtgcctctgttgtggtggctgctatagctccagttcgccttgaagaaccacagggttatgttccaattccagaaaactagtacaaatgaaatgtacatcatatgcagtt

SEQ ID NO: 7897 - DNA, 449 bp, Zea mays
  Clone ID: LIB3278-019-P1-K1-E5
gaagtatacaaggttgacgagaggggtatacgctggttctacactggtgatattggccagttccatcctgacgggtgccttgagattattgacaggaaaaaagatatagtaaagcttcagcacggagaatatgtgtctcttggcaaggttgaatcggctctagcaacaagtagttatgtggagagcatcatggtctacgccgatccgttccataactactgtgttgccctggttgttccagtacgccaggccctggagaagtgggctcaaaattctgggataaactgtgaaggctttgaagagctttgccaaaatggccaggcggttaaggaggttcagcaatcactatcgaaggccgcgaaagcagcgaggctggagagattcgaggtgccggcgaagatcgagctgctgcctgagccgtggacgccggagtccgggctggtgacggc

SEQ ID NO: 7898 - DNA, 432 bp, Zea mays
  Clone ID: LIB3278-019-P1-K1-E6
cggctgaagcatgagctgcatggcgagcactaacttggcctgcaataccggggaactgatacgtacgggggtgatcgttgggggcagatgggcatcatctgggtctacacttgcgattgcgaggagtgtgactttgacctgcaccccaagtgcgctttgcgtaagaagggcgaggaggaggaaaccaagtcgtccactgctgggtgttatgtgtgcaagggaagtgatgtgtgcattaaggcctagagttattctaccttggagctgctgaggtttgtttgttaataaatagaagtcgcacgctgaacccttaggagcatatgtgtatgcaaggctatgtgagtattgtgtccgatcaaagtaatgtggttttgcttgcatggtatttttggtcttaagcatgtaatggtggtggccgttcctttttttttg

SEQ ID NO: 7899 - DNA, 455 bp, Zea mays
  Clone ID: LIB3278-019-P1-K1-E7
cccacgcgtccggtttatgacatcacggacatggagagcttcaacaacgtgaagcagtggcttgatgagatcgaccgatacgccaacgacagcgtatgcaagcttctcgttggtaacaaatgtgatctggccgagaacagggctgtcgacacttcagtagcacaggcttacgctgaagaggtaggcatcccgttcctcgaaacgagcgctaaggagtcgatcaacgtcgaggaggcgttcttggcaatgtctgctgcaattaagaaaagtaaagcagggagtcaggcagccctggagaggaagccctccaatgtagttcagatgaaagggcggccgatccagcaagagcagcagaagagtagatgctgttcaacatgaggcacagcaatgtctgtctttcgagaatcagtaaaatgattatctgctagatgtgtttctgtcttggttgttttgag

SEQ ID NO: 7900 - DNA, 438 bp, Zea mays
  Clone ID: LIB3278-019-P1-K1-E9
gatgaaaccaggaaagccgttaacctttgctgagatcaccacacaagacacgccagagccgtctaaaacagttcttgcatttggtttgcctggaaatccagtgagctgtattgtttgctttaatctttttgttgttcctgcaatccgtcttctctctggctggtcaaaccctcatctgcaaagagtgcatgtgcgcatatcacatcctttaagagcagacccacatcgtacagagtttcaccgtgcagcaattagatgggtgcttgatgatggatctggtcgacctggttttgttgctgagagtactggccatcaggctagtagccgtcttcttagtatgaaatctgctaatgccctgctggaaataccatccactggacaaatattggcagctgggacatctatccaagccatacttatttcagacataataacttc

SEQ ID NO: 7901 - DNA, 454 bp, Zea mays
  Clone ID: LIB3278-019-P1-K1-F1
ggggccggggacgggcgccggagggagcggacgacccgggaggaagcaggagtgcaggacaagggcagccgcggcacgcgcttgagcggcacaagcgaagcaggctgcgtttagttcgtgcggttgactgcggccggggatcgcttcgcttcggaaggaggtggtccaaacaggggaggggcaggtgccactggtgcaaaccgaggaggccgattgcgagtggagcttcaagccacgccgcattgctctcttcgtcgagccgtcgccctttgcttacatttccggctacaagaatcggtttcagaacttcatcaagcatctacgagagatgggcgatgaggtattggtggtgactacacacaagggagctcctgaggagttccatggtgcaaaggtcattggctcttggagctttccatgtcccctgtaccaaaatgttccactctcgctggca

SEQ ID NO: 7902 - DNA, 397 bp, Zea mays
  Clone ID: LIB3278-019-P1-K1-F10
cgcgtccgcccacgcgtacgcccacgcgtccgcggacgcgtgggggcgatcaggactcatcgggcggaggtgcccgtcgaggagtccgcccccgccagggacgccgccgctgccgcgcccctggacggaaacggagccggagcggacggctccgtggttccttcctcggacgacagctgggttgttaagctcgagcagtcgttcaacattttcgccactgattcggtgattatggtactcaagggcgtgtacggtgatcggtactacgccaggttctttgcgctggagaccattgctagggtgccgtacttcgcattcatatcggagcttcatttgtatgcgaccttttgatggtggagacgagcttattacataaaggttcactttgagcagagct

SEQ ID NO: 7903 - DNA, 137 bp, Zea mays
  Clone ID: LIB3278-019-P1-K1-F11
tacctgattggtatcggagggctcaacttgctcttcaaaagggcgacgaggatcttgctcgtgaagcccttaagcggcgtaaatcattatgacttgggggatacgcaccataatatgggtacttgttcccaggaggg

SEQ ID NO: 7904 - DNA, 450 bp, Zea mays
  Clone ID: LIB3278-019-P1-K1-F12
gcgtgtactccacccgccccgcagcggtgtacgaggtcggcaaggttctcctgccgatgcggatcttcaagagcgaccccccgctggcgcctgcccccgctccggcaccggatgccaaggcatccgacgtcgctcccagcccggcgtcggggaaatcgtcagcgagtgcgaaggcgaaggagaaggcgggagagaagagctcgtcatgccaagccggggtcgtcgaccattacttggcgatcgctgactcccgcggcctggtgctcttggggtgaggatcgacgagttcgtcctcaccgtgtgtccgtgtcgaaggagcaagtacggggttcagcttagggccccccgtgtttaatttatatatgggtggttatggattcattcttttggacatatggtaggccatttgtgtttaggactgaactgttgttgagtggttgcgacatatgc

SEQ ID NO: 7905 - DNA, 450 bp, Zea mays
  Clone ID: LIB3278-019-P1-K1-F3
tacaaaggaatgcttcgaagtgccaccgaaagcaacccgtgtagtttctgagagaatggcgtttccattgtcgttgatgcattcccatgattatgtttccaaaaggttagcattagttggagatgctgctcatactgtccaccccttagccggccaaggtgtaaacttgggctttggtgatgctgctgctttagcaaaagttattgctgagggagtttcagtgggctcggatgttggggatctgactttgctacagcggtatgagaaggagaggaaggctgccaatgtggcgatggcagcagtgctagatggttttcagaagatgtactctgttgatttggggccccttaatgtagtgagagctgctgcgttccacggtgcccagtacatatcaccactaaaaaagaacatcatctcttatgcaacgggtgacacgaaatggtcactatt

SEQ ID NO: 7906 - DNA, 440 bp, Zea mays
  Clone ID: LIB3278-019-P1-K1-F4
cgccgtcgcagcaatcacagcagcccggagaacggccaggtccgacaagatgcagatctttgtgaagacgctgacagggaagaccatcaccctcgaggtcgagagcagcgacaccatcgacaatgtcaaggccaagatccaggacaaggaagggatcccgccggaccagcagcggctgatctttgccgggaagcagctggaggatggccgcacccttgcggactataacatccaaaaggagtctacgctccacctcgtgctcaggctccgcggtggcatcattgagccctcgctgcaggcgctcgctcgcaagtacaaccaggacaagatgatctgccgcaaatgctatgcacggctgcaccctagggctgtcaactgccgcaagaagaagtgtggtcacagcaaccagctgagggccaagaagaagatcaagaactgag

SEQ ID NO: 7907 - DNA, 454 bp, Zea mays
  Clone ID: LIB3278-019-P1-K1-F5
ccgccgccgacagggaacatcgccggccgagatcggctgcacatctgtgctgcttcagggcgccggagttcgcgtcgtcgttcggtaacttgcggggtcaatgggaggagggaaagacaagcatgacgagagcgacaaggggctcttctcgaacatgatgcacggcgttgccggtggtcatgggtacccccaccagggataccctccgcagggctacccaccgcaaccaggagcatacccgcctcccccaggggcgtatcctcctcctccaggggcatatcctcctccacctggggcatacccaccacaatatgggtaccctcagccaggtggctacccacctcaaggtggatatcctcctgcaggctaccccggctcatctcaccagggttatgggagcagccacggcgggggccacgggggccacatggggacgggggcaatgctagcggga

SEQ ID NO: 7908 - DNA, 462 bp, Zea mays
  Clone ID: LIB3278-019-P1-K1-F6
ctcgtgtgctcgcatttcctcccaatccatcccgcctccaaacccgaactccaagtcgccccgcatcgatggcgcccaaggccgagaagaagcccgcggcgaagaagccggcggaggaggagcccgctgccgagaaggcgccggccgggaagaagcccaaggcggagaagcgtgtcccagcaggcaagtccgtcggcaaggagggcggtgagggaaagaggggccggaagaagggcaagaagagcgtggagacctacaagatctacatcttcaaggtgctgaagcaggtgcacccggacatcggcatctgctctaaggccatgtccatcatgaactccttcatcaacgacatcttcgagaagctcgccggcgaggccgccaagctcgcgcggtacaacaagaagcccaccatcacctaccgcgagatccagacctccgtgcgcctcgttctacccggggagc

SEQ ID NO: 7909 - DNA, 451 bp, Zea mays
  Clone ID: LIB3278-019-P1-K1-F7
gctcgctcggctagctaggcaccgggttcctgttcctgccgcgaggcgcgtctcacacgcggcggtcggtgcgcgcatgcagcagcggggccacgacgcggcgggcgccaacgcctggatgacggtgccggcgttcggggactgggacacgaagaacggcgcgctgccggactactccatggacttctccaagatccgcgagatgcgcaagcagaacaagaaggagctctcccgcgccagcctcggcggcgacgacgacctcctcgcccacgcccaggcccaggccctgaagccgcaggccagtaacgccccgcccaagctcggccgcccccgccccggccccgccgacgaccactccccaacgggagggaagaagttcctgagctacttccggtgttgtatcaaggccggaagaggtgctgctctagtgcctgcagtccctgtgtttttt

SEQ ID NO: 7910 - DNA, 189 bp, Zea mays
  Clone ID: LIB3278-019-P1-K1-F8
aaaaaacataaatactaaattatactaataattatttaaatgaacaaataaatatcggggtgcggaaaaatgtatgtagtaaacaaaccaaattacactttctttatcataaaacaacattaatcccaagcttgtgatcctccacatgaacatgggcgtctatgtatataaaaatataatgatcattac

SEQ ID NO: 7911 - DNA, 238 bp, Zea mays
  Clone ID: LIB3278-019-P1-K1-F9
gaccattctgaaatggttttgtccaactacaatctcaaatgtggaccttttttgcgggaagcatacaaattctgaattatgtttgacacttgcttgggaggtctgaccgtctgagctattttggctataggactcccccacccgcagttatgacttatgaaacaactgtgaatcattcactataagaaacaacaatgaaatgtaacttgttttctgttaactaattgctggtttagtc

SEQ ID NO: 7912 - DNA, 125 bp, Zea mays
  Clone ID: LIB3278-019-P1-K1-G1
ctccccgtcaaggccttttgagagtccgtgagtttactttagcggaaattgagcactttgggggcggcagaggacaaatcccatccaaagttttcttatttttccgatctagagttctgggatgt

SEQ ID NO: 7913 - DNA, 454 bp, Zea mays
  Clone ID: LIB3278-019-P1-K1-G10
gatgaggggaaagctggtaaagaggaacaagaagtcttctggcgacttggatatggatggggggcatagaatcaatggggaaccaatagggacgctaggtgaagacagtagatcagaaataagatcaaggggtgacagggatattgacaaccaacaagcccttcaagcagaagagaaggatgttgtgtcatctgtggccacagtgttatctgatctctgtggccctggagaatggatgcccatggcaaaactccacaacgagcttcttgagcagttcggcaacgtgtggcaccccatcagggtccggaagtacctgacacaggacgactggtcgccgacggagacgaagggcaggccttggttcggccttctggcgcttctcaggaagtacccggagcactttgtcatcaacacgaggtccaagggcaggatgacctcggagttcgtctcgctg

SEQ ID NO: 7914 - DNA, 438 bp, Zea mays
  Clone ID: LIB3278-019-P1-K1-G11
cggacgcgtgggtggttacatagtgtatgagatcgaccagcacccttaccagaatgtattgtacaatggcactattgaggtcgttgaggctggaggcttactcagtgttgagtctgtgttcctcatcacccttggaatcgctcttcttggtctctttggattatgggcatatggccaggttcagcagctctcgaagtagaaaacgaagaaggcccccaaggtggagctcggaactggaacaactgatgccaacatcgatgagtggctggagggcacttcgtttgtgcagagaagcaaatccaagaagaagcagacctgaagctagctctccagactagttaatccttggaggatctagaatgaggcatttgagggtagcccttcacaagggacttttgtagaaagatagatgcctaaggaggggctgaaaaatgtagt

SEQ ID NO: 7915 - DNA, 432 bp, Zea mays
  Clone ID: LIB3278-019-P1-K1-G12
ttcgggggcgcgcacgcgtccgcagataatacatcgtcatagactctaccgcaggtgtagctttggtcatcatttgggagcagggggaataactccttgagagggactcgcaacaacagcactgactgtatcaagaggctaattgcacgttaccagctgtattggcccagatgtgctgcgccatgtacatacaacagctcaagtgggtatcactaccgacatatacatgggtaattatgaaaagatggtgtattcatgaagaggtagcctagggcgaaatcgattcacggagttgacgggatactgaacatgagggagaggttgatctagcgcttctaggacgcgtgcccactcatctcttacttcgattatgacgaagaagaggtagttgtagccgcggcaggcatcggtgggtatgcaactctttacact

SEQ ID NO: 7916 - DNA, 312 bp, Zea mays
  Clone ID: LIB3278-019-P1-K1-G2
cccacgcgtccgcccacgcgtccgcccacgcgtccgcccacgcgtccgtaaggatcagctggttaaagacctgtatttgttgtacttgaaatctggctggttaataattggacatgtaaagacgacgtttacattgatgtaacgtgttcttgtctgctattgcttcccagcctctggtgtttcttcatgtaagtcagtctgaacatgaatccttgttattgaagaaagtatgaaatataagcagacacgcgcgtagcgcggtggcggcgcctcctgtcatggagcgcccgcttttcattcccaaaaataaaa

SEQ ID NO: 7917 - DNA, 456 bp, Zea mays
  Clone ID: LIB3278-019-P1-K1-G3
cccacgcgtccgattccgcattcgttccaactcctgagcactttctcctcgtcccagacaggccaggtcgaagccgagatacgaccatggactccaccggcaccggagcagggggtaaggggaagaagggagcggccgggcgcaaggtcggcgggccaaggaagaagtcggtgtcgaggtccgtgaaggccggtctccagttccccgtcggccgcatcgggcgctacttgaagaagggccgctacgcgcagcgtgtcggcaccggcgcccccgtctacctcgccgctggcctcgaataccttgccgctgaggttctggagctcgccggtaatgctgccagggacaacaagaagactcgcattattccgcgccacgggcttttggcgatccggaacgacgagggacttgggaagctgttgggcggcgtgaccatcgctcacggcggggtgctcccct

SEQ ID NO: 7918 - DNA, 487 bp, Zea mays
  Clone ID: LIB3278-019-P1-K1-G4
cctccggttccgaattcccgtttcgacgcgggcgtccggaacctctaaaatttcccccactcgccagtcgcagcagcacctgtagccatggacgccagggggggcggtagcaaggggaagaagggtgcggccgggcgcaaggcaggcggccccaggaagaagtcggtgacgcggtccgtcaaggccgggctgcagttccccgtcggccggatcgggcgctacctgaagaagggccggtacgcgcagcgcgtgggcactggcgcccccgtctacctcgccgccgtcctggagtacctcgccgccgaggttctggagttggcagggaacgcggcgaaagacaacaagaagacgcgcatcatcccgcgccacgtgctcctggcgatccgcaacgacgaggagctcgggaagctgctggcaggcgtcaccatcgcgcacgggggcgtcctccccaacatccactccgtgcttctgcccaagaaggcggcgg

SEQ ID NO: 7919 - DNA, 459 bp, Zea mays
  Clone ID: LIB3278-019-P1-K1-G5
gcgcccacgcgtccgcccatgcgtccgatcgtgatccaaacttgctgaaaacactagaggtctatgatgagacagcaagattcctgagagagctagaattggatgatgatgcactcacaaaagctattattggaaccataggcgatgttgacgcctaccagctaccagatgctaaaggttacagcaggtatgtaagcctctgtttatgctggtgctcttgtccagcacaaattaaccaacaattgatggtacaaattaaccaacaattgatgatatgccttaccattggtggttttgatcgaaacatctactctgatcagagatgatagtgatgtactgtaagctggcatcttgtcacaagtaggcctgtttttggacagggcagtacgccgaaactttaaaatgattattagaataactaaaatttagtaaattggtaatttggtttggggaaatggg

SEQ ID NO: 7920 - DNA, 456 bp, Zea mays
  Clone ID: LIB3278-019-P1-K1-G6
cggctcaacctcgctccgccgccgccggcgaccatgtccctggcggctatcttcgtcttgggcagggggtccgcgctgcagctgctcgaccgctacctcgacctcgccagaaagagcggaggacttagtgatgagcagatcaaagtgcggcttgaaatcaagcaacttctcaaggaggctgatcagttgtcaacgccgtccacatttgcacaagctgctaaactcaagcgcctggctgctgccaaggagaaggaactggcaaaaatgcaggaacatgaccttaaagggaagcaatccttatacgacaaatacacaaaatttttggtggttactaagggcataatttatgctgggctcgttctgtgcttttggagtactcctgtaactgcgagtccacaacatcttctacagcccttcggaaaaatgtttttctggagaggtgttgatactgccacc

SEQ ID NO: 7921 - DNA, 433 bp, Zea mays
  unsure (1)..(433): unsure at all n locations; Clone ID: LIB3278-019-P1-K1-G7
gggttttgctgctctccgaccccgagctccgaaggccgcagcatcangcgcgggcgccctggcgtgtgaccgagatggcgctgccgaatcaggggaccgttgattaccccagcttcaagctcgtcatcgtcggcgatggtggaactggtaaaactacatttgtgaagaggcatctcactggagagtttgagaagaaatatgaaccaaccattggtgtggaagttcatccgttggatttcaccactaactgtggtaagatcaggttctactgctgggataccgcagggcaagagaagtttggtggcctcagggatggatactatatccatggccagtgtgcgatcatcatgtttgatgtaacctcaaggcttacttacaagaatgttcctacgtggcataaggacctgtgcagggtctgtgaaaacatccccat

SEQ ID NO: 7922 - DNA, 306 bp, Zea mays
  Clone ID: LIB3278-019-P1-K1-G8
acgcggacgcgtggggccgaaataccgccttattaggaatggtcttgctactaagggggggaggggctgcaagcatatgaaggagcgtaagaacagggtcaagaagatccgtggtgacaagaagaccaaagctggggacgcctagaagaagtaaacgttcggttacatttgtattactgtgctgggctctgggaggtctagctgtcatggcttatttatggccgtgttatggtttgttgcacctttggcactgaagggatttttttggaattcctgtgtactgaagtgaagttctgtcagaatatt

SEQ ID NO: 7923 - DNA, 388 bp, Zea mays
  Clone ID: LIB3278-019-P1-K1-G9
gtcgcttccagccgccgccgcgtccgcctcgccaagcgcagcagccgccgcaacacgtgggtctcttgatctcagccatggcggaggtggaacatcaacaggacacgccgaagctcttcaaccgctggaccttcgatgatgtccaggtgaacgacatctcgctgaacgactacctcgctgtgaacgcgacgaaacacgcgatgtacctgccgcacaccgcggggcgctactccaagaagcggttccgcaaggcgcagtgcccgatcgttgagcgccttacaaactcccttatgatgcacgggcgcaacaacggcgagaagggcatggctggccgcatcatcaagcataccctggagatcattcacctggtcaccggtgccaaccccat

SEQ ID NO: 7924 - DNA, 449 bp, Zea mays
  Clone ID: LIB3278-019-P1-K1-H1
ctccccgtcaaggccttttgagagtccgtgagtttactttagcggaaattgagcactttgtggacccagaggacaaatcccatccaaagtttggtgatgtttccgatctagagttctggatgtttccgagagaggatcaaatggcaggaaggtcagccacaagacttaaactcggaaattctgtatctgagggaactgtgaacaatgagacccttggctacttcattggaagggtctaccttttcttgacacaacttgggattgacaaggatcgtctccgtttccgtcaacacctgccaaatgaaatggctcattatgctgctgattgttgggatgcaaagattgaatgctcctatggttggattgagtgtgttggaattgctgataggtctgcctatgacttacgtgcccactcggataaaagcggcgagaaacttgaagcacatgag

SEQ ID NO: 7925 - DNA, 477 bp, Zea mays
  Clone ID: LIB3278-019-P1-K1-H11
ggggcgcgccacgcgttctataatctatttcaaatcctaccataaaattaccaattactgcgaagccatcggggagtgggttattggcaagggcgggaagggtctgtgcaaaggcggagccaagcgtcaccgcaaggttctccgagacaacatccagggcatcacgaagccggcgatccggaggctgtcgaggaggggcggcgtgaagcgcatctcggggctcatctacgaggagacccgcggcgtgctcaagatcttcctcgagaacgtcatccgcgacgccgtcacctacacggagcacgcccgccgcaagaccgtcaccggcatggacgtcgtctacgcccttaagcgccagggtcgcaccctctacggattcggcggctgagaggcgctaccgccgctggtggccgtggcaaaagtcttgggtcgcggtcaagaaatcgagagtattctggatgacgtgcttagtttcgtagt

SEQ ID NO: 7926 - DNA, 465 bp, Zea mays
  Clone ID: LIB3278-019-P1-K1-H12
cgctcgcttataacttttacgactgctcatcgccgcttggttctcccgtcggtacacaaggttgaagaagcgctacgcggacttccacggccgcgctgccgatctcgtccacggcctccggggcacggcgatgcccaggagacaggccctcgaggaagagcaatgtacagaagagaaaggtatctcgactattccaaagcacaagtatgcatccaaagcctgttccccaaaaggaacctttatctgcagctctctctgcgcttactcttgttgtgcaatttaatgggtggctatcatttttcctcttgctttattataaacttcctctgcggccagaaactcacaagacatactatgaatacactggcttggggcacatctatgggctccttgccatgaattcatggttctggagtgccatatatcacagttgtgacacaatttggatagaaaagctatattttt

SEQ ID NO: 7927 - DNA, 441 bp, Zea mays
  Clone ID: LIB3278-019-P1-K1-H2
ccttgatgcagaatctgcttagaaagacttgaatgatttccgtacacagatggctggattaactagtgtgactcgcaattattttgaaaacctagttcgggctctggaaactggattaaatgatgtaggtccttcacactagtcatggtacatgcatgaaaagcgcgacttggaagagccttgttggtaaaagtaagagtggctagaacggatcatcaagcaccagttccaagttgggtggctcaagctgaggtgagtatgatagtaacatatagacgtgcgatcagagcacatatgcagacctaaaatataccagagcctgccacgcttgcgatcaccagcttctatagcgctcgcagtcttggctagagatagaacctcattggcagagaatcatgtggcgctagtgcgagttatacacaaacatacatgatattgaat

SEQ ID NO: 7928 - DNA, 429 bp, Zea mays
  Clone ID: LIB3278-019-P1-K1-H3
gtctctaccaaaaaaacagcgacctctaacgcttagctagctctttgtgggagcgcctgagcatcgagctattggcatggcgcactccaccaccttggccctggtgattgtcgttgtgctggcgctcacctttggtgccacggtcagtgtctccgctcccgtgaacaagtcgagcgtcagcggtagcgccggcgccagcgtgagcattggctacggcggggcaagagccagcgccgatgctggcgtgtcccttggcgccgacacgtaccacagcacgtgccaccgtgcctaggagatcatgcgtgcggccgttgagagggccgtcgctgccgacccacacatggcagcgtttctcctgcgcctccatttacatgactgctttgtcaacagctgtgacggctccgttcttctgtacgacaagcccttctt

SEQ ID NO: 7929 - DNA, 446 bp, Zea mays
  Clone ID: LIB3278-019-P1-K1-H4
cctccctcagccgcgtcgcgtcgcatcctacgatccaaagctctctctgctcgcaggtcgcagccatggcgaagaactacccgaccgtgagcgccgagtacagcgaggctgtggacaaggccaggcgcaagctccgagccctcatcgccgagaagagctgcgccccgctcatgctccgcctcgcgtggcactccgcggggacgttcgacgtgtcgtcgaggaccggcggtccattcggcacgatgaagcatcagtcggaattggctcacggcgctaacgcggggctggacatcgcggtgcggctgctcgagcccatcaaggaggagttcccaatcctctcttacgccgatttctaccagctcgcgggagttgtggccgtggaggtcaccggtgggcctgagattcccttccaccccgggagggaggacaagcctcagaccccacct

SEQ ID NO: 7930 - DNA, 446 bp, Zea mays
  Clone ID: LIB3278-019-P1-K1-H5
aacctacttaacttcttttataattttagcggaaaccggcgagccgctgcaacatcttaattattacaggctcgtcatgctatccatgatccaagaaaaaaaaaatcctatccgattttgaagatccatggactttaggcactgatgattttcctctctctctctctctctgaataatgtaaaaaaaatggaactaagttcagtagcgcgagctgagcctgaaagtggctcgacgagcttcgggcgggcgcggggcttaccggctgcattgctggcagaagcgctggcggaggccggcgacgagcacgacgggggccttggagtgcgcctcgcacaccttgtgcctccggttgtacggcttctcctcggtcatcaggttcgcgttgcaccgctccgcctggcacctcggcccgccgccgccgcctgccgcaacgacagacgccggc

SEQ ID NO: 7931 - DNA, 444 bp, Zea mays
  Clone ID: LIB3278-019-P1-K1-H6
ctcgtttttaactctcaggtatgtaccaattggtgttctttttgatcttctatgtgcagagccagaaagaccatggaatctaatagtccattttaggggatatccctcagaaatcttgtcaccatgcgagggtgaagatagtgtgaagtggagctacatgaattccctgaaagaggtttgttttgagaatcaaaattactaccatgttctatcacaaaggaacctatagcattctctctctctctctctctctattcaggccaccttcatcattactgggaacagtaagagtgtgatgaatatgtcgcatgctgatcaagtcgctctgtgggaatctgtaatgaaaggtaacttagatgggtataaaaatatctccaccaggcttaagcttggaccatttgaagatgatgtgttagtacggacagccttcgtggagcggcaacg

SEQ ID NO: 7932 - DNA, 448 bp, Zea mays
  unsure (1)..(448): unsure at all n locations; Clone ID: LIB3278-019-P1-K1-H8
gttccgtttcccatgctcaggtggtgttattgtattgaaagaggaggtagcgaagaggctagggatggatgttggcacgttcgatatcaagtatctcgatgatgaccatgagtgggtaaagttggcgtgcaatgcagacttggaagaatgcatggagatctcgcggctttctggcagccatgtcattaggctactggttagcgatattgcagcacactttggcagttcttgtggaagctctggttgatatgcgtgtcagccttttgctttgatcaatgtagactcgaaagttcagttccacttggtagttttgttgctagttagctttagctgtttcattgtgtttgataaatgtatcattgtattttacccccaaaaaaatacatgtaattgtgcagaacgcacttgtagtcaactttgtatatatcatgtgctgngaaatctattt

SEQ ID NO: 7933 - DNA, 446 bp, Zea mays
  Clone ID: LIB3278-019-P1-K1-H9
gcaaatggttcgattagatatgaagaagagtacactcatggttcaaatgctggtttaaagagtgctatcgatctccttgagcctatcaaagcaaagaatccaaagataacatatgcagacctgtatcagcttgctggagtggttgcagtcgaagtgactggggggccaactgttgaatttattcctggcagacgtgattcgtcggtgtgcccccgtgaagggcgtctgccagatgctaagaaaggtgcaccacatctgagggacatcttttatcggatgggcttatcggacaaagatattgtagctctatcagggggacatactctgggaagggctcaccctgagaggtctggattcgatggtgcctggacaaaggagcctcttaagtttgataactcatactttcttgagctgttgaatgaggaatctgagggacttttaaagct

SEQ ID NO: 7934 - DNA, 512 bp, Zea mays
  Clone ID: LIB3279-008-H11-R1A
gtcgattagttgttgccaccggagtatgtctgatatccgagccattaactggagatatatgaagaggggctctatctgtttggttagatgtgaccttcgatgctcttgctatgcgtattactaaagtgggtactgcctctcgtactcttctagaccaaccatctggtgattcgtacgcaatggcctttcactatgctcagcatgcttacacagcaaaggggtgatgcttattcaaatgcagatgtaacggtctctctggaagagcttgcatgtacacaacgtcatgatgatgtcgctaagctgacacctactgatatttcaattgagtcacttcataagatcgatagcttcgtcatcgagcatactgctgatagttcatctagcgacgcgcaacaggagtcgcagattcagacgttacagaacttgtagaaccttaatcccgatgtttgccacatagagcatcgtcgacttatgcatcaatgcatggaatcagggagctaataatccgaagt

SEQ ID NO: 7935 - DNA, 586 bp, Zea mays
  Clone ID: LIB3279-057-D4-R1A
gacattgagcaagtaaaagctgatgctgagggcctggcaaagaaactggaagcacttgaagcttacaaaagaaaacttttgggtgagaggttggaagaatgctcctttgaagaactgcacagtttggaagtgaactcgaaaagagccttcattgcatcaggggaagaaagactcagctgctggaggagcaactccataagctgaaggagaaggagatgaatctgcgcaagagcaacgaagatttacgtgaaaagtgcaagaagcagccgccgccgccgccgcctatgctgatggctcctccgccgcctccagcgccggcagccatcgatcacacggggccgaagatgtcgggatggacgtggagacggagctgtacataggattgcccggcagagattaccgctcaaacaacaaagacatgactgcacagtagctgtcaggtcaggtcaggtcaggctagccagcagtgcagagaataatcttagatctgtggtgcggagaactggagatgcaagccaagcccaagccaatcaacatgataaggatcatgagtgtcgcgtcgtgttttacaaacctgtccaccgtc

SEQ ID NO: 7936 - DNA, 103 bp, Zea mays
  Clone ID: LIB3279-057-D9-R1A
gtctcctctccgcatcttctctcctggaagccgactcggtcggtaccggacaagattgccgccttcttcggtgctgcaccgccgacggctctcgcttcattcc

SEQ ID NO: 7937 - DNA, 695 bp, Zea mays
  Clone ID: LIB3279-060-A7-R1A
gtggcatggcacaggttttgaacacggctccagtagcaccagcaaatctccctatgccaaatccagcaccggcaatttcatctgtggcgccttcagaacaatctgcacccagcaaggaggatgttgaattagcaatggctatcaatgcctccattcaatcagctattgcagagggagtatcagtgcccaatgttcaaccaaatgcatccacccccaacaacaatggctgggctgcccctccaagtaattctcacaacggatggggaccaccagccactcctgcaccatcaaagacgagcggtcagtcccaggtccgggtagacgccccaagcagcagcacttacaatggatgggatgtgcccggaacaagctctagtcaaagttcatcgaaaccccaccaaacccaaaccaaccctcctccagtcttgattccacaggaagcacttcaggctctcccaaccccaaccgcgccaccgtttgctgaagaaaccttctacaacggtcctgttcactatccatccatagactctacgcctgtcgatgtaaccatgccggctaccactggaggcggtagtacaacagtcatcgcaacggcagcacctacagaacagttagaaaatgaagctgatgcaagtgacagcggcaaaactccctctggtacttgcgttatatgtctggaatgccctgtggaaagt

SEQ ID NO: 7938 - DNA, 512 bp, Zea mays
  Clone ID: LIB3279-055-G7-F1A
gtttttaaaatttttttttttttttttttttttttttttttttttttttttttttatattatcagggtaatacaaaggaccagaaaaatcgggagccatggaagcgacggcgaaggagcgagcaggggggcccaccacggtgtccagaagagtcctgctgggggaggaaaaaccaaacgcccaaagagtgttttaaaaaagcccccccacggaaaacaccccaagggcccccaggggcccccaaaaggaccaccaggggagggaaaaagaggccccccgggaggggcccccccaaaaacgccgagggggggcccccccccccaaaaggggagggggaaaaccccccggaaaaaaaagggggaagccccccccaccggcacaaaaaaaaggggggcccaaaaaagggcccagaggtcccccgaaaaaaaaaagggggcaacccccccaaaagaccccaaaaaggggaaacccccaaaagggggggccccaaaaaaagggccaccccccccccc

SEQ ID NO: 7939 - DNA, 404 bp, Zea mays
  Clone ID: LIB3279-057-D4-F1A
catcaggaggagaacatacttgaacagaaggtttcgacatgagcaggccggagcagctagctaatagagggagatgagggggtaagtgttctctgacggacgttctggcgcatgtgcctttgacggacggtggacaggtttgtaaaacacgacgcgacactcatgatccttatcatgttgattggcttgggcttggcttgcatctccagttctccgcaccacagatctaagattattctctgcactgctggctagcctgacctgacctgacctgacagctactgtgcagtcatgtctttgttgtttgagcggtaatctctgccgggcaatcctatgtacagctccggctccacggccatcccgacatccttcggccccgtgttgatccatggcttccggcgctt

SEQ ID NO: 7940 - DNA, 188 bp, Zea mays
  Clone ID: LIB3279-057-D9-F1A
gtaaaaagagagttagcagaggatctctgatctgcctttgtcctgcagtttgtgttacaagcggttttttcttcttctgcaaacatccacccatacccatcgtcgcccttgcttggtctggtggtgcttacagattcgtctctcccaacccaaagcagagagttatcaccgtaccattgctactagga

SEQ ID NO: 7941 - DNA, 474 bp, Zea mays
  Clone ID: LIB3279-060-A7-F1A
tttttattggaaaagctccacaatcgtgcaactttgaacgtgagttgcaacttgcaacaatacccagatttttatagaattgtcttgtatagtactacctatgtacataaaggcgtcaccacatacattacacggaagtcatatttgtagtgcagtacgaagtgcaaaaatagcataattgcacaattttgagatagagacgttcccatcaacatttgttgcgagaaccctccaatccattgccaactttctgaacccaccgtttcaactcctcaaacagcatagaggcgaacaacctggttaatcgtggcacggcagatagggcatccccacttcttggattctatgtccttcaaacaggacatgcaaccagccatgtggccgcacgggatgcaggcaccttccacaggggcatccagacatataacgcaagtaccagagggagttttgccgctgtcacttgcatcagcttca

SEQ ID NO: 7942 - DNA, 546 bp, Zea mays
  Clone ID: LIB3279-174-P1-K6-A4
cccaatttcctggtcacggactcggaccgaaggagccgcgaaggaaatcatcaccctccctagtaaagccttgaaatcaccgagtacgccgcggcatggccagtgaatctacacaaaaactactcggcatccaaaccttcagctagatcccgcacatacagtcattatccccctagtgtgacacgggaatcgggcccttccaaccctatggagactggagccgagccaagtgggtgagggcagaaggggaggggagcgggactacttaccggtgcccacgcccgacttttgcttcctgcagttgagcagcttcttgcggtagtctgagatggctggccggcggcgcgcggcggcggcgttctcccgtcggccatctcgacgtcccgctgctaatgttcgggcagtgtttgctttcgtttcaggagaggaccaccccaggtacttaaaatatgactagggttactgcagagctttcacgagctgcttaatctgttggaacatcaaatgggtttacgaaatatttggtgggcccatgtttccttaaaa

SEQ ID NO: 7943 - DNA, 200 bp, Zea mays
  unsure (1)..(200): unsure at all n locations; Clone ID: LIB3279-174-P1-K6-A8
ancaagggcnacaggcgcaccngcaagggcgcgggcanagaccacagaggcacaccggagcagccggcgaggaccagcacgcnngaaaccgacgacgaggccanaagcgggggaaaagcanaacgggncaagggaggaccagaaaaagagcgaaaagcagagcagcacagaggagaggggggagggcgaggacgaccaga

SEQ ID NO: 7944 - DNA, 599 bp, Zea mays
  Clone ID: LIB3279-174-P1-K6-B1
cggacgtgtgggggcccattggatgggtcgaaccttactggtgtaggcgagatcagacttgtaccagatatgccaacactcgttgggctaccatggtcaagacactgaggaaatggtgatggctgacatgcaaataaggcctggagaaggctgggaatactgtcctagaaataccttgaggaaagtcacaaaagttctgttagatgagtacaatgtgacaatgaaggcaggttttgaaaatgaatttttccttctcagaaaattagtaagtaatggagttgagatgtgggctccatatgataataccaattactgctcaacttcagcatttgatggtgcatcatccatattacaagaagtatattcttccctcaaagattcaggcattgttgttgaacagttgcatgctgaagctggaaaagggcagtttgagatagccttgaagtatatcttgtgcactcttgcggctgacaaactcatatatgctcgtgagactattaagtctattgctcgaaagcatggctggttgcaacattttttctaagcctgatttggatgattatgggactggtactcacttccttctgatcttgtgggag

SEQ ID NO: 7945 - DNA, 499 bp, Zea mays
  Clone ID: LIB3279-174-P1-K6-B12
ttgacctttcagtgtttgaagactcagatttattaaagcagggggacatggatgtatatccacttgcagttaaagctgaaacagcattgcctgttgatcagccaccagaaggggatgaccaaaagatgaaaactcctaactcacagatcacccaagccgtgtttgaaaagaaagaaagtggggattatcatgtaagagttgtttgccagatcctttgggtcaatggaactaggtatgaactgctagaaatatatggcatagggaactccgtggaaggtgatgctgatgcaaatgatccagggaaagaatgtgttatttgcctttcagaaccaagggatactactgtcctcccatgtaggcatatgtgcatgtgcagtgagtgcgccaaggtcctgaggtaccaaaccactcggtgtcccatctgcaggcagcctggttgagcgtctcctttagatcaaagtgaacatcatatctggagatcagcaacagatgccccaat

SEQ ID NO: 7946 - DNA, 310 bp, Zea mays
  unsure (1)..(310): unsure at all n locations; Clone ID: LIB3279-174-P1-K6-B2
ctcgccttcaacactatatgccattgcctgtgtcancggagaggggtgctcgttcatcaatgggagcccccagaacacttttgtgcctgggctgattgatcttgctatcaagaacaactgcctgatcggtggtgacgacttcaagagtgggcagaccaagatgaaattggtcctggttggtgtttcttgttggtgctggaataaagcccaactagattgtgagctacaaccacttgggaaacaacgactgcatgaacctgttctgcccctcaaacattcatggtccaaggagatctccaagagcaacgtt

SEQ ID NO: 7947 - DNA, 568 bp, Zea mays
  Clone ID: LIB3279-174-P1-K6-B3
tccactttcaaagtgttttgtttgttgtccgcctggcgcctgcccccataactactctgccaccaatccggggaggaatcaacctagcggtaagcggacatggcggcggcgaagatagcgccgtcgatgctctcgtcggactttgccaacctcgcttcggaggctgagcgcatggtccgcctaggcgccgactggctacatatggacatcatggatgggcacttcgttcctaacctgactattggggctccggtgatccagagcttgaggaaacataccaaagcatatttggactgccatcttatggtcacaaagccttcagattacgtagaaccatttggaaaggctggcgcttctggattcacattccatatagaagttgctagagacaactggcaagatctcatccaaagcattaaatcaaagggtatgcggcctggtgtatcattgaggccaggtactccagtggaggaagtttttcccctggtggaagcagaaaatccggtagaaatgggtcttgggatgacagccgagcctggtttaggtggtcagaaatttatgccagaat

SEQ ID NO: 7948 - DNA, 449 bp, Zea mays
  Clone ID: LIB3279-174-P1-K6-B4
gcaagatcaaagagtgcaagaagcacacactccacaaggtgactcagtataagaagggcaaggatagcctgtctgcccagggaaagcgccgttatgaccgcaagcagtcaggatatggtggtcagaccaagcctgtcttccacaagaaggccaagaccaccaagaagattgttctgatggtgcagtgccagagctgcaagcactactcacagaacgccatcaagagatgcaagcattttgagattggtggagacaagaagggcaagggcacatatcttttctaagcttctcgtccacctgtctggttgttgagttgaagctgaggggctactactactgttataaaaacatgtcgcccaatttcaatgtttttgtaacaatgtaagcggaccatgctttgtattccaaatccaatgcccgccatttgttcttgggtgttgggtgaattt

SEQ ID NO: 7949 - DNA, 519 bp, Zea mays
  Clone ID: LIB3279-174-P1-K6-B6
cgagatctttgagcgcaacccgaccaccatcaagaactatggcatctggctgcgctaccagagcaggactggttaccacaacatgtacaaggagtaccgcgacaccaccctgaacggcgcagtggagcagatgtacaacgagatggcctcccgccaccgcgtgaggtccccctgcattacagatcatcaagacagcgacggtccacttcaagctgtgcaagagggacaacaccaagcagttccacaactccgagatcaagttcccgcttgtgtaccgcaaggtcaggccgcctaccaggaagctccggaccactttcaaggcttccaggcccaaccttttcatgtgagaggtatatcgtacccgtgttctgtgtcttgagcgcccgagagataaggattcttcctgtgcaaagttttggtgccctgttcgttgagcactttggttgattcagttaaggatttgaatgatgctgtgtaaaacaatgactatgtctgcatttagttatcaactacttgctt

SEQ ID NO: 7950 - DNA, 69 bp, Zea mays
  Clone ID: LIB3279-174-P1-K6-B7
ctctctttctctctgtctaaaaccgcggcaggcggagagaacaaaggggcaatgcgggaaggaggagcc

SEQ ID NO: 7951 - DNA, 411 bp, Zea mays
  Clone ID: LIB3279-174-P1-K6-B8
tgacaagctggtttcaacagctatatctgaaggatggcttgatgcttcttttggtaaatcagctgcccctgacgaagagatacaaagtacaagcgttgtaaaggtgaagcgttttaaagaagaatgtggccacataatccatgagtattttctctcagatgatgtcccagaacttattggaagccttgaagagctttctgccccagaattcaatcccattttcctcaagaagcttgtgacgcttgctatggatagaaagagcagagagaaggagatggcctcagtactcctttctttattgagatttagaattgttttcaactgatgtcatcattgagggttttgtatgcttttgctttagtaaaataactgtactgagaattgtggatgctcttattgaactttcttttt

SEQ ID NO: 7952 - DNA, 139 bp, Zea mays
  Clone ID: LIB3279-174-P1-K6-B9
accaggtgtccgagcagaataggccgtcgattacgccacacattaacacaaactaacatgcaagttgccagggcagtgctttaattgatgctcgagttcaagcgcgagaccaatatgacacagtggatttccctgatct

SEQ ID NO: 7953 - DNA, 95 bp, Zea mays
  unsure (1)..(95): unsure at all n locations; Clone ID: LIB3279-174-P1-K6-C11
ccgggncgacccacgcggccgcccagcgtccgcgcacccgaccctgagctcccaggggctctcgccgacgctgacactggggcccaacgctctcc

SEQ ID NO: 7954 - DNA, 545 bp, Zea mays
  unsure (1)..(545): unsure at all n locations; Clone ID: LIB3279-174-P1-K6-C12
ccgggncgaccagcgtccggctcgcnagatcacaaggtgctcatataccaacctttgagcctgttcctgagtcaagtgtctcgatagtggacgacagaactcctgaggacaaagaaaggtggtggaggaggggcttgagagccatttcagaggggaagttggctattgttttattggctgttggccaggataatggttcatatatcgaggaagtccctcgtgagaaagtgaatttctcagaagagcttttgagcagcacattatttgttcgccaattagcggatcagatgactttagcaaaggcttatgtcatccttgcaaaagagcatgataatttttagcttgcatgggagcttatttcgcagataaggaattgtcaaagattgctctttgaaggggcagttagttgggagagcattctctaaagattaagcccatcctattatatttctgggctgtgacaacaagccctttttcaggcatgaaataatggatgctgtttacaatagtggaaaattttgacttgaattttgaaggctttactg

SEQ ID NO: 7955 - DNA, 300 bp, Zea mays
  unsure (1)..(300): unsure at all n locations; Clone ID: LIB3279-174-P1-K6-C2
gntggcttctcctccccctccggctcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgctttctgcacctacggtgtggtcctcgagtccaagatcattctttattgagagacgcanaggncccgcggctcccccttngtcaccttctccaccgaggaggcgatgcggaacgccatcgaagacatgaacggcaaggaa

SEQ ID NO: 7956 - DNA, 170 bp, Zea mays
  Clone ID: LIB3279-174-P1-K6-C3
ctcggatctgccgctctcgtctcgctcgctcgcgtgcattggccgacagggacgacacgccggcgtggctgctcacgtgttctcagttcttaccctgcgctctcgccgcccggggcaactggcgagcgagtgtggctgccgcttcctctccgagtcaggcttttatttaa

SEQ ID NO: 7957 - DNA, 407 bp, Zea mays
  Clone ID: LIB3279-174-P1-K6-C4
cgaattcctaggagcggaggccatggctgggaagggaggaaaaggattgctcgccgcgaagacgacggcggccaagtcggcggagaaggacaaggggaagaaggcccccatctcacggtcctcccgctcgggcctccagtttcctgttggacgaatccactttttgctgaagtttttttttcaggcaaatggccgcgttgtttttatttcacccgtctactctgccgccatcctccagtacttgtctgccccggttttggagctggcctgtaactctagcaaggatctgtttgtgtagctgttcatccctcgtcttcttctgtttggcccatatgctgtgactaggatctcgtcacctctatcatgggctctcattcctagttttgttggcttttttctgttcttcg

SEQ ID NO: 7958 - DNA, 174 bp, Zea mays
  unsure (1)..(174): unsure at all n locations; Clone ID: LIB3279-174-P1-K6-C5
gtcgaccagcgtccgaacatccccacctcggaaggcaccttcagaagcncaagactctaaggccgtcgccttcccattcttcctngccgcgggggtcgcctgagatcacataaacaatggttaaggctgttgctgtgctcggaagcaacgagggtgtcaagggcaccatttttt

SEQ ID NO: 7959 - DNA, 515 bp, Zea mays
  Clone ID: LIB3279-174-P1-K6-C6
gctcatgctgcctggggttctaactacggcgacccgcgggagctgccgttcggcaacctcggacccagcgacgtgtgcacgcccttcaaccaggaagctggcttcgcgaggccgctcgccagggcatcgtgcttgctcaagaccaccggcaagctcccgttctccgtcacctccatcaagtccatggccgtcattggccccaatgccaaccccagctccaccatgatcggcaactacaaaggcacgccatgcaggtacacgacgccgttgcagggcctgggcgcgaacgtggccaccgtgtaccagccggggtgcaccaacgtggggtgcaacggcaacagcctgcagctcgacgcggccaccaaggccgcggccagcgctgacgtgaccgtgctgttcgccggcgccgaccagtccatcgagcgcgagagcctggaccggaccagcctcctgctgcccggccagcagccgcagctcgagtccgcggtcgtcaacgcgttcagcgacccgtgcat

SEQ ID NO: 7960 - DNA, 648 bp, Zea mays
  Clone ID: LIB3279-174-P1-K6-C7
ataaaatttactattattttgacttccttttttacttttaatgccttaggccatccctctttggtggtgctcgcccccgtgaacaagttctcaaagaacgtggagtggatgttttggccagtgatcttgagcggatttcaccagttggcaggtctaaaggtgaatttgcaaaggtcgagcagaaggttgaagctttgtccattaacccttctcttgaaagagctgatggtttttcagctggtcatagaggcccaaggagtgttgataagaaggattacaggcgggatactgagaaggctgatgcatataggccttctcgtcgggaggataacagggtcgctagagatatggagaagccacaggagcaaccacgcccagagcctgagacatggcgtaagccagtggagcctccaaagccagaggttgcaacacctcgttttgggaaagcagcaaccgcgttggagcttgcgcaggccttctcaacgtccatgtctgataccgcaccacagaaccggttgaccagcgttcccagtccaagagttcctcttagcccaggggctagggatcagtctggcttctcaaggcttactgacagcaggacgttacgctccagccctttctagcgaaaggataaatggctactgatcg

SEQ ID NO: 7961 - DNA, 206 bp, Zea mays
  Clone ID: LIB3279-174-P1-K6-C9
ggcagcagacaggttatggaaacacctatggagggtatggtggatccaacatgtatagttcatatggtggatttggcaacacttatggtaccggtggactcggaaatagcatgtactcgagttacggaggaggttatggtggtggcatgtacggaggtggcttttatggaggctgtgtgtatggagggatgggaggttatggtttt

SEQ ID NO: 7962 - DNA, 604 bp, Zea mays
  Clone ID: LIB3279-174-P1-K6-D1
aggaatttccaaagaaaactaaacagaactgtagagagtttttgaaaaagattatagaagtaggaaaaagatggggaagctttgcatgaaagtgatgggttttgttgctcgtccttctacgaccattgttgagcaaattcgtgatgttattagtattcatatttactttctactttaattttaaattgttggtatgctcgtaggttaactttatctctagggctaagcttcaattcgacatccgcccattcttaagtcttaatgtcattgccgccgagtacaatagtgattccccggtgcatccacaccaaggatttcatcaccactagccccatcaacgactacaatggtgaagagtttgtcttttactctacaaggaagtaccgtgccaaaaactcaataatagagtaccacaccaaccaaaatggctaattgttgccactagagagaatgtatagcctattttgtctggcactttagggaatcgatagctataagggcagttatgcactcgagtgactacaatagggaagggaggtttttccaggcaagaaaggctctttgtctgttgaaataacacctctccaaaataatgttcatgcct

SEQ ID NO: 7963 - DNA, 96 bp, Zea mays
  Clone ID: LIB3279-174-P1-K6-D10
cccggggcgacccagcgaccgcggactcgtggggggagggaggcccctgccgaaggcaagagaaaccgccggcgcgcgagagaggagaggaagggc

SEQ ID NO: 7964 - DNA, 141 bp, Zea mays
  unsure (1)..(141): unsure at all n locations; Clone ID: LIB3279-174-P1-K6-D11
ccgggncgacccagcgnccgccgatttcgacagacganagcccagcgaaggaggacacggcagcnggnggccgcaaacgggcgggggaggagcacgaggagccagggccagccagcacgaccacagcggcaaggaccacaa

SEQ ID NO: 7965 - DNA, 498 bp, Zea mays
  Clone ID: LIB3279-174-P1-K6-D12
ccaaggccgagaagaagcccgcggcgaagaagccggtggaggaggagcccgcggccgagaagacgaccgccgggaagaagcccaaggcggagaagcgggtccccgctggcaagtccgtcggcaaggagggcggcgagggcaagcgtggcaagaagaagggcaagaagagcgtggagacgtacaagatctacatcttcaaggtgctgaagcaggtgcacccggacatcggcatcttctccaaggccatgtccatcatgaactccttcatcaacgacatcttcgagaagctggccggcgaggccgccaagctcgcgcgctacaacaagaagcccaccatcacctcccgcgagatccagacctccgtgcgcctcatgctcctcggagagctagccaagcacgccgttctttgagggcaccatggccgttaccaagttcaccttcttctatgcttgcacgctcgccctttgtaggcttctcttgtattgatgttcgccttgt

SEQ ID NO: 7966 - DNA, 320 bp, Zea mays
  Clone ID: LIB3279-174-P1-K6-D2
gtagcctgtagcttcatccgatgcgctgctcccggttccatcgcgcggtgcggaatttaacatggccgtgccggaggtggtggtcgacggcgtcgtcttcccgccggtggcccgcccgccgggctccgccggctcgcacttcctcggcggcgcaggcgtgcgaggcctcgagatcgtaggcaacttcatcaagttcacggccatcaaaaagtacctggaggacgcggtcgtgcccgcgctggccaagaagtggggcggcaagacggccgacgagctctcctccgacgcccccttcttctgcgacgtcgtcacgggcgact

SEQ ID NO: 7967 - DNA, 303 bp, Zea mays
  Clone ID: LIB3279-174-P1-K6-D3
gccttttgttgatgtcctcaaggagggaggcgtcctccctggcatcaaggttgacaagggcaccattgaggttgttggcactgataaggagaccaccacccaaggccatgacgaccttggcaagcgctgcgccaagtactacgaggccggtgcccgctttgtcaagtggcgcgctgttgtcaagattggccccaatgagccatcacagataagccatcgacctgaacgctcaaggtctggctcgcttatgccatcatctgccaggatattggtttggtgccaattgttgagcctgagatcctt

SEQ ID NO: 7968 - DNA, 363 bp, Zea mays
  Clone ID: LIB3279-174-P1-K6-D4
ccacttgtccggaaaagccagtcagtccgggctctctcaaatagcgaggacaagttaccatcaagtgagcctttaacttccatgtctacgggtagtggggcttctacctttgaagtttggatgtcccttcctaagtgggcagcacaggttctgaagcatctagctccagatatatgatacaggagtttggttgcacttggtattggttgtataaatggtactcctgttgcttcatttgagaggcgagatgcagaccgtcttcttttcttttgcacaagccagtgcaaagatttggctaatgaaaacggtccatattttcatttgccaagatggtcagcctcccttaccaaggacagaacaaag

SEQ ID NO: 7969 - DNA, 207 bp, Zea mays
  Clone ID: LIB3279-174-P1-K6-D5
gaaaaataataggcccaaatgatcggctaattcatgtttatcacttcaagaaagatattaatcagactcagattcagaacttcggagaccctttcgttttggtcgttcatgaaggtgagactttagcagaagtcaagaagcgcatacagagtaaactgcatgtttatgcttgagggggtgtgtgcaagtggaaatttgcatttatat

SEQ ID NO: 7970 - DNA, 325 bp, Zea mays
  Clone ID: LIB3279-174-P1-K6-D6
cgtaccccgcctcccggttcaaccaaatccctctcgcctcatccccaccagcgcaaagccgccctatcgtcctgtcgtgagaagcaatggcgggccgtggcaaggcgattggcgctggtgccgcgaagaaggcgacgtcaaggagctccaaggctgggctgcagtttgcggtcggcaggatcgctcggttcctcaaggacagcaagtacgccgagcgcgtgggcgccggcgcccctgtctaccttgccgctgtcctcgagtacctttccgatgatgtcctggagcttgctgggaacgcagcgagggataacaagaagacccgcat

SEQ ID NO: 7971 - DNA, 172 bp, Zea mays
  Clone ID: LIB3279-174-P1-K6-D8
cccatgtgttacgactccgacgacgcgaccccggcggcctgctgcccagctccctctgccttcgcgccgtgcctcctaccctcctgaatccgcgccgtgccacccgagtccaggcccccagggtgcgagggcggcaccggcgcaggcgaaccggaatccgatccttcgcact

SEQ ID NO: 7972 - DNA, 80 bp, Zea mays
  Clone ID: LIB3279-174-P1-K6-D9
cgaatcaaagttgctgcttcatccacaataatagatagctcagatgcttgttggatggctgagttcatacaccagttctg

SEQ ID NO: 7973 - DNA, 454 bp, Zea mays
  Clone ID: LIB3279-174-P1-K6-E10
tccgggtcgctccagcgtccgcgcatttcacctcgcagccgtattcttgtctcgaatcctctctcgccgctccgatggcccgcacgaagcaaacagcaaggaagtcgaccggcggcaaggccccccggaagcagctggccactaaggctgcgcgcaagtcagccccggccaccggcggcgtgtttaagccccaccggtttcgccccggcaccgtcgcgctcctttgagatccgcaagtaccagaagagcactgagctgctcattcgcaagctccccttccagcgcctcgtcctcgagatcgcgcaggacttcaagactgatctgagggattagtcctccaccgacccggctcctgcaggaggccgacagggcgaacctggtgggggttttagaggacatcaacttttgctccattcaagccaagtgcgtcactttcatgcccaaggacatttca

SEQ ID NO: 7974 - DNA, 287 bp, Zea mays
  Clone ID: LIB3279-174-P1-K6-E12
cttcctgttctcaaaccaacctagccaattcgccgcagcctctcaccctcgcgagtcccgacctcccgcagccgccgcacagatggcacccaaggcggagaagaagccggtggccaataagcccgcgtgaggaggagcccgcgacagagaaggtggagaaggcttttttctgggaagaggtggtaggcctataaatgctttccggtttttattaccaaggagggcggcaagggcaagacggggaaaaagaaggctaagaattccgtggttgacctactagatctaca

SEQ ID NO: 7975 - DNA, 522 bp, Zea mays
  Clone ID: LIB3279-174-P1-K6-E2
gcaagaggcaggtcatgatcaggccgtcatccaaggtcatcatcaagttcctgacggtcatgcagcgccatggctacattggagagttcgagtacgttgatgaccaccgatcgggcaagattgtggtcgaactcaacgggaggctgaacaagtgcggcgtcattagccctcgctttgatattggcgtgaaagacatcgaggtatgtattgaaaggctgctcccgtccaggcagttcggatacatcgtcctcacgacttcggcaggcatcatggaccacgaggaggcccgccggaagagcgttggaggcaaggttctaggtttcttctattgaagaagctgagaatctttgttatggcctgcctgcctgtcttactctctcagactagagtacctgttattttactttaatatgtctttctcagactagagagccctcttttacttgaatattggttactgcattggtctttcactttaaaatcccgggactgcattgatcgaattatctgagccggttcttt

SEQ ID NO: 7976 - DNA, 425 bp, Zea mays
  Clone ID: LIB3279-174-P1-K6-E3
gtcgctagtggtgtgaagagcagtgccccagttcaggaaaacacggtcgagaacaaggtcgggagctcggcggaagaagccaagaaactggaggagctcgacaccaacctggagaaacattacatagcaggcctccgcaggagagatggcaggacagtcggccttggcctctagaaactttgtttgcagttgcagatgctgcggtattgataaatgcagagagcttgctctgtacaatctacagtgccttgtttattcttgcacttacaaaatttcctgtacggcttacgttgactgtttccgggttatcttgaagctctagaacatgtgtccctgattgacactcctgtactgcgtttgcataaccccgtcattcttgagtagtaattcaccggttattgtttaaaaaagatgtatctatatat

SEQ ID NO: 7977 - DNA, 282 bp, Zea mays
  Clone ID: LIB3279-174-P1-K6-E4
cggacgtgtaggtgcctctgaagcaggagctgcggtatcacctaagccacttgaggttttcatgtgcagtgttgttcgcaagatgggctacggcgatggtttcaagtgggtctcccaatacatcaagtagggcccttgccggggcgcttgctcagcccagctttttttttgccttggtttttgctctggatggtatttcgcctttttttttaccgtcatcatatcatgacagcctccccgaggggtatgccccggaaaaaactgtgcttaacattggggaac

SEQ ID NO: 7978 - DNA, 467 bp, Zea mays
  unsure (1)..(467): unsure at all n locations; Clone ID: LIB3279-174-P1-K6-E5
ttgacaagaacccacacacacaaggggagcgganaaacgaaaaagagnngggagcnagncgcacacancaaaaacnaccagcgnnnncnncacgggcnacaagggggagcaagccaacgaggaagaggaaaggganccccgaaccgaagaggaagacgaggagcagaaagcgggaggagccaaggaaaaaggcaaagcggaagagaagaaacagaaaaggcaagaaaaggcagcggcngcaccgncaaaancaagcccggaccccaagaagagcaaggaagacgacgacacggaagaggacgagacngaagacacagaagaggaggagacggacgacacggagagggaaagacgccggaagaaggcgaggaggaggcaagggaggaagaagaaaccagggacgaagaggaggaaaacacacccaacgccaaaaaagccacgaaggaggcaagaagagagcggccgaa

SEQ ID NO: 7979 - DNA, 459 bp, Zea mays
  Clone ID: LIB3279-174-P1-K6-E7
cttttatttcagtcttctggtcatttggttacatccgtctctctgaaaggcttagaaaaacatccaaagaacctgctaaggctcctccacgtgctgatgttgttaagagccttaaaaatggcatcgtggttaatattcttgggatgggcgctgctgttctcggtttgcaagctactgtgtggtgctttggtagcaaaagctcttacaatctctgcagtaccctattatcaggctgctggccaaagccctgtcttggctttagatgttttcctagttcaggcttcagcgaacaccatcctgtcgcatttccttggggtggcgagctccctggagctgctgcgctcggtgtcactggctacagcaaaagccgccgtacccgccccggcccctgcacgggcctgagccatggcccgttgggcaagtcaagaaaaacctttaatccttggttttggctctaga

SEQ ID NO: 7980 - DNA, 510 bp, Zea mays
  unsure (1)..(510): unsure at all n locations; Clone ID: LIB3279-174-P1-K6-E8
ggctctttgctctcaagctatgtcgggggctttggaactgcaaacaacatgcctggaaatttccctctgaaccaaagtacaancgtcggcaaccgcaactctttgggtttgatggaacggtcccgtcacatttcggaagatggaaaccagtttgtttgtcttcagcataacgagaaccctgcaatgtggatgcatggagctggttcacgagggatgcccccacttgcagccagtaccatgtatggctatcaagggcagagtcatcagaccggccttcggcagggccagctaccttcacaatatggctctgctctagggcagtcacagccgggcctgggccccgaacaccgaaatcctagcgatagtaacctaagtggtgctgctcaagctaaccagatgtggccaaacagctactgatccacccgaccaccccccttataaacatctgtggaagacggtctttgtgttgtgtgcgcaaacgccagaggccatgcacatgcctgtggcctg

SEQ ID NO: 7981 - DNA, 134 bp, Zea mays
  Clone ID: LIB3279-174-P1-K6-E9
agattgtgctcgatagtgctcgacctttgagtacgatcgcaaacacgtgtaatcactggtgcgataaaactgcaatggcagcactgactgctgaacttgttgagaatgatgtgactagggccttgtttagggcc

SEQ ID NO: 7982 - DNA, 588 bp, Zea mays
  Clone ID: LIB3279-174-P1-K6-F1
ccgcggtcgacccggacctagcgacgacggccgaggcgctgcgtctgctggacggctgtggcgccgacgtcatcgagctgggggtaccctgctcggacccctacatcgacgggcccatcatccaggcgtcggtggcgcgggctctggccagcggcaccaccatggacgccgtgctggagatgctgagggaggtgacgccggagctgtcgtgccccgtggtgctcctctcctactacaagcccatcatgtctcgcagcttggccgagatgaaagaggcgggggtccacggtcttatagtgcctgatctcccgtacgtggccgcgcactcgctgtggagtgaagccaagaacaacaacctggagctggtgctgctgacaacaccagccataccagaagacaggatgaaggagatcaccaaggcttcagaaggcttcgtctacctggtgagcgtcaacggagtgacaggttcttccgcaaacgtgaacctccgagtggagtcactcatccacgagggtaataaggtgactaacaagcccgttgttgttggcttcggcatacccaaacccgagcctttaatcagaatgcttc

SEQ ID NO: 7983 - DNA, 434 bp, Zea mays
  unsure (1)..(434): unsure at all n locations; Clone ID: LIB3279-174-P1-K6-F10
cgcgtccgttctgttgacaagaacccacacatacaatttgatctgattttcgataaagagtttgagctgtcgcacacatcaaaaanctaccagcgttttcttcactggctacaaggttgagcagccattcgaggaagatgaaatggatcttgattctgaagatgaagacgaggagctgaatgttgcagtagtcaaggaaaatggcaaagctgatgagaagaaacagaaaagtcaagaaaaggcagatgctgcaccttcaaaatcaagtccggattccaagaatagcatggatgacgacgattctgatgaggactagactgatgattctgatgaggatgagactgacgattctgatgagggtttgtttcctgaggaaagccatgatgattcaagtgattaatatgattccagttggcatgaggaggaaagacact

SEQ ID NO: 7984 - DNA, 186 bp, Zea mays
  Clone ID: LIB3279-174-P1-K6-F12
gcggccatttttgcgcccacgcgtacgggtacttgctgagatgaccaacggaggggtcgaccgcagtgtggaatgcactggcaacattaatgctatgatccaagcttgcgaatgtgtgcatgatggttgttgtgtgtgcattgctgtgggggtgtcccacataacgtctctgagttgaagacccac

SEQ ID NO: 7985 - DNA, 57 bp, Zea mays
  Clone ID: LIB3279-174-P1-K6-F2
gacgggtccggactacatagtctctcctatgctgagcgctcactgaggcagaagggg

SEQ ID NO: 7986 - DNA, 426 bp, Zea mays
  Clone ID: LIB3279-174-P1-K6-F3
caaaatataagcacatggagtacgaggaagagatgaagtcccaggaggaaatttttcatggtctaattgaggatattcacaaggccacagaggataaagaaaagcagtttgagaagttgttgcaggaagagcgctcaaaggccagacgctttgatgttgattctggaactatgaaagatcgtcagctaaggaaggaatatgtgcagaagttcattgattgccaagtcaaggatgtggcagagtttgaagttgagcgagatgagctgatcaaagtccactaggacaagaagttgaagctcaagaaagaatacttggatctggagctggagcttggagaaggagtttgaacgcaaccttgacgggcctgatggggaaagcataagccagatccctttgaggccttcagcttggaagggggctttagcg

SEQ ID NO: 7987 - DNA, 367 bp, Zea mays
  Clone ID: LIB3279-174-P1-K6-F4
cggacttgtgggtctagaagctactttctagatgtatgcctgatataatggatgttgactcgcccaattgcttaccgaaaacaccagtgaaaaaaaagcatgtgactcttgtacttgatttggacgagactctggtacattcaacattggatcactgcgacaatgctgattttacggtggtgtgttttctttaatatgaaaaatcacacaatgtatgtgagaaaaaggccttacctgaaaatgtttcttgagaaggttgctcagatgtttgaggttgttattttcacagctagtcagagagtctaggctgagcaacttatagataaacttcgaccctgatggaaaatattttttatggggtatttta

SEQ ID NO: 7988 - DNA, 357 bp, Zea mays
  Clone ID: LIB3279-174-P1-K6-F5
cgcgtccgcggatctgtgggcaagctccaaaaccgtaaatcatccaagaagggcagaagaggtgggatgatgaagaagcagaggaagcttttagagctggaagataacaataatattaatcacaatcaaactggggtgcagcaaaaccaagagaggtttggatttgaatctgtgcctgagttcagagtggagacatttaagaagtatgcagatgatttacgtgaacaatattttaagaaagaagtgcccgcggactcaccaccatcagtagaagacattgaaggcgagtattggcgtttagtctaaaagcctactgaagagatagaggtagtatatgatgctgatttggagactgga

SEQ ID NO: 7989 - DNA, 287 bp, Zea mays
  Clone ID: LIB3279-174-P1-K6-F6
gggcgagctctccagcgcccgcttcagcgagaaggagctgatcagcgccatcgaccgcgaggccgagttcacgtacgcggaggacgcggccagcgccagcctgccgctgatgcagaagctgcgcgccgtgctggtggaccacgccctcagcagcggcgacgcggagcgggagccctgcgtgtgctccaagatcaccaggttcgaggaggagctccgcgcggcgctgacccaggaggtggaggccaaccgcgtggctggacgccgagggcaccgacctcgtggcgaac

SEQ ID NO: 7990 - DNA, 544 bp, Zea mays
  unsure (1)..(544): unsure at all n locations; Clone ID: LIB3279-174-P1-K6-F7
cgcgggcccggcctcgcggcgcgcccgggcgctcgcggcgccgcccctgccccgcgccgtcgcttccacccgcgcggcgctggtggtctccagtccgccaccgcccgcggcctcggggacgcccgcacccgcgcacgccaaggtcgaccgctccggccgcttctgcagccctcgcgccgcccgggagctagcgctgatgatttcctacgccgcgtgtctggagggaaccgacgtcgttcggctcttcgaccgcaggatcagcgcaagacgagagcccgggtttgttttcgacaaggcatgcctactgagttacaaccatatgagctttggcgggggaccgctcgaggttggaacggaggaggaggctgagaagctgaccagtcagaacgagaaggattcagccaacgaagcanatgtactttcagctccttcaaaactggtttacaccaactttgttttaacggtgtccagggacttctagtggctgtagccagtggatgggataagcatgtagagatatcgaccaaataatcccccaggcttg

SEQ ID NO: 7991 - DNA, 559 bp, Zea mays
  Clone ID: LIB3279-174-P1-K6-F8
cgcacatagattaggcaaaggatgggcgaggatctggacagtctggacttcgacgagctgcgcggcctcgagcaaaacgtcgacgcggctctcaaggaggttcgccataggaagtaccatgtgatcagcacgcagaccgatacctacaagaaaaaggtgaagcactctcacgaggcgtacaagaacctgcagcaggagctaggcatgcgggaggacccggcgttcgggtacgtggacaacacgggcgccggcgtcgcctgggacggcgcggcggcggcgctgggcggcgccccgccggacatgtactccttccgcgtggtgcccagccagcccaacctgcacggcatggcctacggctttcacgaccttcgtctgggctagcgcattcatcaccatgctgggtggggctgctcgatcatcctactgcatggcaatgcaagctggttggttggttcgctcatgcttcgtccgtcacaaatcaagtaactatgcaatgcaaccgatgtactgtaatagccaataaatctactgcatactgcaaacccaattacttggtagc

SEQ ID NO: 7992 - DNA, 457 bp, Zea mays
  Clone ID: LIB3279-174-P1-K6-F9
cgggccgacaacccggtcgcccagcgtccgaatatttcttttttatattattccggaaattttggatttatcgggacagacaataccctaggaaccccaagaagggctgatttgagcatgatcaatttagaggatatgctcgccctcttccttcccgtccttagtttaggacaggggaaaggatttttccttttattttaggaattttgggaacatttcaacaaaggagatctttcacaggtcaaacgagacctaagacttaatctaaaagaaattattagattgaatctatttgcattaaaaaaaccgatcaaaaaaggacgagcgaatttagtaatcgaaaaactttcttctttggtcggcctatctattagaggagagcatatgaaaaatgtaacccaatttttttgttattttagcttactagtcattcaatgggaagttggggcttaatacc

SEQ ID NO: 7993 - DNA, 384 bp, Zea mays
  Clone ID: LIB3279-174-P1-K6-G1
gttggcttctcctccccctccggctcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgcttttagcacctacggtgtaggtcctcgagtccaagatcatttttttttgggagactcagaggtcccgcggcttccgcttcgtcaccttctccacggaggaggctatgcggaacgccatcgagggcatgaactggcaggagctggacggccgcaacattaccgtcaacgaggcccagtccctccgcggccgttgaggcggcggttgcggctggtacggtggtgg

SEQ ID NO: 7994 - DNA, 202 bp, Zea mays
  unsure (1)..(202): unsure at all n locations; Clone ID: LIB3279-174-P1-K6-G11
gntggatctatctcctttgtggccttctcttacctggacctagatctgctgttctactgcctgcgccgattcgagacaactccaccagagtcgcctagccgggagcacataaaaatggccgtgtgggtactcaccacgatgctcactgctgcaatctcattctaggtggcagcagtggtgccactcccggagcacgttgctt

SEQ ID NO: 7995 - DNA, 462 bp, Zea mays
  Clone ID: LIB3279-174-P1-K6-G12
atttatcaaattatgtagagacatttcaagaaagataatgcgaggtatagccttggctttgggaggggcaattgatgcttttgaaggggatacagctggagatcctttctgggtgttaaggttgattggttatcccgtagatattccagaagagcagcgcactgatactggctgtggagctcatacagattatggacttctaacactggttaaccaggatgatgacatatgtgcccttgaggtgcaaaatcgttctggtgagtggatatttgcaacgccgattcccggaacctttgtttgtaacatcggtgacatgctgaaggtttggacaaatgtaatatattagcccacccttcacagagttgttaacaattcccagcattaccgagtatatgttgcattcttctactagttcaacttcgatgctgcagtagagcctgttgagttctgccgggagaaaac

SEQ ID NO: 7996 - DNA, 652 bp, Zea mays
  unsure (1)..(652): unsure at all n locations; Clone ID: LIB3279-174-P1-K6-G2
cgaaaattctagcccgtcagctgatcaggttaaggcagcagatttctaatttgcaaggtagccgagctcagattcgggggattgcgacacatactcaggcaatgcatgccaacacttcagtggctactggtttacaaagtgcgagcaaagcaatgggagctttgaataagcaaatggaacctaccaagcagatgaaaataatgcaagaattccaaaagcagtcagcacaaatggatatgacaaatgagatgatgtctgattcaattgacgatgtcttagacgatgaccaggccgaggaagaaactgaagaacttgctaatcaggttctggatgagattggtgtagacattgcatcacagttgtcctcggctcccaaaggaaaaattgctgggaagaaggttcaggttgatgaaagttcggagttggaggaactagagaagagactggctgctctaaaaaatgcataagatctgtttacaaccctctcctctatgcacatagcaagcctgtcgtgtaccttaattccaaatcttcattcgacacgcaaagtcactgtgatttgtatgtatcaaaaggaagatgatgcanacccccaagtttttgggcgaatcgatgttgctgctgttcgtacacactcacgtataagatgggg

SEQ ID NO: 7997 - DNA, 106 bp, Zea mays
  Clone ID: LIB3279-174-P1-K6-G5
ctctgggtggcctgaaagcttcagcgtcgttcttaggggtccctataggtcacaactcatcctatcgacaaggccctgcatttgctcctccacgcaaacagggagg

SEQ ID NO: 7998 - DNA, 221 bp, Zea mays
  Clone ID: LIB3279-174-P1-K6-G6
ccagttttgaccgccgcctcccttcccctccgctactgctcctactcaccccactcccccgcaggagcggcggcggcggcggcgaggtcgtaccccacatcggcgagcggtggcggcaccgccggaggcaaaggcaagatgttctgggcgcgcgccgaattttttttacaacaccgtgttttacgagatcctcggggtgcctttttttttttttccttgac

SEQ ID NO: 7999 - DNA, 301 bp, Zea mays
  unsure (1)..(301): unsure at all n locations; Clone ID: LIB3279-174-P1-K6-G7
cggctgtgacggcnccgnacacccggacgacaagcgcgacaacaacggcgagaagacggcngggcccaacgccaacccaancaggggcnncgagggcaangacgccaacaagaccgagccggagcgggagngcccaganacagnnnccngggccgaccccccngccaacgccgcccgggaccccgacgnngggnccggcgggccgagccgggagaangagggcgggcggaaggacagccggaccgccagcccgcagggcgccaacaccaaccncccagcaccgacgaccggccgcgacacc

SEQ ID NO: 8000 - DNA, 504 bp, Zea mays
  Clone ID: LIB3279-174-P1-K6-G8
gttctttatatccttatgaaaaccagatggacctcgcattagaaagggcactctgctcgttacttgtgggggatatttgcaattgcagaatgtggcttggaattgataatgagtcctcgtcatatagggaccccaaaattatcgagtttgtggtgaataactctagcatgaacgaagagaatgatcttcttccagggctgtgcaagctcttggagacatggcttgtctccgaggtattcccaaggagcagagatacccgagggacgcagttcagactgggagactattacgacgacccaaaagttctaagctacttagaaaggatggatggcggtggtgcttgccatttaactgcagctgccgctatagcaaatacttggtgctcaagctactgctgcgcttggtactgtaaaatcaagtgctcttcaagctttcagtaacgttttcccattgatagaacagatagacatgtgcggcaaggatataccaagtgatgatcttgat

SEQ ID NO: 8001 - DNA, 292 bp, Zea mays
  Clone ID: LIB3279-174-P1-K6-G9
cccacgtgcgcccacgcgtccgcccacgcgtccgggccaacaacctttgtgtagtgattatgcacatccttaagatattgttttttctcaaacaacacatgagaactgcgtgcatttcattaagttgaaaaaaaaaggccaaaggataagcagtgtggggcgttgttagccttgggcgtgggtggcctagggaagttggccctttgtataaaagccaaaacagtttgagcacggctgaatgtcctggatccggggattaagaactgaatggctggtgtacacagacatatcc

SEQ ID NO: 8002 - DNA, 653 bp, Zea mays
  Clone ID: LIB3279-174-P1-K6-H1
gcgagtcccgagtcgactctctcccgtttcccggccgtccccttcaccaatccaatccaactccaattcgtcctccggtcctccccctcgaggcctacgcacaatagattcgatctcgagtcctcgaatcctgccttttcctctggtcaggaaagcatgagcttgatttccggcgcttctcgccgtcgagctcgaaccagaagataagaagaatccgctaggggcgagccccatagaagatggccccgcacccgcaggaggacaaatcagatcggcacagcagcggcgccggtgcgtcgagggagcaggaacggcggccgtccaaggcatggggaatcctcatcttcggcctcatcggcgtcaccaccgccagtttcgctattactcaagttcgcaaaagcatggactggttctacactcagttgaataaagtgcagtcaacatcatcttggacttggaggtatacaagtaataactcaagtcgtggaagcttcagtgaggaagctaagaaaagatattatcagcgaatgcagcaggaatatgaagaggaacaagagagagttcaaagaataaggcatatgcagagtgtcttcaacagagagagggataatttggacgaggttatgaaagctggagggagaatggccctcctc

SEQ ID NO: 8003 - DNA, 378 bp, Zea mays
  Clone ID: LIB3279-174-P1-K6-H12
gggtcgaccagcgtccgccagtgtcgggaacttacacagcaggctctcctgacgacctatcaagagaggcatggcggtcgcagacccgtcgagcccgtacaaggtacggctgctggtggaggactacccgtacgcgtcggacgggctggccatctggcacgccatcgagcagtgggtgacggagtacctcgccgtctactaccccaacgacggcgtgctgcgggcggacgtggagctgcaggcgtggtggaaggaggcgcgcgaggtctgtcacgccgaccttaaggacgcgccctggtggcccatgatgcagacggtggtcgagctggtcaaggcctgcaccatcattatatggatcgcgtatggtgctacacgcgg

SEQ ID NO: 8004 - DNA, 609 bp, Zea mays
  unsure (1)..(609): unsure at all n locations; Clone ID: LIB3279-174-P1-K6-H2
attctctcggtctctaccaaaaaaacagcgacctctaacgcttagctagctctttgtgtcagcgcctgagcatcgagctattggcatggcgcactccaccaccttggccctggtgattgtcgttgtgctggcgctcacctttggtgccacggtcagtgtctccgctcccgtgaacaagtcgtgcgtcagcggtagcgccggcgccagcgtgagcattggctacggcggggcaagagccagcgccggcgctggcgtgtcccttggcgccgacgcgtaccggagcacgtgcccccgtgccgaggagatcatccgtgcggccgntgagagggccgtcgctgccgacccacgcatggcagcgtctctcctgcgcctccatttccatgactgcttcgtcaacccgttcttcatcggcgagaagacggctgtgcccaacgccaactcaatcaggggcttcgaggtcattgacgccatcaagaccgagctggagcgggagtgcccagatacagtttcctgtgccgacctccttgccatcgctgcccgtgactccgtcgttgtgtctggcgggccgagctgggagattgaggtcggccggaaggacagccgcaccgg

SEQ ID NO: 8005 - DNA, 371 bp, Zea mays
  Clone ID: LIB3279-174-P1-K6-H4
aacttgtccgcaccgcctcctaacggagcttcaagttctgatcaacctgaaagatgattgagaagatggaactggtagatttttcgtggcatgagtctaaccaagatgggcttcaaaaggtggtgcaactaaccttggcagatcggttccaagggactcggacaatgggctcaataaaaacaagctcaacagcagtttatccgttgcttatatatatttctattgactgtatcgagtgaagaggatagttctagtatttcattttgctttgtttactgtgctgtgaaaaggagttcttatcagtagataagctgtagacaactatcagtttggctcctacattttatgacttagtgaaagtatcttgtttc

SEQ ID NO: 8006 - DNA, 380 bp, Zea mays
  Clone ID: LIB3279-174-P1-K6-H5
ccccacctacttgcggattcgccagccagctagggtttcggcccggcgtgcttatccgcccccgccggccatgtcgaacaaggagggaaggccaagccctgaaggcgcccaaggccgcaagaaggagtctacgagacggatcttgtatatctgcagaagaagaaagatgaggaaaaagcactgaaggagcttaaggccaaggcacagaaaggcgcgattgggggctcgggtctgaagaaaaggggaaagaaatgagactggtcacccgtctccaatacctaaaggatgataaggcaaccggctaaatggggtgcgcttaactaagggggaatggaacaggggaacctcttggggtctgtgttccctgatgtttacaagtg

SEQ ID NO: 8007 - DNA, 236 bp, Zea mays
  unsure (1)..(236): unsure at all n locations; Clone ID: LIB3279-174-P1-K6-H6
aacctttcccgncgcctacagatacgtgcctccggcggaaaatcggtatcgagctcgctttgttcgaatcttctgtatagccagcaaggaggcctctccatctcctccgggaaggctgtgcaccattggagaagtttaacagcaagactcacatagcacccttgagagataccccgtttgctctccaaggagctcttggtagatcaagctactacctctgagcaagccaggggcta

SEQ ID NO: 8008 - DNA, 343 bp, Zea mays
  Clone ID: LIB3279-174-P1-K6-H8
cggacttgtgggcttttcctatcgatgaaggagctgagtgagctgggggctaggaagttcgtcgtgtccgacgtcgggccgctcggctgtataccctacgtccatgctctggagttcatgcccgcggggcagtgctcggcgtcggcgaatcgagtcaccgaaggctacaacaggaggcgtgaggaggatggtggagaagatgaaccgggagatgggtccggagagcaaattcttgtacacggacacgtacaggatcgttatggcgatcattcagaaccaccgacaatatgagtttagacgacacgctggacccgtgctgcggcggcagataccctttgcctcc

SEQ ID NO: 8009 - DNA, 589 bp, Zea mays
  Clone ID: LIB3279-174-P1-N6-A1
acaaacaaggaaattatattatagcacaaacaaattttcttcaaaagaaaagatcgatgttccaagctgtgtatttgagaatgcatctgcatgaactgtttgaattattgttaccggttcgaattgaagcatgtggcactgagacaagttatatactgtatacacaaaacgtggaacgaggccactcgaatgcatatcctactgcacgggattagaaacttaatcgatttccatgcccatgcttgcccttcagtatagttgtgcatcttacactttggaaaaatgaaactaaactatacaccaacatgttcccttattcatttgtcacccgctgggaaaatacggtcttgaggtatatgtgtaactataagacagtaacctacgtgaccatggaagacaatgcgcatcatgtccatggattataattttgcaacgatctgaccgtatgatggatcaatacacacaacgaccttgccaacactcttgccagaatgaagatattcgaccgcatctacgactgaagcaacacccaagaattgcttggggtctagggaaacctttagctttccagaggcatacaggtcaaaaa

SEQ ID NO: 8010 - DNA, 540 bp, Zea mays
  Clone ID: LIB3279-174-P1-N6-A10
atagacgcggtaccgcgcgaactcccatagatctgagcgagccaccctgcgaatcttcacctgacgcaccaaatctggtcagaaacggtgaagagttcggacacgatcttaagcgtcgttgatttaagaccacacacaaacacatctgtttgcccttcccccctatttttttccttttcggacgattcataagaacagacctgcaaggtttgcagatctacctgttcaagaaccagggaccttgttttggacgcccagaacgaacccttgaccctgcggatctgctcgatccgttttggatctgcttgcttttttctggatctagagagaatgttcaagtcgatggtttatttcgtgaacatctcaatcggggaggttgaggtgtggcccaagggccaggcgagcgcaggcctggccgtggcggcgtgggcgcgagatatccgcgttgaccgcctttccccgcccagcgagcggtgccctccgctggccgtcatgcacaccgtggccgtcgccggccgatgccttgtcatggagtccagg

SEQ ID NO: 8011 - DNA, 587 bp, Zea mays
  Clone ID: LIB3279-174-P1-N6-A11
gcaagagcgaccatatatcatacaaggcttgcatataaacaggttgcatgcagtaccttacaacagagtgtgactcatacgattacaacaggtcatggaaataatctatgctatccgaggctgtataacaactcatatcacacctatcgaccgggttttatccatgacactatatcaatctatttcgtagtgcatgagcttttaacacatctaggtataaagattacaatactcgtccatcatgtactatgacatataagactacaagtattattgttaacggcaccacaggtctatccttactctcatatgatactcttatgtaagctgtgccgctctatatcattgttccttatagccgtacatgactgaagcgcgcaaacaataaagccaataccctaacctacaagttcacatacacttgtccaaacagaggtgaaatccactatacgatcggtacacactgagatggatatacaggtgatcatgatcttaatatagtgaggaccttccttaggataatgtcacacgcataaaccataccctgtctgagaaaccacaattccagaccggaacattaaagccta

SEQ ID NO: 8012 - DNA, 595 bp, Zea mays
  Clone ID: LIB3279-174-P1-N6-A12
gtcacatcaaaaccgacatgtaacacatactcaggtgatccaacagcataatccagcacagttcagtccatcggttgctacaggtgcataatgacaaatacgatgatcacagatcagcgacgctcttatttcacgatgtctccgaatgttcaggctcgtctgctggggacggcaggagacggacctctcaggcacccccaagtccggcgatcgttttcagccctggagtccaatgatcccacaagcaacacggccaccggcgtttccagtgctcttgctgagctcgtgcccaccctttccaagatcatcaggatcagcgtgaacaacaacagctctgccaatgattgagtttggcccagtcagtgggatctggctgtcggtgacattgatattagcaacaccatctgctccagctgtcacgtttccaagatcaccagcatggcggttctcatcttctggtgccccatgctccttgctcgcaggattgtagtgtggtccagttgacatgcatccattggtggtgtcaccaagtgcatgtacatggaacccatggaggccaggcttgaggccagagacactttcggtgacagcggta

SEQ ID NO: 8013 - DNA, 557 bp, Zea mays
  Clone ID: LIB3279-174-P1-N6-A2
agtaactaaattcacctttatttaacaaaccaggtagtctgataagtgataactcttatctctctttgtaaatacgttgcacctctaacctgtaaacagcaatcggaaccagacctcttctttctctagagatatttacatccatctctgacgaattgccgagggtgcgtgtaacctccaggggtcttggaaatatgtgaccactatcacgaggtaatgaggtagtgatgccaacctaatctccatccaatgctccagaaagatcaacattgggcacaaatcaaatcttgcccaaagttgtcggagagctacctacatgccgggttatgttacttcactatttctgtgaatcaaatcagccgagctctcttttcagctgagacttcgactgacagatctgagattgcacttcatggtagcatttgaccattggacatttcgttaccatacttcacaggatcaacagctaacaaagaagaatgcgctgcagaatccaagacttctccacgacttcaatacctgttttttatgggagtatcttgaagagttaacaattt

SEQ ID NO: 8014 - DNA, 513 bp, Zea mays
  Clone ID: LIB3279-174-P1-N6-A3
ctcaaaatagctgtggcctgtagcttctttcattgtttcaaagcattacaacataagcagcaaaaccagaaacagtcctcataagcaccacttattagggcagtacaacacaaacgataagcgcggtgcagatcaagaaagaaccacaacatgtagaagccatataaaagcatgattaagcacagcagaccaccaaaagcttcttactgaaaaaaaggccgccttaggcagaaggtttctccgacttgagtggcttcaccacctcccaggtgaagtcagggtcgtcccttccaaagtggccgtaggccgccgtcttgaggtagcgcccgttgccgcctttcttgaggtcaaggttgatgatgatcatgccaggcctgaaatcgaagttctccttgacaatcttgaggatctccttgtcggggatcgcgccggtgccgtacgtgtcgacgaacacggagagaggctcgggcacgccgatggcgtaagacacctggacgatggcgcggcgagcaa

SEQ ID NO: 8015 - DNA, 545 bp, Zea mays
  Clone ID: LIB3279-174-P1-N6-A4
aaggaaacatggcccaccatatatttcgtaaaacactttgatgttccaaaagataagcagcatcgtgagctctgcagtaacactagtcaaattttacgtaacttgcgtggttctcttcctgcgacggaagcaaacactgcccgagacatagacagcgggacgtcgagatggccgacggggaggacgccgccgccgcgcgccgccgggccgccatcacagactaccgcaagaagctgctcaactgcagggagctagagtcgcgcgtcggcaccggtgagtcgtcccgctcccctccccttctgccctcacccactttgctcggctccagtctccctagggttcggagggcccgattcccgtgtctcactagggggatcatggctgtatgtgcgggatctagctggaggtttggatgccgagtagtttttgtgtagattcactggccatgccgcggcgtactcggtgatttcaaggctttactagggagggtgatgatttccttcgcggctccttcggtactagaccgtgaccagtggcgttgggcg

SEQ ID NO: 8016 - DNA, 615 bp, Zea mays
  Clone ID: LIB3279-174-P1-N6-A5
aggcatgaacattatttttggaaaggtgttattacaaccgacaacgagcactttcttgccttggaaggcctcccttccctattgtagtcactcgagtgcataacttgcccttaaagctatcgattcactaagtgccagacaaaataggctatacattctctctagtggcaacaattagccattttggttggtgtggtactctattattgagtttttggcacggtacttccttgtagagtagaagacaaactcttcaccattgtagtcgttgatggggctagtggtgatgaaatccttggtgtggatgcaccggggaatcactattgtactcggcggcaatgacattaagactgaagaatgggcggatgtcgaattgaagcttagccctagagataaagttaacctacgagcataccaacaatttaaaattaagtagaaagtaaatatgaatactaataacatcacgaatttgctcaacaatggtcgtagaaggacgagcaacaaaacccatcactttcatgcaaagcttccccatctttttcctacttctataatctttttcaaaaactctctaacgtctttttagttttctttggaatttcccggacgcgtggg

SEQ ID NO: 8017 - DNA, 515 bp, Zea mays
  Clone ID: LIB3279-174-P1-N6-A6
ctcgttccaacacattctcattgcattgcaagcatcaccgaagcaacagaatgatggcaaatcatgccttatacagcaacaaaggagacgtccatagttgcagaacacaaatttcacggcaaaaatattggccggatcagaagagaagcctcggaagaatacagggtgtgtagacaccgaaccacgcactggttaacaattaagtgtgcctataacagtccctctcatgacgtgcctcagttttgcactagttgaagtcaggcttctccgggtaagtacagcccgggcgctggatgataacgtttgcggcatagcaacctgccctcacgcagtcttcaatgcccttgcctagaaccaactgtgagaggaagcctccaacgaaagcatcacctgcgccgttggtgtcaacaagcttctccttgggcaataggatcacagggaacgttttcaccttcccatcctcagcaacaaccactggatcagcaccttgagtaatcacagcaatccttttttgc

SEQ ID NO: 8018 - DNA, 456 bp, Zea mays
  Clone ID: LIB3279-174-P1-N6-A7
aagcaaaagttttaccaaacagttagcttctgcagcagcttatcagttcagctgcttttcaaaatacactaaaagcagtcaacaagcagaagctttttttcaccagcttatcagataagctgttttttcaataagcagcagttgggccaatcagggccatactaaagaaccaaacaggccctaaacaagggcctagtcacatcattctcaacaagttccgcagtcagtacagccattgcagttttaacggaccagcgattacacacgtttgcgatagtactcagaagtcagaacaatggagtacaatctcgcttcttagaccatttacactgccgcaccaggatcgctgataacacccagaaaatcatcctttattgggccaatgcaaaaaatttctgtagcatcgacacgagtaccaataattttcagccgcacctcactctctttttgaatttt

SEQ ID NO: 8019 - DNA, 617 bp, Zea mays
  Clone ID: LIB3279-174-P1-N6-A8
gcttatcaaatgtctagcgaccgacaaaatcagctccaaatctaaatttacagtgtaaaggatgagctgggcgtaattctactacaaaagctgaacaatcagagtggtgatcctaactgtttctttggttaggaccaatcagaagtacctacggctaaatctagagagagaaaaattagcgtcaagattttacaacaggcaaaaaataagctaatgaaggaattttgtgtacacattggcaggtttacatggcatctgcatctccagccatgtggccgtccatggtcatatcatccgcatatcttcctccatgttggttcctccatccacggttatactccaaagatcgcacacgatcatcatcagacgcctcagcaagccttgcaatcgcatcaattaatgattgttcgtgctcctttagcgctttcttagccctctccatctcaagggggtcagggttggctgaactgaaaacccgctccacctcctttatgagtgtctctgtatggagaatttctatgtagtcaacactcttcttcccaataccgttttgtgatggataatctttcttgaatgagttcttttggggacctctgtctcttccggtacctgacatg

SEQ ID NO: 8020 - DNA, 572 bp, Zea mays
  Clone ID: LIB3279-174-P1-N6-A9
aacaaaacacttgtgcagctttattcatgaccatatttcgttcgtggagacaattattcacgatgtcaggtttacagacatgtcttgtgagcttttcaggtctcagaaggaaagcaaccaatccgcaccggaccaacaaacttggaaataaattatactagccgcggcagaaaagctctctattagccaaaactcttgataggaggaaatgctgccgcctcgtgtatagaaaatcagaatacacaaggtgtcagcctaagtgatgccggaacagcgaggccatctcaatggcagtaagagcagcttcagctcctttgtttccagccttgccaccagcacggttcagtgcctgatccatgtcttcacaggttagaacaccaaatacacaaggaacaccagcagataatccagcattgagtacacctgatgcagctgagtttgcaacggcatcatagtgggttgtgtcacctctaatcacagctccaatgcacagaattgcatcaaattttccagatttcccaagcttttgtgccgttataggaacttcaaagctttcaggaacactaacaact

SEQ ID NO: 8021 - DNA, 425 bp, Zea mays
  Clone ID: LIB3279-174-P1-N6-B1
aaaaaaataaaagaaccttttttttttgaaaaaaaaaaccctgggtttaaaaagttcaggggcgggggggaaatcccaagttaaccgggggaacaaaatttattttaccagtttttccggggggaatacagggaaaccccttgccacgtccaaaaagagggagcttttaattccgtttttttgccctaaaaacggggggggaaatccttaagggcccccggtttttttgaaaaggggttgatcccacccttccgttttgctttagcagttgggacaagtttttcaccaattaacttatgcaaaaccttttttggaaaaagggattttacaaattcctgcaggttctgggggagccttttaagttttgaagagggaccaaaagggtttgattcaattggctcaggcaactaaaggggtttttttag

SEQ ID NO: 8022 - DNA, 245 bp, Zea mays
  Clone ID: LIB3279-174-P1-N6-B10
aaaaaaaaattaggggtgggtggggaaaaagaaaaaaaaaacctttgttttttaaaaaaaaaaattttttttgtttgttttcaaaacctttttttttttttaaatttaaaaaaaaaccaaatttttacaaaaaaaagggttttgaagggcttttttgaaaaaaaagaaatttttcccaattttttaatttaagggggaaaatttttttttaaaaaaagtttttgggggggaaaaaaccccattcc

SEQ ID NO: 8023 - DNA, 269 bp, Zea mays
  unsure (1)..(269): unsure at all n locations; Clone ID: LIB3279-174-P1-N6-B11
atcttaagagctattgtattacgagctgaacttacagtccaacacagtagttcagtacagaacatagataatccagatttaaaacatcggtgccggaaacgtctcgagaggcaaggctgcctgaaaaggtacataaaagagctacggctataatacttcgacaaaatggcctcgatcagcatgctgatatacttcaccccacgcgtccgcccanggcgtnncgnccacgcgtnncgggacgcgtgggcggacgcgtgggcggacgcgtg

SEQ ID NO: 8024 - DNA, 563 bp, Zea mays
  Clone ID: LIB3279-174-P1-N6-B12
catggcataacagagaaggcctggtttccctggaaatagtcattttttgtacaaatttatgagacaaccttctcttcacctggttttcctggaggaagtcaaccaggaatgatgaatcctcctcgctacgcttcttaaggtagccatggcacacgcatgcatggtgtatatatggtacacactcttcttggcatcttggtctcccacctccagataggcagatacagcagaggtcggcaaagccatgccagaaccttacatacgctaaaggtaaagtaccagttacattccccattgctcaaatgagagaacaaacctttagggaaggcctgaaggtccgcaaacgagagccatataatgtttcagaactgactttgatcacggctacacctcttcctgctgcggagccagtgctgggagcggtggcgattggggcatctgttgctgatcttcagatttgttgttcactttgatctcgaggagacgctcaacaggctgcctgcagatgggacaccgagtggtttggtacctcaggaccttggcgcactcactgcacatgcaca

SEQ ID NO: 8025 - DNA, 464 bp, Zea mays
  Clone ID: LIB3279-174-P1-N6-B2
aaataatgcggggaactagcaccctcgatcacattatatcatacgatgccattacaggcttcaagcgctaatagcagagccctgatagttacgggtccaacaattaaaatacaaaagcgccacagcgaagaccaggaaaagaacgcaaaagaaaacacgagaagccaacacaactccacagctaatctcgcctttctagtccctccccttcgtgcagcctcctccatatctagctgcaggccacgccacttcgctcacttgtactccaggatcatgttattctctggggccaggccaacgcaggccctcaagatgttctccagcatcgccctctgctttgcaagagcgttcaccaccggtgtgccgggcggaaccagtggtgccttggtgaggtagctaaggatggtggccaccgggtggaaggagtggaacttgtccgttccctcaggttttagctggatcct

SEQ ID NO: 8026 - DNA, 556 bp, Zea mays
  unsure (1)..(556): unsure at all n locations; Clone ID: LIB3279-174-P1-N6-B3
caaggtctaacatcaaattttattctcgccgaacagttccggtgcaatgtgaggatcagctcatctgacgtgcagggtcgaagtaatccctccattctcgaatatcagtcgtccgctagttcatgtttgaactaaaacgcgacgaataaaaaaacggagggagtactttacagcagaaacaccaaaatcagtttttgttctgagagccctcgacgctcttcctcagcacagatatgatggctcctgggtccgcagcgccaaatatagagcttccagcgacgatgcaattggccccagcagatgcggccacgtctatggttgaaggacctagaccaccatcaacctctatgtcaagggaagggtacttctttctcagtgtgcgcaccttatccatcatttctggcataaatttctgaccaccaaaaccaggctcgactgtcatcacaagaaccaattctanccggatttttctgcttccaccaggggaaaaacttcctccactgggagtacctgggcctcaatgatacaccaggccgcataccctttgatttaatgc

SEQ ID NO: 8027 - DNA, 500 bp, Zea mays
  Clone ID: LIB3279-174-P1-N6-B4
ggcccggccctttttttttttttttttttttttttttttttttttttttcaagccacaaaactttcatttagccaaaaggcgaccaaccccccaaaacaaatggcagggcttggaatttggatacctagcaggggcgggtttcattggtacattaacattgaaattgggggacctggttttattacaggggggggagacccacaggtttaacttaacaaccaaacaggggggccagaagcttaaaaaagagatgggcccttgccctttttggttccaccaatctaaaaaaggttggattttttgatggggggctgggaggagggcttggaactttggcactggagctttaaaacaatttttttggggggcttggcctttttggggaaaacaggcttggtttgaccaccattttctggctggttgggggcataacggggctttccctgggcagacagggtatccttggcctttttatactggggcaccttggggagggggg

SEQ ID NO: 8028 - DNA, 397 bp, Zea mays
  Clone ID: LIB3279-174-P1-N6-B5
gggagcgacaattctaccatgtgacatgtccacagtgcatgcagacctgacacaggtgggcacatgcaatcaacaatgcataggataaactagcatccgaggcggttacaaaaccatagcacacgaccaccggggtttaccatgacacagatcaagaagccgtagtgaggagcttgaacacagttaggtataaagattacaatagcatgctgagcatgtactatgcatgtaagcaacaagatcatgtaggggaagcacaggccaacctgacctccataggaactcttatcaagcgtgccgcctaatcatgcgccttaggccgtacatgactaagcgcgcaaaccataaagccaaaaccctaacctacaactccacatgcacgtgtccaacaaaggag

SEQ ID NO: 8029 - DNA, 402 bp, Zea mays
  Clone ID: LIB3279-174-P1-N6-B6
agcagtagttgataacctaattgcagacaagtcattgttttacacagcatcattcaaatccttaactggaatcaaacaaagtgctcaacgaacagggcaccaaaaacttgcacaggaagaatccttatctctcgggcgctcaagacacagaacacgggtacgatatacctctcacatgaaaaggttgggcctggaagccttgaaagtggtccggagcttcctggtaggcggcctgaccttgcggtacacaagcgggaacttgatctcggagttgtggaactgcttggtgttgtccctcttgcacagcttgaagtggaccgtcgctgtcttgatgatctgtatgcagggggacctcacgcggtggcgggaggccatctcgttgtacatctgctccactgcgcc

SEQ ID NO: 8030 - DNA, 386 bp, Zea mays
  Clone ID: LIB3279-174-P1-N6-B7
tgataaaggaggggttttattaactcgatggaacaatctgggggcttgaacggatcatgcccagagagagaactggctggctattcagagaaccgagaaggtcgagaagagaagactacgatggacatgaactctgcatgcgccaagaactcgagaaacaagagaattgctggctacagagaaaggcggcggaattacctctaccactaccacccgcaagcagaattccgtgcaccgctccactccatcggagccaggcctgaagaagacggttgcctaggaagaggaagcagcaggctctgctctggccatggctacggctcctccttcacaattgcccctttgtgctcaccgaatgggagagagaaagagagagagagagagag

SEQ ID NO: 8031 - DNA, 537 bp, Zea mays
  Clone ID: LIB3279-174-P1-N6-B8
cgacaataaatcatattaagaatatggtaccaccaggtccagggacaaaggttgcagcatacatctcataacctgaaacgaaatggctttattcttttaactctcaaaagtaccctcccagattagaccaataggacactatctcaacaaccgacaccacatccatcctacaatcctccagtatacggtaacataagtaaactaggaataggaaaactttggtacggagctaatgacatcatgggcacaaatgtacacataaggaaggtatcgccagtggtggatgctcagggaacggaggcgaaggtcggcagcagccagccgcgctctgttgccagctccacatactctccaaacttctcctgggcatttgggatgtcgaggatcagatcatcaaggccttccttgacacgggcaaagcctttggtcatctggttgatggttatgagcccctcgccgaaacactcctgcagcaggaccaagatgctggtgccattctgcttctccatcgccatgaccagtgccttctttaccacc

SEQ ID NO: 8032 - DNA, 500 bp, Zea mays
  Clone ID: LIB3279-174-P1-N6-B9
cacccaaaactcgtttaaccatgatttccattgaccactgaattcaggcccaacaatggtttcaccgaacgcaacaaaatctccatcgctgcaagttcacggggatgatgtttagaggaaaaactgctacattgcagtggtagttcttaaatcataatcatgctcttgcaattatgtgacattcctttgggcactcatgacgaggcataatctttgaaatgctaactacgtggttctccgtcgtgtatctccccctcttcaaacagatcatcatatgcaacaggagcgcgaattctgtccgccagtggtttgcgttgagctttattgtctgatacgtgtacctccacatcatccaattgctcagggtcatccaatgtttccttttggtctcgcgcttcaatttcatcatcaattaaagcactgccctgtgaacttgcatcttcgtttctgctaatctgtggtcgtttcgtacacctaaactgctcggacgcgtgggcgga

SEQ ID NO: 8033 - DNA, 573 bp, Zea mays
  Clone ID: LIB3279-174-P1-N6-C1
tttttcaagagagcatgaaatctattcagcgatcagtagtcatatattgagatctgagatttaaaacagcacctattgagatttaaaacaggcagcgttgatgcttgggggtaagtataagtgccgaagaagcgaacacactaccaactaaacagcatcacttcagggacaacactttcaattactaactcagagcaggcactactagtctacagcatctcaaaagacagacagcttccagacgctacggagcagcaaagcccggttaggcccaacgacgatgagatttccctgctgactgcaagcacttgggcagcccagagtttcacccgtcatccatcactcatcaccctcctcgtccccgtcgttgacctcggacttggacttgtcagaatcaccagacaatgtgggtcctcctccagactgcttgttgttataggcgtccatcttctttgtgtactcaaccttcagcttctcggccttagatacgtagggagccttctcggcatcagacaaggacttccacatgtcaccaccagccttgccaatcactgagacttgtttcacattggg

SEQ ID NO: 8034 - DNA, 429 bp, Zea mays
  Clone ID: LIB3279-174-P1-N6-C10
gcacatacaatttactatgaagaaaattacagatctgcacatacaatttactatcaaggaaaatacatctgatgacaaccaccaggtttccgcagtatacatgtcttgagtgatcgcataaattgaacaggccggaaggaattaaggcaacgaaccaggagctgcctagtaaactagtaccagagaaacaacttcataccacacagcagatattacctactagcttcattagaacattgcttaactgagaagagcacacagagcaaattagaatatcgctgcaacctgctggcttgattttagctgtcttcagcttagttcagacgccttctcttattctgatgtaggtccccaccatccacatccaaagaacctaaggcaccacttcctcttctttttctcagggatcttgaagacccggcattacta

SEQ ID NO: 8035 - DNA, 608 bp, Zea mays
  Clone ID: LIB3279-174-P1-N6-C11
atcattcagaatcttgttattgaactaccataactcattcaatgggtggagcaacaggtttgatctccacttccccaggaataagcccaaacaacacaccatcatacaacttaacagactcctttaaatacaactgcttgagcttcatgaagcactgcagggtcagcagcgaatcagatccagcctggtggctgatcccaacacgctcaatcttgagcagctccccaagcttgctcagcccgccatataggccaccgccacagaacttcatgagatgcttgatgtcgtacatcaccggaaagaaggtcttggtgagtttcaggaactcatccaaggtgttgggcatttcccgtccggtgagcagcttgaggaggtagccgaagtcgtggccactgtggaaggtcacccactggacatcgtcgttcagcacgactccggacgacatcatcagctcggcgaagcgggtggaatcgaccccctcagccgcaaagaggtcgaagtcgatgccgctgcggcggagcagatcgatggagtcgctgctagaagggtcggtgtgcgggtcgaagccccggaagttaaactgccagatgcagcgcctcccacccgtg

SEQ ID NO: 8036 - DNA, 582 bp, Zea mays
  Clone ID: LIB3279-174-P1-N6-C12
gatcgacaaatccactcacgtgacagtatatattgtccggtgggatggggtggcatctgtctggttcacaactcaaatattgtgagaataaaaaattaggctgagatgtacaccatcaccagttcagaccatataaaaattcaaatgatgtataatctaatcacggttgcaactcagctgagtcagactaactgaacagtatgcaaggatgttaactgctgataccaaggaattcggtgaagcttggatactttggttcccaaccgatctcagtccgagtttttgaattctccattctcttccccaatggaccgtcaataccagtaaagcctccaaacttcatgtcaaattttccactattgttaacagcatccattatttcttgcctggaaaggggcttgttgtcacagcccagaaatattataggatgggcttcatctttagtgattgctctcccactaactgccccttcagagagcaatctttgacaattccttatctgcgaactaagctcccatgcaagctgaagattatcatgctcttttgcaaggatgacatacgcctttgctaaagtcatctgat

SEQ ID NO: 8037 - DNA, 491 bp, Zea mays
  Clone ID: LIB3279-174-P1-N6-C3
agcttattggcgcttactgtacagtagtacgatacaacagcaggagaaaacgtgtagttgtgtgaaatatttatattgtaataacgacgttctgtgctagcttgctgcgtgcagttcgctcagcttgtgccagtgccagcctcgcccttgagcaagcgcgagaaccacagcgccgatgctttcgggtgcctggacagcccgttcttgtagtccacgtaaactatgccgaacctcttggtgtagcccattgcccactcgaagttgtccaggaacgaccacgcaaagtacccgcggacatcagctccgtccttgatcgcttgcgcaactgaattgaggtaccctttgaagtaaccgaccctcgtcgtgtcgtttaggacctggtcaagcgttgcggattgatcgtcctctttatccatgccattctcagtaacataaattgctggattattgtacttttttcctattaaattagtgacttatgaagggcccca

SEQ ID NO: 8038 - DNA, 501 bp, Zea mays
  Clone ID: LIB3279-174-P1-N6-C4
aacaactcaacacaaacagtgtccaaataactgaagcagtaccaggcaagcgttacacaggagaagggtcactccaacctgacagctcaactaaaacctacacgacgacaaggactcgcagaggagcacacagaaatgtccagtttaaactaacaatgtgcattccctagtcttcactccttggaggacttgttgatcagggacttgtggatgtgcgggatgacgcctccacctgcgatggtgcccttgatgagggtgtccagctcctcgtctccgcgaatggccaactgtaggtggcgaggggtgatacgcttcaccttcagatccttgctagcgttcccggccagctccaaaacctcggcagtcaagtactccaggatggcggcagagtagacggctgcagtggcaccaacgcggccatttgcctgagtcctttgcttcagctgacggtggattcgtccaacaggaaactggaggcccgcgcgggaggaccgtgagatg

SEQ ID NO: 8039 - DNA, 566 bp, Zea mays
  Clone ID: LIB3279-174-P1-N6-C5
gtcacatcaaaaccgacatgtaacacatactcaggtgatccaacagcataatccagcacagttcagtccatcggttgctacaggtgcataatgacaaatacgatgatcacagatcagcgacgctcttatttcacgatgtctccgaatgttcaggctcgtctgctggggacggcaggagacggacctctcaggcacccccaagtccggcgatcgttttcagccctggagtccaatgatcccacaagcaacacggccaccggcgtttccagtgctcttgctgagctcgtgcccaccctttccaagatcatcaggatcagcgtgaacaacaacagctctgccaatgattgagtttggcccagtcagtgggatctggctgtcggtgacattgatattagcaacaccatctgctccagctgtcacgtttccaagatcaccagcatggcggttctcatcttctggtgccccatgctccttgctcgcaggattgtagtgtggtccagttgacatgcatccattggtggtgtcaccaagtgcatgtacatggaacccatggaggccaggcttga

SEQ ID NO: 8040 - DNA, 441 bp, Zea mays
  Clone ID: LIB3279-174-P1-N6-C6
ccaatccattacatttatcgtgattacaatcacaaatcgaccctccaatgaatccaatgcctccaaacaaatgactaaaaagctgcccgtggatccaattctttcccaacaggaagcctttattagacacctgccgaaccaattctgacaaccttcttttccgactgcctccgacccatccagccctccaaattccaactgccttcacgttggtacttggtagccattcccctctcggccatcagactcccaagttgagcgtgtgcttgaggtccccgacgtgcagcgtgtggctgccgagcgccaccttcctgttgcccagctcgtccacgacgctgaggtccttgcacacgtccaccttgaacgccaccacgcccgcctgcccgggctccagcgacaccttctcgaagcccagcaggtgcttcgccggcgcgttgtgca

SEQ ID NO: 8041 - DNA, 429 bp, Zea mays
  Clone ID: LIB3279-174-P1-N6-C7
ggaaaggtatatcctttaatcatgattcaaccgtacaagaccaatagtttgttctcgcagtaaaatcccaattttgcagcttatgaagagaaggcctgaaaattgcattgtgacgcaggctacataccaccgatcaccgatctggcaacatcataaaaccaagcacgggagagcacatccaactaagatgcgcaggtggcaattattccccagcaacaaatcagggctggctggcgaacataagcagaaatagtccacaaattcacatctttgttatcaatagaggaaaaatgaaccctgagtcataaatcactgaccagaaacttgtggaagaggagccttttgtttgctatcaatgagattatcaccactcacgtgccaccatctgacagagcaacaattggacttctccacgcaggggcagttgag

SEQ ID NO: 8042 - DNA, 483 bp, Zea mays
  Clone ID: LIB3279-174-P1-N6-C8
gacaaaatatatgtacattttgttattacataggaatacggggagctctcatgccctccatcgtttcagacaaccgtactaacgtattaagttctcaaagcaaatcacctttacatataatagaaccaagaacagaagaacttggcgatgcgttccaattcccagtcaaacatttttttagtcccacaggtgaatgttttctaccactgatgcgatgagaaactgaccacgcaaaacaacaacaaaattaactagaagacagcagagacaatagtagcactagcataccaacaacagattgcataatagcataagtggtaagacccacagaacagacccgatgttctctctctttcctccataagaataaacccagcttagtcgacctcctccatcttgctctcgccagcgtcatcctccagagggggcatgtcggtgtcagcctccggagcctcctcgtcctcgtcgatgctcaggcccagc

SEQ ID NO: 8043 - DNA, 248 bp, Zea mays
  Clone ID: LIB3279-174-P1-N6-C9
acacaaacatttgctgtattattttcgaaggcggacactatttacccagatagagatatacaaacattcgatacccacactgatatcacaacagcagcaagcagctacatatatatcagtgcactgtgaaaccgttcttcaccaaaccttacagttgcgattaaagaaaaacctaccactgtcatgggccatggccctcgcaggtacatcaaagcaaagctgcgaaaagcaagagaggcccagcagtt

SEQ ID NO: 8044 - DNA, 568 bp, Zea mays
  Clone ID: LIB3279-174-P1-N6-D1
aggcatgaacattatttttggaaaggtgttattacaaccgacaacgagcactttcttgccttggaaggcctcccttccctattgtagtcactcgagtgcataacttgcccttaaagctatcgattcactaagtgccagacaaaataggctatacattctctctagtggcaacaattagccattttggttggtgtggtactctattattgagtttttggcacggtacttccttgtagagtagaagacaaactcttcaccattgtagtcgttgatggggctagtggtgatgaaatccttggtgtggatgcaccggggaatcactattgtactcggcggcaatgacattaagactgaagaatgggcggatgtcgaattgaagcttagccctagagataaagttaacctacgagcataccaacaatttaaaattaagtagaaagtaaatatgaatactaataacatcacgaatttgctcaacaatggtcgtagaaggacgagcaacaaaacccatcactttcatgcaaagcttccccatctttttcctacttctataatccttttcaaaaac

SEQ ID NO: 8045 - DNA, 601 bp, Zea mays
  unsure (1)..(601): unsure at all n locations; Clone ID: LIB3279-174-P1-N6-D10
gaacaatcatggccaatagggggctacgaacaatttactacatagtacaaaatggaaacacacacagcagcagtatccaatggagtggaaccatagagtatatactcaaaataacccaaccattaaccaccagagaactacttattagccagctactcaatagtcgtctccctcgtcaccctcatcatcggcaccctctgcaccgacttcctcatagtccttctcaagagcagccaagtcctcacgggcttctgagaactcaccctcttccataccctcaccgacataccagtgaacgaatgcgcgcttggcgtacataaggtcaaacttgtggtcgatgcgtgagaacacctcggcaacggcggtgttgttgctgatcatgcacacggcacgctggacctttgccaggtcacctccagggacaacagagggtggctgatagttgatgccacacttgaatccagtggggcaccagtccacaaactggacagttctcttggtcttgatggttgcaactgcagcgttgacatccttaggaacaacatcaccgnggtacatcaagcagcaagccatgtactttccgtgccttgggtcacacttg

SEQ ID NO: 8046 - DNA, 367 bp, Zea mays
  unsure (1)..(367): unsure at all n locations; Clone ID: LIB3279-174-P1-N6-D11
gggggggttnnnnnnggtnnnngttttggtttttggagtggtttttttttttttttggtgggttttgggggggtttttttgggtttggggggtggggttttttttttttngtttttttttttttgtttgggggggggggtttttttttttttttttttgtgggggggggggggggttttttttttttttggggggggtttgggnnnggttgggtttttttttttttggggggggnttttgtgnnttttttttttgtttttttggggggggggggnnnnttttnnngttttttttttttttgttggtttnggggggggggggtttttttttttnngggtgggggggnnnnnnttttttgtttgggggg

SEQ ID NO: 8047 - DNA, 528 bp, Zea mays
  Clone ID: LIB3279-174-P1-N6-D12
ggaacataagtgatcaacaacaaagtgttgatgattcacaaataaacaagtccttgctgggttacatgacgcagttcctacagaagcagagcagcgccgacagagaaaccagcaacatctaactacaacacaaggcgaacatcaacacaagagaagcctacaaagggcgagcgtgcaagcctaggaggaggtgaacttggtgacggccttggtgccctcagagacggcgtgcttggcgagctcgccggggagcacgaggcgcacggaggtctggatctcgcgggaggtgatggtgggcttcttgttgtagcgcgcgagcttggcggcctcgccggccagcttctcgaagatgtcgttgatgaaggagttcatgatggacatggccttggaggagatgccgatgtccgggtgcacctgcttcagcaccttgaagatgtagatcttgtacgtctccacgctcttcttgcccttcttcttgccacgcttgccctcgccgccctccttgccggcggacttgccagcggggac

SEQ ID NO: 8048 - DNA, 615 bp, Zea mays
  unsure (1)..(615): unsure at all n locations; Clone ID: LIB3279-174-P1-N6-D2
ggcggtctccttggcgaggagctccgacaccctcgcggcgaggctcagcttcgcggccggcgacacgccgcgctccccgatgatggactccagcacggcctcgcagaggcgcttgttctcgatcgccacgccgccggccaccggcaccgacgagtccttggagaaggcgacggtgaggactccggcgggcgagtgcgtgaagaggatggaggcgcccggcgcgaaagtctctggcttgaacacctccctgaacttctccacggcgacgccctcggcgtccgtgtacaggccggcggccttccagaacgccacgcagttctccgtcactttctccgcgtactgctcgcccgtcagcgggaggatcatcgtcaccctcgtgaacttctcgaagtcgcccgtgacgacgtcgcggaagaaggcggcgtcggaggcgagctcgtcggccgtcttgccgccccacttcttggccagcgcgggcacggccgcgtnctccaggtacacgccgatggccgtgaacttgatgaagttgcctccgatctcgaggcctcgcacgcctgcgccgccgaggaagtgcgagcccgcggagcccggcgggcgggccaccggcgggaagac

SEQ ID NO: 8049 - DNA, 600 bp, Zea mays
  unsure (1)..(600): unsure at all n locations; Clone ID: LIB3279-174-P1-N6-D3
atgaatttttgccgactccaactcagcatatagaattgtttttgccgatacatagccagcattacagcatagttgatagaacaaaaaaagggggctgctcgattctccatcggcaggaccaacttacacgaaatttaacagcaaagagactaattaacatacaaatataaagataaccatcatcccacataggaagcatgttttttggatgtccgaaaataagctctaacgagcaaaccacactccgcaacctagctcgtaggcaggagttccaaaacgggcacgcaaagagaagcaactcagtacttgtagtccttgacgtggaggctctcggtgtcggcggcagcatcacccttgtaggtgccgagggtagcctcagagttggccttgcacctggcgaggaaggcagctctagccttctccaagttctccaccttgccagcccaggccttgagggtgctcgcctggagggcacggccgaaggagaaagacagggaccacggcttcttggtgctgagcttgttcatggcattgaggttgcgggtggccttctnctcgctctgtccaccagagaggaagacaacagcaggcacagcagca

SEQ ID NO: 8050 - DNA, 502 bp, Zea mays
  Clone ID: LIB3279-174-P1-N6-D4
aaaaaactacttaggaacttgaatgtgttatcaattgtacatctataaaaaactcatagccactaaattagcgagatgataccttcgatacctaccctgaaggccttgcccatctttccatcaggctattccctactctaatgacttcttcccacaaacacgggaccaaaggaaaagaaaaaaacaagaaattaaacacttcgtggtacatatgctgtatttgagaaaccattagctacttttggtggtagtggtggcttcttgtagtttgctaagctacagtgggggcagatgtattccaaaccgtctgtcttagcgtaatccttgaaagtgcctagcccttgtcgtctgtcgcaaccaaagtgagcccattcgccacataaaccgcagttcacccaatctccaggtgcgctactgtgacaaagcaagcagcattcgccatccacatcatcatgtgctaactcatattccaacaagtatggctcgtaatgcctttttaatg

SEQ ID NO: 8051 - DNA, 538 bp, Zea mays
  Clone ID: LIB3279-174-P1-N6-D5
cccaacaacaacaaatactgcaagtttctgaaagctcccccaaagcgtcgtgcatgagatgggacctgaaaattggaaccacgatttacagtcagcccctgtcactgcattaacaatagcacaagacaagatacgagggatcaagccgagagagccacaactatacagatacagcctgcctgtatacacgcttcctaccaaaatcttatgtacccagctttgctctaagaatgaagcaattgcccaaccgaaacggacaccaatgcgctcgcgccatcaccctaaggcaaagaaggaaaatcttgtacaaaaagaaaatcattgctataggagctgctggctgctacagatgaaataacagtcgctggcctctagcgctggaatagatggccgtgccacaccgaatggctcgctaactatgaggttttccccctgacagtataaattccctgtcctcccttttctggccgctcctctcgtatggaggcctttaccgtgcggccaggccagttagaaatctcaattgtaaattttgacc

SEQ ID NO: 8052 - DNA, 508 bp, Zea mays
  Clone ID: LIB3279-174-P1-N6-D6
gttcaagctttaacgtccttccatttcttttcaaacgatcaaatcaactggcgtacgtcccagagttgcatagcccaaaaaccttagccgtattcacatctgaatcaacgatcttagggaaccaagaaaggagctattgtcattcccaaacacatcgagctctcaaagacatgctgactaactgcgtgctaaacctaggaaacaagacggtagcgaatgcctcttctccagtgggcagcttcagttgtcatcgtcatcgacggtggaagccttggacgagccagccttcttggggaggaggtgctggtggatgttgggcataacgccgccgctcgcgatggtggcaccaccaagcagcttggtcagctcctcgtcgttgcgcacggcgagctggatgtgacgcggcacgatgcgggtcttcttgttatccctcgctgcgttcccagcaagctccaggacctcagcggcgaggtactcgaggacagcggcgaggtagacaggggcgccg

SEQ ID NO: 8053 - DNA, 500 bp, Zea mays
  unsure (1)..(500): unsure at all n locations; Clone ID: LIB3279-174-P1-N6-D7
gtatctaagttcacattccattaccatgtgcatatatcatgagcaagaaaaaaaataaggtccagatcgaaccatccaagatttattccatcaccatccatccgaattccgaaaccatagttcaactacggagacaagattaaccaaccaaaaaaagcagtgttcccctcggccacagtccattctcttattagatcgactcacttcgtccaggcaagtgatcgatctatgggtcgacaccaagcagaaaaaacgccagaccagccatcacgttactatactgagatgcaacagaactacgatgacctagtggcactagctaccactggtgatgatactactactactgccaaagggggatcttgaaaacgagttgcactacgacttctgctgctgctacgggctctatccaggcaccggcgatggttggcggccggccgggccggcgccgngaggctcattcgaggatggtgataacggcgatgaccaagatgacaatc

SEQ ID NO: 8054 - DNA, 557 bp, Zea mays
  Clone ID: LIB3279-174-P1-N6-D8
atgatacggaaaacaatatgtagtagttaaaataaagcatcacagaagtaccagaaaaacatcagccttctctgagaactgagagtcgcttggtgcagttctagatgtccatagtaccttagcccttaaactgccactctctacggcacatggggcaaaggggtgtggatgtttgagaattgacccacttcagtatgcagtgaagatgataagcatggttgcagacaccccaaatgagtgggcaatcatcaccagggaacttacagtcaggacagcagccatcaaaagccatcctgcatatgccacatgtctcatcctgtgcatcccacgtccaagaagccactgcatgccactgaagaatcttgaccttcatagtgctaccttgttggttgctgcctccacctctcgattcagccagtctgccactgacgctcgcttgctttgctgctcctgctgtgctcggagcttcggatggggcggagtgcggaggcgcggactgcggttcgcctgccccggtgccgccctcgcaccctgggggcctggactcgggtggcacg

SEQ ID NO: 8055 - DNA, 595 bp, Zea mays
  Clone ID: LIB3279-174-P1-N6-E1
gcaaacatatatcttagattcgagaattgagtcttgatatcacattaggtactcggggaacatagtgtggcgccatagctagatgcaataaaccttaaagtcctctgaactcgaaaatcctaacccaaaagagcaaatagagcgcagtcttctcaaccatcaaacatgacaccattgaaaccaaagatgacactgctcacgcttcaacagcgacccttccagccacttggtccagatcacgccttccctggttggtgatgaggcgtccacccttgggatcgacatcgatgatgcccataatctgcagctgctgcaggatgttgcgtgcaacagcaccactgctcttgcagaagtgtggtgggcgggagccattcctctggcggccaccgtagatcttctgaaagccacccacaccgatgccttgccttaggtagatcttccttgcaatggatgcagccctgatgtagtaccagtcaggatcataaggaggaagctccttgaacctcgcagtcttcacaatgtcaacccactcagggagctccatcttgccggagcgcttgaggtgggcggagtaggccttgacgaactcgtgcgg

SEQ ID NO: 8056 - DNA, 496 bp, Zea mays
  Clone ID: LIB3279-174-P1-N6-E10
tttttgcaagaacaagtccattgataaatttcagaaatgagcaaacacagtccattgcactgaagccaagacatctagaacattactcctacaggataaggaagccacgaaacgaaagccaccatctacttctagtaacactacaacgacgagcagcacgacgggcgctcaagccctctcgcccctgatgcgccgcgcgagctggatgtccttgggcatgatagtgacgcgcttggcgtggatggcgcaaaggttggtgtcctcgaagagacccaccaggtacgcctcggcggcctcctgcagcgccgcgacggcggaggactggaacctcagatcagtcttgaagtcctgcgcgatctcgcggacgaggcgctggaaggggagcttgcggatgagcagctcagtgctcttctggtacttgcggatctcgcggagcgcgacggtgccggggcggaagcggtggggcttcttcacgccgccggtggccggggccgac

SEQ ID NO: 8057 - DNA, 608 bp, Zea mays
  Clone ID: LIB3279-174-P1-N6-E11
cagcaagcattgcactccgattatctttttattctttccttaccgaggtcaaaaccccagaagcagctagaaagtcggcaagtcacgcacccaaacaggaaaccaaggcatacggttgctagctactgtcttacacacctcaacaggtacctcctatagctatccccagcatgtaacttgtgccaagaacacccaccaccaccaccaccaggtcaccacactaagcatcaacaaaacaaggcgtcgactgtctctttctcttccgagtcaccacagctattcctaccctcctttgtgtttggctccggctactcagaaagccagtggcggcagtggcaggctgctgttgagccccgatcgcatcctcctcttcctcagcctctctgcgatgataaaggcgagctccagggactgggaggcattcagccttgggtcgcagtgggtgtggtagcggtcgctcagatcgtcgaaggtcacggtccgtgatccaccgatgcactcggtcacgttctgcccagtcatttcaaggtggacgcccccagggtggcttccttcttggtcatgcacatcgaagaaggcacgcacttcagccagaatggagtcaaatg

SEQ ID NO: 8058 - DNA, 593 bp, Zea mays
  Clone ID: LIB3279-174-P1-N6-E12
gtagaaagatcagcacaattctttaattcaattacacgcagatcatcatcatccatcgctagcagtatcacataaactgagccacgcctaccgccgacgcccacatgaccattacaaggatcctaagacgaggtgaacttcgtaacggccttagtgccctcggagacggcgtgcttggcgagctcgccggggaggacgaggcgcaccgaggtctggatctcgcgggaggtgatggtgggcttcttgttgtagcgcgccagcttggcggactcggccgcgagcttctcgaagatgtcgttgatgaaggagttcatgatggacatggccttggacgagatgccgatgtcggggtgcacctgcttcagcaccttgaagatgtagatcttgtaggtctccacggacttcttcgccttctttttccccttcttgccctcgccgccctccttggacttgcccgccgggaggcgcttctcggccttgggcttcttccccgccggagccttctccaccttctttgtcgcgggctcctcctccgcgggcttcttggccaccggcttcttctccggcttgggtgccatctgtgcggcggctgc

SEQ ID NO: 8059 - DNA, 521 bp, Zea mays
  Clone ID: LIB3279-174-P1-N6-E2
gaagaaccggctcagataattcgatcaatgcagtcaccgattttaaagtgaaagaccaatgcagtaaccaatattcaagtaaaagaaggctctctagtctgagagagacatattaaagtaaaataacaggtactctagtctgagagagtaagacaggcaggcaggccataacaaagattctcagcttcttcaatagaagaaacctagaaccttgcctccgacgctcttccggcgggcctcctcgtggtccatgatgcctgccgaagtcgtgaggacgatgtatccgaactgcctggacgggagcagccttgcagtccatccctcgatgtctttcacgccaatatcaaagcgagggctgatgacgccgcacttgttcagcctcccgttgagttcgaccacaatcttgcccgatcggtggtcatcaacgtactcgaactctccaatgtagccatggcgctgcatgaccgtcaggaacttgatgatgaccttggatgacggcctgatcatgacctgcctcttgc

SEQ ID NO: 8060 - DNA, 213 bp, Zea mays
  Clone ID: LIB3279-174-P1-N6-E3
ttttaaacaataaccgggtgaattactactcaagaatgacggggttatgcaaacgcagtacaggagtgtcaatcagggacacatgttctagagcttcaagataacccggaaacagtcaacgtaagccgtacaggaaattttgtaagtgcaagaataaacaaggcactgtagattgtacagagcaagctctctgcatttttcaatgccgcagca

SEQ ID NO: 8061 - DNA, 623 bp, Zea mays
  Clone ID: LIB3279-174-P1-N6-E4
gataggcatcaaaactcatactatatatagatggaggtgtacatatgtttgataaataaggtaacagtgcctgaagacaagaccggggttgatccaagacgcacatgcgccttgttccggttaacaaaattgagccggctctgcacacaatttaagaggaaccctcgactaaaaaaatgtaaaggcacaagagaaggttccaaaagaaaacgcaggcaagactcttcctctccacacaaccaccactaaaaactgatgaaaatgactccactctcccatcactacaagttactgggacctgctgtacaacatggggttaattcttacagcgaccaaaatctggaggctctccctgcgcttttcacctttctcggccttcaggttaacaagcacatagccagtaccaccctcttgcatatagcttcccgtcagggacaaaattttgcagcaacctaagtcttcggtgacccgcatcgtggaagtcaataaatacagatcgggagactttacaaaacagaaccaaaatgggaaaggggggaaagaactgaaaatgggtttgcaaaaagttatagtttgggcctttgtggtcagcaacgcagcaagctgcagttcagctactcagt

SEQ ID NO: 8062 - DNA, 426 bp, Zea mays
  unsure (1)..(426): unsure at all n locations; Clone ID: LIB3279-174-P1-N6-E5
tttttaaaattcgaaacacacaacccaaatattgaagtacacaaaccacagccttgttttgctacatcgaacgcatagcccgtctctaaacaaaataaggttaggcctacttccaccgacactctttcgagactctcgcttaccctcctctcccatgtttcgcatttgttgttgactctattggacctgcgactcacttgcccccatgcttcgccttcgagtgagcctgaagtgccgtctcactgatgaatgacttgctgcacgatttgcaagggacaccagattttggcgcagattttggagacttgaccgatttgtcattgtttacaatggtcttgccttttgctgggtgtggagttgccacatggacggcggcgcccttcttgccacctgtcttctgagatgacngtgtggcaacctttgctt

SEQ ID NO: 8063 - DNA, 278 bp, Zea mays
  Clone ID: LIB3279-174-P1-N6-E6
tctttgtttaaattttttttcctttttttcacgtgacaacacgtgtacacatgtgtttaccggagcgagaacgcaacagcgggttaggagtggctctgacaggtgataaacaataggtgagcgtgagaaagatgcgggctcataggaacaccctcaaaaggaagaatacaagagtaactcatacacataagaggggggagagcgccggggctttaaacaatggtcagaagaacgcagctctaacccggaaaagacactcccaaagggtgtgcaaaaca

SEQ ID NO: 8064 - DNA, 581 bp, Zea mays
  Clone ID: LIB3279-174-P1-N6-E7
gaccagcgaaacgggtacaatgattaagaacgagcgagagccggtcactgcactcacttgcacttgcacagcaaacaagcgccacatgtggttcgcgagtgctcatgcaagagctcacactcggcgggaattacgcgaacatgttgcgtccaggtgaactggaaggcatcgatgtgtatgtattcttgatgcaagttgtacatgcaatcaagaaatagcaactgtctagagccaaagccaaggattgaaggtttttcttgacctgcccaacgggccatggctcaggcccgtgcaggggccggggccgggacggcggcttctgctggaggcagtgacaccgagcgcagcagctccagggagctcgccaccccaaggaaatgcgacaggatggtgttcgctgaagcctgaactaggaaaacatctaaagccaagacagggctttggccagcagcctgataatagggtactgcagaggttgtgagagcttttgctaccaaagcaccaacagtagcttgcatgccgagaacagcagcgcccatcccaagaatattaaccacgatgccatttttaaggctcttaac

SEQ ID NO: 8065 - DNA, 559 bp, Zea mays
  Clone ID: LIB3279-174-P1-N6-E8
gatgcaaagacaacagactatctttcactcccctcggggaactaatggtgctgatgtgttagatattccggttttattgtcacaagatatgcaaacgacaaaaaaaggggggaaatagaacgaaaaacgaccggccctttccctatcagaatttgaatgaacagatccagctacatttttggccatatcctacaaaccctacaggtggaacatgctccaacatatatctcttgcgcctctcaaaatgtcacgacagtaactcatgcacacgcagctggtatccgcgtgcctggatcaggccacaggcatttgcatggcctctggcgtttgcgcacacaacaacaagaccgtcttccacagatgttgataaggggggtggtcgggtggatcagtagctgtttggccacatctggttagcctgagcagcaccacttaggttactatcgctaggatttcggtgttcggggcccaggcccggctgtgactgccctagagcagagccatattgtgaaggtagctggccctgccgaaggccggtctgatgactctgcccttgata

SEQ ID NO: 8066 - DNA, 290 bp, Zea mays
  Clone ID: LIB3279-174-P1-N6-E9
tttttagcttctgcagcagcttatcagttcagctgcttctcaaaatacactaaaagcagtcaacaagcagaagctatttttcaccagcttatcagataagctgttttttcaataagcagcagttgtgccaatcagggccatactaaagaaccaaacaggccctaaacaaggtcctagtcacatcattctcaacaagttccgcagtcagtacagccattgcagttttaacggaccagcgattacacacgtctgcgatagtactcagaagtcagaacaatggagtacaatct

SEQ ID NO: 8067 - DNA, 573 bp, Zea mays
  Clone ID: LIB3279-174-P1-N6-F1
acacacgtacgtacgcatcatatgcgtactgtagtttttattcaatctgcagattaatcagtacatatacgatcgagacggctagctagccagcttcttcgtcgtacaagatcgactaggtacatctgctaccacagcagagcgaagaattataatcgaatgaacggccagctagctagtagctccacactccgtgcattacatactactacgtacacgttctgctagctagccggccgagatcgatccggaacgacgacgacgacgtacggtgtatatacagctaagcttcacttccacttggcttatttttattggtcggtcgtcttctccgagatgatagatagatattatcaagtgtctctgtacgttttactttgtcatggactcatggcagcgcgttcttcatgcccctggcatactcctccagcctcctcaggccttgcttgggagaagccgcttcgcccagctgcctcaccatggcgctgccgatgatcaccccgtcagcgccccactgcgcaatctgcttcacgtgctcgggcttggatatgccgaagccaacagcaacgggct

SEQ ID NO: 8068 - DNA, 559 bp, Zea mays
  Clone ID: LIB3279-174-P1-N6-F10
tttttaaaattcgaaacacacaacccaaatattgaagtacacaaaccacagccttgttttgctacatcgaacgcatagcccgtctctaaacaaaataaggttaggcctacttccaccgacactctttcgagactctcgcttaccctcctctcccatgtttcgcatttgttgttgactctattggacctgcgactcacttgcccccatgcttcgccttcgagtgagcctgaagtgccgtctcactgatgaatgacttgctgcacgatttgcaagggacaccagattttggcgcagattttggagacttgaccgatttgtcattgtttacaatggtcttgccttttgctgggtgtggagttgccacatggacggcggcgcccttcttgccacctgtcttctgagatgacggtgtggcaacctttgctttcttatcagatagaggagttttcagcacggaactttcagcagctctcttcttgcctacctcaggcttcttaggagttggagtgtcttcctcctcatcggcactggtatcatcttcatcacttgaatcatcatc

SEQ ID NO: 8069 - DNA, 438 bp, Zea mays
  Clone ID: LIB3279-174-P1-N6-F11
aaaaaaagggggggtttttttttaaaagggtttttttgaaaaaaacctgggaccaatttttttttactcccaaaatttttttttttaaaaaaattttttttttttggggtctttttgaactcccgaaatttttggacaggtactttttgggtttaaattttttttttttggagatttttaaaaaacttgggggcaaaaagaataaagttttttccttggggaaattttttttcccttaaaatttcaaaaaaaaaatggccctgaaagttatattttaaatcgggggggttctaaaggggggccttttaaaaatttttttgggtgccagaaaaaggctttttttaaagaaaaaaactggggggcttttttttttaaaaaacacccccccccgggggggggggtttttttttttggccccaaaggggttttttttttttt

SEQ ID NO: 8070 - DNA, 547 bp, Zea mays
  Clone ID: LIB3279-174-P1-N6-F12
agttggaatttgtatcttacgttcataccatgtagagccaaaaggtgatggttcataccatataattaccgacacgggaagctaccctactgcttggcaaaagccaaactgaacgcgacacacaagcgcggtccatcgccagcgtgtatgtacctcctcatcgaaagggcaggctagcattgcctcttttattaaccccaagcccaggccagatcacaaactagacagcgaaatctagttctccatgcggatgatgcagcggatgccctcccccttggccatcaggtcgaacgccttgttgatctcggcgaacgggacgctgtgcgtgatgaacttctccacctccagctcctttttcatgtacagctccaccacatttggcagatcagtgcgtggcttatagttgccaaagaaggtccccttcagggtcctttcgttcaggaagttcatcgggtgggtcttgaactcagcgtccttatgtggcacacccaccagcacagcaacaccccagccattatgaacacattcgaaagcttggatcatagca

SEQ ID NO: 8071 - DNA, 340 bp, Zea mays
  Clone ID: LIB3279-174-P1-N6-F2
ctggccacaacatgctcgcttagatacacgcaggtacatgcacatatggctctatgacagtgaagtagctgtacgtgagggacacttgacagcaatatgtgctactaagctatatatcacatagatactacaaaccaactgattagtagacgaaccttgatgatatctaataatcagctcgcagtggagccagatacgtcttgctaatcaggagcaggatgatctgtatacaaaatgaaaggttaagtacaggtatacgatactgtgctactatataagggtaacactttcttcagaaaagatagtgatcagatgtggtcattaagcacgaactaagcag

SEQ ID NO: 8072 - DNA, 625 bp, Zea mays
  Clone ID: LIB3279-174-P1-N6-F3
gacgatcggagcagacataatcagtaaattatccggggcaaaccaccacccgcagtcaacaagagcgctggaccatataaactagatatcacactccagttgtagtttgacccatatgccatcacaggcaaaccgctcaagagttcagatgcttcaaccacactacgactgagagatacttactacacacgcggcaaccacagggggcaccatgttttcgcaacatctacagactgtccaggcattatttcatggataagcaagcaggagcatgtacgagactgctccaagcttagctggggcctaaggaaagcgcttagccgctgaagcccccttacgagctggaggcctcgaaggtatctggcttatgcttctccatcaggcccgtcagggctgcgtcaaactccttctccagctccagctccagatccatgtattctttcttgagcttcaacttcttgtcctcgtggactttgatcagctcatctcgctcaacttcaaactctgccacatccttgacttggcaatcaatgaacttctgcacatattccttccttagctgacgatctttcataggtccagaatcaacatcaaagcgtctggcctttgagcgctcttcctgcac

SEQ ID NO: 8073 - DNA, 492 bp, Zea mays
  Clone ID: LIB3279-174-P1-N6-F4
catgagcaaaattgcactcagatcactttattcagcactaatgttcgtctctgtacaatgatccgtgacacggaagcccaaagggacatacatatacaagccattttcatcgacgagacaacgaccgcagtttatgcttgctatttgtaacagctaacataacagaaattgggatttttcatcctatatctaacttcccaagaatgatggcctgcaccatgtggagcgaagctaacttcagcgacaggttcactggatgatacatctgtcgcctcaaactaattctgctcaagtttgtcatgaaaggtctttgaaattattggcctcacgtcctctgaatccacgaggctctccaagaacgggagcaactcgatcagttcctgatctgaggggtcatcaaaccagctcttaatcggtatgccgttatccacttgcaactggaaaacctgtggagtattgtcaactattgcaacttttgccaagtcgatcccc

SEQ ID NO: 8074 - DNA, 470 bp, Zea mays
  Clone ID: LIB3279-174-P1-N6-F5
acataagttcacaaattcacataagtccaaatacataagttcacaaattcacataagttcacatttttagttcacaagttcaaacaaacaagttcaaacattagctccatcgctctcgatcaggacatcagaatgttgttcgtagctccaccactagaattgagacatctgtccgcaaagtcatcgtgagggggaggagtcacttgatgagagccggaatcctcttggatcaactgattgcaggaataagaatgatagacttaatcaaatacatcagaatgtattctcaattcccatagcatacatggggttaccagggtggggtctgtctgcaatgataaagtaaacacaagaaatatcattaggacaaagaaatttttgttattgtttcaacaaaacaccacaatcaagaatcatctcctgcttcagccaacatatttaactcattgatatcataacggaaaaggaaa

SEQ ID NO: 8075 - DNA, 508 bp, Zea mays
  Clone ID: LIB3279-174-P1-N6-F6
gaggaacattctagtattaggatacttacttagaaggaattgagtacgcaagatgtacttaaacacaacaacagtatatgaccttagaaaacgctgcccgccaccatggcatgcacgcacgtcggccggtggcagggcacagctacacaaaagaagaaagagcaacgccacacacgcacgcacacatacggatcgatcaatacaaccaaaaatcaacaacgaagagcgatcgacggcacgatctggacagacacgtgtacaggttttattttttttcacgtatttcctcccctccctcctcttctccttggcgttcttttacttgatgttgatgggcagcggcttgccgtcccactccttgaggcactcgagcatggggtccacgagcttgccctggctgatgccgacgaacaccttgttgcactcctcgccgggggacttgagcctctcgccggtcaggaacacgcagccgagctcctcgcgcacgaagcgggacagcgggaacgac

SEQ ID NO: 8076 - DNA, 493 bp, Zea mays
  Clone ID: LIB3279-174-P1-N6-F7
tttttgagtgtagatgtctcgcattaatttatgaaactagaattatccagctcccagtgcaataagcctatgacaagcagaacattttacatatacatcaagcttttacagaacttgtgatctttacctgatcatttaacgatctgtgggttatcagaagcgataaccctcagttgtttcagatggaggatggatgtgcaccaccagtttacagccctgtatacttcacccaataaccgatcactctgaaagaatgaactatctgtggctccttgatgagcccagcatgtttgctgtttaggttcccttaggttaaacgctaaatcttcaggatggaatgtggttgctggaactccaagacagcaatgttttctacatagttctttacctcagccaccattctgttgtacgattcagggtatttgcaaaggttcacaattttgattcagctcccttgctagtgcctgcaacgtcaacatgatcctttacaaat

SEQ ID NO: 8077 - DNA, 449 bp, Zea mays
  Clone ID: LIB3279-174-P1-N6-F8
aattaatcggttgattcgtacacaccgcggtagctaagctaccagtaattgggtttgcagtatgcagtagattttattggctattacagtacctcggttgcattgcattgcttacttgctttgttgacggacgaagcatgagcgaaccaaccaaccagcttgcattgccatgcagtaggatgatcgagcagcaccacccagcatggtgatggatgcgctagcccaggcggaggtcgtggaagccgtaggccatgccgtgcaggttgggctggctgggcaccacgcggaaggagtacatgtccggcggggcgccgcccagcgccgccgccgcgccgtcccaggcgacgccggcgcccgtgttgtccacgtacccgaacgccgggtcctcccgcatgcctagctcctgctgcaggttcttgtacgcctcgtgagagtgcttcacctttttc

SEQ ID NO: 8078 - DNA, 465 bp, Zea mays
  unsure (1)..(465): unsure at all n locations; Clone ID: LIB3279-174-P1-N6-G1
tttgcagcaccaagaagcaccatttttttccttaggatttaacttagaataaagcctgacgggggtaacagcacccatcgatccgcagtccatgctggttgatgcatgggtctgctggagccgaggatgaacacagcactaacaactgacacagagcgaccttcaatcaaaaacacagatgggcaacaacaaacacgagacgaacgaagataaacactctggactagggtaaacaacacggtagcgaacaggataacttggccgcgcgggccccaccgctcagttcctccagttcccgtcggagttgccgtagccgccgccacggttgccaccgccgtagccgccgccaccaccaccgtagccgccgccgccaccaccgtagccgccgccaccgncgtagccgccgccgccatcacggggcccgccaccggcgtagccgccgncttcacggccaccaccggaccc

SEQ ID NO: 8079 - DNA, 587 bp, Zea mays
  Clone ID: LIB3279-174-P1-N6-G10
gaattataagcatcaggcagacttaaaaacatggtagtcttagaacattgttctatatccttgcagagcaactagaaaaaactctcaacacagcacattcagaggatttatgcgttggcagcagcctgggcagcggcatcccgcttcctttgctcttctatgatgctcagcttgattcccttgcccttgggcaggctcacccacggcttattacccttgccgatggtgaacacgttgcccatacgggtggcgaactggtggcccagggagtcctccacgtgaatggtctcaaagctgcccttgtgcttctccctgttcttgataacacccacacggccagtgttccttccgccagtcaccatgacaacgttgccaacatcaaacttgatgaagtccacaattttgttggtctccagatcgatcttgatggtgtcgttggccttgatgagcgggtcagggtagcggatggtgcggccgtcatacgtgttcaggtacgggatgcccttctgcccaaactgaacagacctaaccttgcaaagcttgaacttagcatcctcatccctgattgggtgaaggcgggaagcggc

SEQ ID NO: 8080 - DNA, 354 bp, Zea mays
  Clone ID: LIB3279-174-P1-N6-G11
gaattacaggacactcatgatggacggcgatggcgacagagtcaccagcatccatctttattcatgctcaacatattataacagaaccccaaattcgacaagtttgacccaaccctaaactcagacgcatattttcggatgcttgcgagcacacaacactgtaacataaaacggcatggcactaatgccgtgataaacagaagaaaaatcaagacacacagttgtgcgctgagttgcgctaggcaccaccgtccattgccagtgacagagacggcatgctattttatgtagtttcattcaatataaagactcgcccgccccctcaggccacgttcggttactagtggttgaggg

SEQ ID NO: 8081 - DNA, 602 bp, Zea mays
  Clone ID: LIB3279-174-P1-N6-G12
gctttagtccgttactacctttctggtacagcactacacaccaaataggtctggagttctgatgctgcaatgcagatttatttgtcgtacttagcaaatttacatgacgaagttcgtcaatactttctgaaccaaatgctccccgtacacaaccttttcgtacttagcagcaccgccggttttctcccggcagaactcaacaggctctactgcagcatcgaagttggactcgtagaagaatgcaacagatacacggtaatgctgggaattgttgacaactctgtgaagggtgggctgatatattccatttgtccaaaccttcagcatgtcaccgatgttacaaacaaaggttccgggaatcggcgttgcatatatccactcaccagaacgattttgcacctcaagggcacatatgtcatcatcctggttaaccagtgttagaagtccataatctgtatgagctccacagccagtatcagtgcgctgctcttctggaatatctacgggataaccaatcaaccttaacacccagaaaggatctccagctgtatccccttcaaaagcatcaattgcccctcccaaagccaaggctatacctcgca

SEQ ID NO: 8082 - DNA, 594 bp, Zea mays
  unsure (1)..(594): unsure at all n locations; Clone ID: LIB3279-174-P1-N6-G2
aacaaaaagctgtcatgtaaaaataatcaaacttctttacaagactatggaatcccttgctctgaatcatgtcgctaataaggcagcacagccccatcttatacgtgagtgtgtacgaacagcagcaacatcgattcgcccaaaaacttgggggtttgcatcatcttccttttgatacatacaaatcacagtgactttgcgtgtcgaatgaagatttggaattaaggtacacgacaggcttgctatgtgcatagaggagagggttgtaaacagatcttatgcattttttagagcagccagtctcttctctagttcctccaactccgaactttcatcaacctgaaccttcttcccagcaatttttcctttgggagccgaggacaactgtgatgcaatgtctacaccaatctcatccagaacctgattagcaagttcttcagtttcttcctcggcctggtcatcgtctaagacatcgtcaattgaatcagacatcatctcatttgtcatatccatttgtgctgactgcttttgggattcttgcattattntcatctgcttggtaggttccatttgcttattcaaagctcccattgc

SEQ ID NO: 8083 - DNA, 387 bp, Zea mays
  unsure (1)..(387): unsure at all n locations; Clone ID: LIB3279-174-P1-N6-G3
aaaaaaaaaaaaaaaaaactttataaaagggacagggggccccttttttaacagggaatagctaactgctttggggggcanttgagagagactgcaaagatccttagccaggagcccacgggtttattaggcttgctctaggactgaaacaatgcacggggggggatctgaataattaggggagagctcaccgggcgacattaacagaagaactgtgtttgatcgacaacagactccaaaggcactgaaacaagcactgggctggagcacccttttttttttggtgggggggccaaaattcccgccaagtttggccccccatagcaaatataggttagatgactcagctttcattttcatttacagggttcacccctccaagggaac

SEQ ID NO: 8084 - DNA, 493 bp, Zea mays
  Clone ID: LIB3279-174-P1-N6-G4
ggaaaggtgttatcacaaccgacaacgagcactttcttgccttggaaggcctcccttccctattgtagtcactcgagtgcataacttgcccttaaagctatcgattcactaagtgccagacataataggctatacattctctctagtggcaacaattagccattttggttgctgtgatactctattattgagttttttggcacggtacttccttgtagagtagaagacaaactcttcaccattgtaatcgttgatggggctggtggtgatgaaatccttggtgtggatgcaccggggaatcactattgtactcggcggcaacgacattaatactgaagaatgggcgaatgtcgaattgaagcttagccccagagataaagttaacctttttctgcagcttcctccgacatctcaaatttatatctaaacaatattgtcactaaattgtttttagcattcaacatctcgaattttaatattgtcactaactatg

SEQ ID NO: 8085 - DNA, 414 bp, Zea mays
  Clone ID: LIB3279-174-P1-N6-G5
aaaacaaaaatccggcagattagatttcagaatccagcataaataaaccattatggggttattgcaacctaattaacatataaaccggggagatggcgaacaatttggggcctcgtacataaaaaccatggccaataaccaccggggcatcaaaacccaccctttcgttttgcttcaaaaagaggggggcaatcctgaccggttcacttggagatcttagcagggagctcccgaaccagctttggggggaccatgggtgggatcccatttaccgggtcacgctggggggtgaactccaccacataaggggggacaacgtcaccctggaaattttggaggatggtgaggacattgcggaaggagaggcctccaggttcgatgtgagagaccccaggagcaaacgctggggcaagg

SEQ ID NO: 8086 - DNA, 610 bp, Zea mays
  Clone ID: LIB3279-174-P1-N6-G6
ggcatcatcaatcaggccattccaagctcgttgattagcaaactacaggcgttacatgaaaagaaaaatgtaccaacgatatcattcagacagcaatgcaacagacattgcacccaaatgtgcgttataccgtagcattccacagacattcaagtccccctatatatcgaaaccatcactctagcaaatccccaaacagaagttaaaaggtacccagctatgcctgggtagcattttttatgttgcagcaaaaaaggatacattccccgcttaagaggtcgattcagcttcctatttcccagctcggcgacagcaaaaccagagatcactcccacgctttaagggcaccacccctcccaattgccttgatgatagtctgcttactgttgcgcgcactgcactctctgggctccgcccggcatctcgtcgtcctcctcgtacgcctcctgggcagcgtgagcttgcttcctgcgcatctcttcctcgatgttgttcacatcatgcatagtcgtctcctcgcattcatctatctccatgtctgtcagcttggatgaaggccttggtggaagtactgtctcgagagctttgcactgctctggtgccagcgagt

SEQ ID NO: 8087 - DNA, 484 bp, Zea mays
  unsure (1)..(484): unsure at all n locations; Clone ID: LIB3279-174-P1-N6-G7
ctaatgtcttaaaaatatttatttggggaacagcagagtacgtagcgtaaatagtacattagtacatcaagacacctactagtagctatttaaacgatggccattatcataattcccatgccaaagccgattattttttaacccaaacaaacttactggcttgacttagctgataacaaatcagcaatgcaagccgcacggacgaccagatagttgagcgtgagcatgcatgactttattcggagctgttcaccacccggcagttccggcggacctcgccgttggtgccgacgcccggtgcaagcctccccatccgcagcatggactccgcgaagtcctggaagaatacggaggcgtcaaaggcgtaggtggcgacaaggctggcgacgtccgcctttaccccaggcacggnagccgacgacgccagtgcctggtctgacggcagcagaccgtcgccagagagcaggttgatgtantactggtt

SEQ ID NO: 8088 - DNA, 447 bp, Zea mays
  Clone ID: LIB3279-174-P1-N6-G8
ggtttagtggaccttctaactcatttactgtaattacaaagacccatttattagtaaccctctatcaaggccccactcatattttgggctagaactggatgtacacttgatcttgatcagcatccacaggccagtgacaatgttattaagtagcagtatttatcagtgtcaactactcttgtagctgcacacaagccttcacgagagttggcgcaggacaaaagatgggagtatacttatatataacagtgcctccttatattgctcagacacagaatcctgaattgtatatatagggaaactatattgatgtggagtcgtggagacggctcagctctcctctgctcgttcgagcttcctcttcctctttactttattttagtggtactcttcactcctttgcagctccagctatctctccgggcacacgtactgggtctgggctgc

SEQ ID NO: 8089 - DNA, 429 bp, Zea mays
  Clone ID: LIB3279-174-P1-N6-H1
ggaacaaaaagcacattttttgaacctatccaaatttacatcgcccaagctaataaatggaactcgggctacaggtccttaacagcaacagaagaaccattttttcaagctggcggcaacaattgtttacatatacaagggacaactgattcccgggtgatccggtcccagtttttaccacttgatccgaccacactggaagtttgcattaacttacaccgttttttttttccgatttaattgcttcgtaagacttgacaacctccttgaactttttttttgcagcatctttataattttgattttgggcaggatgcacttccatcgtttttgttctaaaagcagtcttcacttctgaatttgtatatgggggcgctcgtgatctgtcaagacctaaaactgcatagtgatgcgacataggataaaccc

SEQ ID NO: 8090 - DNA, 322 bp, Zea mays
  Clone ID: LIB3279-174-P1-N6-H10
aggggcaaaaaaatttttaaatattaaaaaaaaataatttattttaaaaaaccattcataaaaacttttttaataaaccaatggaaaaacggggcggaaataaacaaaaagttttaaaaaattaggttttgaaaaaaaaaaaggggaaaaaaacaaaaaaaaagccttaaaataaccgcataaagatacttttaatacttataaacattattaacttttttaaccttataaaaattaaaaccaacctttttttaatttttttaaaacgcttccaaattcttaagggcctaaaaaaaattgccttttttaaaaaccttaacga

SEQ ID NO: 8091 - DNA, 490 bp, Zea mays
  Clone ID: LIB3279-174-P1-N6-H11
gggtcaaaaaagaaaaattttttttttttgacttaataaaaaccccagccaaaaataaatttttaatgaaaaacccacccttttcaaatttggaaacttcaagcaccaaaagtaaataccggttttaaaaaaccctttttttttcaaaatgtttaagtaaatttgatactaccggttttaaaaaaaattttggttgaaattcctaatgctaaaaaaaaattgtgccttatttttgaaaaaaaaaccctttttaaataaaaaaaattaaattcggtgggggcaccgtttaaattatttcaacccttaaataataaccgattttgaattccagcttttaaaaaattttggaattttcccctttttcattaccgtaagcaaaagttgaacccacctttttaaaaaaaaaaaaaacatttttttttgggtataaaaaagaaaaaaaaaaccttgcattccttttttttggtgaaaaaacaaacttttttaaaaa

SEQ ID NO: 8092 - DNA, 524 bp, Zea mays
  Clone ID: LIB3279-174-P1-N6-H12
gaaacacaaagtaacttcattattgaggaactgaatagagccttattacaacagtcctcacgtagcgacttccgtaaggagtacttggctatttgcacaataccgcgcaagtgagaaccacacttcacggaacggaacggggaaacgcaaacaactagtgcgacgaccgtacgtcctcagctcagacagaactcaaatggagatgctgtttggaatgcccttggcggtgatgccggcggcgtcgcccttcgtgtcggaggtgttggggtagagcagcgtgtaggggaactcggccgggccgttgcggttcttgaggcgagggtccgcgttcatggtgacgacgcgtttctcgatctcggtcagccgcgcgccgaaccgcttgaacgcctcctgcgccttggcgtccgacgtccactccttggtgtcgcgctggccgaggtacacctcgtcggaggagtggctggacaggatctccagcagcgagatgccgacgagggcctggaactggctggtgatggtgcgca

SEQ ID NO: 8093 - DNA, 486 bp, Zea mays
  Clone ID: LIB3279-174-P1-N6-H2
agctatttaaacgatggccattatcataattcccatgccaaagccgattattttttaacccaaacaaacttactggcttgacttagctgataacaaatcagcaatgcaagccgcacggacgaccagatagttgagcgtgagcatgcatgactttattcggagctgttcaccacccggcagttccggcggacctcgccgctggtgccgacgcccggtgcaagcctccccatccgcagcatggactccgcgaagtcctggaagaatacggaggcgtcgaaggcgtaggtggcgacgaggctggcgacgtccgcctctaccccaggcacggcagccgacgacgccagtgcctggtctgacggcagcagaccgtcgccagagagcaggttgatgtagtactggttgtcgaaggtcgccggggtggcgaggtccaggtgtgccagcgcggacccagccgaccccgtgcacagctgctgcagcgactgcaag

SEQ ID NO: 8094 - DNA, 371 bp, Zea mays
  Clone ID: LIB3279-174-P1-N6-H4
gaaacaagatactttcactaagtcataaaatgtaggagccaaactgatagttgtctacagcttatctactgataagaactccttttcacagcacagtaaacaaagcaaaatgaaatactagaactatcctcttcactcgatacagtcaatagaaatatatataagcaacggataaactgctgttgagcttgtttttattgagcccattgtccgagtcccttggaaccgatctgccaaggttagttgcaccaccttttgaagcccatcttggttagactcatgccacgaaaaatctaccagttccatcttctcaatcatctttcaggttgatcagaacttgaagctccattaggaggcggtgcggacaagtt

SEQ ID NO: 8095 - DNA, 437 bp, Zea mays
  Clone ID: LIB3279-174-P1-N6-H5
aaaaaaaatatgtcatcattattatagggggaccatttgtataaaagctagcaaaggggggggggaaacatttttggataaagcaaccaactgcaacatgggggaacaaaaaaaaaaagagggcccactgttacaatcacacttagggaagcgcaacaaaaatggacgggggcctaataatcctttaggtatgggagacgggggaccagtctaatttttttccactttttttaaaacccgagccccaaatggcgccctttggggcctgggcctaaagctccttaagggctttttcctaatttttttttttcggaaaatatgcaagatccgtctggtcgaactcctttttgggggcctggggcgccttaaggggttgggccttccctccttgtttaaacagggccgggggggggggataagcacgccgggaccgaaac

SEQ ID NO: 8096 - DNA, 585 bp, Zea mays
  Clone ID: LIB3279-174-P1-N6-H6
ccttaaacagttaaactggtattttataggtttatttacttattacacaagtctgcaagcatggcaaagatattattccaacggcacctacagttgtgtcgcaaggtaaccgagacgatgaaaaacagacacagaaacggaaaatgatgtttctcatgagacgcagcaaatcgctctcagacaccaaacattaggctgaacttggtggcgagaggaacagatacgatggcaactcccaacgcgacaccgaatatacgatgcgagattgagaaagtcgcgctgaactgtggcttcttcagaggaaggtggggcgacagcgggcggtttgctacaggagatgacagggggcaactcgagtgcaggagtcgatttccagtagtagaagacatctttggtcgcagagctgctagaggggaagacgtgtagcccctggcttgctcaaggtatgagcttgaactaccaagagcaccacggagagcaaatggggtatctctcaagggtgctaactgagtcttgctgatatacttctccattgctgcacagccttcccggaggagatggagaggcctccttgctggctataca

SEQ ID NO: 8097 - DNA, 466 bp, Zea mays
  unsure (1)..(466): unsure at all n locations; Clone ID: LIB3279-174-P1-N6-H8
ccccgccaacatggaataaattgaccaatttgcacgcagtcctagtcaaccatacaaaattgaagcaaataaaagcctagcctaaaaaaccccaacagggcagacaaaactccaggagggacacaaaaccaatgaatcgttaagccggccttaaaatggggcgcgtggtggacataaatcatttgggctcgtactgggacagttcggggacattgataggccaggcggcagccgcgtcgccgtcaaggagtttgccggcaacaatgaggttggcggtttcggtcgggtggaacgcatcccaaaacacgtacttggagcggtcgctgcacagcgtcaagctggagcgattggcgacggctccaatgcaaaggaacggaggcaaagggaagctgccgccgaaacacgggtccagcgcgtngtaaaaaccatattgggggtggttctgaatgatcgccataacgatcct

SEQ ID NO: 8098 - DNA, 574 bp, Zea mays
  Clone ID: LIB3279-174-P1-N6-H9
ggcatcattattatcagaaatcatgtaatgtgactgatccaacacagtgaagtagccatctactgggtagaacagaaaccatagtactagcagaacccaatcacatgcatgatccaacataaccaaggtagatactagtagtagctagaacggacacatcaagatttgcgctagggcagtagtaagagcactgtagcagagatccaatcacttggagacttgaggctagtgactgcaaatctgtagacacgtaggtagctaggtgacgatggctaataaggagtggaagcagagaccatgccatcgatgtccgacttgacgttgctgaagacgttgtggagcagcacgaagatcaccactgataagttgctcccgaggccgtggccggcgagcgcctgaccgtcgacaccggtgaggtccaccttcctggcgaacaccgtgcctctgtcaagaggggtgccgccgcaagcgctcgacaccatcttgcgcacgatctccagcttctccatgatctgcagcgccatccaccacttggcacaccccccctcggcagtccacctcactgactcaaata

SEQ ID NO: 8099 - DNA, 516 bp, Zea mays
  unsure (1)..(516): unsure at all n locations; Clone ID: LIB3279-173-P1-K6-A10
catggcgtcctggcgggnagtcgtgacgcgtgccacagcaaggctgagtttgacgcccacatgaccaaggcccaggaagccggcaagctggtggtcattgacttcactgccgcctggtgcggtccatgccgcgccatcgccccactgttcgtcgaacacgccaagaagttcactcaggtcgtgttcctgaaggtggacgtggacgaagtgaaggaagtcaccgcggcctacgaggtcgaggcgatgccgaccttccacttcgtcaagaacggcaagacggtcgcgaccatcgtgggtgccaggaaggacgagctcctggcccagatcgagaagcatgctgcgcctgcgcctgcgtctgcgtctgcctaaaggagatcagatcagtcgtcgccgtcaataagggccagcacgtatggctgtaaatgttgtcgttatcagttctggctttgtcgtttgtgggcgattgtgaactagtagtatgtttgtttctatccgagccggaggcgatacttaacc

SEQ ID NO: 8100 - DNA, 498 bp, Zea mays
  unsure (1)..(498): unsure at all n locations; Clone ID: LIB3279-173-P1-K6-A11
gtcagaggggagatgtgatgcactgaagatgatcagtcaatgcagattaagngggccgaagaactatgttggagacagaagagcttggtgtgtcaattcttcaggaccttcaccaacagcgacagtcactactacatgctcatactactttgcacggagttgatgacaacattggcaagagcaagaagatcctggctgcaatgtcaaagaggatggataggaacaagtggatcattgggggaattatcacggctctcgttctggccatccttctcatactctacttcaagctcgctaattaagcctctgcctgcaggtaggttccccctacatatctgtgttcagtaattgtgtgatatgagttgtctgaatgccgtgtattgagcaacacgcagctctccgagcgtcatttgttccccctcaaacctgtaaactcaaaatggcttattctgtgtatagtctgttattcccaactatgtaaaatgtctaaagagtatg

SEQ ID NO: 8101 - DNA, 629 bp, Zea mays
  unsure (1)..(629): unsure at all n locations; Clone ID: LIB3279-173-P1-K6-A12
cttgctccacccattcatgccctttgtaacagnaaagctctggcagcgtcttccaagcccaaagatcttgtaggaaaggttcgattatgatttcacagtatccatctcttgttgaggaatggagtaatggcagactttgaaaatgaaatggacatcgtcttggatgctgtgaacaaaataaggtctctgaagccaccaacagattcaaatgaaagacgtcctgcttttgcactttgccgaggccaagagatcgctgccacaatccagtgctatcaatctctaatcgtgtatctttcttccatatcacatctcaagatcctgacagagaatgatgaaactccagccgattgtgcaactgctgttgtcaacaaagacttgtctgtgtaccttcagctccaaggagctttaaatgcagacgctgaacgtgaaaagctaaagaagaaaaaagatgagattcaaaagctacagaatgcactggcgcagaaaatggacgcctctggctatcgcgagaaggctccacagagcgtacaggaggaggacatgaggaagctcaccgctttgttggagcaactagaggtcatcagtgaagctgagaagaaatagacgcgaactgagtttgacctctgttt

SEQ ID NO: 8102 - DNA, 603 bp, Zea mays
  Clone ID: LIB3279-173-P1-K6-A2
gcagggaccgctagctagctcctcccatgctatcacccgggccccggccagccatctcgctgaaagaaaagcgcaccatgaagactactagctcgggcattgcagtcgtcctcctggtggcgatgctggcagtccagtccgcggtggccgacatctcgtgctccgacgtgctcaacgacctgtcgccgtgcctgcccttcctgcagggcaaggcagccaaacccagcgagagcaacaaccagtgctgcgacggcgtgaggaccctgtacgcggcggcggacaccaggcccgacaggcaggccacgtgccggtgcctcaaggcggcctacgttcaggtccacgctgtgctctccgcggcgcaggagctgcccggcgactgcggcctctcgctgtcctacaacatcacccccgacatcgactgcgacaagatcgaatgaagggatactgttcccttaccagaatccatacgacgggatggtgatgttcagtgccctgctagcagtaggctgcatctgcactgagtgactagaataaaggatttggtgatgtttgtgctgattggtgtgttcgcctgtaatcgtgtgatgccgtcgttggcttctt

SEQ ID NO: 8103 - DNA, 558 bp, Zea mays
  Clone ID: LIB3279-173-P1-K6-A3
ccccgcgtccgccccgcgtccgcccacgcgtccgttacgatgcagcctaatttatcctccaatagcaccgattggttctgatgatctctaccctggacctggtgcaggtttttaccctcacagtggcattgggagcggtggtagcatgcatgttggtcctaatgatccgcgcttctttccttctaatcccttctctgccccatttggtgggcttgggagtgttccaccaggtggtcgctatgatccaattggcccacctgacgtcccagggtttgagccatctagctttgttaggcgtccaaggcggcctccaggcgggagcacccacccagacctcgagttcttccagcaaggcccagacttctgagaatcgcgcagaggccggccagagcctcgccctaccctcacgaaataacttcaaaatgctgagccctcgagctagatatcccgctcgcttggtgtgattgcaactgctgtatcgagtatagtcctagtgcgctttggctgtaaagatggatgtgaacatcgtcctagtgtatttactcttaattccaaacc

SEQ ID NO: 8104 - DNA, 198 bp, Zea mays
  unsure (1)..(198): unsure at all n locations; Clone ID: LIB3279-173-P1-K6-A4
agcgtccgctttgctgcttgtctatgctgnggaataaatgtgacggtgcccctggncgctgggtccatgctggttttggacacgctgtctttttgtgtttaacttatctgctgccgtcctgtaaaaaaaaaaaaaaaaaaaaaaaaaaaaaaaaaaaaaaaaaaaaaaaaaaaaaaaaaaaaggggggggcgttttaa

SEQ ID NO: 8105 - DNA, 603 bp, Zea mays
  unsure (1)..(603): unsure at all n locations; Clone ID: LIB3279-173-P1-K6-A5
agcgtccgcactgtctaaacaacccacacgccaatggggccctggccctccgccttaaccctacggcggccacggnggtctcaccccacacaccacccatggactccgcctctaccacctcgcgctgctgctcggcctcgtcgcctgggcggcggctgctgccacgggagccgaggcgcagccggtgtgcgacccctccatcatcgccacccagatcgcgctcttctgcatgccggacatgcccacggcgccctgctgcgagccgatcatcgcctccgtcgacctcggcggcggcgtcccctgcctctgccgcgtcgccgcccaaccgcagctcgtcctcgcccgcctcaacgccacccacctcctcgcgctctacgcttcctgcggaggacaacacaccgtgggcgctcacctcgctgccgcctgccaaggtccgtcacctcccgccaccgttcctgttatcgccccgccgtcgcccgccgcgccccgcctcaagcagccaacacgcgaggcccctccccctccgccacaaagcgagaagccgtccccgtcgccccagcagcagcctggcgtcgccgtcgtccacggcaaggccatccccac

SEQ ID NO: 8106 - DNA, 627 bp, Zea mays
  unsure (1)..(627): unsure at all n locations; Clone ID: LIB3279-173-P1-K6-A6
gttatttttcactganaaagacaaacattgacttcttgggggagtagacttattaccaacgttggtgtcctgttatctagtttaacctgaacctgttcttgaaactgtgtcagaaagtcggtttgttctataatatattgtctgtgctatgagctacaataagcaagagtattttaaattagaaagcagttttctaaatgatgcaaaggcagattggtttgagattgcacatggaattcttttagtgaacatcttatcttagtcaagcagtagttaagattaactgttttacttattacccccaagaactctttgaaactcgactaactattctgtggtttctttcaggtagatgactgttttggccacccgcagtgggttgtccataccatgtcctgaaggaagcaaagtgcggttggcccagcttagtggggatatcagcagccctcccctgaagggcgaattccttttgctgttttaacccatgtttgttaggccttttattccagaaacctatgcaaaactctgctataagtttgccaagaaatgctaactgcagttgttatgttttcagcaatttcagggtaagaagatgttaacaagcaaagcaacctctctgcatttgca

SEQ ID NO: 8107 - DNA, 611 bp, Zea mays
  unsure (1)..(611): unsure at all n locations; Clone ID: LIB3279-173-P1-K6-A7
gtttgacaaactggnagggtcacaaaatcgttctgcctcctgccaggctggtcataagaganctttggctttgttcacttttgcagnaaaaatcaagtgcattgaaggcagttaaaggaagtgaaaaatatgaaatcgatggtcaagtactggaagtgtccatggccaaaccattggcagataagaaacctgatcattcacacaggcctggaggaggccctaattatccccttcctccctatggtggtggtggctacatgggagatccatatggtgcttatggtggcggcggtcctgcatacaaccagccaatgatatatggcagaggaccagcaccggcaggaatgaggatggtgccgatggtgcttcctgatggccgccttggctatgttctgcaacaacctggtggaatgccgcctccgcccccaccgcggaggggtagtgaccgaagagacagtggcagaggtggcgaagggcacagccagcgatatcgcccttactagcttttcccttatgggctctactcccatcatgtggtatgaagcgtttaacttatgagacaacgagataggagcctgtgttcttgtcccagtataagaattgcgatggca

SEQ ID NO: 8108 - DNA, 618 bp, Zea mays
  Clone ID: LIB3279-173-P1-K6-A8
ctcttgctgaactggctcctaacccacccatcaggctcgggcttgctctcaacttctcagtgttctactacgagatcctcaactcccctgaccgtgcttgcaaccttgcaaagcaggcctttgatgaggcaatctccgagctagacagcctgggagaggagtcctacaaggacagcggtctgatcatgcagctcctgcgtgacaacttgaccttatggacttccgacaccaacgaggacggcggggatgagatcaaggaagcagctgctgcccccaaagaatccgcccccgagggccagtaagacggatccgatctcccgacctgatgcgtgtctgctgatgtcggggagtttaccaggactgtgccgttcttgatttctgatagcttatcttctagtacacctcgtgttgttctcttcgtcacggcgccggtgcgcgtgcgctgaagctgcctgccattgccattgcctttgccgctgtttttaattaagcacacactctagatgttatgcccgcatgctatgtttcgattctcaagttgataaatgatggctggatgctggttttcgtgctccaagcctgctgcttcttccagggaaaaaaagacctgcccttgtt

SEQ ID NO: 8109 - DNA, 507 bp, Zea mays
  Clone ID: LIB3279-173-P1-K6-A9
cccgggtcgcccagcgtcgctcacggtccgctcccctcctctaggtttctgggttttcgggaggagaatggcgtctgatagggtgctcgggactggaatggttcacggaccaaggcttcgtttatcacccccgcgacgtagcgaggacctattctccacatcctcctcagaggggggggtaccgagtcttaacgacgcgatgccgcgaatacaccgtcggagcggcaacacggccggccaggccctcgtgtcaccgcgcccggcggcggcccgcttgccggcggggaacgtcccgacggcggcaacggcggtgggcgaggcggatactgcggcggcgaccgcggttacggcggcggcggtgaccgcggctacgggggaggaggcgaccgtggctacggcggcggcgaccgtggttacggtggaggtggcgaccgcggctactgcggcgaccgtggctacggtggaggcggcggctatggcggtgggtacggtggaggcggcggtgga

SEQ ID NO: 8110 - DNA, 648 bp, Zea mays
  Clone ID: LIB3279-173-P1-K6-B1
cggccggattccgggtcgcccagcgtccggcgctaaaggtaggggcgacgaaatggctccacgaccgccaccaaggcgacagtggctacggcgacgagcgccggcgcgagctgcaggcgttcgacgacacgaagctgggggtgaaaggcctggtggactccggcgtcaagtccatcccgtccatcttccaccacccgccggaagccctgagcgacataatttctccggcgccgcctctgccgccgtcgtcgccctccggcgccgccatcccggtggtggacctctcggtgacgcggcgcgaggacctagtcgagcaggtgaggcacgcggccgggacggtgggcttcttctggctggtgaaccacggcgtggcggaggagctgatgggcggcatgctccgcggggtgcgccagttcaacgagggccccgtggaggcgaagcaggcgctctactcgagggacctcgcccgcaacctgcgcttcgcctccaacttcgacctcttcaaggccgctgcggccgactggcgcgacacgctcttctgcgaggtggctccgaacccgccgccgcgggaggagctgccggagccactgaggaacgtgatgctggagtacggcgcggcggtgacgaaactggcgcggttcgtgttcg

SEQ ID NO: 8111 - DNA, 638 bp, Zea mays
  Clone ID: LIB3279-173-P1-K6-B10
cggccgcgtgggggcagctgctcaggccacctcctgccatcccatcctggttcgattaggttggcatgatgctggtacatatgacaagaacattaccgagtggcccaagtgtggtggagctaatggtagcttgagatttgaagtcgagttgaagcatggggccaatgctggtcttgtgaatgctctgaagctgatccaacctatcaaggacaagttttcaggtgttacctatgcagatctgtttcagcttgccagcgccacagccattgaggaagcaggtggccccaaaattcctatgatctatggaagggttgatgttattgcccccgaacaatgcccaccagaggggaggcttcctgctgctggcccaccttcacccgcggaacatttgcgtgaagtattctacagaatgggcctgaacgacaaggaaatcgttgcactgtcaggagctcatacacttggacgtgcaagaccagagcgtagtggctggggtaaatcagaaacaaagtacactaaagatggtcctggtgcacctgggggacaatcttggacatctcaatggctcaagtttgacaacagctatttcaaggctatcgaagaaggcgagatgaagacctcctaattctgcctactgatgc

SEQ ID NO: 8112 - DNA, 613 bp, Zea mays
  unsure (1)..(613): unsure at all n locations; Clone ID: LIB3279-173-P1-K6-B11
gcggnagttcaatgggtttgtacaggacgagggttacatatttgngactcgacctgtgggttaggccgagagccagcctccctctcgacgacgatctcaggcgctcgcggggagtcgagtcgagaccagcttcgttccttcataaaagctcacttagttgttgtccccgcctctttttttcgctgttcttgtttgattacatcatcttattttgtgcttgaatctaacctgccattaagtttttatcgcttcgttatttctctgttgtgcttgtcttgttcttttgttgctctaaccatggacgcaggctcccgctcgatctcctcggcgaagaaccgcgccgccgccgtcgccgccgcgccccggccaccgctgcaggaggcgggctcccgcccctacatgccatcgctgagctcgggaccccgcaacccgtcggccaagtgctacggcgacaggttcatcccggacaggtcggcgatggacatggacttggcgcactacttgcttactgagcccaggagggacaaggagaacgcgtcgggcatggcggcgtccccgtccaaggaggcgtaccgggagctgctcgcggagaagctgctcaacaaccggacac

SEQ ID NO: 8113 - DNA, 426 bp, Zea mays
  unsure (1)..(426): unsure at all n locations; Clone ID: LIB3279-173-P1-K6-B12
ttcttccgctcgccctcgcctccattttgtgccacancccgtagcgacgtgccccggcccccggtcctgattcccacaaatttccgccatggcgatccgcccggactgatgcccngttctccatctgacgatcctcggtaagccttcgccccccgctggtttgatcctgctttattgagatttgttngggggttcttgcgggttcttttgcgtctttttgttgtggttgcagattcgtcttgcgtatgagtgttccgcggattccctcgttgcctggtcgagtatttgtattttacattggcccattctcgtagattcttaagactccttctgttctatagggttctgttaccaatctgtgggttttatattgcagaattgatcttttttcttgcgaagttttttaccactctagtgcgctccttt

SEQ ID NO: 8114 - DNA, 624 bp, Zea mays
  unsure (1)..(624): unsure at all n locations; Clone ID: LIB3279-173-P1-K6-B2
gtcaggagcgacaaagttggggatgaagtggttttgcacctaacattcagaaacaaanaagccttgaactattgaaggcagccatagaaaagctggctactactggaaaggtggtcattggaatggatgttgctgcttctgagttcttcggtgagaaagacaagacttatgatcttaatttcaaggaggagaacaacgatggctcaaacaaaatttcaggcgacagcctgaaagacctgtacaagtcctttgtttctgagtaccctatcgagtcgatcgaagatccatttgatcaggatgactggagcacttatgccaaactcactgatgagattggacagaaagtgcagattgtaggagatgatcttctcgttaccaaccccaccagggtcgccaaggccatcaatgagaagacctgcaatgctctcctcttgaaggtgaaccaaatcgggtctgtgaccgagagtatcgaagctgtcaggatgtccaagcgcgccggatggggagtgatggcaagccacaggagtggcgagacagaggacaccttcattgctgacctctcagttggcctgtctacgggccaaatcaagacgggagctccttgccggtctgagcgcctggcca

SEQ ID NO: 8115 - DNA, 625 bp, Zea mays
  unsure (1)..(625): unsure at all n locations; Clone ID: LIB3279-173-P1-K6-B4
cttaaaaatacatccatgataagnagatcgatcactcgccgtttgtatgcatttagcctatttgtttagttgtgtttgaactgacaatgatctatttgggcctgaactggttttctacctataaatttcacagctgatgtttctgtagaatgaatacacgctgatgggcttgaactgggactatttgggccatgggctgtatacttatagctgcatgtgtgttttcatttcatgttagtaatgctaatgccttatgtatttctcataattaaacttttcgactggatcatgaagttttcaataaaaagaagggacaactcggtggtatcaatttctacaatcatgaaaaaccacatggaagtagcaaattcttacaaattataattgtcacgacaactcggtggtatcaatttctacaatcatgaaaacatgtatttgaggctgtctcctcttaatttatctcttatggtaaaataatagaaagttaaagagtatatttttttatcacatgttagatttaacgcagtacgattcatcagagaagaaaatccttncctttactcctctcccacaatagacataagttgaatactataacatatggtttacaaactattatatattg

SEQ ID NO: 8116 - DNA, 631 bp, Zea mays
  Clone ID: LIB3279-173-P1-K6-B6
ccttccactggtgctccgtctcaggggtggcatgcagatctttgtgaagacctcactggcaagacaatcacccttgaggtggagtcttcggataccattgacaatgtcaaggccaagatccaggacaaggagggcatcccaccggaccagcagcgcctcatcttcgccggcaagcagggggaggatggccgcaccctggcggactacaacatccagaaggagagcaccctccacctggtgctccgcctcaggggtggcatgcagatttttgtgaagacattgactggcaagaccatcaccttggaggtggagagctctgacaccattgacaatgtgaaggccaagatccaggacaaggagggcattcccccagaccagcagcgtctgatctttgctggcaagcagctggaggatggtcgcaccctcgcggactacaacatccagaaggagagtacccttcaccttgttctccgcctcaggggtggtatgcagatctttgtgaagaccctgactggaaaaaccataaccctggaggttgagagctcggacaccatctacaatgtgaaggcgaagatccaggacaaggagggcattcccccggaccagcagcgtctgatcttcgccggcaaac

SEQ ID NO: 8117 - DNA, 612 bp, Zea mays
  Clone ID: LIB3279-173-P1-K6-B7
cgcatcgccgtcgcgtcgtcgtcgactccccgccccgcccgcgccgggaactgcgacatctctctaatctctcctaggaccgggtgcccttacatccacgccgcaacgcaaatcgccgtccgagtcctcgcggtctctcgtctccccgtgcgagaggacgccggcagcaggggggggccagtgcggtggcttggtgggggaagaccggaggcggcggcagagctcgcgcccagaggtgcacggcaggcctgttctcggcgtcggctgggggaaggcgagtagccgcgggaaggacgagtgaataatcatgagctcgctctgccctttcgcgggagccaccactggtggtggtgtatgccctgtgaaatctgataagatcaacactggggtgtgccctgcaaaatctgacaagagcgtcagcggtgtatgccctgtcactggcaaggatcatggtagcaagctcaaggaaagtggtgattctggtgaagaaaagggcaccgatcctcgtgtcgtaccagcaaaatgcccattcggctatgactccaacactttcaagctgggtccgcttagctgcattgtctgccaggcactactcccatgaagtagcaaatg

SEQ ID NO: 8118 - DNA, 639 bp, Zea mays
  unsure (1)..(639): unsure at all n locations; Clone ID: LIB3279-173-P1-K6-B9
ttgtcctnncgccgttgagaaaagtgtngacctcacctactgctggnaaccaagcagtgtgngaaaaaataatnnggaaattgatgagcactataggctgtgcctatgagtnnggacttattgctgatgcttagaacatctagtggaacatnngctcgtgttgaaactcagaatcataggttctcatacggaggagccaatgactgtagaatcttcgacacaagctatctgtgacttagctctgcgttttggcgaaggtgacgaagagtcaatgtcacggccatttggagtctctctcctaattgctggacatgatgagaatggacctagcctgtactacactgacccatctggtacattttggcaatgcaacgcaaaggcaattggatcaggttctgagggagctgatagttccttgcaggaacagtacaacaaggaattaaccctccaggaggcggagaccatagccctttctatcctgaagcaggttatggaagagaaggtgaccccaaacaacgtcgatattgccaaggttgcccccaagtaccacctctacacccctgccgaggtggaagccgtcatcgcgaggctgtgaaacgcttccgagctcttgctatccacgtcatcaatcggtaatag

SEQ ID NO: 8119 - DNA, 623 bp, Zea mays
  unsure (1)..(623): unsure at all n locations; Clone ID: LIB3279-173-P1-K6-C10
tgntgatcagttgtttagcccagttttggatccccaggntgggaccatgatattgggttcgatgccatcaattttgaagcatctcaagagttgaaaaagatgtctctgcggcaattacaggacagatgagaaaggacaaggaagacatgtatatccattcagaatgttcagtaggtgggagatgctcagagaggctgctccttgatggggggtatggatatgcagacggcaagcaaagatttggtctgtactgttcatggggatgccaagttccacaatctgccttggaacagtattggaggtggcatttctgttactaagtttggcaacaagtactttgctggggctaagttagaagactctgttaccattgggagacgagttaaactggtagccaacgccggtaggatgtctggctgtgggcaggtggcacatggaggtggtgtggagattacagcaagggggaaagattaccctgtgagggaagggagtgtcactgccgcggtctctgctttgtcatttgaaaaggaaaccgtaattggggccaaccttcagtcagacttccgagtgggccgtggatcaaaaatatcagtcagcgctaacctaatagtagaaatttgggc

SEQ ID NO: 8120 - DNA, 617 bp, Zea mays
  unsure (1)..(617): unsure at all n locations; Clone ID: LIB3279-173-P1-K6-C11
ccaacttcaagtataaccagtgaattttgccagnacctgacatgaagtccatgaatgtggctagccttgtggagatcagtgatgcatattcacttgaccgtgctatagctacaccagagagagcattgcatactgcaaacctgtgtgtgaggcttttattatctaaggagagcattgtgattaggagacttattatgacagcgaatgcaaaatctcttgcccgtgatctgatctccagagatgctttgatgttccgggtgctccttagtaaggttattgcggatgttgtctaccaatggatgttgagtgccacaggcttgaaacgagttatggagaccaagatccagacgcccatgaccacaggaaagaacgagggacatctggtgctggctgaagaaccatcgaccctgatggtactccaggcggcagtaaaagaccgaaggattcagctcatgttcaccaagtttgtgagggagttgagagaggagcccgtcttgatgattagggtgagctggaacgtgttcctcatctcggtctcatctgccgctgtaggcctgcaccgtttcttggtgttcttcttgaaggaggatggtgccaggttcttggatgacaaggtc

SEQ ID NO: 8121 - DNA, 293 bp, Zea mays
  unsure (1)..(293): unsure at all n locations; Clone ID: LIB3279-173-P1-K6-C12
gnacagnacactgtaacagngcgagcgagctgtccggccaaaccctcacggccgcctccacaatgccgcgccatctcgcgctgctcctgcccctgctactgctggcctcgccggcggccacgcgcctggcgtccgccgcctgcgcgggcgagaagttcccggcggggcgtgcgggcggggggggcgaggacctgccgaagctgggcgcgtcgctgcactggacgtacgacgcgtccaagagctccctgtcggtggcgttcgtggcggcgcccgcggcggcgggcggatggttg

SEQ ID NO: 8122 - DNA, 220 bp, Zea mays
  unsure (1)..(220): unsure at all n locations; Clone ID: LIB3279-173-P1-K6-C5
cccccaaacggcggacgagagagaagangaagacacacagggagaacgggggagaggagggagcaggagggagaagcaccaggggggggagcnggngggangnaacagaagacgagggaagcggacaggagaagacacggaaggacgaaaaaggggagaacaaagaaaaaagggggaaaacagaagacgaggcagaacaggcaaaaaccaggagcgggcc

SEQ ID NO: 8123 - DNA, 561 bp, Zea mays
  unsure (1)..(561): unsure at all n locations; Clone ID: LIB3279-173-P1-K6-C6
aggctgtattacagcggctgngttcgtgctttgtactgagtaccttagatnngggggctggnaaagnaaggaggnnaaaaggtgaactgtaagcttgaacgtnctttgtattttgggggacgagacgagcctcggctcgtntatgaaggacaataagggagactacgctntntgggggctnngaatgcatagccttttacaactgactatgtctgcttcaagggactatggacaagtaagggctgtgacctatttgctctgtattgaacagtntattggggagtntgnncgnagcatgccttgtttacattttgctttgtagagttcaaggtacacggttcaccagggtaggaattcaaggatgctggtggtagtttaacaagacaagcaagggacaggaactgtcgatgaagacgcttgagaactgtacgaaggcagtagaagtttgaagccgtacctgagttatgcttgttcgtgtcttttgtacgtgttcaggaaggaaggaactgatagagtttntgttgttgtggagtttttaagaatgttttgttatgatatatg

SEQ ID NO: 8124 - DNA, 589 bp, Zea mays
  unsure (1)..(589): unsure at all n locations; Clone ID: LIB3279-173-P1-K6-C7
cccggtcgcccagcgtccggtccgtggccaggcgtcgtccatgctgtccgctaccaccgtgccactccagcaggggggcggcctgtccgagttctccgggctcaggagctccgcgtcgttgcccatgcgccggaatgccacctncgacgacttcatgtccgccgtctccttcaggacccacncggtcgggactagcnntggtcgnggcgggcgccgacggaggcgaagctgaaggtggccatcaacgggttcggccgnatcgggcgcaacttcctgcggtgctggcacgggcgcggcgacgcctngtccctcgacgtcatcgncatcaacgacaccggcggtgtcaagcaggcgtnccacctgctcaagtacgactccacgctcggtatnttngacgccgacgttaagcccgttggcgacaacgccatcttcgtggacggcaaggtcatcaaggtcgtgttcgaccggaaccccagtaacctgccgtggggtgagctaggtgtagaccttgttattgagggcaccggagtatttgttgaccgtgagggcgcggggaagcacattcaggcgggtgccaagaaggtgctta

SEQ ID NO: 8125 - DNA, 609 bp, Zea mays
  unsure (1)..(609): unsure at all n locations; Clone ID: LIB3279-173-P1-K6-C9
ccaaatccatgtctccaactctccagcgcgtctgctacgcctctcctgcaggacgaccaatggcttccaggaagttcttcgtgggtggncaactggaaatgcaacggtactggcgaggacgtgaagaagatcgtcaccgtgctcaaccaagccgaggtgccctctgaagacgtcggggaggtggtggtgagtccgcctttcgtttttctgcagcaggtcaaggggctgctgcggctggacttcgccgtcgcagcgcagaactgctgggtgcgcaagggcggcgccttcaccggcgagatcagtgctgagatgctggtaaacctgcaggtgccctgggtcattttgggacattctgagcgcagagctctgttgggtgaatccagtgattttgttgctgataaagttgcatatgcactcactcaaggtctcaaggtaattgcttgcattggtgagacccttgagcagagagaggcaggaacaacaatggatgttgttgctgcacaaacaaaggctattgctgaaaaaatatcagattggacaaatattgtgttggcatatgaaccagtttgggctattggtaccggcaaggttgcaactcctgctcagctc

SEQ ID NO: 8126 - DNA, 613 bp, Zea mays
  Clone ID: LIB3279-173-P1-K6-D1
cccagcgtccgcgccgacacggcatccctcttcctaacgttaactccaagacctatccaggtaatcgagtactgcaacaagcacgtacatgccgccgccgccgccgccgccgcctcgaaggccggttccgacgacgtgggtgccgcctccgccaacagcaccgccgcctccggtgaggacctcaagaactgggatgcggacttcgtcaaggtcgaccaggccacgcttttcgacctcatcttggctgcaaactatctgaacatcaagggtctgctcgacctgacctgtcagactgttgctgacatgatcaagggcaagacaccagaagagattcgcaagaccttcaatatcaagaatgacttcacccctgaggaggaagaggagatccgcagggagaaccagtgggccttcgagtaaggaggtgctggatctattgatgcctaagtttggtggtgtctactactatgtctactttatgttgtcctaatggttgtaagtattttgggagtcactttgcttgcgaatgtctcgcgtaagacttatgtggtcaatggtcggttattaacttattaccatgaaagcacttcgtctgctgccctaagagtttagtccc

SEQ ID NO: 8127 - DNA, 362 bp, Zea mays
  unsure (1)..(362): unsure at all n locations; Clone ID: LIB3279-173-P1-K6-D10
cggccgcgtgggcggccgcgtgggttgagagtcaacttgttgatacttanagatagtgtaaaccacaattgactggctggtaacttgaaaaaccatccaaacacatatctagaagttcccaaatattattgaaatacttgccatcttccgatgaggttattatatgataccatgcaaaatggcaagtccaaactccacatcggttgagagatacaaaatctagggattagaagggcaaaaggacaagaaatctgtatgtctgacattttgtccttttttatctcataaaatggatgaagttggtcttgaaaatttgtgtgatttggtaatatgatgtcaattaatgataccaagtttttagt

SEQ ID NO: 8128 - DNA, 618 bp, Zea mays
  unsure (1)..(618): unsure at all n locations; Clone ID: LIB3279-173-P1-K6-D11
ccgcatcgntgnataattatgaagcttctatcgtggtcaagtttagtggttcgtctcgaggcattggagtcacccaatttaacccagccaaccatcctcatcatataacccactagttttttctatacgagagtttgtttagagatgagcagtttaatactgatcaaatgcacttcagatgggtatcattcaaatatgtatcgtacacactgtcgccagtattctagaaccatcttgagtagtggtttcttattgatccaaaatataaccccttatcacgctaccgccatccccaccactgccgtctgacccaccggttaccctagccaaacccctccaacgtgcatcccctaccttatgtcagcatcacatatgtaggattcaatttctgtgttcttcctatggcgccgcatgagttagctaccctcttgcaaaatatataaattagattagattaatttttttcactttcgtcatgataaccagatcgagatccatctaattcgttgcaatatcttatcatcaaactaaaaatgatcatggccagtgatgaggtgtgaacttgcatgcatttgtcacaacatgtggcggagtaagagcaagacattacttttcaac

SEQ ID NO: 8129 - DNA, 656 bp, Zea mays
  unsure (1)..(656): unsure at all n locations; Clone ID: LIB3279-173-P1-K6-D12
cggtcccattcccgggtcgcccagcgtcgccacccatcgctcaaacctctangctctcgcctgctcgcctccgccgccggagcgagctccccatcttcatccgtcaaccatggcgacccagatcagcaagaagaagaagttcgtcagcgacggtgttttctacgccgagctcaacgagatgctgacgcgggagctggcggaggacggctactctggcgtggaggtgcgcgtcacgccgatgcgcacggagatcatcatccgcgccacgcgcacgcagaacgtgctcggcgagaagggccgtaggatcagggagctcacctccgtcgtccagaagaggttcaacttccctgagaatggcgtagagctttacgccgagaaggtcgtcaaccgtggcctctgtgccatcgcgcaggccgagtccctccgttacaagctcctcggaggccttgccgtccgcagggcttgctatggtgttcttcgttatgttatggagagtggtgccaagggttgtgaggtgattgtgagtggaaagctcagggcccaaagagccaagtccatgaagttcaaggatggctacatgatctcatctggtcagccagtgaacgagtacattgactcggctgtgagacacgttcttctcagacagggtgttcttg

SEQ ID NO: 8130 - DNA, 632 bp, Zea mays
  unsure (1)..(632): unsure at all n locations; Clone ID: LIB3279-173-P1-K6-D2
gtcaggggcaggccaggnagggagggcctagggctcgccctcatggcctgacgcagcagaggaggcaggnaaataaaggaagcttttgatctgtttgatacagataactctggaaccattgatgcaaaagagctcaatgttgccatgagagccttgggatttgagatgactgaagagcaaattaggcaaatgattgctgatgttgacaaagatggcagtggagcgatcgactacgaggagtttgagcacatgatgactgccaaaatcggagagagggatagtaaagaggagctttcaaaagcattccgcattattgatcaagatggaaatggaaagatttctaacattgatatccagaggattgccaaagagctgggtgtaaatctcaccctcgatgagatccaagacatggtgcaagaggctgatagaaatggtgacggtgagatagactttgacgagttcatcaggatgatgaggaggaccagctttggctactaggtgtatttatctgtgagtgcttgacgctgccagtttgtttatgactaccgggcgtgtgttaatcgactggtgttgttactatgaacaataatgttgtgctctggtttcgcttatatatataattttaatttaat

SEQ ID NO: 8131 - DNA, 626 bp, Zea mays
  unsure (1)..(626): unsure at all n locations; Clone ID: LIB3279-173-P1-K6-D3
ctgnaaaaacattgagggtctcttatgacaagnagacatggcttacagctgctcttcttcagcttgcacctgataaacaatacgtattaccgagttcatccccgagcacaagtcttattcaaggtctgtttacctgccccgagggagacatagcaaggaactctgttatggatcagagggagatatatgctggtgcccgtagcttggcaagagcatctgaccttggaaatcaataccatagagatgctaatccagtgtctggttccagcaacaacatggcaaacaattaccatgttggaaggagacctggggaacataccccagacagccatgtgttgccaaccggtgctacaagagtgaatgaaggatctaggtatggcaaaactgacagtgaaatgatttggcaggctgtgctagagaatgttcagtcagactcattaagaagattgttagccagagagggtcgactgatatccgtcagcctaggcacagctccaactgtacaattaatattcaactctcgagtaaataaatctaaagctgagaagtataggggccaaattctgcaggcattttgaatctgttctttcttctaccaataatacttgaaattcgatatgaatcta

SEQ ID NO: 8132 - DNA, 603 bp, Zea mays
  unsure (1)..(603): unsure at all n locations; Clone ID: LIB3279-173-P1-K6-D5
cccggtcgacccttcgtccgcccagcgtccgacccgcgtgggggcgagcgtggcgcccacacataacgcccaggggggcgcccacgcgtccgtttggctcggcagctaacgacctgcagccaaccatctaccagcgactcagcgagcgagagcagcacacactgcacgcagctagctaggaccancaggggcgttttgattgggggctccatgatctcctcntcagctctggcggtggcgcctcagggcctgccgcccctcggccgccgcgcctcctccttcgccgtcgtctgctccaagaagaagatcaagaccgacaagccctacgggattgggggtggcctgaccgtcgacgtcgacgccaacgggagaaagggcaagggcaagggcgtgtaccagttcgttgacaagtacggtgcgaacgtcgacggatacagtccaatctacaacgaggatgactggtctnctaccggcgacgtctacgttggtggaaccactgggcttctgatctgggccgacaccctcgctgggatcctcggtggtggggcccttcttgtctacaacacctatgccctgtttcgctaaggatatccaatgcatgcg

SEQ ID NO: 8133 - DNA, 458 bp, Zea mays
  unsure (1)..(458): unsure at all n locations; Clone ID: LIB3279-173-P1-K6-D6
aacatatnaaaaagctgaggcttgtagaaaggagcttgaggatatatgcattctattgaaaaggaaacatgcagaagctaaagagctagcagttcgggctatcgttaacaacaatacgatgctgatgttaaaccacccgatgattgaggagaaaatttactctattcagaaatttgcgaacgacctgaaatccaagaagtacttatttgaggaagttggcaccattaactctcactgacgtgggacaaatgcagggagcaaatgacttatccagcggagcatgggtaatgtaaatgcaacaaaagagctcaggcgtccagcgtaaatgcaatcttgaagtaacttgaataactaccttcctcgtgcattctgctacatggttggcttntgtagatgcgtccgtttacactttacacagcgtagcaactgttgagtgacctaatacttctagtagcgag

SEQ ID NO: 8134 - DNA, 618 bp, Zea mays
  unsure (1)..(618): unsure at all n locations; Clone ID: LIB3279-173-P1-K6-D7
cccggtcgacccatcgtccgcggccgcgtgggtgagtactgcagctgtgaggaaatcacctaaaatgttccggggtggggaatgaaagattctgggaagtggaactccaaaagctcatgtggataatgcaatctcctcacgtatgccacctgggatgggagccatttcagatctagagttgcctgtgtgganaaagtntngggacatannaaaaagctgaggcttgtagaaaggagcttgaggatatatgcattctattgaaaaggaaacatgcagaagctaaagagctagcagttcgggctatcgttaacaacaatacgatgctgatgttaaaccacccgatgattgaggagaaaatttactctattcagaaatttgcgaacgacctgaaatccaagaagtacttatttgaggaagttggcaccattaactctcactgacgtgggacaaatgcagggagcaaatgacttatccagcggagcatgggtaatgtaaatgcaacaaaagagctcaggcgtccagcgtaaatgcaatcttgaagtaacttgaataactaccttgcttgtgcattctgctacatggttggattatgtagatgcttccgtttacactttacac

SEQ ID NO: 8135 - DNA, 610 bp, Zea mays
  unsure (1)..(610): unsure at all n locations; Clone ID: LIB3279-173-P1-K6-D8
ccccgcgtccgctggtttcaggatgtgaatccgtcacaagtatgcattgacaatgactccagtcgccttgtctatagaggaagccctgccaaagaagcgctggtgatggcattgcttggatctgtcttcacaatgcttgtggctctgatactcccatgcncgtgctacgcggtccagcaangagggtgcantgccattgtgggagatcatcctgtgcatagtcatcataatgatcggcgccgtatgtgcatgcgtgggatcatacacctcagtcagccagatgattagcagcaccagatagcgcacgctagctgatatttatctagtgtctatggatccttccaaatgctttgatagagttggaactggcagcttttcgtagctaagtttatttgttccttctttatggcagaaatttggtaagagagagtttagttgtgggaggacaggcggcgaaggagtaatatgagtttagtgtggtgcttttgtgactgatcatctctggagcttttatgaatgatctagctagctatctgtaaatgatctagttgtgaatgatattataattgtgatgcttttgtgaatatataattggggtgcttttgtattt

SEQ ID NO: 8136 - DNA, 539 bp, Zea mays
  unsure (1)..(539): unsure at all n locations; Clone ID: LIB3279-173-P1-K6-D9
cccgtcgcccacctccgtaaagaagtgatcgcttggacgaactgggtagagggtgggtgatccccgttttgcactggctggactcgcggcggggagttcatcaacgcataaatcctttccgggaatcggtaacaagaaggacacgcttaattccttgtcgggggagtccaatcaggaagacttacaaaacagcccctcgaccatggtgtttgcgccctctaaagtggtaataactaacttggaagaaggaaaatctagaccttgtgggaaaagtggccagatgcttctgatctgatgcttcttcatataagcttccgtctaagaactgtctacattgagaaaactgatttcgcttaaggactaaaaactctagngctgcccctggtaaattgtcatgctaagtatgcgttcccataaatgccagactttcttggtgatactctgatatatgtgaaatcgagcagatatgatccttgaagcttttaacttaaggtgttctgcactggttgtgagccgcactgtgtcgaaccttgaagtgg

SEQ ID NO: 8137 - DNA, 620 bp, Zea mays
  Clone ID: LIB3279-173-P1-K6-E1
ggccttctcctactgctcacagcgtccagccagtgctgtcaggcgtcgctgtcggcgcgggctggcagagcgtcgtcgcctacgttaacatcacttcgtactacctcatcggcatccctcttggagccagccgtctcgctagggtttcgccgccgccgccgccgccgccgccgctatgcctcgccgcagctcaggaaggtctgccccacgcccagctccccgtgctgctccagtgaggaacccgccacagccagcacgccaggctcctcctccagctcctgttcgagatggtggtggctccatgtttggaggaattgggtccaccattgctcaagggatggcgtttggcacgggtagtgccatggcacacagggctgttgatgctgtattaggtccccggaccattcagcatgagactgttgcctcagaagctgctgctgctgcccctgcccctccagtgatgaatgctgacgcttgcagcatccattctaaggcttttcaagattgtgtcaacaactatggcagcgagatcagcaagtgccagttctacctatacatgctgaacgagtgccgccgcggtggtgtgtctgcctaaatgcttctggggttattcgtggatt

SEQ ID NO: 8138 - DNA, 621 bp, Zea mays
  unsure (1)..(621): unsure at all n locations; Clone ID: LIB3279-173-P1-K6-E10
gtccgctnaaagnaagttngaatcgcttgtgacagagactgggtagatgggtgggatgatccccgcttattgacactggctggactccggcggcggggagtatcatcaaccgcaataaattcctttatccgtggaatcgggataacaagaagtgacaacagcttaattcgcgttgatcggggggggtaccacatcagggaagagcttaacaaaacagcccctcgaaccatggttgttttgcgccctctaaaggtggtaataactaacttggaagaaggaaaagtactagaccttgatgggaaaatgtggccagatgcttctgatactgatgcttcctctcactataagcttccgttctcaagaactgtctacattgagaaaactgattttcgccttaaggactcaaaagactactatgggctggcccctggtaaatctgtcatgctaaggtatgcgttccccataaattgcacagacgttatctatggtgatactcctgatgatatcgttgaaattcgagcagaatatgatcctttgaagacttctaaacttaagggtgttctgcactgggttgctgagccagcacctggtgtcgaaccattggaggtggaagtaagacta

SEQ ID NO: 8139 - DNA, 614 bp, Zea mays
  unsure (1)..(614): unsure at all n locations; Clone ID: LIB3279-173-P1-K6-E12
ngaaacgttgtctccagtttccatgcagngcagnaaagnacagctagcgagagnagcaatggcgtcggctcctgcgttctgcgtcgcgctgctgctgctgctggcttccgccgctgccgtccaagcggtgccgccccaggccggcacgtcgtccacctgcagcactgacctcctccgcctgctcccctgcctgcccttcatcgagggcaccgccaccgtgccggcggacacctgttgcgccaacctgggcagcatggtgcacgacgagccgcagtgcctctgccaggctctcagcaaccccagcacggcccccgtcgccgtcaacatgacgcgcgtgatggccatgcctcggctctgccgcctcgacctcccgcccgccaccggcgcctgcgcagttgccggtcttcttccccatggaccatcaccgccgctgccaccgccgccgccgccaccggcggtcactccacacgcaagcgccaactccagtgctccagcgaccctcaccacgccagcgacgccaacgccgacgacaccacgtatgataccgtcaccatcggtgagcagtcagacgccgccgcgatacagccgggggtccaagatgatagctgacggct

SEQ ID NO: 8140 - DNA, 588 bp, Zea mays
  unsure (1)..(588): unsure at all n locations; Clone ID: LIB3279-173-P1-K6-E2
aaatgcatcctacttcactcccatggtctgaccaaattctcaaccaaattctaccctcaactgatctaaaccgtctggacagcagcctcataaactgaatcagtctcagcaagctccttcttcagttgtgcaatcctcgcctggatctcatctttaatggctgcatctgctatgagggttgttgtagtctgatatatcgtgactttccttgctgtgccaagttgttcctctgtagcattttcaaccaacaaaccctgagttgttaccaagcccaagtttctgatggtagtctgctggcagagtatcattatgcttcagtttaaactaccatgcaccttgaaatagtgagaagtaaactaatgagcccttggactgaaaagccaatcagaaaatatatgcggatagattatatcctcagattactattataagtactgttgtttggtgatttgaccaaacacatgacataattcctttgatagttggttgttctttgaaggtagcacatttgtagacatgaacacctnctctaatactgcattataggatcagagtttgtgttccctatatagttagatagtgttcttt

SEQ ID NO: 8141 - DNA, 598 bp, Zea mays
  unsure (1)..(598): unsure at all n locations; Clone ID: LIB3279-173-P1-K6-E3
ctcttgctngtctggctccaacccacccatcaggctcgggcttgctctcaacttctcagtgttcntactacgagacctcaactcccctgaccgtgcttgcaaccttgcaaagcaggcctttgatgaggcaatctccgagctagacagcctgggagaggagtcctacaaggacaggggtgtgatcatgcagctcctgcgtgacaacttgaccttatggacttccgacaccaacgaggacggcggggatgagatcaaggaagcagctgctgcccccaaagaatccgtccccgagggccagtaagacggatccgatctcccgacctgatgcgtgtctgctgatgtcggggagtttaccaggactgtgccgttcttgatttctgatagcttatcttctagtacacctngtgttgttctcttcgtcacggcgccggtgcgcgtgcgctgaagctgcctgccattgccattgcctttgccgctgtttttaattaagcacacactctagatgttatgcccgcatgctatgtttcgattctcaagttgataaatgatggctggatgctggttttcgtgctccaagcctgctgcttcttccagggaa

SEQ ID NO: 8142 - DNA, 593 bp, Zea mays
  unsure (1)..(593): unsure at all n locations; Clone ID: LIB3279-173-P1-K6-E4
cccgggtcgnaccctatgcgtccgggnatatcaggnnacctcttcctcgaaaggaggagccctgcttctactggtaaggaatgcaggaagctagttcaagtgccaanatactttaagctctcctcggtcagnacattgaagnaaaatcctgcaaaggctgagnaaaaaagnataagaagtnntcagagatctgtttgttaccctggaaatccggtattggtggggaggatggggnggttcagatcttggtgatgaaagactggnnctgttcagcagtaaaaggaactcctgatgctatcatggttcaaaagcagagctactgatagttcagtgccgatccatccaatggtgcagcagaagccttctttacaacccagggcaacatttttgccggaccttaatatgtaccagctgccatatgtcgtaccattttaaacatctggcgaggtagatgagaattagatgagatgttgggagagagctgtgtggatgtgggagataatgggttccctgccgaagttttccagctttgttccatagtgtttntttgaggccaatagagttctggcagaacttataatgtaatattgatt

SEQ ID NO: 8143 - DNA, 525 bp, Zea mays
  Clone ID: LIB3279-173-P1-K6-E5
tatcgtccgcccagcgtccgcaaggtgtctcatcttcatgtacagtttcagagttcggagcttggcagtacagagagtgcggatcctggtgtactagcacctgaatctgaatgaagttaaaaccaagtttctgtgacgtaaaaaaaaaaaaaaaaaaaaaaaaaaaaaaaaaaaaaaaaaaggggttaagaaagggggaaaaaaaaaaaaaaaaaaaaaaaaaaaaaaaaaaaaaaaaaaaaaaaaaaaaaaaaaaaaaaaaaaagggggggcctttttaagggatcaaagtttagttacgggtgattggaaggtattattttttttttagggtaactaaaattaaattaattgggggtgttttaaaaaggtgggaattggaaaaaccttgggttaaccaaattaaattgctttgaaaaaaatttttttttggggattggggtaaaaagaaaaagggccctaatgatttggccttttcaaacagttgggaattttgataggaaaatgggacgctctttttaaggg

SEQ ID NO: 8144 - DNA, 509 bp, Zea mays
  unsure (1)..(509): unsure at all n locations; Clone ID: LIB3279-173-P1-K6-E6
ttcgtctccgccgcttgctctaatcctgtcccggcacgcgaacacgcgaggcgcagcgtttatggcggcgacaccggcggacgcgaagaccgaggccgccaagatggacctcctcgaggacgacgacgagttcgaagagttcgagatcgaccaagaatgggatgagaaggagtaattgaatngagctgtccagcagtgggaggatgattgggatgacgatgatgtgaatgatgatttctcgctgcagctgaggaaagaactggagggaagcaacgcccagaagagctgaagtattatttctccagtttacaaatgatccttctatgccagctacttctggaaatcggaacctttatgtgatttgtgctgctgggagcaatcgaactctggagtaagaaagtaaccataccagtgatttctaagtatgaacggcaggaagttgacggacatcagtcggctatttaaaaaatatctcagttgtggttagaatatgccacagttcttatctt

SEQ ID NO: 8145 - DNA, 237 bp, Zea mays
  unsure (1)..(237): unsure at all n locations; Clone ID: LIB3279-173-P1-K6-E7
cccgggtcggactattcttccgctctcaaacttaaaaggnctgttgttccacttgaaagggtttttttttggtgggaaacctcttacactcattcttcatgaggagattgagtttgttgagtttgaacgttatggtgctgggggtgccagtatataatatnattattttnacctaattattactattggggttttgtttnggggtntaataaaaaatatttaaattaattaatactt

SEQ ID NO: 8146 - DNA, 561 bp, Zea mays
  unsure (1)..(561): unsure at all n locations; Clone ID: LIB3279-173-P1-K6-E8
tggctgctatctagttgggcgtggaaagctcgnnagtgctcctnaaatgnngtcgtcgtatttagctttgatactgacatctacctcgatgccaatagnataatnnattgtttaacacgcgtgnagnntccaaaattgttggctttttgggtcagagcagtggatttcgattaaggtattnttatcacttnntgagtgcaaccttttttttattatttttacgagcttctgcctcttgcatatgttgtagattctcgccgagaagggagtagtagtattacctgatatctatgctaattcaggtggtgtggtcgttagctactttaattgagtgggttcagaacattcaaggtttcatgtgggccgaggagaaagtgacgatgaactagaaaaggacatgagcagtgctttttaacacatgaaggccatgtgcaaatctttggtgctgtcgaagtgtgttgtgacattggaattgtgggtttagaaaaacaagcttatttagattttgaaaaaacattagaagttattatattgggagcatttttttaagatttaaaattt

SEQ ID NO: 8147 - DNA, 511 bp, Zea mays
  unsure (1)..(511): unsure at all n locations; Clone ID: LIB3279-173-P1-K6-E9
agttccccatgctctacaataagatgtgtaggagtgctntgaanagagtggtgcttatgcgctcagttccttctttgngaacaagtccgtatcttctactttggccaatagggtttctgcatgggaaactgtgtgtgagaatgtcgtcgaggccttacgaccacaccaaaatggtactgccagtgccatcaaagaggaattggtagatgcagccaccaaagcagcagcagcagcagcttctcaacaagattcaggccatgatgcaccgtatgggcagtcttngacagccaaggcggacatggaaatcgatggttgatttgtaggttccagagtggcaagaaagggaatcccctntaatcattatgtatactgtggtcagaatgtccgttatatattgtaacatcaaagaaagcaccttcaggcctgagggtgttactgctaatgcgtttggtttacttgtacttgtaatatgcatacaccatttagaacttatgcagtcattgtgtgtgct

SEQ ID NO: 8148 - DNA, 617 bp, Zea mays
  Clone ID: LIB3279-173-P1-K6-F1
agacatcggggttaggagactgcccatggccgcgaccaagtgtgcaacgttaggttcgagggcaacgtgatcaccaccaccgtgacggcctccggcgcggccgtggagagctggctcgacgagatcctctccgtccaccgccgccgcctgcacaagctcgtcgtcgggctggacgtcgagtggcgccccagcttcagccgcgcctacagcaaaacagccatcgtccagctctgcgtcgggcgccgctgcctcatcttccagcttctccacgccgactacgtccccaacacgctggatgagttcctcagcgaccccgactacacattcgtcggcgtgggcgtggctgcggacgtcgagcggctcgagaacgactacgacctggaggtggcgaacgcggaggacctggccgaactcgcggcgaaggagatggggcgcccggacctccgcaacgcgggcctgcagggcatcgcgagagccgtcatggacgcccacgtcgagaagccgcagtgggtgaggacgggcccctgggacgcgtcatccctctccgacgagcagatcgagtacgccaccatcgacgcttttgtctctttcgaggttggccggatgctgctcagcgg

SEQ ID NO: 8149 - DNA, 240 bp, Zea mays
  unsure (1)..(240): unsure at all n locations; Clone ID: LIB3279-173-P1-K6-F10
cggncgcgtgggnacctgggngggttgagctgggtgcaaacgcctagctcgagctgactgttttgtttgaggagcagaggtcggggggagccattttgttattatagaactaactgagcctgttatttcttttttgctactcgcatatggaaatgctttggggaagtagtttgagggggagtgtgttcttctaagttacgtctattaatcgtgttaatatgcccttatttcttaattatt

SEQ ID NO: 8150 - DNA, 628 bp, Zea mays
  unsure (1)..(628): unsure at all n locations; Clone ID: LIB3279-173-P1-K6-F11
ncacgatccaaanacgacgtgggggagcgagcgatagaccagaacagagagcgatccanagagaagcgaaagatcaggggagctgctaaggaccgatggccgaccccagctattggatagggatggacatcgaaacctccgtcacgatgctcgtcatctgtctcgccgccggcgtggtgagcgtgtgcctcttcttcattttcatgtgcatcgtgcaatggttggactcgccacggatgcgcgtcttcaggctcggcggcgtcaccaccctgaggcagaacctggactacacctgcaccctgtgccaaaacagcatggaggccggcgagaaggtccgcacgctctcctgcgaccacgtgttccactgcggcggcagcgtcaagtgcgagggaatcgaccactgccttcgcaccggaccgatggagcgctgcccgacctgtgaccgggttccccatcccgtgccctggaagcggacaccgtcaccgtcgccaccagcacctacaccttcacagggagcattggcggcagcgctaccacctttgcggctcccgttgtcgacgcgggatttggacgaggcgctgctgcgttgggagcaaatccagaaactagcggaagcgtcgtcatcagc

SEQ ID NO: 8151 - DNA, 588 bp, Zea mays
  unsure (1)..(588): unsure at all n locations; Clone ID: LIB3279-173-P1-K6-F12
caactgtcctacacacacacccacacacgccacactgaggagccctgagccctccgcccttaaaccctagcgagcgagccagcgagaggtctcatccccaccaacaccacccatggagctccgcctctaccacctcgcgctgctgctcggcctcgtcgcctgggcggcggctgctgccacgggagccgaggcgcagccggtgtgcgacccctccatcatcgccacccagatcgcgctcttctgcatgccggacatgcccacggcgccctgctgcgagccgatcatcgcctccgtcgacctcggcggcggcgtcccctgcctctgccgcgtcgccgcccaaccgcagctcgtcctcgcccgcctcaacgccacccacctcctcgcgctctacgcttcctgcggaggacaacacaccgtgggcgctcacctcgctgccgcctgccaaggtccgtcacctcccgccaccgttcctgttatcgccccgccgncgcccgccgcgccccgcctcaagcagccaacacgcgaggcccctccccctccgccacaaagcgagaagccgtccccgtcgccccagcagcagcctggcgt

SEQ ID NO: 8152 - DNA, 286 bp, Zea mays
  Clone ID: LIB3279-173-P1-K6-F2
attccttatataagatagataataaaacgtgggggggggggagtggaaaaattgattcaaaatatgtataaatagtttgtataaatgtaaagtacaaattgtaaattgttgagataaaaattttatttaatttatataatatattgtaaaggaatgcttgagtgtaggtggaatggtgggatttggtactttgttttattgtttgataataaaagggaggtgtatgtaggtaatttgagtaaagagagattttttaaaaataagggtatgggatatatgtttttgt

SEQ ID NO: 8153 - DNA, 608 bp, Zea mays
  unsure (1)..(608): unsure at all n locations; Clone ID: LIB3279-173-P1-K6-F3
cgcctggcccaatcctcccgtcgtctacgagccgtacctcgncgcggcgagccctcctcctcctcctcccgtcgtctacgagctgtaccgcggcgtggcgagccctccgcctccttctcccgtcgtctacgagccgtaccgcgcggcgagcccccagtctcccgtccacgactacgcggggggggtggtgtactcgggctcgggcgacgacctcggcctgcagcagatcgccaaggtgctcgcgtcgctggggtacaacgagatggcttcgtcggccacgctcctcgcaggctcggcttccgtcgctacatggcccgggccggttaccgtcttcgcggccccagacgtattcctccaggccgactcctgcccggagtgctcgcgacgccacctactcctggaccacatggccctgggctacttcccctacgccgagctcgccgccgcgcccaccacgaagctaccatcggcctccgtcggcttctgcctcgacgtcgcggcccagccacagcgcgggcccttctccgtccaccacgccagcctgtacgtcgacggcgtcatggtgtcggaacctgagctatacgacgacggncgntacgtngtgcacg

SEQ ID NO: 8154 - DNA, 606 bp, Zea mays
  unsure (1)..(606): unsure at all n locations; Clone ID: LIB3279-173-P1-K6-F4
tatcttccgtaaaaaaaaaaaaaaaaaaataaaatataaaaaaaaaaaaaaaaaaaaaaaaaaaaaaataaataaaaaaaaaaaaaaaaaaaaaataataaaaaaaaaataaataaaaaaaaaaaaatataaaatttaaataaaaaaaaaatgtgggtccttttttaattatccaattttatttanttttttttgggggttgttggtgttttttttattttaatttaatttcttttaatttgctgttatttttaaattttttaatttggaaaactttttttttatcaaatttattagttttgtataaattgtttttttgaatattttgtttattataaaaaagtttaaactttttgtttttttaaatatttgttaatttttattttatattggatctccttttttggggttattttaaaggttttggttgtgggttttttttttatttttttctttttttttttaatttcctttatatcgtttttttttttttttttattttgtttantgaaatttttactggttttttttttaagttttttaattgtggtttttttttaggtttttatttttttttttatttatttttatttttaaatttttttt

SEQ ID NO: 8155 - DNA, 620 bp, Zea mays
  Clone ID: LIB3279-173-P1-K6-F5
cctacccgtctcccttcgggccgctgtcacaggtggcccacggctcgcctcccgtctccgggtccaccgcgtcggcgccgccgtcgcccagcttcccaccacgaatccggaggtagcttctggggagaagaagacagatggtcatcaagggctgtgcggtcttttgcgatggcggggggggaggcccggaagatgaggtaccctaccacaggcaccgaggggctcctcatgggcattcttgttgaaggaactagtggcgcagcaaaacttttgcgtgctaatggaaccacacttctcaaagtgcgtgaggaggcagcgaatgttcttgggaaatcagaaatgttttactttagtcccatgcatccaccattgacagaagctgcacaacgagcccttgattgggctgtcaatgaaaaattgaaatcaggtgaggatggagaagtaaccgccaatcatttgctactggggatatggtcagataaagagtcggctggtcataaaatcctgtattcgcttggatttgacgatgagaaagccagtttactggccaaaacggctggtgaagaggctgcaatgagtcttagagagcaaggagagcacctaatttattcgtcaactta

SEQ ID NO: 8156 - DNA, 587 bp, Zea mays
  unsure (1)..(587): unsure at all n locations; Clone ID: LIB3279-173-P1-K6-F6
ccgggtcggacctatcgtncggcctcaaatcagncagcgccgtgccggggtctgctagnaacagtgacagaaacgaccgcaacgcagcaggcccgccgcgcagcccaggatccatccatccacctcacaccgngtcgtcgtccagctcacactccccggccgcgcccccgctgctcctcncctcggtgtcaggctcgcanggggcgagcgaccagtaactgacgtctntccttccttcccccctgctccggcccctctacaaatccccgattaaaccctagacttncctccccacccaaatgcgcgccccctcctaggcggcgcccctcgaattcggcaccggctccgtcgtagccagggtgcgtacaatgagtgcgggttttgacaagcagatattggctcagaagctttcgaagcttaatagctnacagcagaccatagagactttatcacattggtgtgtcttttattatngttgctggcaacaagttgtagaaacatgggattatgagttccatgcaactcctggagagaggagggtgtttttgctgtaccttgcgaatgatattatgtcagaatagtattaa

SEQ ID NO: 8157 - DNA, 629 bp, Zea mays
  Clone ID: LIB3279-173-P1-K6-F8
tgtttttcttctcccgtccgcagtccgcttggcgtgcgcgacggctagggcgaccgccgccgccctacgccctacgtccagctgcccatgtcttcttcgggccccttgccggcgggaactcaccagaccaggaatcgtgctggcaaccggcgcaagtctggagatagggctgaggggggggggtactactacaataatgatggagagaagagcaatgttccttcattaaagaaccttcctccaattgttcatcatgaaacattcttcagcaatgttcagaatgactacaatcaaacaggattagtgcctttggagggatgttctgccagtgaggcttcacagcttctcagtgatcgctggactgctgcaatcaacatgtacaatgaccaaacaattgacccctcagagaaaccggtaatgtattctggatctagcagctcatcatggggtcacctgaagcttcctcatcagatgaacttcctcgaggagttgcgccgtgcagtggacgctcatacagaatttgcgttgcctgtcgacacctggaactaatcgaagtcagcatctgcatcattatgcgttatgactaatttatggaaggcaggctgttcgccaggtctatgtatgatgta

SEQ ID NO: 8158 - DNA, 592 bp, Zea mays
  unsure (1)..(592): unsure at all n locations; Clone ID: LIB3279-173-P1-K6-F9
nccggccagnaatatgacgcccacttcgnctatttccacgacagnaaacaacctgagctcggcggccagcgagttgcgaccgtccttatgtacctcacagatgtcaacaagggtggagagactgtatttccaaacgctgagggaagccatttacagtacaaggacgaaacttggggggggtgtgcaagatctggcctggcagtgaagccaaagaaaggagacgcgctactgtttttcaacctccacgtcaacgccacagccgatacaggcagtctccacgggagctgcccggtgatcgagggcgagaaatggtcggcgacgaaatggatccacgtcaggtcgttcgacaaccccccagacgtgaggacggacgcgccgtgctccgacgacaaggagctctgccctagatgggctgctatcggggagtgccacaggaacccgacgtacatggttgggaccaaagacactctcgggttttgccgcaagagctgcgggatctgtgatgcttgaacgtgttttgggggtagattttgatcccatcatgttttcaataacagatgaatcagtaacctagtgtaatgcgaatttcggt

SEQ ID NO: 8159 - DNA, 639 bp, Zea mays
  Clone ID: LIB3279-173-P1-K6-G11
tgtttttcttctcccgtccgcagtccgcttggcgtgcgcgacggctagggcgaccgccgccgccctacgccctacgtccagctgcccatgtcttcttcgggccccttgccggcgggaactcaccagaccaggaatcgtgctggcaaccggcgcaagtctggagatagggctgatgaaggtaattactactacaataatgatggagagaagagcaatgttccttcattaaagaaccttcctccaattgttcatcatgaaacattcttcagcaatgttcagaatgactacaatcaaacaggattagtgcctttggagggatgttctgccagtgaggcttcacagcttctcagtgatcgctggactgctgcaatcaacatgtacaatgaccaaacaattgacccctcagagaaaccggtaatgtattctggatctagcagctcatcatggggtcacctgaagcttcctcatcagatgaacttcctcgaggagttgcgccgtgcagtggacgctcatacagaatttgcgttgcctgtcgacacctggaactaatcgaagtcagcatctgcatcattatgcgttatgactaatttatggaaggcaggctgttcgccaggtctatgtatgatgtatcccatacac

SEQ ID NO: 8160 - DNA, 632 bp, Zea mays
  unsure (1)..(632): unsure at all n locations; Clone ID: LIB3279-173-P1-K6-G12
ccgcatcgnatgataattatgaactatctatcgtggtcaagtttagtggttcgtctcgagacttggagtcacccaatttaacccagccaaccatcctcatcatataacccactagttttttctatacgagagtttgtttagagatgagcagtttaatactgatcaaatgcacttcaatgtgtatcattcaaatatgtatcgtacacactgtcgccagtattctagaaccatcttgagtagtggtttcttattgatccaaaaattaaccccttatcacgctaccgccatccccaccactgccgtctgacccaccggttaccctagccaaacccctccaacgtgcatcccctaccttatgtcagcatcacatatgtaggattcaatttctgtgttcttcctatggcgccgcatgagttagctaccctcttgcaaaatatataaattagattagattaatttttttcactttcgtcatgataaccagatcgagatccatctaattcgttgcaatatcttatcatcaaactaaaaatgatcatggccagtgatgaggtgtgaacttgcatgcatttgtcacaacatgtggcggagtaagagcaagacattactttttcaactccatcaccactcct

SEQ ID NO: 8161 - DNA, 620 bp, Zea mays
  unsure (1)..(620): unsure at all n locations; Clone ID: LIB3279-173-P1-K6-G2
cttagtttgtgcatctcttnttttttcctgtttttngaagtaatgtgtgtatctttaagtgttcagctttgcaaatgctgcctttcatgtttcataattatatataaatacttctatagattaggatctttgatttgtttcattaatttacaactctaggcgagtgaatagctgcttatttatgtggacacttctcatgtgtaacagctatccataaagtaacacatgaaagtgcagtccttatttaaagggctgagagcaaacagattaaggagaattattaatgattcctttgtctcagtaaaaactacttatacgcctgtgaaacttggatggaggtagtatttgattgcctatttgtttgtcattcttttatagtgatgtcaaatttggatacatattatagtgatgtttatcgttccatatctatgttgtatattaatttttaactctcgtggcaacgcacgggcacatacctattgtattaaaggagtgcacatgtatctgctgaagtttttagaatttgatagttttatatactttattgttatgaaaaaatgttttattcataaagaaatctgtcggtgtattgctaccaaaatccgctattaagtttgaga

SEQ ID NO: 8162 - DNA, 562 bp, Zea mays
  unsure (1)..(562): unsure at all n locations; Clone ID: LIB3279-173-P1-K6-G5
gttgcagtgcagngttctccaaactgccgtcagcatctgcatccatcaatagtggtttcctgcttaatgttgcatcacccggtgggcgcattggtactgagaataaggaaatgctcaaaactatagagcaaaacatgcctcagtacattcaagttctactagaggttggaattggggggggtatgctgcgttgtcttgactatgttgacatggaagatctagcaaataaggtgatccagctcgtggttgacaggtgttctgatcctgacaagcgcacacgaaagtttgcatgttttgccgttggaaatgctgcttatcataatgatatgctgtatgaagaattgagacggtccataccttaactcaccaccttacttcttggtcctgaggaggataaaaccaaaggcaacgctgcaggcgcgctcagtaatctagtgaggaactcagacatgctttgcgaagacattgtctcccaaggcgcaatttatgcgctgctgaagatggtgggcagttactctactgttgccctgagccccaggcgacgagattgctctaacctaat

SEQ ID NO: 8163 - DNA, 615 bp, Zea mays
  unsure (1)..(615): unsure at all n locations; Clone ID: LIB3279-173-P1-K6-G6
aaaaatngattctgtgtttcagtctcaggcacgaggcacaaagtaagaatgacagtagagaacatctcaaagaagtccgtagtagacagcacacgttcagtatcagcaatggatctaggtgatgcaagtggttcccacagcactcgcaaagaactactcggaagggaaacgggagcgacggactgtggaggaaaatacgcagtggcctcggggtcgcaagaccaagcgacaaccgaagaacactggaggtcagcgggaccgattcaggggttgccttcttcctccatttctcagtgcacacctccgaatcatccacggacggggaggaatacaatgacacaagaatcctcccggtccactactcggacaactacttttcgctgacgccgggggagaacatggccgtcgacatctcgttcgaggctccccagggatccagtcccagagttgtcctcagaggctggaaccatcatctggaccacgccgtgatgatatgagatccgtgtaataaaataagcacgtaccgaataaagtgcagacatcagatcgtgttcgtgcctgttgttgcattataattaggcttgccctaattttattttattttattaaataaat

SEQ ID NO: 8164 - DNA, 106 bp, Zea mays
  unsure (1)..(106): unsure at all n locations; Clone ID: LIB3279-173-P1-K6-G7
tccgcggnacgccgtggggcagtatactatatgcacgctttttaatcatgtgtgtcgcgtctgtcggtatgtatgtcgtctgggggaaaggaaattaagttatatg

SEQ ID NO: 8165 - DNA, 517 bp, Zea mays
  unsure (1)..(517): unsure at all n locations; Clone ID: LIB3279-173-P1-K6-G8
ccctagtcgtccgcccccgcgtccgcccgcgcgtccgcccacgcgtcctgataatgcatatttttaaaactagatgagtctgattatgcatagaagagataagacttattttatcgtggttgttagactgagaatggtggacaaatatatctgtacgtgacgcacgacacacggaggcttgatgggagctganactcaaataagatcattaacctctccgtgctattatcgaccccaaacatcttgtttgacttggatcccgaaggaattcgtactgttatcaccaccaaacatcttgtttgactttgctttgttgctgaagcgtccccaatcctctgggactcaaatgtgatacaattactagtctcaggaggctagtaaacacatttatacattagatgatttcagatctgcttaaacgagacaaacctataaaggtggcgatcaactttaagagttggtccacaactcgtgacatatcattagagtggggtctgaagcatctcgatatactcat

SEQ ID NO: 8166 - DNA, 627 bp, Zea mays
  unsure (1)..(627): unsure at all n locations; Clone ID: LIB3279-173-P1-K6-G9
tgntgatcagttgtttagcccagttttgggtccccaggntgggaccatgatattgggttcgatgccatcaattttgaagcatctcaagagttgaaaaagatgtctctgcggcaattacaggacagatgagaaaggacaaggaagacatgtatatccattcagaatgttcagtaagggagaatgctcagagaggctgctccttgatggggggtatggatatgcagacggcaagcaaagatttggtctgtactgttcatggggatgccaagttccacaatctgccttggaacagtattggaggtggcatttctgttactaagtttggcaacaagtactttgctggggctaagttagaagactctgttaccattgggagacgagttaaactggtagccaacgccggtaggatgtctggctgtgggcaggtggcacatggaggtggtgtggagattacagcaagggggaaagattaccctgtgagggaagggagtgtcactgccgcggtctctgctttgtcatttgaaaaggaaaccgtaattggggccaaccttcagtcagacttccgagtgggccgtggatcaaaaaatcagtcagcgctaacctaaatatagaaatttgggcaatctc

SEQ ID NO: 8167 - DNA, 624 bp, Zea mays
  unsure (1)..(624): unsure at all n locations; Clone ID: LIB3279-173-P1-K6-H1
cagnaggtcttgcccaggagcttgttcagntgtttgtttcagagcaaagttgaagaggctgctactcttggaatttctctcgattgctttaaaggaaggtgtagaactccagacatcattaaattggggtgatgaactatatgatggtgaatcaaataaacttcagagtattggccttcagtcaggagatgcctactcaccgcctgaaaattggtgtgcagaacgtttagggagtcagagacctggcaatctctctctgcacgaagttttacaggtttatttaaccacttggcatgctaatatgaacatcaaccggagtagaattggtgaaatattgagcttgttgaggaggagatgaggattaaactgtcttaaagattccgattcattttgttgggctattcatcaaggaagaagaaatgaaaaagaaagatcaatcagttcactattcaccaggattctatatccattgtctttatctgccttagtagaagccttgagagcttacctatgatcttagaatatagtactggtctccttgtaacccataatatttttttaaatttaatgttgggttacactggaaaaaaaaaataaattatgtacgatccccccctccccccc

SEQ ID NO: 8168 - DNA, 560 bp, Zea mays
  Clone ID: LIB3279-173-P1-K6-H10
ccgcggttcattctccagtaaggaagggttcgtactcatggcgccgccgcagccaagtcgggcctcttcgttggcatcaacaagggtcatgtcgtcaccaagcgcgagctgcctccccgcccgtgccacccgcaaggggaaatcaacgaagagggtgtctatggtcaggggcctgatcagagaggttgctgggtttgctccttatgagaagcgtatcactgagcttctgaaggttggcaaggacaagcgtgccctgaagcttgctaagagaaagcttggaactcacaagagggcaaagaagaagagagaggagatggcgggcgtcctcaggaagatgaggtcggctggtacgcacactgacaagaagaaatagagagcatttcaagttcatggagcctgccagagattatgttccagtgtctgattttccatacatgtagaacctaatagacatgtcaaagtattatgtatcgaaccagctcatgggattttgctccttccaatgcatccagggtttatgtatcgaaccagtttatgggatcttgctcctattccaatgc

SEQ ID NO: 8169 - DNA, 213 bp, Zea mays
  Clone ID: LIB3279-173-P1-K6-H11
caaaaaaaaaaaaaaaaaaaaaaaaaaaaaaaagggaaaaaaaaaaaaaaaaaaaaaaaaaaaaaaaaaaaaaaaacgtggcggaggctgtgcgtggtttcaagtgtcttcctagcttcctttgccttgccttacggttttactttcgtgctagcctgagggacacctctggtgtcccccatctttactggggggggggggggggttaaacct

SEQ ID NO: 8170 - DNA, 299 bp, Zea mays
  Clone ID: LIB3279-173-P1-K6-H12
gttgccgtaaccgccgccaggttgcgcacgccgtagacgacgtcactacaccgtagccgtcggctgcaccagcgtatatgtcatatatggatacatgatggcgatagctacaacgttctggtcaacggcatgaatggtttatacatggtctcgacgttgctcatctttgtgggggggggggggggtatacctataaatccttttctagcattgtggaaaaaaggtgatgctttccttgtgaatgatcttatggtgccttattatgttactctctatatctgttttcatttgcaaaatat

SEQ ID NO: 8171 - DNA, 400 bp, Zea mays
  unsure (1)..(400): unsure at all n locations; Clone ID: LIB3279-173-P1-K6-H2
tttcgcgccgccgccgcagccgcaacatgccgtcgncacagaaccttccgngacaagaagaactggcgaagaagagcgccagaaccgccccatcccctactggatccgcatgcgcactgacaataccatcaggtacaacgccaagcgcaggcactggcgccgcaccaagctcggcttctgagcgtcgggattggccggctgctgcgtcggaaggctagggtctaagagctatcttctgttttatcattgtctctgtttctgtaagctagcaagtgatgctgtgatgcttttattaagattctgatgagtggtgacgttaagagaaaattggcagtactgtgttgtaccccaagattccttgcagcattgctatgctaagtaacgaaccctttatcttatt

SEQ ID NO: 8172 - DNA, 599 bp, Zea mays
  unsure (1)..(599): unsure at all n locations; Clone ID: LIB3279-173-P1-K6-H3
ttccccaacccttactcccgntctcgntggcgnaccctcgcgtcttcttcgacatgaccgtcggcggcgccccggcgggccggatcgtgatggagctgtacgccaacgaggtgcccaagaccgcggagaacttccgcgcgctgtgcacgggcgagaagggcgtgggcaagtccgggaagccgctccactacaagggctccaccttccaccgcgtcatccccgagttcatgtgccagggcggcgacttcacccgcggcaacggcaccggcggcgagtccatctacggcgagaagttccccgacgagaagttcgtgcgcaagcacaccgcccccggtgtgctctccatggccaacgccgggcccaacaccaacggctcccagttcttcatctgcaccgtcgcgaccccttggctcgacggcaagcacgtcgtcttcggccaggtcgtcgagggcatggacgtcgtcaaggccatcgagaaggtgggcacccgcaacggctccacctccaaggtggtcaaggtcgctgactgcggacagctctcctagatctctctgatctggtctgttcggccgccctccctccgtcatcgtcgactcccc

SEQ ID NO: 8173 - DNA, 587 bp, Zea mays
  unsure (1)..(587): unsure at all n locations; Clone ID: LIB3279-173-P1-K6-H4
gntcaagttctgtttgagcttgctaggcatcatgcaccatccacaatattccttgatgaaatagatgctatcatcagccagcgtggtgaagctcgcagtgagcatgaagctagtcgtcgcttgaagactgagctacttattcagatggatggtttgacaaagacaaacgacttggtgatttgtacttgcagctacaaatcttccctgggaattggatgcagccatgctccgccggcttgagaagcggattcttgtaccgcttcctgaaggtgaagcaaggcaagcgatgtttgaggaacttctgccagcaactacctcaaagttagaaatcccgtacgacatactagttgaaaagactgaaggttactctggttcagatattcgtctcgtgtgcaaagaagctgccatgcaaccactgagacgtctcatgtcagttcttgaagccagtgacgagttggttccggaggaagaactgcctgaggttggccctctgaaacctgatgatattgaacttgcattaaagaacactaggccgtcagcacatcttcatgcgcatcgctatgagaagttcaaccaggactactgta

SEQ ID NO: 8174 - DNA, 605 bp, Zea mays
  unsure (1)..(605): unsure at all n locations; Clone ID: LIB3279-173-P1-K6-H5
ccctagcgtccgctctcggccgccgtctggnactgtacaagcggtgctgctgtccgccgcgctccggnaccatgcgggaggggatgaaggagagggacagaggtgggagcccagatgcctcgggccctcctcccttccgcggcccggcgtacaagacgaagctgtgcgctttatggagaggcaggggcggctgcccccgccccaactgcgggttcgcccacggcgaggctgagctccggaggccgccccctcgcgcctccttccagcctcgccctcggcctgggagaagggattacagagataatgactttagagttaggcctgagagaagacactcaccctatgggaggttttcccctgaaagagaatcaggcgtcgttcatttcgtgataagagacagagagcaagttctgaagataggggatctagtcattcaagatcacctattaggaagagtgagagaaaacatagcaaaagtcctgatggtggaaaaaccgattcatccgtaagttttagaagttcagataacgaagacaaaggaaaagatgaaaggtacttaagcagtgtatgagtaaaatggccgtgaagaacaattgaaacaaatg

SEQ ID NO: 8175 - DNA, 619 bp, Zea mays
  unsure (1)..(619): unsure at all n locations; Clone ID: LIB3279-173-P1-K6-H6
ccccgcgtccgtcaaatcgtgggtttgggtttgtcactatgagcactgttgaggaggctngagaggctgtggagatgttccatcgctatgatgtcaatggaaggcttctgactgtaaataaagcagctcctagaggctctcgtgtggacagacctcccagacaatctgggccttctctcagaatttatgttggcaacctgccttggcaagtggatgattctagattggtggagttgttcagcgagcatggtaaagtagttgatgccagagttgtctatgaccgagaaactgggcgttcacggggatttggttttgttactatggcatcgcaggacgaattggatgatgctattgctgcccttgatggacagagtttggatggccgtgccttgcgggtgaatgttgcagaggagcggccacggcgaggtttctaatgaggttgtatcgggtggactgcacgcttgttccatgggttgggagcatcatagcatgttctgatactggtttagaccttccattctctttccttgcgttgctgagcttctatcatcgtgtcttattgcgaagagggaactctttactaatatttcgttatgtactcgcgttcaaaagttcttga

SEQ ID NO: 8176 - DNA, 584 bp, Zea mays
  Clone ID: LIB3279-173-P1-K6-H7
gtcccacgtcctgtccactggcgtgtacactggctcaggacaatgctactgcacatgtcaagggtggtgccatagtaagttgttatctatgacccaagctaattgcacccatgtttgatgatgacatcaataacgacaattacacctttgttgttaacattagttccaatactaactgcatcacaaactttcttaatgccattgataacgtcattcatgacaactacggcattattacagctttgattacaactgttcatgccatcactgctacacacaaaactttagacagaccctgaaccaatgactggacaggtagctggaatatcatctttaacatcattcctagtagcaccggtgctgccaaagctgttgctaaagttattgctaatctgaatggcaagctcactggtatgtcctctcgtgatcctactgtggatgacttggatgttgacctcaccaacagaatctacaatgaggacttctataaagatatcaaggaatgctattaagggtgctttcaagggtatcactcaagatatcataggatatctggaagatgatctattttttaccgacttcct

SEQ ID NO: 8177 - DNA, 357 bp, Zea mays
  unsure (1)..(357): unsure at all n locations; Clone ID: LIB3279-173-P1-K6-H8
tccgccctcgcgtccgctctcggccgccgtctggcctgtagcaagcggtgctgctgtccgccgcgctccgtgaccatgcgggaggggatgaaggagagggacagaggtgggagcccagatgcctcgggccctcctcccttccgcggcccggcgtacaagacgaagctgtgcgctttatggagaggcaggggcggctgcccccgccccaactgcgggttcgcccacggcgaggctgagctccggaggccgncccctcgcgcctccttccagcctcgccctcggcctgggagaagggattacagagataatgactttagagttaggcctgagagaagacacttaccctatgggaggttt

SEQ ID NO: 8178 - DNA, 544 bp, Zea mays
  unsure (1)..(544): unsure at all n locations; Clone ID: LIB3279-173-P1-K6-H9
cgctttcctttcctttcctgcagnacagctgtaaatctcgcctagctcgtcgtcggagaccaaggnagaagagcaagggggggcgcagaggcagaggcttgccagcctacctagctcgtcggggccctatggagatccagcaccaccgggggctgggcaactccaaggttgtcaaggggcagagcgaggaggcgtgggatctgttcaccgatcaagcgagcaacgagggccggcccgttgttgcccatttcggggcgtcatggtgcgtgacgtccctgtccatgaactacaagtttgaggagctggcgcagacccaccccgaggtcttgttcctctacgtggacgtcgacgatgtccagagtgtttcatccaggtacggagtgaaggccatgcctacgttcttcctcatcaagagcaaggaggtggtggggaagatcgtcggggcgaacccagacgaggtgaagaagctggtggatgcttccgccgagcccttggagacttagatagtcgtggagtattagtcgtttcagacttttttttttga

SEQ ID NO: 8179 - DNA, 537 bp, Zea mays
  Clone ID: LIB3279-049-P1-K1-C4-F2A
gaataaataccatttatattcatgaatagatatcgtactagacaggattctgatgatatccatcacatgaaacacaacatgccatcacaagtcacataacacctggactctgagaacagcctaccaaacaaacggctgtctcaagcattcaaactttcttgactacccccacaagcaaacataaaacctagcgaatgtcaggctcgccttccattacattatactaacaaacactagcacgaagttatcttcgtttacttgatctccactgcggctgcgggtgggcgaagcgcgacccctccgaactgctcgctggaatacttcttgtatacagccctcagcttgctgtcagcggcggacgacgagtgtgcgctgaccagcatcttcgtgcactcgattagctctgcctctgactctctgaagcccgtgtggtgcttgagggtgtcggtccagaggggagccctcttgagagtgagcctggctgcgtaaacaaccgaagcagcgaccagcgaaagcagccgcgtcaccaagccgtac

SEQ ID NO: 8180 - DNA, 555 bp, Zea mays
  unsure (1)..(555): unsure at all n locations; Clone ID: LIB3279-049-P1-K1-C4-R2A
agcgtccgcccagccgaagggaagcctcagcagatcaatcgccccatcacgcgaagcttcggcgctcagctcgtgaagaacgtgcaggcgaatgccgcaatcaagaatgccgcaatcctacccgcgaggcatgcgccgaggcaggaaaggaaggctcctgccaagcagccgcctcctgaggatgtcatagtactcagctccgactctgaacagagcaggacgcagttggagagcagcgctagctccgtccgctcgaggaagaaggtcatcaacaccctttcatctgtgctctcggctcgctcaaaggctgcctgtggaatcactgataagagacggcaagtagtagtgatcgaagacatcgacaagttggacgtcaacaatgagctcgcagttgtggaatacattgaggacatctacacgttctacaagattgctcagcatgacagacggccatgtgattatatagacacccaagtcgagatcaaccctaagatgagggctatcctggctggtggataattgaagtacaccacaangtcgagctgatgccggaac

SEQ ID NO: 8181 - DNA, 630 bp, Zea mays
  unsure (1)..(630): unsure at all n locations; Clone ID: LIB3279-057-D9-F3B
gctgcggtggttcaaccagctggacccgcggatcaaccggcgcgccttctcggaggaggaggaggtgctttctcctggcggcgcaccgcgcgtacggcaacaagtgggctctcatcgcgcgcctcttcccgggccgcaccgacaacgccgtcaagaaccactggcacgtcctcatggcgcgcaggcagcgggagcactcgggcgcgctccgccgccgcaagccctcctcgacctcgccctcgccggcgccggcgccggcgccgcacctggcgcccgtcgtcgtcctccaccaccaccaccactacgccggcggctcccctcccatgccgccgttgcacgccgccgacgcccacacgcagtacacggcagcggcggcggcagcggacacccgcgcgcacagcggcggcgagtccgacgagaccgcctccacgtgcaccaccgacctctccctcgcttccgccgccccctgcttctaccagagtggctacgacgtggccccgcgcgccgcggcgttcgcaccgagcgcgcgctccgncttttccgcgccgtcggcgacggcgcgctccgacgacaaggtctcggtgccctttcttcgactttcttgggcgtcggcccggcgttgatgggggg

SEQ ID NO: 8182 - DNA, 455 bp, Zea mays
  Clone ID: LIB3279-057-D9-R4A
gccacttgttgccgtacgcgcggtgcgccgccaggagccgctcctcctcctcctccgagaaggcgcgccgtttgtatccgcgggtccagctggttgaaccaccgcaggcggcagctcttccctgatctgccgtccagcctctcggcgatgaggttccagttctggggcccgaactgcgcgacgagctccttgagcttggcgtcctcggcggggcgccagtggcccctggcgcacagcttcccctggccggcgccgccgtggccacggccgtcaccgctgccctcgtcgacatcgtccacgtggtacacctcctcggcggcgtcctgatgctgctcctcctcctcctcgtggcggaacgaagcgagagccggcggcggtgcagcaccgaagaaggcggccatcttgtccgggtccgaccgaggcggcttccaggagagaagatggggagaggagac

SEQ ID NO: 8183 - DNA, 403 bp, Zea mays
  unsure (1)..(403): unsure at all n locations; Clone ID: LIB3279-012-P1-K1-E8-M1
cggacgcgtggggttccgcgccgcggagaaggccgccgccgacaaggggcggcggctcatgctcatggacgccacggcggcgatgctcatgcggcccgacggccaccccagccgctacgggcactggcccaacgagaaggtgcagctctacaacgactgcatccactggtgcctcccgggacccatcgacatctggaacgacatgctcttccagatgctcctcgcctagcagcaagcagcaaagatttttaaaaaaaaaatctcagcaattcggccgccggtaaccgtgcacagattcgtcttgttttgtttttgccttgtttcgttttttttaaaagaagaaaatggtgcaattttgacagctngatgatgaggccgtcaagcttgaacgatataacaagaa

SEQ ID NO: 8184 - DNA, 361 bp, Zea mays
  Clone ID: LIB3279-012-P1-K1-E8-N1
gggcaaaattgcaccattttcttcttttaaaaaaaacgaaccagggcaaaaacaaaacaagacaaatctgggcacggttaccggcggccgaattgctgaaattttttttttaaaaaactttgctgcttgctgctaggcgaggagcatttggaaaagcatgtcgctccaaaggtagatgggtcccgggaggcaccagcggatgcacccgttgtaaagctgcaccttttggttgggccagtgcccggaccggctgggggggcctgtggcccgcatgaacatcgccgccggggcgtccatgaacatgagccgccgccccttgttgggggtggttttttccggggggcggaaccccacgcgtccg

SEQ ID NO: 8185 - DNA, 630 bp, Zea mays
  Clone ID: LIB3279-018-P1-K1-A4-M1
gttgctgcttgagcggctgcgcaacaagcggctcatgttcgtgggtgactcgctgaaccgcaaccagtgggagtccatggtgtgcctggtgcagtctgtggtgccctggggccacaagacgctgcacaagttcgtcaacaacggatcgctcaacgtgttcacggcgcatgattacaacgccaccgtggagttctactgggcgcccttcctggtggagtccaactcggatgacccgcaggcgcacagcgtcatgaaccgtgtcatcgcctggcgcgccatcgccaagcacgccaagaactggaagggcgtggactacctcgtcttcaactcatacatctggtggctcaacacattcgagatgaaagtcattcgccgtcatcagcatcagcttgaaaaggaggaggagggggtgaggtggagcaagtacgcccttgtggaccggccggtggcgtaccgggaggtgctcaagacgtgggccaggtgggtggaccgccacatcgaccccaaccgaacaagagtcttcttcatgggcatgtcgcccaaccacgtcacgccgtgggcgtggggtaacgacggcggcatcaagtgcgccatgggagacgcacccatcagcaacaaccggacggggcg

SEQ ID NO: 8186 - DNA, 649 bp, Zea mays
  Clone ID: LIB3279-018-P1-K1-A4-N1
gaaaaagtaattggtactgctagtcaaaattaaatcagggatgttttttatagaaattacaagagaagacctgcatgcatttgtcaaaatgaaacgaagatctacagcagcagcagtagtaataggtatccagggtgggtgggtggtctagggagaggagttgaaaggaagcgcttgacattgtgaggctgggcaaaaatggttagtgatcctgggcggacgaggagagcgagaggatgtgcgcgtagaggaagtggttccaggtgtcggggagtcccgggaggcaccagtggatgcagtcggcgtaggtcttggggtcggcctgctgctccggtgtgagcagcttcccctgccgcagcgtgtgcacggaggtgtgcgcgtccttgcgcagctccgacagccccgtgatgtcgacgaagtgcaccggcacgcggcggaggtagcgcgccagcaccccgcgcgccacgccgtgcaggcgccaatccgtgccgatgtccagtcgccccgtccggttgttgctgatgggctgcgtctccatggcgcacttgatgccgccgtcgttaccccacgcccacggcgtgacgtggttgggcgacatgcccatgaagaagactcttgttcggttggggtcgatgtggcggtccaccca

SEQ ID NO: 8187 - DNA, 653 bp, Zea mays
  Clone ID: LIB3279-179-Q1-N6-A3
aaatagcaagcggagagatacaactatattccacaacagggacatcaaatctaagaggaccattacaatccggcgcgccggatttatagagcaggcaagctagctactaggcgggtagggtgggggactggggaaaggacacagcaaagaacccttctaacagatccgcggatcccgcagcgcgctcagttgctggtgaacttggtgacggccttggttccctcggagacggcgtgcttggcgagctctccggggaggactaggcgcacggaggtctggatctcgcgggacgtgatggtgggcttcttgttgtaccgcgccagcttggcggcctcgccggccagcttctcaaagatgtcgttgatgaaggagttcatgatggacatggccttggaggatatgccgatgtcggggtgcacctgcttcagcaccttgaagatgtagatcttgtaggtctccacgctcttcttggccttcttcttccccttcttctcgccgccctccttgccggaggacttggacgcgggcagccgcttctcggccttgggcttcttccctgcggtcgtcttctccgccttctcctcggccgccggcttcttctccgctggcttcttctccgccttgggcgccatcgggtcggggatgtcggggtc

SEQ ID NO: 8188 - DNA, 574 bp, Zea mays
  unsure (1)..(574): unsure at all n locations; Clone ID: LIB3279-179-Q1-N6-A4
atggaagacacagttcaaatttaacaaagcaaacacagtaatgtgtactacacgacgttcaatatccagcatccatcaagaactgaacaagtntgcttgaatagctggaggcatacattatccctattagccagaaaacaaggagcattcagttacaacaaacagccctagacctaacgacggaatggttgctgcccaccaccggttgcaaagctaggggagccaccatacgtggctccaggtccgccatatggtacaccacctcgtctccccgacacgctcccagggacagagaatggtgatgcagctgctgggtttatatatccagcatgaggtgcgtngtttaaggaacgtgagactgggttctggaaacgcggaccaaagcttgagcccctagcagccttggcagcagggaagggatagggtccagctgcgccgcgggatcgcttgttcgggaatctgcttggaccagctgccttcttcctatcagacttctctttctccaactttcctaacttctttcttcagacctcttaatgaaacaccggttgttgctggcaggactcggcgcacc

SEQ ID NO: 8189 - DNA, 633 bp, Zea mays
  Clone ID: LIB3279-179-Q1-N6-A5
gttgctcttgaggaaagcaagttattcataaacgacaaataacttgagcaaatcgcttacaaatgataatcagataagtagagtcaacaagacaaaactgtatctggcaacgcacatcgcctcaccccagccgactacaccattattcttcagcaaaagcaaacagctccttccctcccccctcagctcaagcgataaccataagaaaacctgctacgcgactgcgtatatgataatgcatatgcatgcaaaagataactgacaggccagtgtagcgaacttcatagcacacaacggcccgagtgagctgcaagccgtgtgcctagtaccggtagtgggcaggcttgtagggaccctcgatcggcacgctgatgtagtcggcctgagacttggtgagcttggtcagcttggcaccaagcttgcccaagtggagagcagcaaccttctcatcaaggtgcttggggagcacatacaccttcttctcatacttgccagagctcttctccttccacagttcaagttgggcaatgacctggttagtgaatgagcaggacatgacaaagctaggatggccagtagcacacccaaggttcatcaggcgaccctcagcaggacatgatgccagtgttggtc

SEQ ID NO: 8190 - DNA, 448 bp, Zea mays
  unsure (1)..(448): unsure at all n locations; Clone ID: LIB3279-179-Q1-N6-A7
cttaagacaatgcaaactggcccaactcccacggaccagtaatctgttttgcacacgaaaatcatcgttctgaaaccaaccaggttttaacagcagacagtngtttcactagaagtggacaccacatcactttcttatgtgggttaacataggacaggacgcatgactgacgggaagataacacggaatgaacaccctcaacacaaggaacgccccctggccaaaccagcactggttgctaagttcaggcctttcacttcttcagatgggggaagcactggtacacgtctgtcttgggatgcttggcctcggcgtgctccctgcacttcacttcagtcgtggttcacatgattgtttgcttgcncactttgcactggatgctcatggccttcttgttggtctcgagctggctccccttggcccccttgttcttctccaagttgcgctc

SEQ ID NO: 8191 - DNA, 618 bp, Zea mays
  unsure (1)..(618): unsure at all n locations; Clone ID: LIB3279-179-Q1-N6-A8
acttctctcagtacgcataaatgcatattagggctaaatgacatggaggtggaaaaactacagcatatctacagtttacgggccaaacaatggttgacaaacatggccttcgattatggaaaaatgaatagtcacctcagaataatatctgctccaaacatcttcattaactttgaagaaatctgatacctcagcagccaatgctcccagaattagagccaaatgcagctattagaattcgagcaacgagcaatggccatcatggaaccatatcatggcgttattgtgatcccaatatacccaaaaaattaccataggcagatagcagcagatgattgtataaactcagctacccagcttgaaggcatccacaaaaaggcccaggcatacaccggctttccagtagttcaccattgaaatcaaagattggaacctaccaggaggcctggcaattggttttctgtacatgagcatgccaattccctcaatggcagccactacaacaccagcaacaagaacatcccagtcaccggtctgccctagtattgttgccaaggcattggctgtgtaaaaaaccaagaggacaagnaatatctttgttggcgaattggttctcgc

SEQ ID NO: 8192 - DNA, 447 bp, Zea mays
  Clone ID: LIB3279-179-Q1-N6-A9
ggaaaaaattttaaaaaaaaagtttttttgggggggggaaaaaaatttttttaaatgtttccccccggccccctaaagggggggcccccccaaaaagagggggggaaaattttaattttacccgccaggggggaaaaaaaacttaaaaaaattttaaaatttccccgggccaaaaaaaaaaaattttccccggggggggggaatcccctccttgggggggggggaaaaaaacccgggggaaaggggattttgtttaaaaccctaaaaaaagggggaaaaaaaacccccccttggtgggattctcccaaaggtttttaaaaaaaaaaacaaaagggggggggaaacccaaaaaaaatcctggggggacccccccccccgtttaaaaaaaaaattttggggaaaaaaaaaaaaagggggcccccccccacgggggaaaaaattcctttc

SEQ ID NO: 8193 - DNA, 543 bp, Zea mays
  Clone ID: LIB3279-179-Q1-N6-B1
ttttgaaacaaggcatttcttcttccattctaaatagcaaaggacaacttgcagcaggacacatacacatacaagcacattcgtcccatctgcagcctacgcatcaccgtatactggtaacaaggtactgctaaacatcagatcactccggacagtcagtctatgccttcttaggggacttggcggccttcttgggcgactttgcctccttgctcccgccactggacgccttctccgccgtcttcttgggcagcagaacagggttgatattggggagcacaccgccgtgagcgatggtcacgccgcccaacagcttcccaagctcctcgtcgttccggatcgccagaagcacgtggcgcggaataatgcgagtcttcttgttgtccctggcagcattaccggcgagctccagaacctcagcggcgaggtattcgaggacagcggcgaggtagacgggggcgccggtgccgacacgctgcgcgtagcggcccttcttcaagtagcgcccgatgcggccgacggggaactggagaccggccttta

SEQ ID NO: 8194 - DNA, 535 bp, Zea mays
  Clone ID: LIB3279-179-Q1-N6-B2
aatgcgaagcgcgaagttgaacaggtctaaccatgctacttagtctcacacatatctagatcaacaattcaagcatagctccaggagtgaggtgttcactactaattcctcttgtttttggtagaagctaagcattatcggtggcgattagacaagcacatatctattcaattgttatggagcctgaataacaacagactaattagcgacgctggatgtaacacaggacaacacacccaattggttcctttagattgctgttcattatacaagagggtggataggcaataccctggccgctcattcgctggagcccggtccgggcgtctaggacccgattccgtacttatactggagcctggagatctaactctacttcttcttgaatcctacttcttggacatcttgccgggctggtagttgagcacgatgaggaagagcttggcgacgtttaatccggataggtggtcatacggcgattattggcgtcctagatgtccttgtagacaacgaaagcggcatcgtgcgtgttctt

SEQ ID NO: 8195 - DNA, 532 bp, Zea mays
  Clone ID: LIB3279-179-Q1-N6-B4
acacgagatatgactcgcacaaaagatccaaacccccctgaaaatatgagcttacaacaaatcctaaaagctccagcaggagcaataatgcaagataacatcacaatcaaaagagaccaggtttttgatgtcgagttcccatgactacaccacctaaaccgaccactactagacattacctcctgcatgatactgatgggtactcaaaagggacatggcaaagtacagcttgggggcctgatatttaacttcaattcatagataacggggacgggtcctcacttggccatcatgaccttgacgaactcctcgtagttgatctggccggcgccgtcaacatcggcctcacggatcatctcgtcgacctcctcgtcagtcagcttctcgccgaggttggtcatgacatggcggagctcagcagccgagatgaaaccattctggtccttgtcgaagacgcgaaaggcctccttaagctcctcctcggagtcggggtccttcatcttccttgccatcaggttcaggaactctggga

SEQ ID NO: 8196 - DNA, 283 bp, Zea mays
  Clone ID: LIB3279-179-Q1-N6-B5
acctctggttctttcttgggaggcagcaggaagttctcctcgacgagcaccttgggcctggccaaggcgacggccaccggtgcctggtggaggctgagcggcggcaggccgacgcgcaggtcaaggctcagagaaggctggctgctgatccatggatccatctgctggcgcccccacttattccctttcccctcgatgtccgtccgagctaggccggagtgaagacgcgcttgagagcgagaggaggaggaagaagaggagcaggagagtagggatgtttgag

SEQ ID NO: 8197 - DNA, 527 bp, Zea mays
  Clone ID: LIB3279-179-Q1-N6-B6
cagggttcatgattttccatgcactatcagatctgaacttgagtttctgaaaacataaaagcctgttctttttttttcctcccccaccacacacaacacaattgcaacaacaaaggcacgatgcacgcttcacctgcgttttcctccgtttaaaaaaaaacgagatgtgtcacgggtaggtacacagttactactaacacacaacagcaaaagaacgcatgatcagtcttttactcctactttttttacagctccatccctggacccagctggccgttttgaacagttcatggagacgtagcaaagcaccaatcctaatccggaatcaaacggacgaatgctaaacctccctccgaccaatgcaagtcgatacttacagttccactctccacaaatccgttgctcggggagtcggaaaataggggtgggctctaagcctaagcggggggagagcacaccgcctcgaccgccacccttttggtcacgctcgggcaggggtctccaccgaagttgtcgggggagatggc

SEQ ID NO: 8198 - DNA, 629 bp, Zea mays
  unsure (1)..(629): unsure at all n locations; Clone ID: LIB3279-179-Q1-N6-B7
agattagtgacatggtatacatacatgtgagtaaattatttttagtactcagaaaaaaagaaagcaaatgctcaaacaaaaccagaaacacttcctaacaagattacaagaaacacgctcccgattacagcactgtcactgtgacaagattattaccgcatgctgtgccagcggctcagtccgctgcactgcagtacatggacaaaaaaaaaacggggcgagtctgatacatacattttattcattggtgagatgcaacaggaagtagaactatagaacaagaggcttgaatgaaaatttgtgtaagcgcctcaactcattgtaaatcactcttcaaaaatttatgtgataacggtgggggcagagcggccagtgtactcttgcatcttggagagcttgagcgcaacatcaaccagtggagcaagggcctcctgtgaatccctgccggtcttggaggaatccttctcgtattgctcgatgtagacacggatggtggcaccaacagaaccggttccggatagacggaacaccagtcgtgaaccatctccgaagaggtatcggatgccctggtgcttggcacangagcctcaactggatccttgtactcaaactcgtcagctgcaactact

SEQ ID NO: 8199 - DNA, 231 bp, Zea mays
  Clone ID: LIB3279-179-Q1-N6-B8
acagagacaacagcatatacctttttttttaacaaaactttgtttgaagaaaagttccatgtgaagtacacaaggtcgaaaatggtgtcaacaaagatgttcgaccacgaaactacatttttcagcacctccttaggcatctatctttctgcagaagtcacttgtgaagggctaccctcaaatgcctcattctagatcctccaaggattaactagtctgcggacgcgtggg

SEQ ID NO: 8200 - DNA, 627 bp, Zea mays
  Clone ID: LIB3279-179-Q1-N6-B9
tttgggcagctttctatccggttccattaaactccgtgagttcgggtatcactatctggtgtagtacagctaaattcaacagcatggcacgcatacaacagcgaatgcatgcaagggttctcaagacttcctacgagggttcaaaggtatacgggccgtagtctcccataccatgcgaatttcccctgatgaagatctcaacacattacacatcggaagggtgatctagccccacccaccttaccctaactactccttgcataacgcagcgactatgttaaacctgatgttatcgacagtagttaacatcgtgatcagtaactacatgactacggcagatgcaaaggacctcttcccgagtgaactcaaaccgagaactgaccagccggagctcgcgttgtaaacttcaacggtagctaggatctgcacattggactccaggccaccgattaagtacgcgcttccatccagagtaactgcagcggcgtaccctcttggggcgctcatgggatctcccatcctccaggcgttgagccgagggtcgaagatctcaacgctagaaaccatcttgtctccattgtatccgcccattgcatataggctttctccaaggacagtaagggcatg

SEQ ID NO: 8201 - DNA, 576 bp, Zea mays
  Clone ID: LIB3279-179-Q1-N6-C1
acgcgtagtaactttttcctctagacggccgcctttttttttttttttggttgaaaagccagcgggcacatattaagacaggagttttactacatacgaagaagtccaccaaaggggcactctctcatacgaattaccatcacagaagcactagtttttttatatttgaggcgaggcgtcctcttatttaggcgaatactacattacggcatcactgatctacgaggccatgtgtagttcaagcttccttgctagctcttcctttgctgcgccaacgaccctgtccttgacgtcgccctccctcatgaacaggaatgttggcatggcctctacgctgaattgctcagcaatggtcttcatttcatcgacatcaactttcaggaaaacaacatttggggacttcttggccatatcagcaaaaattggagccatggcgcggctcggtggacaccatgttgcagtgaagtcaatcaccaccagcttcttggcgctgttggcctcctcgatctggatgctccactcctccaggctgtggatcgcgattaccgtcccctctgtcggcgtccccggtgttgc

SEQ ID NO: 8202 - DNA, 265 bp, Zea mays
  Clone ID: LIB3279-179-Q1-N6-C2
gctgcgatcctatatttattgataaataaaagcatttaaaaatagaaactgtcacatatctctttcctaaatttacgtgcatgcagggaaacatatttgactcatgcatgcattcatacacagtgtttctcttcctaaatttacgtgcagccggagtcattgactttgtcgtcccttggctcgttgaagatggactccttctcattgtcgttgaccaccatcccctttcccttaggatccatatcttcgggcgattagtctcttt

SEQ ID NO: 8203 - DNA, 423 bp, Zea mays
  unsure (1)..(423): unsure at all n locations; Clone ID: LIB3279-179-Q1-N6-C3
gggggggggggggggggtcttcctcgnctttgcggccgncgcggggggggggggtggtttctggcccgggggcgtggggttttttggggcggttcggggggggcggtgggggggggcgggggctgggtctggggggggggctttgggttttgttttggggggcgttggggtttccctgggtttttgggggggggtttggggggtgggccctttttttttttggggtggttgtttgggggttgggggggtgggtggcgtgggtggttggtgggggggnttgggtggtggttggggttggctttgccttcgggggcggtggcgtgttgggtggggggggggggggcttngggggggggttttttcttttttttgtgtggggcgcttgctggtttttntggggggggggggggggggggggttttt

SEQ ID NO: 8204 - DNA, 450 bp, Zea mays
  Clone ID: LIB3279-179-Q1-N6-C4
ggagtatcacaaaacattgtgagcgctcaaccagtatcgagttgttgataaggtgacgacatcaaatatcttccaaaattcaaaccgggacaacagattgagctactacatctcgtacatgagcgtggactcaatttctgtcgcctgaccaaacacaactgttgacactatgctcgatggcgacgaagaacggccacaattgtgtgttatagaccttgaatacacggcctgttcctcatgccactagccttgtacaacttgcttcccttgtaactcacatacggctaggtgtggcttgagaagcactccaggagccttggcaaagtgcctcactgcctcacaggcattcttggggcccctaaagaagacctttttcttggcatgtggagcacgaagagcaagctggtgaaatgtgagggactcaccctcacgacgtgtcggacgcatggg

SEQ ID NO: 8205 - DNA, 629 bp, Zea mays
  unsure (1)..(629): unsure at all n locations; Clone ID: LIB3279-179-Q1-N6-C5
ctgaaatcagggaatcacgtttcaaccacaatgcacagatctactaaccagttccaataacaacgacgacactacagaagtaaagatctactgaacacgagcattcaacatcacagcggtaaaggcgcccctctatgccttcttgggggacttagcggccttcttgggcgacttggcctccttggccgccgccttctcagcggtcttcttgggcaggagcaccgggttgatgttggggaggacgccgccgtgggcgatggtgacgccggacagcagcttgccgagctcctcgtcgttgcggatggccaggagcacgtggcgcgggatgatgcgggtcttcttgttgtccttggcagcgttgccggccagctccagcacctcggcggccaggtactcgaggacggcggccaggtagacgggggcgcccgtgccgacgcgctgcgcgtaccggcccttcttcagataccgcccgatgcggccgacggggaactgcagcccggccttgacggacctcgtcaccgacttcttcctcggcccgccggccttgcgcccggccgcgcccttcttcgccttcccgccggctcctgctgcgctggcgtccatggccgnctgactgctgctgctgcgct

SEQ ID NO: 8206 - DNA, 596 bp, Zea mays
  Clone ID: LIB3279-179-Q1-N6-C6
cattagaagaattgcattggctcaaactgtcaaaacctgacatacaatcgtgtcgtaacggtccctgagaaatacaacccttgcggacgacggtacaaggatcgtcctgctgtggcaaaactcgttccttattcgcaagttacgtgttgctgcagcgtttacacaccgcaggaatcaaatccgccagaaataactacacctccagcctactccacaatgctgttgtgatccaaaattctacatctacatttggtcccagtcaataaaattgttgttctcaaaattataaaaaggttgctgcaaacggttgcggcccaatctgctcattgtggcgaggccttcgatcactttgtaaagtgaagaccaccatcgatcagctgggacctgatactgagttagagattcatcgatttcagtattgtgcttcccttccagtacgctttgcagagtgattacagcatcctttgttctcctcagaatattatttccctcggcagcttctaatgcaaggaggtcactatgtgatgatgtgaggcttctagcaagcgcaaactgggcagcttcagcccatcggttagatgcaacccatctccttt

SEQ ID NO: 8207 - DNA, 426 bp, Zea mays
  Clone ID: LIB3279-179-Q1-N6-C7
ggggccccaaaaacaataaattacaattattcattttctcaaggccaactttttttttagttctaggagctggatcgatctttgggggggggcaggccgtaatccccccgagaaaagggaaacgtttaggggggggcttgattagccgcctcagcatagcgcgcgcaaaagccttctccttccttcaatatacccggagagaggcctcgttttcatcttcggcttcttcctccttttcggggtcgtcgggccgaaaaaaactggggcaaaaaaccaaatcgacggtgccgggtttgattagtccaatagcttgccgcgcgcgcgctagctgtttattctcagaactggccgccctctgaggtttggctgaactggcagccaggggggacggcgcccttgctggtgaccgggcggccttcgctgggg

SEQ ID NO: 8208 - DNA, 543 bp, Zea mays
  Clone ID: LIB3279-179-Q1-N6-C8
gaatgaacaaacctacattaaagcagcagaaacgatgtttcaaacgcgaactttgttacggagtacacattggtacaaaaatttaaaaatatcatgcacattccaggggtgcaggaacccatagaatcgagtaaataatacaatcaatatatatataaccaaactacatacttcatacaggggacgggtgactccacaatgttaccggatatattggcaaacacaaaaactgcgagctatagcagagcaaccacccatagatatgtcatcaaacgaaggtatttccagaggagaattaaggctaggggacgtctagaagcacttcctgtggacaatagctggaccagactcctcatactcagcccttgagatccacatttgctgaaatgtgctcagggatgcaaggattgatcctccgatccagacactgtacttcctctctgggggagcgacgaccttgatcttcatgctgcttggcgcgagcgcagtgatctccttgctcatgcggtcggcgatgccagggaacatggtggatccaccact

SEQ ID NO: 8209 - DNA, 575 bp, Zea mays
  Clone ID: LIB3279-179-Q1-N6-C9
gcaattagcaaggaaaatgcatggatgtactagataaaccgttccagatggcagcagggacaagaacattgcggatctacactaaacatgatctagtctaactgcacggccgctaatggtaatattgttctaagacaggagatcactctacgccttcttgggggacttggcggccttcttgggctccttggccgccttctcggccaccttcttggggaggagcacagtgtggatgttggggaggacgccgccgtgggcgatggtgacgccggccagcagcttgccgagctcctcgtcgttgcggatggcgaggagcacgtggcgcgggatgatgcgcgtcttcttgttgtcccttgccgcgttgccggcgagctcgagcacctcggccgcgaggtactccaggacggcggcgaggtagacgggggcacccgtgcctacacgctgcgcgtaccggccctttttgaggtaccgcccgacgcggctgacggggaactgcagcccggccctggaggaccgcgacaccgacttcttcgtcggcccgccggccttgcgcccggccgcgcccttcttcgcct

SEQ ID NO: 8210 - DNA, 578 bp, Zea mays
  Clone ID: LIB3279-179-Q1-N6-D1
agttcgaaacatcaaaactgcatgcatattcatcgacgatccaactttctaatataaaataaggacagcacaagaagtcacttagagcacagggtactatcaatgagcttgatcgtgaacctaattcatccttttgatgagctcattgatgtagttctcgcggttaccggcatcgccgccctccacatagtggttcctcttcttcttcaggcctcccagcggcgccttcaacttgaatggccagaggaagttgttggcctccttgaagtgtgggccaacagtcatgatctcgtgaacaagatcctcaatgcagatgatgttgtgcttgcccaagccctcctcgatgacttggttgttggacagagggatcctctgcttgttcagctttccatagcccctcttgtagatcaactccctgacactcttcaagtttgggtacccatatgcaacatatggctcaaccctgcgtagcatgttaatagtcgccttgttgactttgaggaacacaccattgaagatctgcctcaatcgcagaagctgcaagatcttcctggtcttagggtgcatggcgttaatac

SEQ ID NO: 8211 - DNA, 544 bp, Zea mays
  Clone ID: LIB3279-179-Q1-N6-D2
gcccaggaatcatttcaattatcgaacgataagattggattacattcgaaacaacttcaagaatactactaacaatagtccaacacgtcacagacaaggaactaaacgaaataaccctaacaacaaacaggcatccacgacagcaaggagaagaggcatccagcctagcctccgaagccgtagagggttcggccctggcgcttgagcgcgtagacgacgtccatggcggtaacagtcttgcggcgtgcgtgctcggtgtaggtgacggcgtcgcggatgacgttctcgaggaagatcttgaggacgccgcgggtctcctcgtagataagccccgaaatgcgcttcacgccgcccctccgagccagcctacggatcgcgggcttggtgatgccctggatgttgtcacggagcaccttacggtggcgctttgctccgcccttgcccagacctttgccgcccttgccgcgccccgacatcgtcgctgccggtgccctgtctttcacgctctcctcgcctcgaagaaaagggggatttttttgactag

SEQ ID NO: 8212 - DNA, 501 bp, Zea mays
  Clone ID: LIB3279-179-Q1-N6-D3
caaagggaaacaaaaccccaaaaaaagggcccaaaaaagcaaaatggccaaaaacaaacaaacatgttgggaaaaggaaatttcaaggaaaatccccaacaaagtttttattcaaggcaagctttacaaaccaaaggaaaaaccaaatccccgggaggaaaaaaacaaccaacaaaatggggggcgaggggatccacccaaccccagtcccccagctgaataatgaaagcatcgacccacggatatcctggggggccatttttccatgcaaaaaaaaaatcttcgttccccccccacggaatctggttgcaaatttggtcccctttccccccacaaaaataaggggtcccaaaaaacactgggaaaaaaaagtctccccacaaaaactgtcctgtaaaaaaaacagggggttttgtttggtttttgacccccctgggcacatcctggaagccgggggaaaaatatcgggaaaaaggcccccaactttaaattggggaaaaa

SEQ ID NO: 8213 - DNA, 617 bp, Zea mays
  Clone ID: LIB3279-179-Q1-N6-D4
ggcaaaaaaaatagttgcacaataccaaactatatacctggttgaggaccagaataatcgcactggaacatccggacatacttgtacgctggtgcaacataggatcgtcgtggctaacaactagataaaatacgagtgagtgggtagtaccggggcatgcaatgcatagatttcaggcatgccactacacataaaccaaaacagtcaggctccacggttctttgttgatctgtcgacaaaaaattcccccgaggcaagatatcatgcgtcaattccgggaccagggtaagctgggagactcattatcctcttgtcaagcacaggagcgcccactgtaaaatggtacaggctctgaaagtccaaacctttcaagccaagtgcctcgtgaacagtatcatcaaagtagcatccgattcctgtggcagatatttcaatagcatgggcctcaaggtaaagcacttgaccaagaatgccagcctcccagaacaaacgaggatacatccattcacctttctcatgcaacacaggctcgaatctagcaatcatcccaaggctaaaacatccatgcgaggcaatttcctgaaacatgatatctgcatagcaaacttctggcaatc

SEQ ID NO: 8214 - DNA, 630 bp, Zea mays
  Clone ID: LIB3279-179-Q1-N6-D5
aaataagtaccattcaatatatcataaataaacattgtcaaacaatgcatacataagtgtactctaaatctaaactaaaatacaactgtttgcactaatgttaagcctaactttatatgaattaaagtctccacacttttgcgaccaccaaatttgaattctattctatgttttcctgtacaacaaataggagaaaactagacatagcaaaaagctccaagcagcacgtggatggtctcaaagctgcccttgtgcttctccctgttcttgatgactcctacacgcccggtgttcctcccgccagtcaccatgaccacgttgccgacgtcaaacttgatgaagtccatgatcttgttcgtctccagattgatcttgaccaacgcctccattgcttcgtatagttgcagatacactttcttttcttccatctttttagctctttcctgccttctcgtatcagcttcgacaagagactcgagcagctcctgttcctgaagtgccagatttagcaatcgttccaaggttcttaataagatcttccttggtcataccaatacccctatcccgaatggagaggattttcttctctttgtccaacttaatctgaatctcaagctttgcagtgtcccc

SEQ ID NO: 8215 - DNA, 458 bp, Zea mays
  Clone ID: LIB3279-179-Q1-N6-D6
atatgcacaaaagcctcacaattagaaaaacagtcacaactggatcatttaccgatagcttgccagagcattcacaaaagccccagagatgaccaggcacaaaagccccacagggacatcactccagcgggaagcaggtcaaaagcccacaactacatcactaagggttcatatcaccctaggggtggggcaaaagcccacaactacatcactttagctggtccagagctggtcaggcacaaaagccccaaagctaccctaatgcttcaagcaggtcaaaagccttcaaacaaccaccccagctttttggatccccctggtttaagggacaagctttcattggccaaaacacccatctgaagggctaggctcccaaaagtaccctccacgagattcaggcgagcacggacatcaaaaatgatggggcattcaaaccacggaatcataaaggggggccc

SEQ ID NO: 8216 - DNA, 643 bp, Zea mays
  unsure (1)..(643): unsure at all n locations; Clone ID: LIB3279-179-Q1-N6-D8
cgaatataaaaatactatgttctcgcggaaatgcacaaacaacacgaacatgcaagacttgtagcaacttgttatgatgatgcaggataaaacagattgatggattctctttcctctcaacataagctgagctactcaaaacttaactacccttgccgctcactgagtcacgccgagccactttgagaagttctcaaactcggtgtagtcgctgtccgagaccatggtcttgtaccatgccttgccagcagccttaaccttggcagtctccggggtaagcttggtcctcttggagtcgagcttcgccttcctggccttcacacgagcagcctcagcaagggtggccatcttccgggcagtgccgaggtaggggttgagtttgagcacagcagccatgttcttgagtgggttcttcctcttctccctgcgcttcacctccttgttgagtggcttcaccacagactgcacctcgtcagagttgatgatcctgcccaggtcagcgttggacatcttaggcctcggcagcacgaagcccttcttcttctgcgacggngcgtcatagctcccatacacctcctcgagcttattgaacgcgctctgggtccagatcacaaagcgcccaagtggccaccgggggcaaggt

SEQ ID NO: 8217 - DNA, 599 bp, Zea mays
  Clone ID: LIB3279-179-Q1-N6-D9
aatgacaagcatgataagttgacattataaatggtatagttgcaaacacgagcacttgcgagattagacacggatataagaagccaacgacggcatcacacgattacaggcgaacacaccaatcagcacaaacatcaccaagggcgttattctagtcactcagtgcagatgcagcctactgctagcagggcactgaacatcaccatcccgtcgtatggattctggtaagggaacagtatcccttcattcgatcttgtcgcagtcgatgtcgggggtgatgttgtaggacagcgagaggccgcagtcgccgggcagctcctgcgccgcggagagcacagcgtggacctgaacgtaggccgccttgaggcaccggcacgtggcctgcctgtcgggcctggtgtccgccgccgcgtacagggtcctcacgccgtcgcagcactggttgttgctctcgctgggtttggctgccttgccctgcaggaagggcaggcacggcgacaggtcgttgagcacgtcggagcacgagatgtcggccaccgcggactggactgccagcatcgccaccaggaggacgactgcaatgcccgagctagtagtct

SEQ ID NO: 8218 - DNA, 583 bp, Zea mays
  Clone ID: LIB3279-179-Q1-N6-E3
agcagaagactcggatacatactagtacaaaagaatgcaaaccactactgtttcagacaaggaaatagctttcagacagatcactcgtctcgagctgaggtatcatcctcccaagagtgagatccatttactaacagcaccagcagcacatatatttgtagtatatgccagaaaggaagaaaacaagaaaagaaaaaaatagaaggccaaaaatggaacatgaacaggaacaggattgccttccaaccctagtagtagtatggtatctgcctaccaagctggattctgtatagcgccgtagtacaccagtaacagaacagcctttcacgccttggagtacttcgagctccacattggcaccttcagaggctcgtcgtcggtggcactgcccccgttttcagcggcgctcagggaatccaagatcagagggctcgattcaccctcctttgcctggatggcttgcggggaggcctctgccggcttctgctgagtctctctagtgcagaagtacgagtacagaaccatcccgatcaccgcgatcaggattccaagtatgtttctccagctaaacgggtcgtggagc

SEQ ID NO: 8219 - DNA, 362 bp, Zea mays
  unsure (1)..(362): unsure at all n locations; Clone ID: LIB3279-179-Q1-N6-E4
gcacagcgggagccnaggcaaaaaaaaaaggcagcggnnnnacaccannnnncccangggcaancccngggcggcaccaanaacaanaggagacccnaagggcngcancagcggaggagcaaaagnnncaannaagggcancgnnnncccgggaaccgggcaagaacagnnccacccaaagggggaccaggaagnccaaccacagccggggggagggggaananaanngggccagannananaancnaaccgagggggaaccaacaccgaggncaaaagaagaaaggggananaancggggcaggggaaanccnaaacaccaggcccncaancacagagaggggcagagccaagcgaccacg

SEQ ID NO: 8220 - DNA, 641 bp, Zea mays
  unsure (1)..(641): unsure at all n locations; Clone ID: LIB3279-179-Q1-N6-E5
aaaattgcaacagaattgaacatatccaaacatagcagttatgtaaaggctgataataccacaagataaaatggaccatccatgacacagagtcagcacaggggactctgcgtcagatcacacagctaagcactcatcattcgaacaagttcaagaaaactagataatattattatattggtgtaacactacttgtccatcctcactcctcatcctcatcaccagcatccccgccaccgcttgccttcttctgattctttctcttcacccttcctgcggggcctccaccgaatgggcttgacagtgaaaagtcaatgtgcttctcagactccaccctcaccatgaatgatgggacgttgacaatttgcctgccaaccctgatgtgacgctgcttgatcaagacacgagcatggtgaatggacttggccatgccagccttgaagacaagtgtttgaagccgccttgcgaggaagttctcagcggtgagggcaagaacataatcaagcttgttctgaccctcagcaagcagcccatagcggttcatgcggcgaaagagtgcctcaccctcaaagaacgacggnggttcttctcgtcaaggtgagcaagtgccttgcacattacggatcctgctcatgcatact

SEQ ID NO: 8221 - DNA, 626 bp, Zea mays
  Clone ID: LIB3279-179-Q1-N6-E7
gcgaacaaaaaccttgctcattcttctctcgtctcgtttcatagcgggagcaaccaaagggaacaacaggggtaccaacacctaatccaaaggtagaacggacactaacacggtgacagaagcgaacggtaacacgatactatagatagataagataactcggccgaagccaggatgggcccacacatcagtccctccagccgccgccgccgccgccgtagccgccaccaccaccctcgcgccgaccgccgtagccgccaccgcctccgtagccgccgccaccaccctcgcgccgaccgccgtagccgccaccgccgccataaccgccgtcacggcgcccgccaccatagccgccgccgccgcgaccgccgccgtagccaccgccgccaccgccaccgccacgggactgggcctggttaacggtgatgttacggccgtcgagctccttgccgttcatgttctcgatagcgtcgagcatggagttctcggaggagaaggtaacgaagccgaagccgcgagacctccccgtctcccggtcggtgatgaccttggagtcgaggatcctcgccgtagaggcgaaagcattcttcagcgactcgttgctgttgggccaggcaagcccgccg

SEQ ID NO: 8222 - DNA, 357 bp, Zea mays
  unsure (1)..(357): unsure at all n locations; Clone ID: LIB3279-179-Q1-N6-E8
tcccgagaactttgnnccaagattaaaaagacaatgcaattctgtgaagccaggcataggaaaagtattcgacgaaggaaatgnccacgttgcagatgtcaaaagaatgaaatctcccattatctcctcactcctcagaatcagaatcggaacatcgtctgtaacttgtcctttattattcagctgtctcattatcatcaaacatatgagtttccaccagtacatatggaatacaagcaatgtgagaagcattgtgttcaagatgtagtacaaagttgttgggaattcatccagcttcctcaagatgtgatggaatgatagctagaggctttgattatccaaaatgggaagtaaatc

SEQ ID NO: 8223 - DNA, 569 bp, Zea mays
  Clone ID: LIB3279-179-Q1-N6-E9
ggcaaaaagtgcaatcgtctgtaaggatagatatgaaaacaaaattatactcagtaacaggggtaccaatatgatagatactactgctccatttaagtttcaacctcagacagatctaaatgagatacaatttgagtaaccaacatctgaatgcttgataggttggcggataaagcaaatcggggcaagcaattacgccttctggttgtagacataggtgaggccgcacttgccgcagtagtggcggtcgaagtggttggccatgaagacgcccgcgccgcactctgtgttggggcactccttgcggaggcgggtcaccttgccagtggcgtcgtccaccttatagaactgcagcacggagagcttcaccttcttgtgcttgtgcttgatcttcttgggcttggtgtacgtcttcttcttacgcttcttggcgccaccgcggaggcggagcaccaggtggagggtggactccttctgaatgttgtagtcggcgagggtgcgaccgtcctcgagctgcttgccggcgaagatgagccgctgctggtccggggggatgccctccttgtcct

SEQ ID NO: 8224 - DNA, 560 bp, Zea mays
  unsure (1)..(560): unsure at all n locations; Clone ID: LIB3279-179-Q1-N6-F1
aagtaggaaggattgaagntttgatggaaaggcaggaagtttaacaacaatgaaatgtagacagatncattcataaacaaaccttagaaccaaatgttttcggcctcaagctcactgcatgtgtgatgcttcgatagtgtggctatgtttcagtttgggacaacaatattattagtagactaaaagacaaccgtgtcgagcatggttcctagggtctgaactatgtttgatgacatcaaattcgacacatgctcttccaaatgcttttttgcatcttgccgacccacatttgctatcgcaagtttctcaggtggcagttcgtcctcctcctgcactgccttgttgtacttgatggctaggtttagcatttcctggacagtctgctcgttggttttcgagtgagtgtcaaacctcttcaaaattagcccatcggtccatttctttttgtgcaagttcaacagcattttctcctcaagctcatttttccggtaattgattgcaattgagtagtagtgtctattcagcccatggataagagcctgaatagatggcttatttag

SEQ ID NO: 8225 - DNA, 648 bp, Zea mays
  Clone ID: LIB3279-179-Q1-N6-F2
agactcagaaccattgcaaactcattaactttagacaaaaaaacatcagtaccgttgtttttaagataaatgtatattgaaaaaaactggcaccactcaacaataaactcagaccaagatgtttataatagactcagctccgaacaacatttctgtaatagactagaagggataaactggcatcccagcacaaacttgacgagctgagccgctgccgttgcccaatctcagaaactgaactctagatcttgttgaaagccacaatgtcgcaactctggacgtactcattgatgggctcttgcgtaaggtggtcctcaattagagtgtcgatggacacaagatcgtcgacaattgtcaacatgatagtcatcttcttgatgccgtatccaacaggcacaagctttgatgctccccaagtcagaccctccatctggacactgcggacagcctcctccagcttcttcatatcagtctcatcgtcccatggtttgacatccataaggacggaggatttaccactttctttctttttagaagaggccttggcagcggcggcacgctcatcagctgccttcttgtccttctcagtttcatcaccaaaaagatcaaggtcatcatcatcctcagcctcatccgcagaagcagctg

SEQ ID NO: 8226 - DNA, 392 bp, Zea mays
  Clone ID: LIB3279-179-Q1-N6-F3
gggggggatttaaaaaaaaaaaattggggggcaaaaaaaaggaaaaaaaaaaagggggggaaaccaaaaaaacccccggccctgggagggggaaaaattttgggggaaaatttaaaaatggggggggggtttttttttttttaaaaaaaatggggggggaaattgcccttgggggggggggaaatttacccgggggatgaaaaaaaaagggttttttcctccggaaggtttggggggggggcacacatttttttcctggaaaacaaaaaaaagggggggggttaaaaaattttcccttccccaccccgggatgtatcgggggccccgggggggaaaaaggggggtcctttggggctaattttttaattccgaaaaaaaataaccacccttgc

SEQ ID NO: 8227 - DNA, 581 bp, Zea mays
  unsure (1)..(581): unsure at all n locations; Clone ID: LIB3279-179-Q1-N6-F4
gacacatcaacagcatattcatttcatataacttaaatttcctttcccccagacgacatacataccgacagacgcgacacacatgattaaaaaggtgcatatagtatactgcacaattccaagcaatcatgcaaatgttattacgaaaatccttctgctgacccccccggcgagaccgaagacggatccccagccctagttcttaccggcgccgtactcgtcagcgtcgtggatgatgacgtagccggccttcttggggctctcggagtcggacagccggtcctcgtcgtcgctgtagacgtcgtcgtcgtatccggaggcgcaggtggaggcgaggagcgaccacacgaggtacatggacgcggcggtgagggcgccgcagccgaagccaaagaggaggccggagacgacgaccaggatgtccttggcgcggtcctgggcggacgaggcggcgacctccgactcgacggaggggagcgccacggggcnggcggatctggtgcgggccgaggcggcggacgcggaggacggtgacgactgtggtggtgaagcggcgtcggttggtggggtcccgggttcgc

SEQ ID NO: 8228 - DNA, 522 bp, Zea mays
  Clone ID: LIB3279-179-Q1-N6-F5
gttattcagacctatcacgaacaattaagtacacgttctgccgcagcaaacgcagagtttcagacaccatttgcaaatctagaaacaagagttgcctaggagtaactctccgatcagtcagctaaaaaggtgtggaggctgcctacacatcatgccccataacatacacgatcaggggtgaggttctcgagttggtgcggcgataatcaacgagatgcctcgatctccttcgcctgaggctgctgctgtttcttctcggtgtctccggctccctctccttcgtcctcctctgataacttgttaactcgtcttggatcataactttgatggcttctttctttggggccagatccattttatagtgattgtcaagcttcttaaggatgtcactgaaagttgccgtgttgaagtcaactttcttgaggatttcagtaatggtcttcctcagatcatccttgctgggaagaactgcttcaacggattctcctttaccctttgtcacctttttgcctgatgactttt

SEQ ID NO: 8229 - DNA, 657 bp, Zea mays
  Clone ID: LIB3279-179-Q1-N6-F6
ttccacggcgccggcacccctcgcctaggcatccgaccgccgcagcgtccccgccacgaccacgagcgaaaggaggtcgccggaagagggggcgcggagatgagcgggagcgcgttcaacgcgttcaagtcgcgggtgccggtggcgtggagtccccggctgtacatcacgctggtgcggggcctccccgggacgcggcgcctccaccgccgcacgctcgaggccatgcgcctccgccgctgccaccgcaccgtcgagcaccgcaccacgccgtcgctcctcgggatgctcacccaggtgaagcgcctcgtcgccgtcgagaccgaggagatgtacaacgcgcggaagcaggccgaggcggagaggcgcgcgcccagacccccgctcgtcgtctcccaccagccacagccgccggctccgaagccggcagccgccgccgcggtgggtgccgctaccactgcgcagtagcctctggtgagctcctcgagtcccgatttcgtcctggtgcggtctggttttccattttgtttgtttgtccattcaagcgtttgatgcaatgactcaagtcagtgcgcgtagattggcagtcaatatacacaatgaaatgtcttagtttcctggtgggttattataattcttcccttagttctccatgta

SEQ ID NO: 8230 - DNA, 611 bp, Zea mays
  Clone ID: LIB3279-179-Q1-N6-F7
ttttagacgaccagaaagaggtatgcttgctattgtcccaaaagaatcgaacacaactagtacgcaccacggtgcaacattagctaatttagagtccaataaccaacacaaataacctccgcatccacgcaacgtaaatcctcaattaacaggaaccttcctgttgggctcaaagacgtacttgatcaaagaatccttgatggacagcagctgagggaactcggccttcagtttcgacgtgtccatctcgttgttgcttctaggcgcgactatcaccttggcctgttcttcgagtgtgaaattggtccacttgaaatcaggattgatgtatttcttgtacatctctagaatctcgttgtggcttacagcgccagggttggtgaagttccatatgcccctgcagtcccgtttcgccatctcaatggagataggcagaagctcatccaagattgtcatgctgttgggaatgttcaccaccttgtcgtaacgagctatctttgtgatgaagttacgagggttgcttagatctgatgatataggcatcctgaccctaagagtcagacattatcatactccttcaatagctcttccaccattgctttagttttgga

SEQ ID NO: 8231 - DNA, 594 bp, Zea mays
  Clone ID: LIB3279-179-Q1-N6-F8
aacaatcaaaccacctccagtgttttattttattaggcttaaacgtatataaaacaaaataattctacactatttaggaaaaagaaaagaaaagcaaggaaaagaaagggtaacacctgaatttgatggatattagagaaaaaaatttatacccccaaattcagggtgttacatgcagccacatccgaggtccactggtcacaaccccactgatcatctccttggtaatcagttactgtagcaaactcatgggccgcagcagcttcctcttcctgctcctttgcttcctctgggtctctgtagaagaacagatcaaccattacttcccacttgtgcccagagaggatagtgcccctcatctgcagaaccatcctggccaaaagccagaacaggcatccaatgttgttcctccccttgttgttggcaggatgccgatatcgacataccgcatgggagagtcagtgtcgcagaaggcaatggtcgggatgttccctagagcagactccttgattggctgatggtaataggaacgacatctcatcgtttcttacatatgaacaattgattaacatcctatttttttatgacaacatg

SEQ ID NO: 8232 - DNA, 525 bp, Zea mays
  Clone ID: LIB3279-179-Q1-N6-F9
aagtacgaagcatatttggttgccattctcgctgattcggtcagacgattcgagccatcggccaagtacacaaatactcactgcacaggtctttctccgttctactacggaaagaccgctcgctacaactactatattgtatacccagtgagaggaaagatgagtacaattggcttggtgattcctctctgtagatacgagtcctacatcaagtgatagccttcttatcgggtgaaccagaagactggggagaagaaccagtcgccgcaactggtgcgtcgtgggagcagcacccaccggggccgtgatggtggtggtggtggtgcttcttgggctgtggctgccggagcagcttgcgcatgtcgaacgcgtcctccccatcggcatagtacttggcctcgatgtcctggatctggtacccgagggtagaggtgtagaggttgaaggcagcgcggttggatcggcggacgtggagtgacacgtactcagcgccgaagacctggtccatggcggcctgcgcggcgg

SEQ ID NO: 8233 - DNA, 633 bp, Zea mays
  Clone ID: LIB3279-179-Q1-N6-G1
gagttagcatgttacaagaatacttagaataggttgccaatatagcaaataaacatcaatgggcaaattgtcccatatacaaaatacagaattagatgagtacaacaacggattgctccttagtataaactattgaaggctatacgatgaccaaaagaactattaaccagagcaaatgcaacattatgcttttcttcacgggagcggacgcagtagaatcagcaacgggtttgctaggagcaacacaatttcaatatatattggcagaatatttgtagaaatcccatgaacccgtgaatcagaagcaatatcaatcagagcagaaactgattaaccacctgataacctgaacttgagctatgatttcaagaacatcatcaacaagaaaaccatcctgaatctttgatagctccataaattttttccatccccaatcatgctccttcttccagaacctatgcaaagtatctgagtacttcatctttttaggatctatattggctacagctatagtgaactgtgcaaaatgactccatcctgggagaagtttgtcatgattagcaacgcaaaggaataatgaaagatgattagagacatcacatcctttgagatatacaagaatataccatttgt

SEQ ID NO: 8234 - DNA, 636 bp, Zea mays
  unsure (1)..(636): unsure at all n locations; Clone ID: LIB3279-179-Q1-N6-G2
aacgtcaaaacaaacgatgttcagggcatcgagtatttcatgggcaacaagtttactgtgccgaatcactaagttcaaattcacactttgatggtactcaccagaaatttattctgctcagagcaagcgcattgctggcaaatgacacaagaaaccagtccctacccaccgcggcaaaatgtgaaatgacgttagccaggaacagccatccttacgccttcacttgaggaggagcatcgccttgaagagcaggatcagatttgacagcatctagtgccttgaagaactcctcaggaagagcaacaggccggtgctgaggaacatgcttaggaattggggtgtcgtcttcaatcacctcacattcgtagtcatcgggaacaccccatggatcccattcaatcattttagcgatgagcttgagctcgtcctcggcctcctcgatgagctcctcgacctgcccgcatccgattcggtcctcgatgcgcttccagtcctcctcctcctggcagatctggaggcggtgaccggtgaaggattcaacggccttgcggtaaccctcgtcttcggngacggccttgatctctttgagcgtgcgctcgtagagccctaccagaacctctcgcgcgttaggcacca

SEQ ID NO: 8235 - DNA, 531 bp, Zea mays
  Clone ID: LIB3279-179-Q1-N6-G3
ctggttgcacgacaatcaatcatgacatacatgcggaatagttaaacacaggcagggatattctgtatactagacccaccaacatggaatcacgtatgcaatacagctttgtctaacataacattcgcgttgctgtacgagctattgtactctccggatactacttattactgtgcatcgatcctacctttaacggcactccttggatgctaccaccaggaggcccagtgcaccaattagcacatactagaggactggtttctaagtcatgactattgatagccacccagcataaggcagatagccaacaccccgtccaaagatgtgctgtccctgaaaccaaagctgaccatgtgcgtacaggactcggtaatgcaagggattattgtcacctttagaaaaaatagaagattccacgcagctcatggcactcatgaacctcgttcacacgatgagacaattggaatatcacagccctcagaattgaaaacaactatgtctcctgtgcggacagggtgcttatttatgtgc

SEQ ID NO: 8236 - DNA, 622 bp, Zea mays
  Clone ID: LIB3279-179-Q1-N6-G4
ttttaataaaaatgctatcacaatcaagcaaagcatatatgtaaggaaaattgcccggctgcaacgaagggcagactagacacaccctatgaccatgttttggggacccatgccaccacctagtaggacagttacgagtgttttgagatcaatgtctccgcccaaaacgaatgttggaaaaattctcctacataaattattaatttcttcgatatgaaaggcaaaaacttgaccagatcctgactgggctggaccgggagcgaactgctcttgttcgtcatcatttttctccatttaagcaccgccggagccgtacttctttccgaagaagaggatctggagctggtcgtagccagaaagcacaccagcgccagcaatggcacgaagaatgttagcaccagcacccttgaacagggacttggggccttccttcttaaggatctgctggaatgcgtccaaggagctcttgtacttgacagcctcaccagaagtcatcatcatccttctgcggacagtatcaatggggtaagatgcaagaccagcaccgttggtgatcagccaacccagagcaaaactggcaaagaagttgtcctggaagctgccagtgaggacaactggcttg

SEQ ID NO: 8237 - DNA, 601 bp, Zea mays
  Clone ID: LIB3279-179-Q1-N6-G5
catcatcatcatcatcatcatcactggtatgggtcgataaatggtttcatgatacaggcattgacacccccaccccctctgccacctctctaaaacaaatcacccacttcgaaagtcttgcggacaataaaaagtgtctactaactctgctattacttactgcgcaaagcagcttcaagtgtacggcagcaacaaaggcacggaacaagtaccagtaccagcaagaggttccttcacatggacatgagcttcaggccattgtcaggctttcccatccctgcagcgagttctgcatcaagctgcgtgtgcggggccggtccagacattaccttaacccttttcttgtggcgctttgaacgatagtgatcatccttcacgctttcacttgcaaagtagcgatcgcagtggaggcagtagaactgtcccaggcctgggaggtcctcatcgacggggagctccttggtttcagcgtccttgccctggtcggcaagcttgacgagctcgtcatagacggcatcgtcggccttcaggaggaacttgccgcggcgagccgtcttgtgggataggcggcgcttctttaccttgcggtgcgggcacttgc

SEQ ID NO: 8238 - DNA, 656 bp, Zea mays
  unsure (1)..(656): unsure at all n locations; Clone ID: LIB3279-179-Q1-N6-G6
agaaatatgacgagccaattcctcagccaaaaaacattatccatgcaacatcatacaggttcgactaacggtaaacggtcantccacatagagnncaaaattaaaggnctcgtcttggacaatacacatgaaaacagcaacaccacccagagaggactagcttcatgatggccacccgccaagagccagcaaatggcacgcagcagagacgcctacagcctccttcccctcctaccgccctttctgcgagtgctgtccgtggggaccggggtaacgtcctcaatgcgtccgattttcatcccggaacgagcaagcgccctgagggcagactgggcaccaggtcctggggtcttggtcttgttgcctccggtggcacgaagcttaatgtgcagtgcagtaatgccaagctccttgcagcgctgtgcgacgtcttgagcagcaagcatagcagcgtaaggtgacgactcatcacggtcagccttcaccttcatgccaccggtgatccgaaccagagtttccctcccagacaaatcagtgatatgaatgaaggtgtcattgaaggatgcaaagatgtgagcgacaccaaagacatactctncttcacggacagtgggtccaagggtgacgttctnctncttgggctccctggtcttcct

SEQ ID NO: 8239 - DNA, 565 bp, Zea mays
  Clone ID: LIB3279-179-Q1-N6-G7
ggcaacacgaatcatcagtcttttaccaagatcgcttcgggacgaagcggtacacgaactaccacacaaaatagacttgtaaagccgtttttacactacttcgccacgccggctaaaagcgaacaaacagcataaagttacaaattgcactcctccatccctccgccgccactggggccgggcgcgagatacgcctacccgcgctcgccgcggatgcggcgggcgagctggatgtctttgggcatgatggtgacccccttggcgtggatggcgcaaaggttggtgtcctcgaacagaccgacgaggtaggcctcggcggcttcctggagggccaggacggcgtggctctggaaccgcaaatccgtcttgaagtcctgagcgatctcacggaccaggcgctggaagggcaacttccggatgagcagctccgtgctcttctggtacttgcggatctcgcgcagcgccacggtgccgggcctgtacctgtggggcttcttcacgccgccggtcgtcggcgccgacttcctcgccgccttggtggcgagctgcttgcgcggggccttgc

SEQ ID NO: 8240 - DNA, 589 bp, Zea mays
  Clone ID: LIB3279-179-Q1-N6-G8
agaacacagaacacaataattacttaatctaacattacccaaactgacattatgacaatgttagccgatgacgacgacaatggaaacagtaatctaggtacaagcaggcgcctctgctagctggcaagtgtgaccacacacaaacacaccagaccagaggcagaaccacccgccagtggcgccaacgaggagcgctatccgttatagcacgacaaaagtaaaaataaaacatcacgatgtggagtgaaactgaataattctagtacatggatataggctccttttttttgatcgccacggggccttgtgtagccgctccattgttggatgaagcaccgtccattgtctcgagcgagctctccatcactcgtcatcatcttcatcctcctcgctaccctcttcgtcatcctcgtcattgacctccgacttggacttgtcagactcctcttcgtcttcctcctcttcctccttggcaggagccttcttagctgcagtgctctcgcccttgttgtaggctgcgatggccttgttgtactctagcttgagcttgttagccttggctacatagggagccttgtccgactcgctc

SEQ ID NO: 8241 - DNA, 609 bp, Zea mays
  unsure (1)..(609): unsure at all n locations; Clone ID: LIB3279-179-Q1-N6-G9
caacgtcaagtaccacataaccaaagatagccacatgcaacaccattatttgttccgtttaaaccgtggcacagaaatgtaacgtcggacaaaatttaaatatgacaacagcagacaacacaacgctcggtgacggggggagctgggcgcccttcacttcccaccaaggcttgggaactgagcttgatcttcaatggatggagcagcagcagctgggccacgactgtatccccctccgtatccgcctctaaaaccaccacgatccccacggcccccccttccacggccacggccgccgtagtacctttctccttcagcaggtttcaggaactcgttgatgctcaccgacttcttggcacgctcatcacgctcagcattttccttcttcttatccttgtcagaacccagcttaatgaaaacttcatcattttctttcttgtttgaaagtggctgcagagaacgcagatccttgtcaacttcaactttcctctcctcagccttcaacgcaagtagtgctttcctcttctcctctcttattttctcaaattcctccagagtcatctccttgccctcttccttttcttcctcctcatttgcagnagcatcctt

SEQ ID NO: 8242 - DNA, 639 bp, Zea mays
  unsure (1)..(639): unsure at all n locations; Clone ID: LIB3279-179-Q1-N6-H1
gtgcggaaatctcatgaatgctttatcaagaggtactttcaatcactccaaatactttggacaggaacgaataaagcatatagttcactcgtcgattaactacaaaagaatgacacaagtttctcttcaacaaattgacaacaattttcatattaaacacacctatacacaacgtattatctatcataaggtggctaggaaacatgtgtccaatttgaattccagaacttcaatgtgaatgttgaccatttcttcaaatgcggagtcaactaccaagcccagcgatcatcgctgtaaatgtggctactganaatccaagcactccgccagcaaatacctgtggaggtgtgtgccctagcagctctcgcagtggtcttgtttcagccagtggatgttctgatggaagctcatacacaatctggttcaagacctctgcttgcttccctacatgtagcctaacaccaaaggcatcatacatcacctcaccagaatgccaaatttagcacattccatagcaagacgtgtcgcgcgcgatatactttctttggttcttgtcaatgtactgagaaaatctttgaaaggccttcgcgctgcattggctccaagcgctgctaatttcttctgttgaatattatcaaa

SEQ ID NO: 8243 - DNA, 596 bp, Zea mays
  Clone ID: LIB3279-179-Q1-N6-H2
ggggaaagacataataattcatagacgaattacaaacagcaatctctcttgttattcaatatcagtagcagacagctccgcagacaaacgatactttcattcttgtaacacttacaaaacatactgcaaggacaacttgcatcaataccagtcttatcaaatgaaataatgacacatattcagatgaataacgactactgatgttacgaaggccaacaagcttccgaagcttcaatacctggtatcatatggtatcatatgataggcacacacaagcacttcaaatttgcagtctaaaatccgtgaatcttgatgctatcttttttcacgattccggcctggactagaaaagtagcgacatttttacgctgatcaccttgcagttgaatgacctggcctagctctggatcctggactacagtaccattgcagcagaactcttttttgagatccttgaggatcttgttgtagctgtactctttcttcaagccctgaacagttgtcagactcttccttccgttgcgctgctgaatacgcacgtgcacatagtcctttgatccagcaccagcactggagtcctcagcatttgcctctgc

SEQ ID NO: 8244 - DNA, 206 bp, Zea mays
  Clone ID: LIB3279-179-Q1-N6-H3
atacaatataaaggcaccactctgcttgaaaagcaccatatttatacatgctcatagatagtgctcaaatcaaccggtttctgaagcgcatatgctgcaccctaccaggcaagaaaaatatttggaaaaaaaatccaaggaattattgatgccgggctgtttgccatggaatggtgataggatgcttcttagtaatccagcaatcc

SEQ ID NO: 8245 - DNA, 411 bp, Zea mays
  Clone ID: LIB3279-179-Q1-N6-H4
aaaaaaggtatgcagcagatcatccaactttattcatatatataaatgtcgcagacatatatgatacaaaaagaatgaggaatagcaacactgaaccaaattcccgctcaaatctagtatgatacttctactgcatcagggccgtcataaggagggacagcagtgcggacgacaccacggccacagcggaggccggagcggaggccgcgccagcgaccggtcccggcgccggagcaaacgcgggcgccatggactcctgcgccgccgcggaggccacgaggacggccacgacgaaaagcaaagcggaggcgacccggggagccatcaggggcgtcttgagaatcttcggagtaaaaggattctgtagggcaaaactgtggcggcggcgcggtgtttgtttgtgctgcgctg

SEQ ID NO: 8246 - DNA, 491 bp, Zea mays
  Clone ID: LIB3279-179-Q1-N6-H5
ggtgtggggggggggggggccaaaattaaaaaaaaaatttttttcaaaagggggggaagaaaaaaggggaaaatgtttcttttggttttaaagggttgggggaaaattttcaatttttattttttggaaatccagggggggtggttttttttccaaaaaaaagggccctgggggaaaaaaaggggaattttttttttggccctttaaaggggggcatttctaaaaaaaaattttttgccaaggtggaaaaaaaattccccccggtgggggccgggttaaaaaaccagggggggggggggcccaataattttgggggcggttgggacaaactttttgccctcaaaaaatggggccccaaaggggcggaattgtttttttccaaaaggcctttaaaaaaggttttgggggaaaaaatgggtttttttttttaaaaaaaaccttttcccgtttaaaaatttaaggcttggggggaaaacccttttttaaaaagg

SEQ ID NO: 8247 - DNA, 475 bp, Zea mays
  Clone ID: LIB3279-179-Q1-N6-H6
gccacaaccagaagccataactttggcgttctgatggattcgcgttacacaggccacaagtttcttcagtcatgtagtttgggtgcagccgaaaccaacgtcactgcagttggttgtgggggggtaaggtggaggaagcaaagaagggtaaaacaaacatttttcagcaggagatggactctccagctcgtcatgcctaactgggaaaagcataaataaacgcttaaaatccaaaaatggaacttgtacagggttgaacaagcaagaagcctccttatgaagcagactccttggcaattttctcagccttagcaatgacttcctcaatgccaccaaccatgtagaatgactgctcagggaggtcatcatacttcccatccaaaacaccctggaaactcttcacgctttccttcagctccacatactttcctggagcacccgtgaaaacttcagcgacatggaaaggctggctcag

SEQ ID NO: 8248 - DNA, 550 bp, Zea mays
  Clone ID: LIB3279-179-Q1-N6-H7
gcagcaccaagaagcaccatttttttccttaggatttaacttagaataaagcctgacgggggtaacagcacccatcgatccgcagtccatgctggttgatgcatgggtctgctggagccgagggtgaacacagcactaacaactgacacagagcgaccttcaatcaaaaacacagatgggcaacaacaaacacgagacgaacgaagataaacactctggactagggtaaacaacacggtagcgaacaggataacttggccgcgcgggccccaccgctcagttcctccagttcccgtcggagttgccgtagccgccgccacggttgccaccgccgtagccgccgccaccaccaccgtagccgccgccgccaccaccgtagccgccgccaccgccgtagccgccgccgccatcacggggcccgccaccgccgtagccgccgccttcacggccaccaccgtacccgccgtcgccgccgtcttcacggtcgtcgcgggactgggcctcgttgacggtgatgttgcggccgtccagctccttgccgtcatgccct

SEQ ID NO: 8249 - DNA, 610 bp, Zea mays
  Clone ID: LIB3279-179-Q1-N6-H8
ggtgggagaagagccaggaatgctcatttccgaacaattcaatgtctcgttacaagcaagcatgctcacacataggcactcaactttcgtcatagaagacacatcactgaacaagcaaactcctataacagacttggctttttggggggaccgattgacagggcaaccgtttcaagcagatggcttcatcagggcagcgaccttctggacagacggcctctccatcagaccagaccaccaggccttcacatgcgggtaggcgtcgagcacagatgcgtagggcgtagcgaacaggcagagagtgacagacacatggttcaggtcggcgaggctgaggaagtctccagcaaggtacttgcacttggtcaggcgtgcctcgtacacctctagcaccttcttcagcttctcaaggttctcatccacaactttctggtcggtggttcccccaagcataggactgatgaggacctggaagaggatgggattcagtgcagcggtgtactggttagcctccacctcgatccaaacatccaccattgctgcctcctcggagtttccttccctcaaagctctggcttgtttttgcgagcagcgtacttgcagattgctc

SEQ ID NO: 8250 - DNA, 485 bp, Zea mays
  Clone ID: LIB3279-179-Q1-N6-H9
tgtttcacctgggcttggggggggcaagcgcaatgtacgcgacgacgcggtagccgacgagcatgagcgccatgacgcaggcgtcgacccaatggttgttgagcccgacggccttgatggccgggaactcggcgacggggcagagcgcgccgtggccgcagtcgtagtaccctccgccgtcggggaactggatgccgagcaggaggcggtagcagtagaagctgtagttgagccacctgagccaggcgacgaagggcgggatgtgctgcacgtagtacccgccggcgatgaggaagaccatggtgatgacggaggccagcgtggttccctgcttgacgtccatgagcacggcgccgatggcgagcccgaggctctgcgccaccagcacgctgtagagcacgacggcgagggagagcaggaagggccccgggcgcgggtccagcccgcccatccagttgaggatgagcacgaacgccgtgggcagg

SEQ ID NO: 8251 - DNA, 395 bp, Zea mays
  Clone ID: LIB3279-180-Q1-N6-A1
gtgtggggggccaaaagttttttgggccccaattttcaggggggggggtccccttcccccccagggggggggggaaaccccccccccccccccctttgggcccgcgcccccccggcccccccccggtccccgggggccctgggggggggggtccggggggccccgccccccaacccccggggggggggggggggccccctccccccggggggcctttttctgggggggccgggggggggcccttgcccccggggggggggggggcccccccctcaaaaacccgggggggggggggcccccaaagttttttttttttttgtaaacccccccccccttccccttgttttttttccccccccggggggggggggcccccggggggccccccccacccc

SEQ ID NO: 8252 - DNA, 594 bp, Zea mays
  Clone ID: LIB3279-180-Q1-N6-A2
aactcgaaaaacaaatcttattcataaacaaaatgggttcacagatatttctccatacgtacatgctcattgtggtagacgcagctgaccacctagagctgcatacttacttattcagactgatccagcatgtggcaacgtcggaagttcacatgcttacagacgacaaattttcataacaatagcttggcttggctgcttcacagaataaccaaacgacaaccacgaaattgcgacgatataaaataaacaactcagaagcaaatcgaccccagaagcccgtcttactcatcaagcactcccgccttctcctccatggcatccgcttcctcctcccagcatagaagattagccagtttgtagtccttcttcataggaggaggagcactctccacgttctcgccgtcaaagcagtggaaaacagatttgggcgaggtagcaacagcgtcttcagcagcacagaagctctggtacacgaggagcccgcctccaggcagctcctgctccaccatgttgttgcagtcatagacctctgcaccaagtgcctttccccatgtcccggcatggccacgcccgccgaagaggtcacggcaa

SEQ ID NO: 8253 - DNA, 468 bp, Zea mays
  Clone ID: LIB3279-180-Q1-N6-A3
atggggaaaggttcgggggggggggccaaaaatataaaaaaaaaatggcccaacaaaaaaaggggggagaccacccagtttcaaacaaaacaaagaaaattcgggggaccctgcattatattaaaccaaccaaccccaacaaaaattatgaccccaacaccacggggggaacgaaagggcaaaaaaaccccctttgggagctttaggggggaggggagccacaccccgccccaataaaagcagcccaggaaaaaaaaataaaggggaagctgttttccccaccagggggcttccggatgcccccgagggtttttcggggagcgggggttccatcggggaaaaggcactgccactcatttccttaaattttgaaaagctaaaaaacttctggggggaggaagggacctcccccttgaaaaggtggtacccggcaacccccgaaacctcgggggggggaatttttttggg

SEQ ID NO: 8254 - DNA, 631 bp, Zea mays
  unsure (1)..(631): unsure at all n locations; Clone ID: LIB3279-180-Q1-N6-A4
ctgaaataattgcattatttgaagcatcacgagagtgtgtatggcttcgtaaaatggtaaaccatatactcacaacatgtggtattggttcaattgaatcactgaccattaataaacatattttttctaaactgttttatccccaggaacttcaggaaaatgcagataaaaacatcttacagacaaagtcttgtgataatcttgctgatttattcacaaaatctctaccatattctacgtttcagaaatatgttgaggggattggaatgagaagacttaaaggattgcaaggatcagggggagtaattctccgtgatatttaacctgttttgggccataatattacactcttttctttgtatgagttttgtcttgttgagttttctcatccaaagtttttaacgaggtaatatcaactaagctatatgcttcatcatttattttcccccacggtgtttttaggaatggtgattacagacatacttttttttggaagccagtgtgagttttactcataatccaaaagaaggtatactccttattttttccacaggggttttaaggagataatatctttgaagaaaactganagatgatcaaatgaagttagaattaaccaagggtgagtgtt

SEQ ID NO: 8255 - DNA, 565 bp, Zea mays
  Clone ID: LIB3279-180-Q1-N6-A5
ggttccaagtaccagttttttttgacactgagaattacagcttccaagtgacacaatacagcagcattcagcaccacacgcggcactgtactgcaaacccaattcggttcatcattatacaggaaggatagaacgaatacatggaggcacgtccaggtcccggcaacacaacgcagcagcgaccccaaaggccaggtagagaaaatactacatggcatacctctgggtccaggtcctcgcggtgttctcgtacttgtgccggtccgtcttgtacatgtgagctatctcggggaccaaagggtcgtcggggttcggatcagtcagcagggaacagatggacagcagcaccttggagatggttagtgccggactccactggtccttcaagatgtcgaggcaaatgctcccgttgctgttgatgtttggatggaacaccttagtgcgaaatgccacctttggtggtttgaaaggataatcaggaggaaaatggattgtaactaggaaaactccaccagaatatgggctatcagatggacccattattgttgcctgccagtggaacatg

SEQ ID NO: 8256 - DNA, 429 bp, Zea mays
  Clone ID: LIB3279-180-Q1-N6-A6
ggacctcaatcactgcaacactacatatataataagataaagggttcgttacttagcatagcaatgctgcaaggaatcttggggtacaacacagtactgccaattttctcttaacgtcaccactcatcagaatcttaataaaagcatcacagcatcacttgctagcttacagaaacagagacaatgataaaacagaagatagctcttagaccctagccttccgacgcagcagccggccaatcccgacgctcagaagccgagcttggtgcggcgccagtgcctgcgcttggcgttgtacctgatggtattgtcagtgcgcatgcggatccagtaggggatggggcggttctggcgcatcttcttcgccagcttcttcttgatccggaaggtcttgtgcgacggcattgttgcggctgcggcggcggcgcg

SEQ ID NO: 8257 - DNA, 647 bp, Zea mays
  Clone ID: LIB3279-180-Q1-N6-A7
acaatctttgacgagaacttgacttgaggcgccacacaaggaactccataaactcgacatccacggttacagaatgctaaagtttcacaggatttaactcgtaacaccaatctgctgtatgtagcatgaggtgacaacggaattatttcattacttgagaagcatggccaacgtttccatagctgacagatgcgaattactgggcactgaggacttcaatctcgaacacaagcactgagtttggttgaattccccaggctgggaacccgccggctccataagcataatcaggcgtgcactggatacgagcaacttcacccacttgcatggtcataactccctcgtcccatcctttgatcactgaaccctgaccaatgctgaaactgaatggctgctgcccagggtccttggtgctccaaaatttcttggacagatcacgatccttcccgtagccggtgcagtgaacggtgaccttctggccctttatcggcttggggccggtgccggatctcaggatctgcttctcgaagcccatccttctcttcagttctcactatcttgtctcctggagttgacgtctttctttgggcggcggcgtctgtcttgcgagttgcgactggagccccgccgctgtggtggtctagtga

SEQ ID NO: 8258 - DNA, 581 bp, Zea mays
  Clone ID: LIB3279-180-Q1-N6-A8
gaacacaataattacttaatctaacattacccaaactgacattatgacaatgttagccgatgacgacgacaatggaaacagtaatctaggtacaagcaggcgcctctgctagctggcaagtgtgaccacacacaaacacaccagaccagaggcagaaccacccgccagtggcgccaacgaggagcgctatccgttatagcacgacaaaagtaaaaataaaacatcacgatgtggagtgaaactgaataattctagtacatggatataggctccttttttttgatcgccacggggccttgtgtagccgctccattgttggatgaagcaccgtccattgtctcgagcgagctctccatcactcgtcatcatcttcatcctcctcgctaccctcttcgtcatcctcgtcattgacctccgacttggacttgtcagactcctcttcgtcttcctcctcttcctccttggcaggagccttcttagctgcagtgctctcgcccttgttgtaggctgcgatggccttgttgtactctagcttgagcttgttagccttggctacatagggagccttgtccgactcgctc

SEQ ID NO: 8259 - DNA, 442 bp, Zea mays
  Clone ID: LIB3279-180-Q1-N6-A9
atcagttcaaatcgaatttcatttatcgtattgtttgatcaaaagcgaaaggaatctcattttgcgtgttgtctctgctcatggtgtagatggggtatcttgaccacggttcacgggcatttgggtaccgaacgtgagcacgacaaatatctgtaggaggacgcagatggtgccacatatgttgtcgatgttgaactctttgaagctttcagcttagttgtcaccctagaagaggaaggcacgacccatgacggtatcgacgaggcactcattcaagtgccgtgtctccctagcaaagacgatcggcagcaaggcctcgatcgtcttgagcgtcgtctccagctacgtcaggtttgggtactccagcaactgcaacacctacttcatcctcaagaagacatgttacttatcaattctacatgtggaagtcaaaacatggtgt

SEQ ID NO: 8260 - DNA, 608 bp, Zea mays
  Clone ID: LIB3279-180-Q1-N6-B1
gaatgaacgatgttccattgatcgctcttgcacatttatgcatatatgattaaacagacagttagttctaatgcctagttcctaatctgtcagctgagactactaactctaatctaattggttcttaacactcaacttgtcaaatccagttttgaaatgttagcataccaatgtagtacatgtttttttttgtttaatttgtttatgtttctcaccgttagccaaagcctcggcgtgtatgaacttgttcagttgttcctccctgtgttacctcattacctgcccatcaacatggtcgtccacacttcgtttcacagtttccctaaaaaaaaagagcacaagaacagaaggcgaggcagcatccgcctgaacttctcagtttgaacttgatatgtttgttgccattcatctagtcagaagagtcagggtggagggtgctgagcctccagcttcctgataacggcattggtcacagcccagttgaaccctcggtactgaagccacctcaccatgcgcgcacgtcggctctccaggtcaagctttgcccacgctgccactgtttggacgcctgagcaaacagacgatccatggaagcttcggacatgccg

SEQ ID NO: 8261 - DNA, 576 bp, Zea mays
  Clone ID: LIB3279-180-Q1-N6-B2
gctgtcgacgcacgcagacttttacatgctgcagcttacctcgcctcttccaggcggcatatctcatagatctactaataattatcgaaattgatccaataattatcagcgcagagacatcatccatcgaggtgaagcaggactgcagaccaagagatcccgccgcctccagccatcgtcgcctcagatccgctccgaaccgaacgacgacgacgacgacgacttagaaatttctccagatctggaaccagaagcagaacatgcgatgctcgaccaccaaaacaaaacaacatgaaccttgaaggcaaggactaaccgatacaggatccaacgcgggtttgttgttttctcccagtcctagctctattcaagcccgtaagatgccgaatccagcaatcagatctgagcctgcataacatgaagcaaacggatttcctgataaatcaaaacaaagtagctcaccgagagcactcgcgaggcaaggtatcaaggaggacggccatccaggatctggaggacgagatgaggttgcgtgcaggaggggaacgcgtccaacaatggtttcggacgcgtggg

SEQ ID NO: 8262 - DNA, 511 bp, Zea mays
  Clone ID: LIB3279-180-Q1-N6-B3
cgccaaatatcgtcaacatcataatataaattcaaagagccattagttcatcacaatccaaaccaaaccagatataagtttggaagtagccaacatgcaacacatagctgctcgagaacaacttatggaaaatcttagctaaaggcagttcatgacgctagtatctggcatagagcaaaacttgaagaccacatccgctctagtctcccttcctgcggaaagaacagccctcagtgagccttgcctttcctcctgtgggttggcagaggacagtttggcagccagggcacacaacaacagtctgggagtggctgaaaacagtggttatgctgaagcacccctggcacttaacatccatgaagaaggagttgggcgactggacgagtctctttttcttgtgcttgagcttctcgagttctgccggcgggttgagcagatcaatgtcgttctggagaaccatcttgcctcgggctgcggcggagggaactgcgttagatgcggcagcggcggc

SEQ ID NO: 8263 - DNA, 623 bp, Zea mays
  Clone ID: LIB3279-180-Q1-N6-B4
agagtaaaaagggtgagctctttgactgtttatcgattaagttcatgcacagaccaattctcaatgctgaccgggatgatcagctgggttcagctgatggatgaaaagaacaaccatccaagggagcatgaagcggcgagtgcccgcctctatttttgagaaatgtgtatgtatcagcagattgacaacgcaacaagagcgaagccacccacaagaggttcatggtactacttggttctcaggtttttttctcagactgcttgctccttcgtcattcctaggcagccttgtcgatgagctccctgtggatgtgggggatgacgccgccgccggcgatggtggccttgatcagggtgtccagctcctcgtccccgcgtaccgccagctggaggtgccgcggggtgatgcgcttcaccttgaggtccctgcacgcgttcccggccagctccatgatctccgccgtcaggtactccaggacggccgccgcgtacacggccgccgtcgcccccacccgctcgccggcctgtgcgctatccttcaggtggcggtggatgcgtcccacagggaactgcatggaattcattcacaatatcagcacgattatgatcagcttaattacatga

SEQ ID NO: 8264 - DNA, 629 bp, Zea mays
  Clone ID: LIB3279-180-Q1-N6-B5
acattattcttcgtctcgatttattagtgccgcatgttcacaagatgcatcatcgtacgattccggctcaaatgcagggaaatagttcaacatttgcatacgcctgtgattgctacaaggtttccagagcttcacttttttggtgtatctgcatacttccaggaggtatgtgcataggaattgtattgtcttccaccagccacatcttctgcacgtatctggctgccaatttccttcaggtcctcagctgtgagcttcaccttcaaggagtcaacgttggcatctaggttcttcgtttttgttgtccctggtataggaaccacatcatccccttgatgcagaacccaggctagagctagctgagctgggctgcactggtacttcttggccaaatcttctattttcaggtaaatctgcttgttcttctccaagctttctgttgtaaatcttggatgcctttgcagactagattcagaagaaacttgctgtgtcactccttttccaccaaaaaatcccggccaattggactgtaagccacaattccaatccccaattctctgcagagtggcacgatctcgggctcgatgtctcgggaccagagcgaccactccatctgcacggcggtgatg

SEQ ID NO: 8265 - DNA, 504 bp, Zea mays
  Clone ID: LIB3279-180-Q1-N6-B6
ttggcatccatcacagaatatgtcatcattattatcaggggaccatctgtatcatagctagcagatgggaggttgaaacatctttcgatcaagcaaccaactgcaacatcgcggaacacagaacacaagaggtaccactgttacaatcacacttagtgaagcgcaacacagatagacagctgccttatcatcctctaggtattggagacgggtgaccagtctcatttctttccacttttcttcagacccgagcccccaatcgcgcccttctgtgccttggccttaagctccttcagtgctttttcctcatctttcttcttctgcagatatgcaagatccgtctcgtcgtactccttcttgtcggccttgggcgccttcagcggcttggccttccctccttgcttcgacatggccggcgggggcggataagcacgccgggaccgaaaccctagactggctggcgagagccgcgagagtaggtggggaaaggcacgcggaaccggg

SEQ ID NO: 8266 - DNA, 458 bp, Zea mays
  Clone ID: LIB3279-180-Q1-N6-B7
aaccaaaaaaaaagaaaccccccacccacaagggaagcaggtttttttaagggccgaataaaaaagcttaaaaaagaaaacaaccctaaaaaacctactcgggggggggggtcccaaaaaaacgggacccaaaaaaaaaacaacccaaacctgggagccctggacggaaaggccctgggggggggggggagaaacccccttggggggcccggggggacccccggagtgggccttcccccggggggggaaggccgcttaagccttttccaagttttccaccttgccagcccaggccttgggggggccccccgggggggcccggccaaaggaaaaggacagggcccagggcttttgggggccgagcttgttaagggaattaaaataaaggggggcccccccctcgctttggccccgggggggaaaaaacagcgggcccaaaagcggggacggccctttgg

SEQ ID NO: 8267 - DNA, 96 bp, Zea mays
  Clone ID: LIB3279-180-Q1-N6-B8
ttttccacaaaacctacacatgttattatgttttgcacatatttgcaaacactttacaaaatcattcacaaaaatactaacgcttcaagtgattcg

SEQ ID NO: 8268 - DNA, 504 bp, Zea mays
  Clone ID: LIB3279-180-Q1-N6-B9
atctgaaagcacacaatcaggtcaattcaatactccatggttacagagattgttttgcactctcacatacagagggaaattttatggaaaggggcaaacaggcaaatgtgccaagtggatggaaaactacacaaatggatatcactatttcaggaagttttctccataagttgtattggggccaaaatgttctgtttacttgtctccacaatgcaaccattcatcaccattttttccagcatgaagtgcactttctccagatggaacatgatatcaagctcgcacacattgccgaagtggcgatccatagtttccaccagaagatgtatgaattcaaggatagctaactcattctcatcgctgtcgacgccgacgaggaaaaaaagggaggcgtagcgcctgtaaacgaccttgtagttccggtgctccacaaacgaacactgctggtcagtgcgggcgaggcacttgcggacgatctcgccctcgagggcccgtcgctcgtcg

SEQ ID NO: 8269 - DNA, 608 bp, Zea mays
  Clone ID: LIB3279-180-Q1-N6-C1
gtctcagaattgattttaaattacataaacctcgtcgcggcatatacaccattacaaatcaaccattccattcaggcacaacttggtctgtacattacttcaacctaacgtcatgacaacccagtccccggtttcttacaaatcaaaatggaaccatggccacgagttccgagcatacaggcaagaagtaaccatgcgaaaaggaaaacaccagggacacacgcctctaggcgagtggttagcttgagcgccataagatagctgctgtgtaaggtccttagtccggcaagccagtaccttacctctcttcccatgctgttcttgataccgagctgctgtgtacagttttagtccggcaaggcagtacctctttcgaggttgttcttgatctcgagcgtgtacttgccgaacgcgcgctcaaccttcttgttgaagtgctcattccggtcgttgatcgaatcaatgtccttgtcttcgttaaacttgcgcctcctgctgaacgatttccgcttctcttcccgctccttgagttccttgaccatcttgtcaatgttttcttcagggacattggacaccttcccgtactggagactggaggcgtcacggta

SEQ ID NO: 8270 - DNA, 621 bp, Zea mays
  Clone ID: LIB3279-180-Q1-N6-C2
gatgacaaggtaaacaaaaattctcaaaccagcacaaactttaaccagttcatagcaagatataccagatcaacatagacatccaattagagggctaaacagctctggatacagcacactcacttgaagcatttcgcgtcaagcaaggcctcgccctcgaagggttcctggtcctcgatcatggcattgacacgctccttctgggcctcatcagagatgtccaccttggtccactcgtagagctccatgtcatagacctcatccattacaaacttgggaacctcctggccacggaagagccaaaggcccttcagcttgaagggtggctcagaacctaccacgagcatcttgccaaaggcgtacttgcggcacaggtccatccgctgcaggaatccaccaaccttgttcagggtcacaaaggagacggtgttctcatcattgtacttgtagtcacagaaccacagagagtagccctctgggtcatacatgtcccagaaacctttgatggcaacctcccggaagttggtctttgtgtttgagtatagcctcttccagtcatcaaggaccatcttgcttggtggcagcaagtcaagaggattctttggctttggctttggtgct

SEQ ID NO: 8271 - DNA, 562 bp, Zea mays
  Clone ID: LIB3279-180-Q1-N6-C3
agccatataatgagttcttcatatctcagatacactccacattaagttcaactcccatcgaggctcaaagcagtttataagtaacataaaactcctagcacataatcattgatagcaaaaactagagcgataaggagtaataggcggtaggaccaccatcagatccccgcgaagcgcctagtcgatctcctggagagacgcgccagtggcggcggcgccaccagcagcggcggcgacgtcgtcggcagtaaacttgcccttagccttgtcggcggcgcggccccgggccttgcggtcgaggagcgccttgcggtccttgtcaagcttcagctttgtaaccatgaccttggaagggtggatgcccacgttcacggtggagccgttcaccttctcgcgggtgatccgctcaacgtggatgacccagcgacggcggtacacctgcaccactttgccctcacggcccttgtaggtgccgcgcacgacctgcacctcgtcgtccttgcggatcgggatggaacgcacattgtacttgtggcggagctccgtcgatagcgccgcggac

SEQ ID NO: 8272 - DNA, 405 bp, Zea mays
  Clone ID: LIB3279-180-Q1-N6-C4
gattcaagctacaaaactttcatttagccaaaagtcgaccaacaccccagaacaaatgtcaggcattggaatttggatacatagcatggtctgctttcattgctacattaacattgaaatttggcgacatgtttttataacagtagtagtagacccacagcttcaactcaacaaccagacaggtggacgagaagcttagaaaagagatgtgcccttgcccttcttgtctccaccaatctcaaaatgcttgcatctcttgatggcgtgctgtgagtagtgcttgcagctctggcactgcagcttcagaacaatcttcttggtggtcttggccttcttgtggaagacaggcttggtctgaccaccatatcctgactgcttgcggtcataacggcgctttccctgggc

SEQ ID NO: 8273 - DNA, 594 bp, Zea mays
  Clone ID: LIB3279-180-Q1-N6-C5
ctcataatttttgaaactaaatttggaactaagggagtaaaagttgtgcatactgtagtatcacatcaattctgtcagctattgtccggcacaaaagcagacataaaaaaaagaagcatttgttctagcagcggcacgcatgcgagtcctagaatcgaagctgagttcccaagcacttgtgaaactatgacaaagaagatgaggttcagatgaccattccgaactaagacctgcttcatttcctcttagacaaagacgatgctctgttccctgtacaaaatgggccgcgcgcaatctacaccggctaaaataggttaatgcattccctaggtcatctacagcagtggcaccaagattacagtgcagtgctcaccaaaaaaaagccaggctacctagtcctcagcaatcgaagaggaggcggcgccgaacagacttcggcaggctcttgtcgaggtccctgtcggacgattttctcgagcctcccctcgcggcgtgcccttctcccgccggcttcttcccagattctacgttctgcgctttcttcgagcggtagaactctgtgatgctaagctgcaccccgctaggtctcgggcc

SEQ ID NO: 8274 - DNA, 430 bp, Zea mays
  unsure (1)..(430): unsure at all n locations; Clone ID: LIB3279-180-Q1-N6-C6
gggggggggggggggggtcccccgggggaaaaaaaaaggggggggggggaaattttttggggggggggggtttaaaaaaaaaaaaaaaaaaattttttgggggggggggggccctttttttttgggggggggggggggggaaaaaggggggttaaaggtttttttttttagggggggcaaaaaaaagggggaatattttttttgggggggaaaaaaaacacccttgggggggggggggggtttttttgggggggttgggggggggggtttttttgggggggaaaaaaaaaaattttcccctttggngctgggggggggggggggggggaaaaaaattgggggggggggggcgggggggaaaatttttttggtgggggggaggcctttataaaaaaaaaaggggggggggggttttttttattctcccccc

SEQ ID NO: 8275 - DNA, 607 bp, Zea mays
  unsure (1)..(607): unsure at all n locations; Clone ID: LIB3279-180-Q1-N6-C7
ggtccagcgggcaacaaccaaaccataccatcacgggtgcaaacgaaacgagaagctgggtacagagacgacttatgatgagggttcaggcacacgattagccctgaaatctaggcgcagcttacgggcccacgcgggacgggaggtttgggtacacatgaaatgacaacggctgttcacgattcagaaaaagcatgcggcgacagtggggggtgatagcttggtgagcggcatcagttgccaccaaacaggtatcccagggaagagccaccgccaggagcagcgtggaccttggtcgaaggacggtccgtaaggaagtttccggtgttctgaccgtcggccctgtggtagttattggtttggctggtaaccccagcagcaatctgactggtgccatcaggctttgcagcaggtggtttctcagcaggtggagcacctgcagcagcaggtggagcacttacagctggtgccactgctggtttggggggctcaccgcttccaaagaggtaacccagagaactttgaccaccacccgcgctaccgccacggctcatcttgattgttggaaagagaacgaagcagtgacgaggaagtatganggcgaccg

SEQ ID NO: 8276 - DNA, 542 bp, Zea mays
  Clone ID: LIB3279-180-Q1-N6-C8
acacagaacgaagacggatatagtttatggcaaaccattcagcaaaacacaagtagcacaggttacaatctctgctcaaatgagaccttaaacaggtactaatctccgttctcaaatatttgtcgctcgctagttcatttttgaactaaaacgcaacaaataaaaaagaacggaggagtatttgttagtaataaacgcaagacacagcaacggcctctgaaacgagtcatgctgcttctgctgcactcatgcggagctgtccgaaggtcttgactcttccttcatcttaaatggcgtcgacatgccttcaccgcctatctcagccttgaggtcattgaggctctgttccaattcatcaattctcgcacccatttcatctatctttgaaatgatgttctccgacatagcttggaacctggtttgcatctgcataagaaggttttgcacaaaagccgtcatatcagctgtgctttgtgccgagccatccgaatcttgttctgccttgatagggatgccggacttggaactcgccatcgccgccg

SEQ ID NO: 8277 - DNA, 581 bp, Zea mays
  Clone ID: LIB3279-180-Q1-N6-C9
cagcagatccacataatcaatgtttatttttcaaaacgcagaggtgtcacatgacatgagtaaagaatgatggccaggatacaacaaatgaaattccaatcgatataattggaaaaaaaacctaaacaacacaaacactgtttcattaatgttaagttattgaactaacaaacaacacaccaacccagccccaccaaatatttgctgcaacagccgttgcatatattcagatagatcccacttctgtagtttagtcgaagcagcctcccttccactctttccatggaagtagttaagagtgtgtatagttcaagcttaggttcaggcatccagcaagaaagttgcgggttccgatttcgcagcatagctatatctagaagtgttgtactttctatggacccctgtaagtttcccatgagctgctctttggtgcagttcaaccatcatcctagagcaaaccattagatgttcttctgaatatcttgtgtgcagttcacagcatttgttccaggacttgaacccatttatggtgcattgagcggtgtagatggcagcggctgctagcatagacgggcagaact

SEQ ID NO: 8278 - DNA, 635 bp, Zea mays
  Clone ID: LIB3279-180-Q1-N6-D2
tgaggaaactttctttatacttgtacggtaatacagtgtgatagggacacgagttgcttaaaaccaaagaagctttctttaaggagtgatctccatatatcttgtcgtcggtttaggccgggctgagggactaggagctagccagctagtaggcacacaacgacacgagctgccatgtgagccgacgcagcccggccccccgtccaggacgccgccaccctgccaagcacgaaaaagatgtgtgccacccaccaaccgcagggcgcaggctgctgtgctacacatgtccctgcgcgcccaccacgcccggcgccccggcgcgtgcggctagggcttgtgcagcaccctgccggcgacgacggcggcctctatgacgagcgagatcacgtcgatgacctggtcgatcatgcacctgttcccctcgaacgtggacgtgccctcccgcagcttggccaggcagtccagcagcgcctcgttgcaggccgtgctcaggtagtccatctttgcctggacgcagttgtcgtggtgcatgcagcaggcgtccagcgcgtcgcacggcggctcgccggggcagccgctgtacatgatgccgcagtacttgccgtaccgcaagacggcggcgtcgtgcagtggtc

SEQ ID NO: 8279 - DNA, 635 bp, Zea mays
  unsure (1)..(635): unsure at all n locations; Clone ID: LIB3279-180-Q1-N6-D3
gaagcttcaaaagacatgcctcttcattgtattagattagaaaaaaggataatccacaagacccaacacacattggaaaagaaaacgaaaatacaaaaaacactatccactgatatatctaagatagactaaaagcttccaacttgatcattcaccagttacagaaacacaaccaccagtttatagtagtaataacacagtcctccatcgccactagcctcagctatcggtctcggatactgaatgaccagtgtacccgagcctctccgatatcaaatttacagcatcgcgccccccttcttggccgctttacttcttggccttacgggacggcgctttccgcaccggggtcgccgccttcttcgagggagcggccttcttggcaggggccttcttccctggcgtgtccttggccgacgtcttcgccgccttggcggggcggccggccttcttagcaagtggcttcggcttagcgccggcggtcttgggcttcgccttggcagctggcttggccttgggcttggcgggtgtcttcggtttcactacggctttcggcttcgcggcgggcttgggctttgtggcgggcttcgccttggcnggggtcttagctttggggncttgcagcgccttgggct

SEQ ID NO: 8280 - DNA, 591 bp, Zea mays
  Clone ID: LIB3279-180-Q1-N6-D5
aacatgaagtatgcataaattttgacttcctaagatgctaatatgcccctgtaaaaggagttgaatcaatatagattatgaagatggattgatgttgtacactccaagaatgagttgaatcaagaagacagcctgtgagtgcaacgcctacaattcctggcaccacgcctacagtgtttgtgattccccatcattgacaaaattccaggcaacttgagcaagtgcattttgagcaaccttgaatatttttattgcttcaaccaagggcttgtaaggatggttcacattcaaatcaaaaccaagtgtcacgagcacaacacgttccccgagtaaaattagttccttttgttgttcatatacttccttctgttttattcgttgaactgcagcaggatcctttttgtggatgatctcatatgaaagaagtatgacatccttcagaggtctgggtgtttcttcaacttttcccgccaagaacatgcatactgttgcaattgtctcgtcaattgtaggatggggaatcttattgacttcaattggtttacccacgaccacatgcatgggttttgggatagggaatggtgtgccaaa

SEQ ID NO: 8281 - DNA, 536 bp, Zea mays
  Clone ID: LIB3279-180-Q1-N6-D6
gattacaacgctttcagaattcagatacatacaagcggcacagtccaagccaaatatataactatcagcttttccagccacgcacaacaaaccaatcaagtttgacaacccatctcacgaaccaggtgtcacgacagacacagggggctcgcacatggattggagccacaacatacaaaggggggagcctatccccaaaaaaacttcaggtccgatggaaacaaacaaacgtatcatgcaaatctgccacacatatctcgagaaatggaggggacataatttgagactaggtaacgacgaggaacttgggaaaccctaaaagcacttccggggaacaattgccgggccagactcggcgtactcctccttcgatatccacatctgttggaaagtgctgagcgaggctaggatcgaccctcctatccaaacactgtacttcctctcaggcggtgcaacgaccttgatcttcatgctgcttggtgcaagggaagtgatctccttgctcatacgatcagcgatacccgggaacatagtcg

SEQ ID NO: 8282 - DNA, 508 bp, Zea mays
  Clone ID: LIB3279-180-Q1-N6-D8
atctcactcattctgaagtacttactggtaaaagaaaactagttcaacatgggcgtccacaaaaaacatccatttattctagtgtactaaaaagaacacggggactattgcagatgccatccttctccagatgtcagtcagagactcagagcacactcaagtctttcactataaaacaattcatcgtccgttcagcaggcaaaggactagcagtagaacatggaccccttcagctcattctttatctctggaatttgcttccgaccaccattagcagcagctgcattattgtccaagcctttggcgaggtaaaccccggcccgatgtgcgagcttttgggcctagtttgcgggaggagcgaccgacaacgaacgattgccgcctgaataagtgtaacacaggttatttgtgagagcctgcagttcatctgccgtgaagttgttatcatctcgcagtacaaggtacctcacaggacgccttgggcctttgataacaccagattggctgc

SEQ ID NO: 8283 - DNA, 640 bp, Zea mays
  Clone ID: LIB3279-180-Q1-N6-D9
accagtgttcttagcaactacttcctttgcggtggtgcattttactggattcctgttattggagcctctgacccttgcatcaggtttcgctttctgaatgccctctttcttcccagcttccttactttcagtagcaccagagtttagtgaccttggcttcagatcacaattggctgacacattggagacagtacgagcagccttgtcagacttttttggttgctctgagggctctgcagagatcttcagcttctcaaaatcgtccacaatatcataaacctgaagaatgtccttgactgggtcctccaattctgtcgctaggcaatggcgggctacataggacttgagttcttccctcatccggtccaaaggctcacattctgattcaagagcaagcttaaagaagcccagagaaactgagtgtttggaagcagcctctgcaagcctgatctgtgtcatccagtacgagattgaagaaagcgtgctgaacttgcgccttgacatggacatggacacttctgatgtcggagtatcaaacctcccctggctgtccgatctctttgaccgaaccccagaaccggagtacagttccaaaagtattggccttgggctagctcctggcttggtttgtattgagtgc

SEQ ID NO: 8284 - DNA, 270 bp, Zea mays
  Clone ID: LIB3279-180-Q1-N6-E2
ttgacttcacatagaaaagctaaattggatggtcaaatgcctccatttaagagcataacagacaacacttatcacactactaaaataacatcacaaacacatctcggtttacaatgtgctactgataagtagctagaaaaatccagaggcatcatgtactccaggtaaggtaactttcatctttacatcaatctagagagcatggaaacctcatccatgcaacaatttgatacaatatgtagagcatggaaaactaaacccacgcgtccg

SEQ ID NO: 8285 - DNA, 641 bp, Zea mays
  Clone ID: LIB3279-180-Q1-N6-E4
ataatagaaccatatattcagcatgcgccaagcactgcctccgtctggtgaaaaaacgactatcgactccggagcatggcatgatccgttatttcccgtatcagtaaaaagattttactacttatttcgtgaggtggaataaacaattgcagaatccaatctcctgtacggctgtattgatgacctttctcctgatactgataccgcacaagttacaacttcgacctagctaactctgtctctagcaaccgtgaatacatgtctgagatttcttttgcaaagtatgctttggcttgcggcctcttgaccttgaatgttggggtgagaaggccattatccaatgtgaatggctcagcaacaagagtaaccgctttagcaaactcgaaacctctcagctgtgcttccttcgcaatggaatccatatcagccaggacagcagctgttgctctaggatcagcacagagctgtctcaagtcctcgtactggattccttctgatgcagcccaagccttcaacacatccggttcgactgctacaatggcaactagggaagagttgaaactatcaccatatataaagcattgagcaatgaacttgcacttagcatagacattctcaatcttctctggagctatgtattc

SEQ ID NO: 8286 - DNA, 612 bp, Zea mays
  Clone ID: LIB3279-180-Q1-N6-E5
aaagcatgaaaccataagccaaatatatagttttttgagtaaagtgcatttccggtcccttaacttgcgccggtgtgtcagcccggtccataaagttttaaaatgtgtctcttaaagtcttaatcgctgttcgggtctctgttaggtccaaaacggttcgaaacaaatccggtagcaggtttttcagtcttcttccttggcctacctgtcatttccttcttcctccgtccggtagtgtgcgctcggggccactcgtatattcattcagcacatattaaggtcgtcctcaattctagtcttggtctgcaggcccatttcctcttggttccttagcttctcttctatcggggccagagacacaacagctcgctggtactgcagactaaccgtccggctgcaggcgcaggcatagcggagcatctgctgctccacctggggcaagtgagcctatggagctggtcacgttctggtggctgctgggtggcccgccggaccatcccatctgactgcgaatccagcgccttcttctgcaaccgtttcggcgcctgcaggagcgacggcacaggtggacgggtggttgctgtcatggaccttcggtccatggggatagct

SEQ ID NO: 8287 - DNA, 652 bp, Zea mays
  unsure (1)..(652): unsure at all n locations; Clone ID: LIB3279-180-Q1-N6-E6
agtgtaaaaaggtactttgcacagccattatgcacgccttaccatgggtagagttcccacaatacagcaagtaactgctctgacttaacagttaacacccatttgtccaggccacagcaactgcgatagctcaagaagcacaaggagagagtcgctggcaaagaatgaaacgatgaaaattacatgcgcgagaacgccactatcttgcggtgacaagtgctcaggagccacagcaagctgaattctgcgccgccgccgctgcctcagcttccccttcagccttgatcttgatagttcgatcctcaggcttggaatcggtctccgaaagtctctgtttgatgtcccttgctatggaaaagaaaacctgctcgacattcaggtttgtctttgcactcgtttcaaaaaactttatcccgtattcgtcagcgagagcttgccccttcgaagtgggcacagcagaatagatagattccaaacccgtttgctttcatccatatcagctttattccccaccagaattttgttcacgttatccgaagcatgttgctcaatgtttctgatccaatttcttatgttattgaaagatgactcgtctgtgacatcgtacacaagcaagatgcccattgctnccctgtagtaagcagtagtaatc

SEQ ID NO: 8288 - DNA, 487 bp, Zea mays
  Clone ID: LIB3279-180-Q1-N6-E7
ggaaaaaaaaggcccccgttttaaagcccccaaggggggaaaaaatacaaaaaaaaatttgggaaaaaaaggggggggaacaaaaagaaaaccccctttaaaaaaaaaaggggggaaaaaaggggggaaaagccccccccggggaaaaaaaacaaaaaccccaaaaaaaagatttttttttttttttttgggaaaaagggggggggggaaccaaaaaagggggggggccccccccaaaaaaacccccgtttttggggtggagggggaccccccttaaaaaccaacccctttttttggggggaacggggttgggaaaaaaaaagggttccaaaaaaccaagtttggggaaaaaaaaaaaaaacccttggggaggggggtaaattaaaaaaaaaaccccccagaaaaaaaaaaaaaaagggccactttttttttggttcaaatgggggaggggccaaaaaaataaaaacaaaaaaaggggggggttttt

SEQ ID NO: 8289 - DNA, 392 bp, Zea mays
  Clone ID: LIB3279-180-Q1-N6-E8
taaataaagagaaatttgaattatagatgatggtaccagttctttgtttgttattagcttccagtataaaatgtatatgctctactacaataatctacgatgtaaaaagaatgtgtaaaatattgtttgtatatcataagtgaaaaattagagtatagatgatagactctgatgacctattacaagactgaacaatggatgtcacacaaatcatatacatgcaggctccattgtccccaatccaatgctctgcgttaggaagacccacgctccgtgccacttagtaagtccatgtgttagagaatgtgttagagaatttgggcttgacccaaataataatttatgtatatcccaaaggttcacccacatatgtatggtatggtgagaatttt

SEQ ID NO: 8290 - DNA, 515 bp, Zea mays
  Clone ID: LIB3279-180-Q1-N6-E9
ggacgaaaaacacaaattttgcatttcaaaattgattgaccagttacacgggacactacaggttcaatcaaaaccttgggggacttgaaaaacagagcctacatgctcaagccgtttgctgattacaacagtcagtcatgtcaaaaaccaactaaggggtgtttcgtcccctcaggacggacagatgtgcagtctcagggaaggtatggacccctttgaggagaggaccccatgaacgttcgttggatgccatgaatgagtctgactggactctccacataaagccttccggacgaacacatggggctcttttttggactccacctcgtctttttgatgcataatcagaagagctcttctcacaatggattcgttcattcccatcctgtttagtccatcaatcagccggcgctcaaatatggggcttccaatgcccattcttcgctttatctgggcttccgcttgcttgatttcatttgcgatctccggggacaggttcaaatgctcgttgattc

SEQ ID NO: 8291 - DNA, 642 bp, Zea mays
  Clone ID: LIB3279-180-Q1-N6-F1
accgaatcatgcttgaaatcaacaggtgttaactactgtttgatcagcaatacttgtctttccacaaccaaaaacaatgggtgttgcaccgtttccctttttattacttgtaaacagtacaggctcaccgtagttgcggttctctagggaaatctcatggtcatggaatagctactggttactggttagccacttgcttctgcctcagtgctctccaaccaatgtcacgcctgcagaacccttctgcccactcgatagcgtctaccgcaccgtacgctcttgcccttgcttcctcgatgtccttgcccttggcagtgaagccaaggactctccctccaacggcaacaagattgccatctccatctactgctgtcccagcatggaatatcttgacagctggagacactcgctcagccttgtccacgttttttattacggtccccttcttataagagccagggtatccctggcttgccatcacaaccaccatagccatttcaggagaccaggtcagtgaaacattgctcaactctcctttgcaagcggataacagaacttgtgccagatcagattctaatcgcatcatcagaacctggcattctgggtcaccaaatcttacattgtactcaataaagcttggca

SEQ ID NO: 8292 - DNA, 609 bp, Zea mays
  Clone ID: LIB3279-180-Q1-N6-F2
gatcactaaccattcattgtctgataatacaaccgaattgcaaatagttcatgacatatgctccataattgacttctaacattaaaagtgctaagaacacaaatagcaaaactttgaaaatgcaaccagagacaggcacgcttgttgtcttgattgggaatgatcggacagtggcagtatccaagcacccgacgagctgctcagcggtagcggcggagggagagggtctggttgcgcttccaggtggctctccttgagggcctgttcttgtggtgggtgtggcccttgccacgcaggccacggtacttcttgcctgctgaggtgaggccacggagctcacggtgcttgtgcacagggttgcatagccagttgatcctcgggtcggttttgatggctttgtgggcaacgtccacaaggatgatctcaaagtacttgtaggtactatcctcattcacccagtaggagttaagaaccctcagtccaccaagcttacgtccagctctctcctcagcgacagacctcttgttcctctggaacttgagctgggtgataccctggtgcttgggcttgccatagacaatacccttgggcacaggcctcttcctgcca

SEQ ID NO: 8293 - DNA, 615 bp, Zea mays
  unsure (1)..(615): unsure at all n locations; Clone ID: LIB3279-180-Q1-N6-F3
gaaataaccgaataaagcctaatagataaaccagatatgatacagccgggccacaccgcccaatatagatccggcccatgggccaacaaacctcttctggcatgtagaacgacaatggattgtaggctctttcaatttcaaccgacattggcaggcaagatagacattgtccagaacgaaggtgaccattattctgtttgccccgtaagaattacactgtgatacaatgtagcgccaaccatatccaacgggaggagaatatcagttggaaccaaatgatggtcaagtttacagcacaacagtctgatcttgtactgtcatttgtattcttggaagttgacgtggccagtggcttgcgcatgttccacagcctcctgttgaccgatgacgccgatctggcacaccccgcagcgcagagtgaagtttgcggtgtcagtgtagctcctcttcctttgcgcctccctcactaagttgagggcaaggccttctgctggaccaatggaacggtcacgattgacggggaagattgtctggtcaaattcttcaggtgcaccttcagccggagacatagcgagagcatcataatgcanaccatcataaatgagcatggccctt

SEQ ID NO: 8294 - DNA, 504 bp, Zea mays
  Clone ID: LIB3279-180-Q1-N6-F4
gccgccaaggggcctccccctaaaacacaaaatgggaagcttaacttacactggggggggttttgaaacggcttaacttaccctggggggggcccaaaactagcacaggctgcagcaaaagcatttgcaaggccagaaacacaatccttgggggaggcgacaaacttggacttgaagggtttttttgcaaaaaaagctaatgaggaaagggtcatgttgtttttaaaaaatccctttccctggagcactttgatgacacaaaaccggggcactagccgtttttccaaactgaatgcgaacaggaaaggcctttgcaaaaaaaactgggggtttatccccccctcattgaccaagaactcgattttgggaaaaaaaatccccccaaacaatgctagtttttgggggattttggacactggttttgaaacctcaaactcaaaacaaccaaaagtcctcttaaaaaaacaagtttggcagcaacctttttagggggaaaactgggga

SEQ ID NO: 8295 - DNA, 652 bp, Zea mays
  Clone ID: LIB3279-180-Q1-N6-F5
ttttgtgcttaaacgatccctgccatatcataagtgcttgcttgggtccagatgaaaaggttacatcaataactacagcctgaacatgagcagcgttagtttctcattacagtcaccagtacagctacagcaacaaggagcctacattattatatcgacacaagaacaacattccctgaacacccagttccatacatcagcgttgatgccgtcagcattacatgtccttggtgactgtcacaaccagaggtccacattctatcgtttcggccatcttgaggcccttcaccacctccagcatagttggcctcttccatggctcgtccacagtgcagtctcgggcaatggcgagcacatgggccatctgtacccgccacacgcttgagacaggcaaacaaggatcaaacagctcaccttccttgccatgtgccatcatccatcgcacccagccaacaaggtttccacccccttccccttcctcttgccctgtaggtggccgtccagtgagcagctcaagcatgacaacgccgaagctgtagacgtcgccttttgtagaggatttcattgtcagggcatactctggaggtatgtagccaaatgtaccagcaatgtcagtgctgacatgagtctcgcatgcactgattatccttgc

SEQ ID NO: 8296 - DNA, 590 bp, Zea mays
  Clone ID: LIB3279-180-Q1-N6-F6
cagccaagatatcggagccttcgacaccgacttaaccactgcaagtatcatggctggggcaaccaaccacatgagtgtcatacaagacgcaattggtgaaaaggtaattgattttcctcgtccggcctcctcataacatgtcacttgcaagagtcactaactaaccaaagagaagaagtacccccaaaaaaacaaaaaaaaactgctcgatgataacagagatcttaaaagtttggcttatcctccagatgggtcacttcatgtcaaacttctccacgttcttagttgctatcattgttgccttcgcgtgctgttgggaggtcggcctgctctccctgctagttgtgcctatgctcctcatggttggagcatcttactcgaaggcgatgatcagcatgtccctcgcaagaacatctttcgtgtctgaagcgaccgctatcgtagaacaggtaccggctcatcagttgtaccgcccgccttcccctccgctcctgtttggtccctcctccatccgcgcccctcggactgttgcgcagaacagctacccaaccggaggctggctggcccgcagtcgctgctcctgctcctgc

SEQ ID NO: 8297 - DNA, 544 bp, Zea mays
  Clone ID: LIB3279-180-Q1-N6-F7
aaaagcgcgacttcttttttcacataaaattcgaatccgaatcctgaacaaccaaggaagtagaagaaaaaaaattacaaacaaacagtttctacgctcagcacggctattggcagagcagcaccaagattagtaataagtattgtccgccgctaaacaccgttacaaaatttggctcggctcccggcactccacgtcaccaccaccatcgtccatctacaaccatctacagctcgtcgtggtcgtcgtcaacaccgccgtcagcgtcaccgccaggggcgccgcccgaccgctggtacacggccgacacgatggggttgcacacggcctccacctccttgagcttctcctcgtagtcctccttctcggccgactggttgtcgtccagccactccagcgcctccttgagggcctcctccaccttctccttctcctccgcctccagcttgtccgcgagcttgtccttgtcgcccaccgtgttcttcatgttgtacacgtacgtctccagctggttgcgggcgtcgatccgctccttcaccttctt

SEQ ID NO: 8298 - DNA, 657 bp, Zea mays
  Clone ID: LIB3279-180-Q1-N6-F8
aataataacgcttcgttgtacgtgcagagatccagtagtgtttggcttcctgcagatacaaattcacctgagatcgaagacaaacaaaagtaatactactgtttagctagatgcaacttttgcccggcaagcacatacatacactacacacgactaggtaatgacacacatgctaacaacaggcatctatacgtaccgatcgacacgacgacacacacataatagacatgcacgacgacatggtacatgcatgcacagacgacgacgacaagaacattttaattagtacgaacacacacactctagataggtacggtgacaagatgagagagagaaagagacacgtacgtacgggcccctgcctgcaccctgctgcagatgcacacacagacacgtacagctagcaatgccgggggccttcctgcttggcttggcttggctagcacactgctagcagtcgggcggcgtggcgaggccgcacttggccggaagctccatggcgcgcttggggtcgatgttgtagacgcccatccacggcgagttcttgtagccgccaggcacttgaggtccgccccgccagcgcgtcgcagcacgcctgcgaggcgcggcggcgggtccgtcgtcttggccgcgcggctgcacgacatgaactgtcgt

SEQ ID NO: 8299 - DNA, 572 bp, Zea mays
  Clone ID: LIB3279-180-Q1-N6-F9
ggccaccatagaacaaaataaataatataagcatctcagacagcaaacttgaggcaaccagaaatttctgttcactacagaattgagtgaccaaacataaaaggagccatgaaggccaatagcacccttacaacacctgcaacacacaattgagatgatcatactcaagtctaaacacattccaacaagctctcaaacgatggcatttgctgcactggcgatcctaggccaaaggtcagcacactccttgccgataggtccagtgattgcagaacctttcatctcacccttgggattcacaatcactccagcattatcttcgaagtacatgtagacaccgtccttgcgacgccacggcttgcgctggcggacgatgacggcgggcatcactttcttcctgaggtcgggctttcccttctttacgggggccatgaccatgtcgccgacacaggcggacgggaggcggttgaggcggcccttgatgcccttgacggagatgatgtaaaggttcttggcgcccgtgttgtccgcgcagttcaccgtggccgccaccggtagacccagtgacatgc

SEQ ID NO: 8300 - DNA, 630 bp, Zea mays
  unsure (1)..(630): unsure at all n locations; Clone ID: LIB3279-180-Q1-N6-G1
cttggacataacattatcagatttagctaacagataccagtgaattagtcattaagatgtacaaatggagcaaacattaacctgatcacaatgccatttcagcttgcagtgcagcaagctcatcatcttcagctgtagctttctgtggagcagggcgagctggttgcttgttgcctgggacatgcactggatgcacaggaagagctgcaacaggctccagaagctgagattccaactctgctccttccagttcttcaagttccgcttccagttcatcctcgtcaaaatcagaagctccaagaggagttgacaaagcatcttgaatttgtttcatattttcagtctgttcattaatttcatccatggtcttgtcgacatcatcaatgtttgttgctttttgcattgctttcatagctgcagctccagttctcaacgcatcaacagtctctgttgtagctttagctgcttctaacatgatcatctgatcatgaattctcaactgaaaatttccgagttgctcaatttgttgttcataaagttttttcctcttcaaggattggatagccgctcttttattcttagctntggagaactccttggctctctcaagctcagcggctgcttttttgt

SEQ ID NO: 8301 - DNA, 619 bp, Zea mays
  Clone ID: LIB3279-180-Q1-N6-G2
tttttgcagctattgtactgtttggttgatgctgatgctaatgtaactaggcaacggtgctactgatctaacgcctcctttgtccttttattcttccaaacatgaaccaaccttcaggagcaatggatgtaatatagaaaatccagaaaagaaaaaggcattgagtacatgtgttggatggagatgaaagcagacagaactgcatcatagaatagttcattcatgtagcaacgataacgggggatattcactactgactactctccctcttccctctagcttgaaacaagtgacatttctaacaagacgctcacatctgccatccatttacagagatgggagagtggcctctgccatctacatgtcgtcatccaactcgttcttctcatcctcgtcttcctggtcaccatcgtcatcctcgtcctcgtgaagagccttgcactttctgagcttctttgctggctgatccacctcctggtcatctgtcttggctttcttagtggcaacattgttctcaccactgccctcgccattctcggcctcagccttgagctccgcggccttttcaatgtaaggcttcttctcctggtccagaaaaatgaacagcatagcgtgaatg

SEQ ID NO: 8302 - DNA, 642 bp, Zea mays
  Clone ID: LIB3279-180-Q1-N6-G3
gtgttgatttaacttatattcatttattagagaaatctctttatgtacagaagatgctgagaggccacaaaacaagcattgaatctgaagctagaaagttaactcaattcgaaggcacaacatttttgctgcaacatggccgttcgaggtggccgatgcaacacatgctttgcacaatgtcctcgagtttccacctgttatgcactccagagacgggactgtgaccctgtcgatgatgtattctattagtttagctcggggtgaggtgagataggagattccggtggtgccaccgcaaattgcattgttcttccgttccgatgcagaatgatcgccacttccgttggtaatagcattgcttcttcctgtctttgtctttgacgctgcatgatactaatagcccaagccataatatagcatggcagcaaaaatccagctgctctcaaaagaaatagcgagaaaatagcagatgcatcatcttcatcatcactgttagtaatggtcagtgtatgcctcaggagcaaaagggccatcaaaatcagaaatatagagcggcaaaatgcagcagcgttgttgtttgttgcagtatattcatcatagtcgtcttcaagtagacggtgttgagcagcagccattgccaat

SEQ ID NO: 8303 - DNA, 625 bp, Zea mays
  unsure (1)..(625): unsure at all n locations; Clone ID: LIB3279-180-Q1-N6-G4
aagggacaaattatcaggcatcatcaatcaggccattccaagctcgttgattagcaaactacaggcgttacatgaaaagaaaatgtaccaacgatatcattcagacagcaatgcaacagacattgcacccaaatgtgcgttataccgtagcattccacagacattcaagtccccctatatatcgaaaccatcactctagcaaatccccaaacagaagttaaaaggtacccagctatgcctgggtagcattttttatgttgcagcaaaaaaggatacattccccgcttaagaggtcgattcagcttcctatttcccagctcggcgacagcaaaaccagagatcactcccacgctttaagggcaccacccctcccaattgccttgatgatagtctgcttactgttgcgcgcactgcactctctgggctccgcccggcatctcgtcgtcctcctcgtacgcctcctgggcagcgtgagcttgcttcctgcgcatctcttcctcgatgttgttcacatcatgcatagtcgtctcctcgcattcatctatctccatgtctgtcagcttggatgaaggccttggtggaagtactgtctcgagagcntgcactgctctggtgccagcgagtc

SEQ ID NO: 8304 - DNA, 584 bp, Zea mays
  Clone ID: LIB3279-180-Q1-N6-G5
actatctggacgacatcctcgtcgttaaggccatggccgaggccgcaatgctgtggatagtgccttgcgctggttccccatacgagcacatacttcacgtccttgagcaaacttctatggatatgattgcagaagtcctccaccgtgcagccacctctgtcggtggaaagaacaacggggtctgtgaaatcaggctgctggccctgtggctttgtatacaccctcactaggcccatctcctcccacattctcgcaagtagtctgtccaagttcagcttcaaattgcagctgatcactagtgaatttggttgccgagcaagattatcaacgtcatcgataccaacaacatcgatcttgttatatacgtagacgcactttatgtactttcggttcccttcgataacgtcaatgagatcatccacagtagcatcttcacggaataacacctcagcattgtgaattttgtactcgtgcagaatctgatagcacagcttctcatcaatatgagtcaaaggaacagtggtattgaaagaaatcccacccgtcttcttcctcttgaagtatatctggggaggccttttgtt

SEQ ID NO: 8305 - DNA, 631 bp, Zea mays
  Clone ID: LIB3279-180-Q1-N6-G6
ctttgtttttgttttttagttcaaaaggtcacttgggtgatatcaaattcagaagtgtgcataacacatggtaatggaacgattgagagccatagctacaaaactctggtttcacatagaactaggacacaacatttgaactaggatgcctaatgcgggggtgagatgatgccgattttgttggccacatcaagagcatcatagtcgggagtcagcttcacgtaagccttcttcttcccatcaggcctgatcaaggtgttgaccttctttgcctggatgtcatacatcttcttgacggcagccttgatcttcttcttgtctgccttgaggtcaacaatgaagaccagagtgttgttatcttcaatcttcttcatcgctgattctgtggtaagggggtacttgagaatttggtactgatcaagcttgttccttccggtagtgctgattcgtgggtacttggggtccctagccttcttcagggtcgtggggcggtgaaatgtcacagacgtgcggatcttcttggtcttcttcttggctgccccagacttcacagccttggcaaccttcaaggcctgggtcttggcatcacccttcttggcaggagcagctttaggagccatttcagcttctc

SEQ ID NO: 8306 - DNA, 624 bp, Zea mays
  Clone ID: LIB3279-180-Q1-N6-G7
gcttcaaagactgatggttggtttgttggcaaggaacaatcagataacaaggcttgtttcttgtacaaggtgctgtgttacattttatgcatatcactcgctcactacaactctacaatcgatacagctgatatatatacactacaaaatgtatcccactgccgtcacacaagattgtatacaaagcctgcagctggctgacacttttttttcttctctcgttagttttcttcgctttgattggaggttccctatgatctccatggtgatcggttcttgagattcatttcgagcttctgtcgctcgccctccacctcggcgaactgcacgctgagctctgaatacctgccctgcatctcctttagctcgttttctaccgccatctgcctcctcttcagctcgatcgtatcttgtatcacttcattgatgtccctgaagctttggaagatcgctgcttcatcattgtgctgcttcaagaatgaactctggaaaaggatgtttgttttcttctttgcttggagagcctctgcaagctcgagttccaaggcgagtaatctttccaaagcattgccagaaccaggaagctctttaaatgatggaaaatactttgcaaatgctcatttg

SEQ ID NO: 8307 - DNA, 630 bp, Zea mays
  unsure (1)..(630): unsure at all n locations; Clone ID: LIB3279-180-Q1-N6-G8
aaaacaaacgtctattgtgatctgagatttaaaacaggcaccatagatgcttggggcaagtacagactgcaggctaaacatcccaatccaacaacggtcgagtgccgatgaagcgaagaaactacaaactaaactgcctcactccagggacgggacgacacttgcaaggaaactactcagaagacggcactaatctactgcatctagaaagtccttcgagaaaacccggttaggccgacaacgacgagattttttccctgactgcaaacacttggacagagtttcatccgtcatacatcactcgtcaccctcctcgtcctcgtcgttcacctcggacttggacttgtcggaatcaccagacgccgtggggtctccagactgcttgttgttgtaagcgtcgatcttcttggtgtactcagccttgagcttctctgccttagacacgtagggagccttctcggcatcagacagggacttccacttgtcaccaccagccttgccaatcagggagacttgcttcacattggggtgcttctccttgtagtccttcctgaactcctccatgaagacgaagaacgcgctcggaggcctcttgngcttngtttggtccttctcagccttggtcttcct

SEQ ID NO: 8308 - DNA, 603 bp, Zea mays
  Clone ID: LIB3279-180-Q1-N6-G9
atcacaaaacaatcttcgtgctcaaccagtaacgagtagataataaggagacgacatcaaatatcttccaaaattcaaaccaggacaacaaattgtgctactaatctcggtacagagtgatgactaattactgtcgactgatcaaacacaacggttgcactatgctgatggcaacacggagggccacaatttgttttaaaccttgaatccacggctgttcctcctgccacgagccttctcgaacttccttcccttggagcgcacatacggcttggtgtggctgtgcggcactccaggagccttgccaaagtgcctcactgcctcacgggcattcttggggcccctcaagaggaccgtgttctcgccaagtggagcacgaagagcaagctggtcaaatgtgaggcactcgccaccagcattgacaatcctggcccttgctgtctccgtgaacctcagggcagtaaccttcattgctggaacctcctggatccttttgtcatctgtgactgtgccaacaatgacagcaatgttcttctcctttccttccataaacttgacaaggcggcgcatggagattggtggtcggttggttttactcatgaa

SEQ ID NO: 8309 - DNA, 416 bp, Zea mays
  Clone ID: LIB3279-180-Q1-N6-H1
aaaaaacccgttttttataaaccaattttttttttttttaacaaaacgtttttgggggggtgaaacaaaccctaagggggttggaaaaaacatacgggggggggggtttttgcatgcctgcatttccttttttttttttaggttcctttttatactaggactggtttggggctttaattttggttttttttttaaaggaaaaacaattggggctcggttgggggggtggggtttttgaaaacggggtgctacattgggttttgaaccggggcggtgctggtgccccggtagctttttttggggggggttttttttgcaaaaaaaaaaaaaaaaccccccccccccccagggtcgaaaaaagaaaaaaagccttttcccaacgggggggggtcccatgggggtgccttcttgggaaa

SEQ ID NO: 8310 - DNA, 220 bp, Zea mays
  unsure (1)..(220): unsure at all n locations; Clone ID: LIB3279-180-Q1-N6-H2
caaaaaacagggggggggnacaggccccggcagagacgggcaacaanaanggggggcaagggacagganncagaaccacccaaaggccccggaacggaaggagggcacgaaacaaagggggcncacgggnnagggacaaaccaacacnanaaggaagggggggngcggcaggcaanagcaacngcgggacaacaccaacnnccgccaaggnncaacgggg

SEQ ID NO: 8311 - DNA, 639 bp, Zea mays
  Clone ID: LIB3279-180-Q1-N6-H3
gaacctaacgcaaagtttattttcaagaagagcacaggaatgctcatttccgaacaattcaatgtctcgttacaagcaagcatgctcacacataggcactcaactttcgtcatagatgacacatcactgaacaagcaaacaacccagaacagacttggcttattccattcaccgattgacagggcaaccgtttcaagcagatggcttcatcagggcagcgaccttctggacagacggcctctccatcagaccagaccaccaggccttcacatgcgggtaggcgtcgagcacagatgcgtagggcgttgcgaacaggcagagagtgacagacacatggttcaggtcggcgaggctgaggaagtctccagcaaggtacttgcacttggtcaggcgtgcctcgtacacctctagcaccttcttcagcttctcaaggttctcatccacaactttctggtcggtggttcccccaagcataggactgatgaggacctggaagaggatgggattcagtgcagcggtgtactggttagcctccacctcgatccaaacatccaccattgctgcctcctcgaggtttccttccctcaaagctctggcttgtttttgcgagcagcgtacttgcagattgctcgtgattcg

SEQ ID NO: 8312 - DNA, 569 bp, Zea mays
  Clone ID: LIB3279-180-Q1-N6-H4
caaagttcaaacttgacaaatgttaaattcagcgttgattaaaacataacattgaacagatgcaagctaccagttttcatatttcaccatcttaatatggtctattgactgaagtactggactgagaggtgaacttgcagcagaattacattactgcctcaattgaagctaggacagataggtcccttggacaaaccaaggcgaacctccattccatggtgcatgtcaggttgacggaaactgtcagaatcatgaggcatgttaagataatcttcaaatccaaaatcatccaaggaacctgtcagtgcctcgtatccaagcagagatgacggcaaagcaccagggggcctttggaacctggagaggatttgggcatcgagatccttgcggatgttgagggcggatccgtatatggcatctgtcccgaacttcttcttgtccgcccagaacttggtctccgattggatggtaaactggagcggttgctgcggagctaggtcggctttgacgccggcgttgatgccaaagcgaatggtgtcgtgggcctcgctgatctccctcttcatgct

SEQ ID NO: 8313 - DNA, 640 bp, Zea mays
  Clone ID: LIB3279-180-Q1-N6-H5
atcatatgctagaattgtactcagcatgacgtttctgaaacacaagctgaacttcttttatctataattaatcaagtttgaggtatcatatgctagaattgtactttcctttatcagacacaggtagtgcatccgtaacagataggagtaacatcgtttccacctttgtttgcagtgtcattctttgaggtgagcaatgcatgagactctgcagtgcagtccaattggcaatgggtccttccactatttttataaagagaatgtttcgatgtattagcttggatagtccatggtacccctattccatgacaagaaagaggggtctccaagagtccttggcttaatcatgtagagaactacaaaaaccagtgcaaggaaaaggcaaaaaccaccaacaatcagatatgcgaaaccaatgaaattatttttgcctccaatccaagatgtagttgagaggaccagtgcttttgaccctccaaaactgtatgtgttatagttgttctgtataaccactgtgagttcatcattttccataatatctgtctcaattcttccataaagctttctgaaagttgggagggcagcagttctcatccaaacaatgagatcttcttgctcacttagcggtatgctctcattt

SEQ ID NO: 8314 - DNA, 672 bp, Zea mays
  Clone ID: LIB3279-180-Q1-N6-H6
gaatgaattgttatctcaaatatattatgtgactataaaattgtttgcagatatgcatgaacatgaactgtaaccacaatgagtgatattttaataactaccagtacaatacttttacgttgcgacgatatatgaactattcaataaaatgttagtgcataacaattacgtaaaaacaaacacatctatattgtcatcgatcttaatgtcttgcaaattctttgctttgcccgagtcggttgctctcctgcttggtcatgcacgagaactgagcccgaatagcacctcagtgacctcgatctactcttgcatgaaagacggcgacatcaaaatcttcgacggtgcgattgtgacgggattattgaaggtgctgggaacgtgcgttggtcctggaccgtcgtggcttccatcgccaccaagtggtttatgagaggcaaaaccgaatagaaaaaagttagcgaacacgagcaagatgggagacggaggtagatggctcaaaaaagagcagaagcaaaattattgtcatcagacatgtggatgaaacagtccgggagaccaaaaaaccgcgttttcacgatggtacgaacttttctcgatacagcacaccgatcatttcgtcaacaactttgcccacgatggtactcttcatattgaagtcgctaccctttcgct

SEQ ID NO: 8315 - DNA, 651 bp, Zea mays
  unsure (1)..(651): unsure at all n locations; Clone ID: LIB3279-180-Q1-N6-H7
ccatcagcaaagaaattacatttcatgatatagtctagccactacatccaataaaatcgagccttcggtaaagttttcaagcatagcaggagccttcggtatagtctagccacttggtagcatctaggaaaagtagtccctaacatgcatgtggccatatcggtcattgttgccaagcatgtgaaatatacaaaatctatttactgcagataactcacagcaccaacatgataaacttgcatctgtggtcgatccaacattccgtggcacattttcgacgctgtaataggctgttggacatcactgcaaatactcaaaatcttctgtgatcccaacctccctgtacatatgttccagttgttcttttgcttctgggaatgtggttgaacaccattgttgcaaagtgaaaatgttgtctgtccacctgttagctgctgaatgagcaatatcagtagcatccttcattgcttctactgcagctggatcactatctgcatatgcagccagttcctccttgagtttcttatggtgtagttctacagtcttcagctcctccaaagcagcttccctctcttcagagtcttcccggcctctnnttcaagttatctctgtgttcaacaaggtccatgtaacgctttctagagtttgaaa

SEQ ID NO: 8316 - DNA, 596 bp, Zea mays
  Clone ID: LIB3279-180-Q1-N6-H8
ctccatcaaactatccatctcactaaccatatttaaactctactctgtccagatggacgttatgttgggaacagtgttttacagtgctcaaacatggacgaaaatctttcgcattgcacagactgagctaacaccgtgtttcacggtggcctatttttgtcgagcgtcctgtagtgtgtttcgtttcacaaacagtgagaagatgacagctcaggagtcgagacacaggtgctgagatgcctgctggggttcctccgcggtgattttagacagagcaagatgttttgatttcgcactgtaatgtttacctaaacgagtatctggaggcaagcctacaagcttcggtagtccatgacggtcacttcgtcctcgggagcatccaggtcttggtagcttcgtattcgacgagggtcatgcatatgatgaggcggaggagcactgaagactggggacggaccacgcattggaggaccgccgctgcccgtccctgctttcctaggatgtggacctccactgggctcaaaaggaggtggcgcaccctgatccctcaacatatgcatggcaacttccggcggtgcgggaataaacggtccaag

SEQ ID NO: 8317 - DNA, 615 bp, Zea mays
  Clone ID: LIB3279-180-Q1-N6-H9
aaaaatagatgcggttttcacgatcaaaaccaatcgaaatgacaacagacaccaactagaccgaacaacaaacctactgcgacactacgccctagcgagtcatgtacaggcaacaaaacaaggccctcccccctttcaacccctggctagcgacacgtcaagacgacccgttctaccgcctctcggagatgatgatcccagccacgacgagctcgtctcactggtggtcctcctgtacctgcggtcaccgacccctgaagactgcagcaccgcgactaggccgagagctaaagccagacttttgagactgaaaccgctcccagctacagcaaggctagaggacaccatccgcgcgaggaagctcggacccttcgccgggttacctgaactgtcggcgcgtctctcggccttggtagctgacagggaaggccagacgtcctggtagacatcgcggacgaaggcagacgcctcgtctatgaccttgtggtttctcccgtgatgctctttgagccttatcgcgagcatgatgcggctttgctccagcctcgccatcgcgaaatctcgttcggcctgttgctgtgtctgcacggcgagaaaacactcgaactggtcctc

SEQ ID NO: 8318 - DNA, 641 bp, Zea mays
  unsure (1)..(641): unsure at all n locations; Clone ID: LIB3279-181-Q1-N6-A1
gcgctctaagaacttctgcctctattagtcgattagatgtcacattatcgttagacaaacgttcgcagtgggcatctatgctatgtacaaagtttcttccgaaggctctgcgacggcatgatccatctacccccactaaacccctacctacagcagctagtgtctagctatcgggcttcttgttccacccagattctcaaggtacgaaaacctcttggttgcaactggcgagatcttcgtcagcttcgggccgaccaagtcagatagcgccggcgaaaccggctccattctccccgtcttctctacctcggccttagcgtctgagacgaccttgtcggtgtcgtccgaagttaaactggcggcgattctcatcgattccgtgttcctgagatctcgagcggccaagtccgcgctcagaacgtcctcgatccgagacatgaccgtgaaagccaggctctccagagtcctggagtagctctccaaaatggcaaggccaacatccttgttgcattggattttgcttatgtccagcgccgactgggcaatgccaggaaacctgtgcttgatgaggagaagaacgttctccgccctcccttcgaacattccccgcttctcgtgactatgtccncaggcaatttgct

SEQ ID NO: 8319 - DNA, 647 bp, Zea mays
  Clone ID: LIB3279-181-Q1-N6-A2
gcaggaatgtgtgaacagtaaaggaatactgttcactatttataggcacaggacacagcccgtgagggattacaatcgtacccctcataaaagtttacaacaatgactcggactcttatggactaaaaggtcattctatctttaagtcggtttgtaattccgaagcttcacgaaatggcaccttcggcatcacgtacgagcagcttcagtcgaagctgtttctttctgcaggaccttcggcgacgaagcatggtcccaacatttatgaatgatgaagacttgttcttcacaaccttcgtccaagaaccattatgcccgaagggaattaatgcttcgaaggacaaaggtccttaacatttaacaattgtgttgtcttgttttatgaatcagtaataaaaaacaagtgcccaacatatatcttacaaaatattcttagaaattgtatttaggtacagttgactaaataaatacgccccctaaaatgcatctacataaacataacaattccacaaactttccatgaaaatcatatttatatacacgattttttatatttatagtgtctaaaagggaatgatttctaaaggtagatttaaacagatttatcaaataaataacattttttacgatgtcgtcttgttggcata

SEQ ID NO: 8320 - DNA, 590 bp, Zea mays
  Clone ID: LIB3279-181-Q1-N6-A3
acatcgaacttcgatgaatagcattgcaaatcaaaacaggatgatatgaacaacaatcatggccaatagggggctacgaacaatttatcacaaaatacaaaatggaaacacacagcagcagcacgcaatggagtggacccatacagagtatactcaaaataactcaaccattaagcaccagcgaactaattattaaccggctactcaatagtcatcgccctcgtcaccctcgtcatctgcaccctctgcgccgacttcctcatagtccttctcaagagcagccaagtcctcacgggcctcggagaactcaccctcttccataccctcaccgacgtaccagtgaacgaacgcccgcttggcgtacataaggtcgaacttgtgatcgatgcgcgagaacacctcagcaacggcagtgttgttgctgatcatacacacggcacgctggacctttgccaggtcgcctccagggacaacagacggtggctggtagttgatgccacacttgaatccggtggggcaccagtccacaaactggacagttctcttggtcttgatggttgcgactgcagcattgacatccttgggaacac

SEQ ID NO: 8321 - DNA, 497 bp, Zea mays
  Clone ID: LIB3279-181-Q1-N6-A4
ttcagtataaatacccacaataaagttatgaaatcttagatcttacaatgctcatcgacatgacactccactgcagttgagcttatcaatacaagacaaaccacaaccatgttctcgtacgcgcgcaccgaccatgccccatttggggtgcttgttcgggctccgccgccgtacccacaggcctgtcctacccccataatacaactgcgacaggtgatagcagccaacatcatcatggagttggacttgatcggctagacttgatcggctccctattgatgaactacctgtacattgtgccgactttgtcacagaggtatacttgatcggctccctattgtcgaactacccctacattgtggtaacttcatcacggagctagacttgattagctctctgttgtcgaactaatagctacgttgttgtttcatattgagtatctcgacaccgtctactatggttagcgttcctaaaacaggttgaaaacaacataattt

SEQ ID NO: 8322 - DNA, 603 bp, Zea mays
  unsure (1)..(603): unsure at all n locations; Clone ID: LIB3279-181-Q1-N6-A5
accaaactttgtttgctgcttttctgaaaccatacaagtccaatcacgaacgggaactttgttatcacgcggcatgcgatgccactgcaagtatattacagatcgggtaacatgtggtccaaatgcaacttttaatcacttctaagggagagggccaacaacaacacatgcgtccatatatgggccaccaaattcatggctacattaagcacaaatacaaccaaggcaacacgagagccagatggaaagaggtacactgatggcctaatgcaagcaacctgatgttctcctttacctttgttcttctccatttattcacaggctaactttgtatcaaagctactcagacaaatggcaaaggcctggaaagccgagagagggtagcgatagtccatcgtgaacatatcccttgccactttgccaaactggagaatcaccttgtcgggatctgacggggcaggctgagagggggttggcgcacctgccggtggcggngtagccgcggcgatcagctggaagttcttcaccgaggcaattgtcacacggccacggaagttgaggcaccaacactgcagctgttcgtgccacctaggcggcttatta

SEQ ID NO: 8323 - DNA, 264 bp, Zea mays
  Clone ID: LIB3279-181-Q1-N6-A6
cgcggtaaatttggtaagaacccactaatatcaactcggaaaagtggctacaaaatatgctttatgatgagccacctcaacaagaaagcacaaggtactgtccagaatgaatggcggccagaccagccagctctgcctttttgcccatgcattccaagaaacatgtcagcattcatttctttactaaattgctacgggcaagaaagtggaaactcatcagctaataactttggagacaaccccggcaccaaccggacgcgtggg

SEQ ID NO: 8324 - DNA, 597 bp, Zea mays
  Clone ID: LIB3279-181-Q1-N6-A8
tttacaacgcagtaacacacttatcaacatagcaaatacacagatgatacattgtttttgatgtcacacacgcaatcctccaataagtgatgataattctgtagatacaaagtgcagatgaaaactctgaaaatttgcctacaaatgcaaatgggattggatttggattacagcaacgccaacataagctttacatgcaaattatggctccacagggggctttagtctaatcaacctcctcactctgtctttctccgtgttttcaagcaaccccttccaaacaatctcatcaaggcacaagcagatcctcccgtatttgtcaaggaagaggcgctcggtaggaggtttcgcacaaacatccttgactgctgatgtaattgcaaagatcacctcagccaaagcaagctcatcatattcatccttgccaacaatgtagaggcagacatccccgaccgtggtataaacaatagacacagacttgtgggaggcaacgtggagctcctcgttcttggaccctttgaggttctcggacccgagcttcaccaggaaggagcgccagtggagcctctcctccgcgggaaccccatggaatcgctc

SEQ ID NO: 8325 - DNA, 603 bp, Zea mays
  Clone ID: LIB3279-181-Q1-N6-A9
aaaccagtctcttcgtatttcccccacttttgtagggtttccatgacaatgtttcaacaaaagaaattggcacatgtcagaaactacacagatcatcattgtacaaatggatgatcaatcaaatagttacaaattagaccttgacctaccctatctacagcacaaatgtcagtcccgacagcagctcttttcagttgcaaaagtgcctaaaattacccctgcttggccttcacctgatcgcctaacgcgccataggcttgtcgcacatcaaaaccttcctactggcgtacgcgccttcggcagtgtcacgtatcgtaccacgccaccccatggcattcgttatttctttgatctcctgtataacttctttccggtcacggatatatgctttaccacctggtctgagtatccggtccatctccagcaagatgctagagatattacacctgttctgctcctttgagaaatgaccagatgcatgaagtagatcgtaagtcctagggtatgtatcaaagggttcacaccagtcatgagctactccaagaagcccccgatcaaaaattacagtagtgtatttggctcactaataggaacaacattcat

SEQ ID NO: 8326 - DNA, 460 bp, Zea mays
  Clone ID: LIB3279-181-Q1-N6-B1
aaaaaaaaacccccccccatggggggggggatttttttttattccgggcccaaattggttaagggaaatatcccggtggtgggccggaaactaaaacaaaaaagtccggggggggggcaaatgtgctgaacaccacacaagagtttacatggaaacccaaaattgattttgaacgggatttaaattttgccccaagcaaaaaaaccggggggaaaaactagaggttggtgcctaaaacaaaaaaaccaaagacaccggggggtttaagggaaaaaaacccctactttccgagcaaaggcattgttataaaaaaaaacctcggggggttgggacacattttcattttaaaatttggaggcagggccttaaaaaggtttggaggcgggggactccccctttttttgggaaaaaaaaactgccttttggtttccttttggatccactttaggaggatacccag

SEQ ID NO: 8327 - DNA, 636 bp, Zea mays
  unsure (1)..(636): unsure at all n locations; Clone ID: LIB3279-181-Q1-N6-B2
gaagcttcaaaagacatgcctcttcattgtattagattagaaaaaaggataatccacaagacccaacacacattgngaaaagaaaacgaaaatacaaaaaacactatccactgatatatctaagatagactaaaagcttccaacttgatcattcaccagttacagaaacacaaccaccagtttatagtagtaataacacagtcctccatcgccactagcctcagctatcggtctcggatactgaatgaccagtgtacccgagcctctccgatatcaaatttacagcatcgcgccccccttcttggccgctttacttcttggccttacgggacggcgctttccgcaccggggtcgccgccttcttcgagggagcggccttcttggcaggggccttcttccctggcgtgtccttggccgacgtcttcgccgccttggcggggcggccggccttcttagcaagtggcttcggcttagcgccggcggtcttgggcttcgccttggcagctggcttggccttgggcttggcgggtgtcttcggtttcactacggctttcggcttcgcggcgggcttgggctttgtggcgggcttcgccttggcggnggtcttagctttgggcttggcagcggccttgggct

SEQ ID NO: 8328 - DNA, 443 bp, Zea mays
  Clone ID: LIB3279-181-Q1-N6-B3
cggacgcgtgggtttttttagcaattttaaataataaaaatgttggcaatttgcatttggtcaaatccatccagatacaacaggatgcagtgaagcgcatgagcacaagtctaacacgggatgcaatgcaagcaaagggcgtaatagtagtcgcggcctctagggtggcagcgggttattattcttggcagcgaacgcggtgacgaactggcagcgcaacgtttgttgtcgtcatcatctttcctcgtcgccggtctcagaactcgacgcccttgaagaccttgcgcacctgctcgagcgtgacgaagagcacaacggtgaagggcccctggcgcatcacggtggggatgaaccccttgtacagcgccatgggtccctccgacctgacggtcttgagggcgcagtcgacggcgccggcgtagggcgggggcgcgccgggcgcc

SEQ ID NO: 8329 - DNA, 576 bp, Zea mays
  Clone ID: LIB3279-181-Q1-N6-B4
tttttttttttttttttttttttttttttttttttttttttttttttttttttttttttttttttttttttttttttttttttttttttttttttttttttttttttttttttttttttttttttttttttttttttttttttttttttttttaaaaaaaaaaatttatggtgaaaaaaaaaaaaatggggaaaacaaaaaaaaaaaagggggtaaaaaaaaaaaaaaaaaaaagggtgtttaaaaaaaataaaaaaaaaatttttgtaaaaaaaaaaaaaagggggaaaaaaaaaaaaaaaggggggggggaaaaaaaaaaaaggggggggggggaaaaaaagtttaaaaaaaaaagggggaaaaaatttcttttaaaagggaaaaaaccgcgggagagggggcatttaaaaggggggaaaaaatttgtaaaaaaaaaacggggggggggtggcataagaaaaaaaaaaaaaaagggggttttgtccatcaaaaaaaaaaaaatgggtttctatagccgaagaaaaaaaaaccacttttttgaaaaaaagggccccaaaaaaaagggcttttagg

SEQ ID NO: 8330 - DNA, 191 bp, Zea mays
  Clone ID: LIB3279-181-Q1-N6-B5
ccgctaaaacaaaggggctttggaaattcagaggggccagcatcatacccaacccctgtccaagggctttttggggggccccaatcaaccaaaggggcggggatccatttatcaggctgggtcgacgttcattagcagtccaccaacttcggccccccccttttggcgcaaaactggaaggctcgcttctg

SEQ ID NO: 8331 - DNA, 621 bp, Zea mays
  Clone ID: LIB3279-181-Q1-N6-B6
cattacaaaagatagcaagatacgataaacccttccaaatgaatgaaagacgagtcagtttacgaatcatctgcacagcatgtctgaaactgaaacgaacaagcataactcaaccaccgtccaccagccatcacggttccagagttccaaggcaaccacagacgtcaaggtaacatctagcatagcatcgtttcgtcttggttcattcactgttcagcatccactcagaggcaacgaagacctgtaactacacatcctttccatgccaagtagatcagcatcttcagtctccaccaacctggcgtttccaggagtcctccacaatgagctcgtctactccccagtcttcataacttccatcaggtaggtaccgtctgatcgtgaagggtatcttgcgcgctctaagctccttcatcgcaatctcaagagggtcagtttctccctcaagctcaaccatgactggagcattcatgcttatctgcaaggctcgtgtaccaagaatgcgcgcacgttcatacttcgtcatatattttgttgttttgcgctcacgcttggtcttttcctgttccttatcttcaccctctccacctatgacatcatcaggggcatcttcgttgttct

SEQ ID NO: 8332 - DNA, 547 bp, Zea mays
  Clone ID: LIB3279-181-Q1-N6-B7
cagaaggcgccacacctcaaaatctaccaatacagtagattgcaatgataatcaggacccaaacgatgggttaaacgaaagaatgttgacagcagatctgttatcacaatgaaagaagacaagcggtcgcttctcaatattcgacgtcagagcagccgaaatctccaaatcttccaatcatccctcctgttagatcctgaagagtatagcccttttcacccactcacagcataactttaactcccccccccccaccaatgctatcacctacgtactatctatgcgccgctcctgcctttcttcgacttgttcttgttttcttgtgtcttctttttcttctcttcaggtgttgtccacacgtaattggaaggaatggcgaatgggtcctggatgtcctccacgcggctgcttgggccaggtgccgtcgacaagttctggaggtagggcgccttgatccactgaatccaggaacttgaagaaggctgcactgctgggctcttgctgttgtcaggacttgagggtggtgtggtgaactcatctagcggct

SEQ ID NO: 8333 - DNA, 208 bp, Zea mays
  Clone ID: LIB3279-181-Q1-N6-B8
gaaaagctaaccgcatggcctttgaatggcgtttattgatgttgttcaagtctatcatctataccacatgagcaaaggaacaacggagtgcgggaaaagggcccaaaaaacaaacaatttttctgaatccatgggggcatcatgcggaccccttaaaacccagctttgcctgaattgaaggaaaatgaaggaaatcgaacggcccccg

SEQ ID NO: 8334 - DNA, 519 bp, Zea mays
  Clone ID: LIB3279-181-Q1-N6-B9
gaagccaatttttataggcaacaacttcctatacaagttttcaaatatataccctggcttttgaccggggcacataaaacaattgggtccatctaaaaattgcgaggagcttctaaaaagaaaaaaaaaaaggggcgagaatactaaaaggggatgatctaaacataaacagaaccggcctgagtaaaaaaaaaaaaaaaaatcacttgaattgtcggcacaagggctgatcgtaaacattaaaacaccccttctccggccaaaaaaaaaccacgccacgctaacaccggcctccattatttacaccggccaaaaaacacctccattttctattccaggcgcaggatcacccatggagtacctgcagctgtatcaaccccgagtatgccccctcggggctgtacaccagggccccgaggctgccctgctccaccacgcggccgtcctgcaccaaggtgatcgagtcgacgccgaaaataggggacagggggtgccccaccaacacagcggggcggccct

SEQ ID NO: 8335 - DNA, 499 bp, Zea mays
  Clone ID: LIB3279-181-Q1-N6-C1
ttagaaccctgggatgcggaaccgatgtcggccttgcccttcccaccggccttcttgggcagcagcgtctgatgaatgttgggcaacacacctccggcggcgatggtgacagctccgagcagcttgctgagttcctcgtcgttgcgcacggcgagctggatgtgacgcggcacgatgcggttcttcttgttgtcgcgcgccgcgttgcccgccagttccaacacctctgccgcgagatactcgaggacggcggagaggtagacgggcgcaccaccgccgacgcgctcggcgtacttgccggccttgaggtagcgcgcgatgcggccgacggggaactgcagcccagccttggtcgaccgcgacacagccttggaccccttgggcttgcccctgccgccgccggaactcatattcacctcttctcgtctgagactactctctcgcttggtctaactcgacggaatcgctgtcgcgctggtatggcggtggtggatttggg

SEQ ID NO: 8336 - DNA, 469 bp, Zea mays
  Clone ID: LIB3279-181-Q1-N6-C2
aaattaaaaaaaaatttttttttttttttttgtttttgggggggggggggccaaaaaaaaaaaaaagggggttttttttaaaaaaagggggggacattttttgaaagaaaaggggatttttttgaaaactttttttggggggggggcccaaaagagggggggatttggggggtttaaagaacccttgtttttttgacccccagggaaagggggaaaaggggggggggggttttttttttggggggggggggtggttaagggggggcttttttccagttttttggggggaaaaatataaactttggggggcgggggggggcccctttttgggggggattttggctttcaaatggggggggggggccggcgtttaaacctcgggggtgtgggtttttcaaaaaggggtttttaaaaagatttggttcccccccttggggggggaaaagggggaagggcttttttttttggg

SEQ ID NO: 8337 - DNA, 433 bp, Zea mays
  Clone ID: LIB3279-181-Q1-N6-C3
tgaaggtgggcaacaatccaataacccattagatagctgagttcgcaaacaagtacaaggcatcaaacagtaggacaccaaaatgtttgtctgggctctatttccattaccgcaaaaaaacatagaacaagcactttaagtagtagcattcactaatgactgaatagaacaaaacagggtactatcttcaaccgcttcacttcttatcttccttctctgcctcagctgccttcttctggcgggcaccaagatgtttcttgttcatccgctcaaggcggagcttgccataggcagcaaatgacttcatctcatctgtgaccttcacaacctcaactgaacgtttctcaccacgagtaaatggcatgtagtcaccctggacctgggtagcggtggcaagctcctctggagtagagtcaccagccttcaccttgcg

SEQ ID NO: 8338 - DNA, 434 bp, Zea mays
  Clone ID: LIB3279-181-Q1-N6-C4
cacaaagctcggcagatattttacacaaactgattttcagttccttacaagttggaccactacacctccccaaactgattttcagttccttctatgatttcaccagtgttccttacaaacatataattaaattgttggcatgcaaatttccgatttcttccccttatattggtgttgcttacacttactttctccactgtctgaaatataagcacacttgcttacacttgcttctccattgtcaagacgcgtgcatttcaccaaccaaatccatcctggacgagccaaagggctgaaagaagtcgtggtcagcagcagccaggccctggaacacgccctcctcctccaagaagctcaggaaccctcccgggttgagatccatccacaggtcgccgcggccgaggtcgtaatcgccgaagccagctccttgctcc

SEQ ID NO: 8339 - DNA, 557 bp, Zea mays
  Clone ID: LIB3279-181-Q1-N6-C5
ggactagagctcaatcgcttttagaaaacagggtactaatcaggtctgaaaacatggcataacgctctgaacttgagacgattaaccaaaaaaagggggctcatcaggacacacatttcggggcaagacaatccatgagaatgctctaagctacagcgctcttgcccttcttcctctggagcttcttcatgtagaactcaagctctttaccctcaaggatgtacccatcagctcggccacactgtccagggcgggaagaaatgcatgccagcaaccgtccactgccaaattgctcctcaatgggggggtcaagggtacgtccctccttgcgcttctcaagcttcctcgggacatgggtgctctttttcgtttcctcagctgctgcctcaacctcttgtccctcagcattatccttctttgcagcaggggttttcttcttcctaccaatgtcaactccatagtgagtgaggtaccactgcttgaatggggcagcattaacttgcacaatggcactcttcacaagggtttgtgtcctcacaagctcattgtttgatgca

SEQ ID NO: 8340 - DNA, 432 bp, Zea mays
  Clone ID: LIB3279-181-Q1-N6-C6
ggggggggggggggggccccaaaaaaaaaaaaaaaaaaaggggggtttttaaataaaaaacccccccgggggaaaaaaaaaaaaaatgttaaagggggggggaaaaaattttttaaaaaaaaaccccccccccaaaataaaaaaaaaaaaaaactttgggaagcccaaaattttttttaaaaacaaaaaataggggggcccggccccgggagggcccccgggggcccccccggaaattccggcccggccccggggggggaccaaattttccttaagggggggggtaaaaaaggggggggaaaaaagggaaaaaggggttcccgggggaaaaatgttttccccaaaaaatccaaaaaaaaaaaagaccgggaaaaaaaaaaggaaaacccggggggcccaaagggggggaacaaccaaaaaaaatgggggggg

SEQ ID NO: 8341 - DNA, 643 bp, Zea mays
  unsure (1)..(643): unsure at all n locations; Clone ID: LIB3279-181-Q1-N6-C7
ctgattgctgaagatcttctcgatgaagacgaacatacaataagacacaaggacgaaactagagcaggacacatcccatccacagatctagacacgagcatgctacagcacacagtgcaaatgaagtccctactttctaagccttcttgggggacttggcgcccttcttgggggacttgggctccttgctgccggcgctggccgccttctccgccgccttcttgggcaggagcacggagtggatgttggggaggacgccgccgtgcgcgatggtgacgcctgccagcagcttcccgagctcctcgtcgttgcggatcgccaggagcacgtggcgcgggatgatgcgcgtcttcttgttgtctttcgccgcgttccctgccaactccagaacctcggcggcgaggtactccaggacggcggcgaggtagacgggggcgccagtgcccacgcgctgcgcgtaccggcccttcttcaggtagcgcccgatccggccgacggggaactgcagcccggccttgacggaccgcgtcaccgacttcttcctggggccgcctgccttgcgcccggccgcacccttcttccccttgctaccggctccgctggcgtncatggctacaggtgctgctgcgactggcgagtgggg

SEQ ID NO: 8342 - DNA, 598 bp, Zea mays
  Clone ID: LIB3279-181-Q1-N6-C8
ccggcaaaatcctttattctgtagacagaaggttcataaggcctcatgtggaccttcagaaagagccgtcaaagctactgtcccccccaccccccaaaaaaaaatttgtagcccgcgtaacaaaattgacgacggctgttagttctttgccgggggcgacttaggccgcaggctctcgatctccggtgttgtcacaacgaggtggggagcctctgggggagggtttcggccaccgcctccttgccatactttcccatccttgtctgcaaaactcctaatgtatgcctctttgttgaagttggagtaggatagattttttccaagggtaagccaccccgggcggatgttatgatcctctccaaagagttcgagccgcctccttccaagcgcaaaatgctcaatgatcctgtacatgtcctcaggcttctttgttgaaccatcggttggttcttcagctattattatatctgtgtcaatattcgcatggatgacatggccatccgtgctacgccgcacagttccttttatgcccatcaagcaatgctcctttgagtgctgcaacaatgtatgtgagtcatgccgcagacttggagctgca

SEQ ID NO: 8343 - DNA, 611 bp, Zea mays
  Clone ID: LIB3279-181-Q1-N6-C9
tgaaacaagccaccacaatacagaggcatcttcagattacatgacaatcacaaacataagatgcagtacaattcaagtatgatcgacttaacagtgttcaaatatagtttgaaaagcgcaaagtaaacaagacaccatcaccagtccaagcctctgaaaaagtgtcgatgaggcccatcacactgaaaggtcttcggcagatcagatgagaagcttctcaatggagtccttgagaccctgtatctgtagtttcagctggctaccctcattactggtcactgagcaagcaataaccggtcttgtcacaccacaagcacggccaagagcttgcttcgatggaacaaacacatatggcacgttcttatcctcagctaacaaggggaggtggagcaggatctcgagaggctctgtgtccgccgccatcactacaaactccgatatgcccctattcagggtcttcgtcgcttcattcgctcccttcttaagctgtttgtagttggcggcctgctggatgatatcgaggatacccatcgtcagctgcgcatcagccagcgggtatgccttcgggttcaccacggactccatcgcaggggcggggatctgtgggcgct

SEQ ID NO: 8344 - DNA, 585 bp, Zea mays
  Clone ID: LIB3279-181-Q1-N6-D1
gctcaaccagtaacgagtagataataaggagacgacatcaaatatcttccaaaattcaaaccaggacaacaaattgtgctactaatctcggtacagagtgatgactaattactggcgactgatcaaacacaacggttgcactatgctgatggcaacacggagggccacaatttgttttaaaccttgaatccacggctgttcctcctgccacgagccttctcgaacttccttcccttggagcgcacatacggcttggtgtggctgtgcggcactccaggagccttgccaaagtgcctcactgcctcacgggcattcttggggcccctcaagaggaccgtgttctcgccaagtggagcacgaagagcaagctggtcaaatgtgaggcactcgccaccagcattgacaatcctggcccttgctgtctccgtgaacctcagggcagtaaccttcattgctggaacctcctggatccttttgtcatctgtgactgtgccaacaatgacagcaatgttcttctcctttccttccataaacttgacaagccggcgcatggagattggtggtcggttggttttactcatgaaa

SEQ ID NO: 8345 - DNA, 626 bp, Zea mays
  Clone ID: LIB3279-181-Q1-N6-D2
aaggtcaaggagcaggcagcataggggtttccacagaaaatcctttagccgttcaatgtcatgtgactcccaatctaagacgtctgtttcatcttcctcgagagctcacacggtgcgactttcgcttcctttgggttttggacttgagatcatttggttggaatgcaaaaaacactttacagtaatctgtgatgattttatatgtagttttgctctcgtcaatactcgactattttttggaccacattgcttctgcagcttgtatctttacattcttttgactggtaacactgcagaaagttgacctgagcaagttagaactgactgcactgttgagatattggcgccacttcaatctcgtaagtagagctcaaatttctagacaaggccctactatcaactgcaagtagccaattatgtttcattgttctgactgactgcatttgtgaacaggatgcatgccctaatccatccagggagcagttagttgatgctgttcaaaggcacttcacggcccaggttgataaaacaaatttaacttctgactccagtaacttgcatcactatggtgtgaggtcctgacagtctgctttgttgtgttaattccaaatatgcttttgccatgc

SEQ ID NO: 8346 - DNA, 627 bp, Zea mays
  Clone ID: LIB3279-181-Q1-N6-D3
aaacgatggccattatcataattcccatgccaaagccgattattttttaacccaaacaaacttactggcttgacttagctgataacaaatcagcaatgcaagccgcacggacgaccagatagttgagcgtgagcatgcgtgactttattcggagctgttcaccacccggcagttccggcggacctcgccgctggtgccgacgcccggtgcaagcctccccatccgcagcatggactccgcgaagtcctggaagaatacggaggcgtcgaaggcgtaggtggcgacgaggctggcgacgtccgcctctaccccaggcacggcagccgacgacgccagtgcctggtctgacggcagcagaccgtcgccagagagcaggttgatgtagtactggttgtcgaaggtcgccggggtggcgaggtccaggtgtgccagcgcggacccagccgaccccgtgcacagctgctgcagcgactgcaagaaggtgaggtccttgaaggcgcccgcgccgccttccgagacgccgccggcgccggcaaggcgcgcactgaacgaagtgcaccgcgctttcccgatggtgtgcgcgccggagagtgcgaccatgtccttggtagagagggccagttcctg

SEQ ID NO: 8347 - DNA, 647 bp, Zea mays
  unsure (1)..(647): unsure at all n locations; Clone ID: LIB3279-181-Q1-N6-D4
acaaacttaagcaatatggaacaaacattcatctgtacaaaaagcagctgcgctatacaacaaaacacttaaagaagacgagtcttcagaccatagattgttagtactaagattgttgatagcttttctcggttgatccactagaccagtatgctaatagagcagaaagccagtacccgaacgaggctagtttgccaccgcgcggtatatgattatagaagaggctgggaagctcagttatcagcattcctagtaggcaaaagagcatctcgcgaggaaaagaatggtcagcctaatgaaattggtgttaccacnatattacaatgtataaatttgaagctatcaagacattcagaaatgccttcttcgctgtgtaatctgaggttgtgcttaatgactgaatgaataagaatgacgacaacaaaaaatgcctaaacttaaacaaagagagcatgtatcttatatcgttgaccacatcacatctccgcaaatgagccgaaccacatcaatttctgggagaatgcaacaggcacaagcttttgttatgttcagttccacaagccattaaaacggcacatgttgcccccttggtaagcttcacagggtagaatcgagcttctagtaacgccgtaagggctctactgcat

SEQ ID NO: 8348 - DNA, 383 bp, Zea mays
  Clone ID: LIB3279-181-Q1-N6-D5
ggccttgggggggggtgttttttttttttttttttgtggttttttttttttttttttttttttttttttttttttgggggcaaattttatggcggtttttttaaaccattattaaaggggtttttaaatacattttatttctttattttagggggggggggggggggggttttttgggccaaaggggtttgaaatggacttttggtttaaagggaaaccgttaaaaaaatcaattagcatttttacttttggaaaaatttttggtggctgggaacaagggggtttttgggccgggccccgtaaacggatttttttttttgcccttctttgaaaatcttggggggggggtggttcgggcccccgttttggcgggaccggggggt

SEQ ID NO: 8349 - DNA, 428 bp, Zea mays
  Clone ID: LIB3279-181-Q1-N6-D6
ggggggggggggggggggggttaaaaaaaaaaaaaaaaggtttttaaggaaaaagggggtgggggaaaaaaagggggcttcaaaaaaaaacccccaaaaaaaaaaaaggaaaaaaaaaaattttgggccttaagggggaaaaattttttgaaaaaaaaaaaaaaaagggggggggggggggttttttttttaaaagggggtcccccaaaaaaaaaaaaaaaaagggcggtttttgaaaaaaaaaaaaaattttggggggaaaaaagattgtttaaaaaaaaaaaaaaaattcctttttccgggaaaaaaacccaagggtttggggaaaaaaattgggggggggaaataaaaaaaaaaaaggcaaagggggggggtttttgccccaaaaaagcctaaccctttttttttacaaaaagtttcattttttt

SEQ ID NO: 8350 - DNA, 545 bp, Zea mays
  Clone ID: LIB3279-181-Q1-N6-D7
aaccaaaggtttgggaaactgaggcagaacatacgtttttttttacagggatcagggagttggattccataaagcagggggagggcatgttcaaacggtaaacaaaggcaacctccatcctgcaatggatcgaggagtgcatggaaaaggaaagctgggggatccacgtccaaagctcggtcaaaatgttcccggaagaaccaaccccgcccggaaccccttaagggcagcgcatcgacaaggaaatcgaaatcagctccggttccttaaacccgataatggcgttgttcggccctcaaagctcccccgccctcgcggatataatatttcccaaacccgaggaccgggtcctcaactgccccctccttgtaagtagggcccggaccaacaaaaaggtcgtcgtgctgtccaacaacgtcacgctaaaaaaaaagccatggcaaaggttagtacggaaaccaccaaaccctggcaccctgtttgctgtgtgcgttcaaactgaacctggttgtgttgcgttgcacgcggcgcagggcctgccatgc

SEQ ID NO: 8351 - DNA, 545 bp, Zea mays
  Clone ID: LIB3279-181-Q1-N6-D8
agatcagaaaccacagcggcaacagcatatactttcttttaacaaaattttgttccatgtaaagtacacaaggtcgaaaatgtcaacgaagatgtttacggttttcagcacctccttacgcatctatctttctgcaaaagtcacttgtgaagggctaccctcaaatgtctcattctagatcctcaaaaggatttaactagcctggagagcctcaggtctgcttcttcttggatttgcttctctgcacaaacgaagtgccctccagccactcatcgatgttggcatcagttgttccagttccgagctccaccttgggtgccttctttgttttcttcgagagctgctgaacctggccatatgcccacaatccaaacagaccaagaagtgcaaatccaagggtgatgaggaacacagactcaacactgagtaagcctccagcctcaacaacctcgatagtgccattgtagaatacattctggtaagggtgctggtcgatctcatacactatgtaaccaaccagatcatatgctccaggctgcaagaac

SEQ ID NO: 8352 - DNA, 400 bp, Zea mays
  Clone ID: LIB3279-181-Q1-N6-D9
aaaacaaaccgggcttcccttttcgccggcaaaatcccccggggggaaacccaaaacctttcccccgggggaaatgccccaattggccatgtctaattccccccccccaaaggctaaccaaaaaccccattacccccctttttttaaaaaaatcctggcggggccccttttggggcgggcccccccctgaccccaaaaaagccaccccccccccccccgggtaaaagcaattaaccctgggcatccggacccccaggccccccccaaaacccccaacaataagcgaaaaaccgggggcgggggccagtccccgctttggaggcccccccccagttttattttgggggggcccaacatggtttggggaacccccgcccccggggccggccccttgattccc

SEQ ID NO: 8353 - DNA, 608 bp, Zea mays
  Clone ID: LIB3279-181-Q1-N6-E1
ccataatcaattttatccatattctgttatagatccgtgcaatacagtttctatatcatataaccatcaattttaggccttttttacaaaacctcctaatgacttctctctttatctgtttgtcaacaagaacatcaaataacaaacaaaacgttgtgtacgtatttcttattttacatccagacaagccagctcacttcctcaattaaaaaaaaattaagagaataataactgtgatcagttcgacgataatcaatgggtcgctggtgacagccgacaacatcctagtaaaatgtagagctgttcattggtgaagtatgtataatgtgtaagcttatactgagtactataaggtgagaattcattttatcgctcggcatacaagctaggtcttggtagcactacctatcgacttcagcttcgaaataaactgcggaggatcatcgatgctagaagagcccaagacgatttcgcgcttcattttcattgtaagcttgtgcaccgtgcgcagttcagatctagtggctccaccaatcatgaagacaaaaatccggttgcctagcctcttgaagtcacctgatgcgtgtctcaggactgaagaatacttg

SEQ ID NO: 8354 - DNA, 507 bp, Zea mays
  Clone ID: LIB3279-181-Q1-N6-E2
agatcatgtaatttaagagctcgatgattgtatagctacaagcatcccatagaaaaagggatagacattccacctccgaagttatgttgctgtgcaaaagcattagtcaaatacaacagggtccactgatatcttttacatcaggtttcacgctgctagtgctaaagaacaatgattcactgtgacctcgcaactggctccagtgcctcgatcattacaacactgtttcccctgataaccaccattccaatatctgttttgtcatttccattgacctccacaatgttgtccaccaccagattcatgaactggtcgaatccacgaagtgtgccgataacaacacggtttgcattcatcttaatctgaagcttcttgtccatgtacttcttgagatccggaggctgccccgagcggctcatggtgacggctacctagcctcgaacgcgagagaggaaaggatttgcgagctccgaacgccttatacacgagacgaaaccctaacacaac

SEQ ID NO: 8355 - DNA, 645 bp, Zea mays
  Clone ID: LIB3279-181-Q1-N6-E4
gagattaatcatcaccatactgtttaagtttccccatgcttcaatgtctcgctggggctgatgacttaggaagatggactcagttgctcgaaggctggaagagaatttatgggatcaaaacatgatcggaccttggaactaaaaactccaaccaagaaaacggaaaccaaatacacaacggggctcatgaactggacgagcaaaagcacatgccatagatgctgtattactgacatactgctctactcgccttgcaaaactacggcctttatcctgcgtctctcgctggcttagagccatttgaagagaatgccaccatgggcggcgaagaagggggcgaagacaagggattcaaccgccataagcttgatgaggatgttgagggaagggccagacgtgtccttgagaggatctccaatggtgtcaccaatgacagccgccttgtgagggtcagaaccttttgggccaagggtcctggcatgctctgaaactccagcctcaatgtacttcttggcgttgtcccaggcaccaccagtgttggatgcagaaatggcaatctgaacaccagagacaagggcaccagcaaggactccagagagggtctcaaccccaatagaataccacgatcagtggtgtgagcataac

SEQ ID NO: 8356 - DNA, 349 bp, Zea mays
  Clone ID: LIB3279-181-Q1-N6-E6
gcacacgtacctaagcttgttatcctctacgcggccgcccttcattatgttttatgagaacacaacaaagagcggacccagccaaacaatcatctgtctaacgggctccttcacagcaaaacatggcccccgaagaccatgactacaccacttggacggccacgaactcatgagggccagccagcaaaatcagtggtgcgggctgattcatggggaactaacccaccgaatcgacggcggtcacccaggttaagactgtaactgggcaataagcacataatgacctacccgctgagacaccacatacatggccggctcagtcctggtgacattccgaaaaaatggaaat

SEQ ID NO: 8357 - DNA, 454 bp, Zea mays
  Clone ID: LIB3279-181-Q1-N6-E7
taacagcacaacatatttccagctatattccaaactcacatgatccattccttggaaacagaacacagagactgacacatacaaatccaagtttcagaaactcttattgacccagacacgtctaccatcattttttcatatacttctttttttgatttttcagtattcagagaagggaaccatttcagcaaccccgtcccaggcgaaccactggagtcgagaaaccagagaaggtgggagtgtatgcactgctaagttaggacgaggaagatgacgtgacgaacatcctgatcttcctctcaagctcgtccttcttagccccaatcacacggcctacctccttcccatccttgaccagcacgaacgttggcatcgcctctaccttccatgtccttgcgacctccgcgagctcgtcgaccccacgcgtccgcggacgcgtgggcggacgcgtggg

SEQ ID NO: 8358 - DNA, 607 bp, Zea mays
  Clone ID: LIB3279-181-Q1-N6-E8
acagaagcaactgataagagaacatataacgggtgagtaatcaccgagatgggccttgcagccgcatcatagtacagtcatacaacatcaacatcacaacatgtacaggtagctacctctaaagccgattgattgttctgagattgtcactttcaatatgcgtattgcatatgggcctgaggaccatggtatatcaatcccaccagcactacgcgactgaaggagaaagaggacacagacacagaaagaacatacatttaatcgcgataagctaggctcggcccacaggagaaagaggtggacggtggggcacatagctggtcggagctcttccttgactggctaccatggccttgacctcatgaccagcaaggaggtcatgctcctgcgctgcttgcgaaccaacttgcagcctgtcagggtacctcccatgtagcatcactatacacattgcaaaagcttgaagtaatgcaatggatgatctgaattccactgtataaagcccctctttgaatgaagtcatactgaaggcatgcctatcttctcgtgatccaccctgagctagaagttcaaatcgctggctgccatcctttgcctggttagcctg

SEQ ID NO: 8359 - DNA, 576 bp, Zea mays
  unsure (1)..(576): unsure at all n locations; Clone ID: LIB3279-181-Q1-N6-E9
ggggggggggggggnnnnnnnnnngggggggcaaaacnaacagcagggancnacatgagaacaggnnttgggcagtggcatgctatagctgattgtctcaacaaaatactagtgctgcagaagttggggctcactgaaatcacgggccaggggcacaagtgttnggaaagcatcacaatcaggatagtgcgtccaaagtcgcatcacaggagagaaggaatccaccaagggaatgacgcgtcagaatctagccgtcctgcaaaactcctggataaagtttggaccttatttaggaagagaagcaccctggacgagccgcgtggtatcaattcttgccgctctcctccactttcatctntcttctcccacctacgtttcnttgtagtcgagcagcatctggggcatcttcttcatcagctcaacagtatttgctcgcttctcggcggagatgcggtcgcacttgtggcccttgcgcttggtacgcatctccccgcggggaggatcgtagctccagtcctcgccggcgaggagcacctccttgcggaggcgggcgcgcttgcgagcgctaatgccgag

SEQ ID NO: 8360 - DNA, 595 bp, Zea mays
  unsure (1)..(595): unsure at all n locations; Clone ID: LIB3279-181-Q1-N6-F1
anttntaaaaggaggtgtagaggatgtagnttnnttgatggtttnaaaaggattanataagnaggaaaantagaaataatnntntaggtgaataagnaganacaatangatcttgttcacgtaccanttattagggcaggggcagtacagtacaaatgataagcaaggggcagatcaagaatcacaacacgtaggagccataaaaaagcatgatagagcgcaggcagaccagaccaaaagcttcttccgaaacagaggaggcgcctcatgcagaagacggcttctccgccttgaggggcttcaccacctcccaggtgaagtcggggtcgtccctcccaaagtgcccgtaggccgccgtcttgaggtagcgcccgttgccgcctttcttgaggtcgaggttgatgatgatcatgccgggcctgaagtcgaagttctccttcacgatcttcaggatctccttgtcggggatcgcgccggtgccgtacttgtncacgaacaccgataggggctcgggcacgccgatggcgtaggagacctggacgatggcgcggcgggcgaggccggcggcgacgatgctcttggcagcctgcctcgc

SEQ ID NO: 8361 - DNA, 625 bp, Zea mays
  Clone ID: LIB3279-181-Q1-N6-F2
aaagagccgttataggccgagtgcaaagataattacaaccatataatatcatccgattgcacgtagctgaatccccaagacactagcagacaagttgcaaaccaatatccatccaccaacgcagcaccaaagtgctccagacaacaccctcaccgcctactaataaaaaccacacttgagatatcaacaccaacatctggcctgcgcacacataacctctaggcagctcaatggaaaatactgcatcaaccaacatcaacaggccattctactgctgcttgcactccgctggttgttccgcatttccctgcgacaccttctgtggcgccttatgtctgcgaccagatcctgacttccttgctggcttgctttcttcctcatcatcctcttcctcatcatcatcctcttcttcatcctcatcatcttcgtcatcgtcttcatcatcatcatcttcatcatcatcgcccaactcaccaaaatcctcaccttgcacagcctcaccagtaaaccaggaaactgcatgagggataatcttatcccttatggtggtcccaatgtcataatcatgctccatttgactctgcagctcatcagcagtgtcttcatcgatgtcatcatcatcttc

SEQ ID NO: 8362 - DNA, 476 bp, Zea mays
  Clone ID: LIB3279-181-Q1-N6-F3
cggacgcgtgggttaattctcagtttaaaaagcaaatatcatttccattaagacagcagacaaccattacagaggcaggaatgcaagataaacaatcaggttacccagcaactgaacaactctctatccctaagattctaagaacaagcacaatggtaccaagatgccactgccaccagaaaggaaaccaagagaagcacaagtcctacaagcaggcccgaagcaacaacgacgccgcctgcggtgagaggagctcgcctcgctcaggccctctctcccctgatgcggcgcgcgagctggatgtccttgggcatgatggtgacgcgcttggcgtggatggcgcagaggttagtgtcctcaaagagccccacgaggtaggcctcggcggcctcctgcagcgcggcgacggcggaggactggaagcggagatcggtcttgaagtcctgcgcgatctcacggacgagcccacgcgtccg

SEQ ID NO: 8363 - DNA, 523 bp, Zea mays
  Clone ID: LIB3279-181-Q1-N6-F4
gctgcttcatttgttttttttcccttcaaatggggccctttagacttaaagcctcaatttcttggggaaaacgggtgcccctattccattctatgttcacaaatccccaaccggtacggccaacggataggacactccccctgctccaatgctcaaaccctcaaaactaagaccatgttaggcccccctaactaaagggggggcccccacaaaagaaatgggaaacacctgaaaaacctgctctaagcgttctggggggagcccccctgcccccggatggttaaaaggggtagaagccgcccccacctttgctacgagcttccaccaaccattgccatgaaacctcccagtgtggagagcaagggttcctctgaacattcgaaaagccatccccaagagcgggatgggcctggggaatcatcccaacttgggggtgtccagacgcgggggcctaccccttaatggcgaaccgaaacctgcaagcgttccaactaaccctatcccggggcgcaatacctcttgg

SEQ ID NO: 8364 - DNA, 580 bp, Zea mays
  Clone ID: LIB3279-181-Q1-N6-F5
acacggtaaaatagcaaaaccagaactgggttccaccgaagcattaagcagattctgtgaaaattcgttccaaataaacttgggacaaacaagtctaagatgttattacagatatctgacagcttggatatgtaacagcaaaagagttggggcgctccaaaattaggtcctagaactagaagatcacccttttcacttcttcgccttctttggtgcagctgcagccggagcagtagctgatactggtgctgccgcaggttcccttgggccctgagccaatctctcctccctccttgcgatctttctctcacgggaagccttgctcttggcccgcttggcctcaaactgatccgagagagtcttctctctggccttctcggcctttgacttgtggatgctctccatgagtaccctcttatttttaaacatatttccttttactttcatgtacatatcatggtacatgtgcttgtcgattttctttgcttcacggtacttgcgcagcagacgcctgaggacacgcatcctgcgcatccaaaggattttggtggggagcctagcctccctggtacccctgcgc

SEQ ID NO: 8365 - DNA, 305 bp, Zea mays
  unsure (1)..(305): unsure at all n locations; Clone ID: LIB3279-181-Q1-N6-F6
aaaacacagaggggcaacaacaaacacgagacgaacgagagaaaacacccgggacnaggggaaacaacacgggagcgaacagganaacngggccgcgcgggccccaccgcncagnnccnccagnncccggcggagnngccgnagccgccgccacgggggccaccgccgnagccgccgccaccaccaccgnagccgccgccgccaccaccgnagccgccgccaccgccggagccgccgccgccancacggggcccgccaccgccgnagccgccgccnccacgggcaccaccggacccgccgccgcc

SEQ ID NO: 8366 - DNA, 597 bp, Zea mays
  Clone ID: LIB3279-181-Q1-N6-F7
ttgggcaaaacatgtactacatttttaccattacgaataataacgacaaactgttaaaaagggtaaacataacagataaaccagacttatagcctggccagcaggacaaccgataacgtgccaaaaacctcgaacaatagtgaaaattaagctatcacaggtagcttagctagggataagataaacggcaagcatgcgatgcgacacttagtcgacctcctccatcttgctttcaccagcgtcgtcctcaagctgaggcatctcagcctctgcctcaacaggctcgtcctcatcgatgctcagaccgagtttgagcatgcggtggatccggttgccgaaggtgttggggtcatccaggctgaagccggaggtcaggagagcagtctcgaacagcagcatcacgagatccttgactgacttgtcattcttgtcagcctcggcacgcttgcggagctcatccatgatagggttctctgggttgatctccattgtctttttgctcgacatgtagcccgccatgctcgagtccctcagggcctgtgccttcatgatcctctccatgttggcggtccagccatactcgccagtcacaaggca

SEQ ID NO: 8367 - DNA, 609 bp, Zea mays
  Clone ID: LIB3279-181-Q1-N6-F8
aatctaaaaggtttgtcactaagaatgcattccttgcaacaaattattaattctccacggtacagaacgggacatcatcacaatgtcagtgcgcaaccataactgaactgcaacaatgaagaacaggtagcaaaccttatttctagcaaacagtcagctcagcttagaaactaactaaaaagagcacggtactcattggcctcattagccatctcttccatgctcctatctttcctctcaatgtccaggtcaagcttctccttcaattctttctccttcacatcaatcgcatcatatatttcatcatttttctcaaaatcccctttcttccttgggatgaggtggatgtggacatgtgcaactgtttggccagcttgaggaccatcctggatagcaaaggtaagtgacgatgctttgtggtactgctcaagacgtgcaccaacttcctttgcagtaacccataagtcactaatctcatcagaacttagatcggcgaatcttttcacttcacgcttggggcacacaagaacatgtaggtattgtcaaggaaaaaccagtgcatatagaagaacacagtttcctaaaacatgatgtatcaaactttgagtc

SEQ ID NO: 8368 - DNA, 399 bp, Zea mays
  Clone ID: LIB3279-181-Q1-N6-F9
gggggggggggggggaagtctgtttttttaaaaaaaacaccccgttttggcaaaaaaaaagggggcccccccgggggggggggggccccaaaaaggggcttgtagaacccgccatttcccgggcccccccgcgggggaaaaattacaccccgggggccttgttgtgtccccccccggggggggggaaaaaaggtttatggcggggggggggggggggaaacccccgggccccgggaaaatgggtttttggggggaaaaaaaccggattctcccctccaaacaaggaccagggggggggggggaaacacaaaaaaaaaagttttgttttgtgggcttgaaatcgccgggcttttttggatgggtagaagccaacatttgggagcccaatatacaacactt

SEQ ID NO: 8369 - DNA, 498 bp, Zea mays
  unsure (1)..(498): unsure at all n locations; Clone ID: LIB3279-181-Q1-N6-G1
ctttgtttttttttttttttttttttttttttttttttttttttttttttttcggggcngtgcgtgncctttgcttttcccccgcncctggggttgccgggtggcnnttcctttcccgggcgtnntttgtttttttttcttttccntngcgcttttttgggtggggcccccggctggccncccgctgtttttctgtgggtgggggcgcccttccttggttcccctggtgccccccccttggttcctgttctggntcctcnggtctttcctggggcgggtcccccctttcccctcttcgntgccggttttgtttgtctgttggggggccccngggggggccttggtctgttctgttttctccgctggtggcctgggcnnnnggccgggnctcccttccccccctggcctgggnggtttttggcgggttcctttcngggttccggctcgggggtttcgtcgcgcgcgggctgctcnnctgggcttcccgtgggcttgccg

SEQ ID NO: 8370 - DNA, 663 bp, Zea mays
  unsure (1)..(663): unsure at all n locations; Clone ID: LIB3279-181-Q1-N6-G2
cgtactaactttttccttagacggncccctttgttttttttttttttaaaatgcaacagaatgaacatatccaaactagcagttatgtaaaggctgataataccacaagataaaaggaccatcctgacacagatcagcacaggggactctgcgttagatacacagctaagcactcatgatgggaacaagttcaagaaaactagataatattattatattggtgtaacactacttgtccatcctcactcctcatcctcatcaccagcatccccgccaccgcttgccttcttctgattctttctcttcacccttcctgcggggcctccaccgaatgggcttgacagtgaaaagtcaatgtgcttctcagactccaccctcaccatgaatgatgggacgttgacaatttgcctgccaaccctgatgtgacgctgcttgatcaagacacgagcatggtgaatggacttggccatgccagccttgaagacaagtgtttgaagccgccttgcgaggaagttctcagcggtgagggcaagaacataatcaagcttgttctgaccctcagcaagcagcccatagcggttcatgcggcgaagaagtgcctcaccctcaaagaacgacgggggttcttctcgtcaagggtgagcaagtgccttgcagcattac

SEQ ID NO: 8371 - DNA, 581 bp, Zea mays
  unsure (1)..(581): unsure at all n locations; Clone ID: LIB3279-181-Q1-N6-G3
ggggggggggggggcagggaaganggggnnnctaganatncacaggctcccctacttacaagatttctgggaaaacaagttcgtagtggctacacaagtttcagatctccctcttgagcccaccacacccatgactcatgccatgcatgaacttccggggatctcacaggctcacagccactccccaagaccagagacatggactacgtaccttgttttttattctcatccacaccatcatacccatatatgatatatctatctacctagctagttaaccagctctccatgcgttcatgtttttcatgggtgcaagcagcagcaagctccatgatttacaagacaggctccagttcttttttacagtttggttgtttgcagatctgactgaccaagacatggccatgcaagcttgcatgcccagatctcggccggccggtttgtgttcttatgtgtgaccccagggagccaagaacatgactctccttatggggtcctcggccgccgagccgcggcactcagcgccacggcttggttcgccggccggcctggccttcggggtggcggaggcagctccggcg

SEQ ID NO: 8372 - DNA, 486 bp, Zea mays
  Clone ID: LIB3279-181-Q1-N6-G4
aggggaggacaaaaaggagcattttaaaaggggtgggttattttttttttttttaaaaggggggggggggggggaagataagctgggactacaagcacaaaaatgcccccggggagaaaaaaaatttagggcttaggaatggctgtttttttttttgacaccggacttgggaacctggagggtgggggacaccgagcttaacctaaaaagagctggtttgggcaaatcaggcctggggtagttgtaaataaccgggtttttaaaagccttgggcattttggggaactttttgggcataaaaaacttgggggtgagcttcgcaggggggttttgttttttgggcttgggaggagagaggaacaaaaccgagtcctttgcaggtgggtggatcgtgaaaatttttttgttcgccaaaacccagtgtttgaaggagtggattttgaaaaggttgttcggttccttggggaactgcactttgggattggc

SEQ ID NO: 8373 - DNA, 378 bp, Zea mays
  Clone ID: LIB3279-181-Q1-N6-G5
ccagggaatttattctttttaagggttcacatatagggtccaaaaatgcacaatagtttttttttttgtcacaacaaacggggggggggggggtgatttttcaaacactacgacaatgtaaaacacctttgcataatgaccgggccacagcacacttgcgaaacaacaaaagatcatacttttttttgctccaagcagcagtttaataggggcagttgaatgtatcagttttttggtttgggcttaatggggtttgaaacctggcagacagagaggataatgatcagaatgagtgcgatgatttttcccaggacgatgagcttgatttttatgttctggaaccacattttttttctgacatttgttcggacccgtggg

SEQ ID NO: 8374 - DNA, 561 bp, Zea mays
  Clone ID: LIB3279-181-Q1-N6-G6
agctccagaagtgcttaattttataaacgttgtcaatatggatttcccagagtcacaacacaaaactacacatgaagagtacactaatggttttcaacttgtagatgtgagtcgtagtccaccaggattggggatgaacacgaagctgacaaattgcaggaaccacttaacctagagttcatcttttggtgctggcaagcagtcctcatcccagaagtaggggaatttcagctttgcagctgtatgaggcatactccaatcatcgtatataaatatcttgaccggtgggcgcgatatgatcacaagaacttgcaaatcttcgtgctcattagaattccagacctgatgtggatcatttacagggatcgaaaatgtggtattctgaaagacaggaacttcctgcggctgtcctgggtacttcagcgagctcgacccgagtaagagcgtgcctttccccttgaggacaatgaaaacctcttcacaagaatgcctgtggattggggtcctttgacctggaccaaatgtttgtagccacacttccacctccttcgtcccgtgagc

SEQ ID NO: 8375 - DNA, 412 bp, Zea mays
  Clone ID: LIB3279-181-Q1-N6-G7
acaaagggggggggggggggggaaagcaacttaaaaaaaagcggggggggcggggcaggggggggggcaaggacaggaaggggggggggggggagggggggggggggtccgggccccaaaaaaaagggggggggggcgaaacggggggaaagggaaaggggtttcgggaaaaaaaaagaaacccccggggctgggaaagcgggggggggccgggaaattgggggccgggacggggggggggaaaatttttttttagggggggtcctttaaaagggggggggataaaggggaccgggggttgttgggggaaaagtggttcccggaaatattggagaaacaaaaaaaaggcggaaaaaaaaaaaaaaaccggggggggccaaaaaagggggccccccaaaaaaattgggggagc

SEQ ID NO: 8376 - DNA, 569 bp, Zea mays
  Clone ID: LIB3279-181-Q1-N6-G8
aacatcatcctcgccatctagagctcgtcgtgctgcttctcatcatcagaatccttgctatcctcggcatcagagtcggccttgtcctcgtctgccttctcatcgtcttcctcatcctctaggtcatcatcctcatcatccccacccttggcggcatcctcttcttccttctttttctcggcctcatcaaaagcagccttttctgcctccttgtgcttgccccaagtctcctctgcaaaagtcttggccaacgcagggtcatcagtgatgatgatgttgtcaaacagagtgcccgatttaacctgccacagctcaatgccaatgtacttcaagctgtcgaaggcgtaaatgtatggatcatccttaaaatctgggttgtcaatcataggtgccttccatttaccctggtagttcgggttcttgattttcttttgtttccatggtcccttgtattctgggttgggaatggtaggggcagtccattcaccatcttcctcatcgtcccagtcctcaagcttcttagcatcagggtcaggaaattccttgggaatatcatcatagccctctgg

SEQ ID NO: 8377 - DNA, 352 bp, Zea mays
  unsure (1)..(352): unsure at all n locations; Clone ID: LIB3279-181-Q1-N6-G9
acaggagncanaaggcaaacggccnccaaaanggaacgaaacaaaanaaaagggggggggggggggacnnnggancngcagnaacgcagggacaggacgaacaacaaacncnnnnncncnnnggcacccaacnncagcncacggcggagnangacgcnnnacaccgggcacgcnggnaccccaagngngnaccngccnggancnggccccanccgaggaggcgccaangcnncncaacgcgacggcgcagagcaaccccccncnccncggcncgggcagacaggcgcggngagcngnagcnnggcaagaacgnncnnaacagcgaccacacgggcgccnggggacacggacc

SEQ ID NO: 8378 - DNA, 541 bp, Zea mays
  Clone ID: LIB3279-181-Q1-N6-H1
ggcaacaaccattacacagttttatttcttatatattccatccgtggtactacctccgttctctcgaatatttatcaccactagttcatttttgaactaaaccttgccaaataaaaaagaacggagggagtatcaggtatggatgcaggaacataataaatgatgtccaaaactcaacctgatcagagcactgccgaaaacagctattgcaaaacgttttcatagctgcacctggcagccggcacatacaacagacagaatcgtatagactgacaactccgataaccgttgcatctcatctcatgtgcttattcatcaagtggggggtgggggagggaggcatcccattttcacacgacaacaaattttgtgttgcgcctaaggtacttaacccaatcgactggacttggtgaagtatcctcacgtctagcttgcctttgactcaattaccctctttgcaaaagagggcaaacagaatgatgccgtgtggatctccgagttgtagaacttaaggggtccttttgatttcgtagaatgttca

SEQ ID NO: 8379 - DNA, 536 bp, Zea mays
  unsure (1)..(536): unsure at all n locations; Clone ID: LIB3279-181-Q1-N6-H2
agttcatacaatcataagcactgcagatcacataaccaagacatttttgatccgatgtatagaagacatccgccactacaaaattattaaaccaaatccttcaaattcgcccagaaagcatgatccaccttcttgaactggatctcggacatatgtaagcaaatgaagtaccagctacaaactactacggaccgacctcatccgggccctgtcatgatccgatcagacgggggagaggagctggaagacggagggcttgggctcggagttcatgccgatgacgatgacgagggggatgaagccgtagtgcgccaccaccttcgccttcttcatcgtccacgtggtccactccttcatgagcctcaccgtggtcgccgccgcggtggcgtcctcgtcgtcagcggtggccttcttcccgcccttgcccttgggcttcgacttcagcgacggacgcgacgccatggaggatcccccgaactggatccgacgagccgnagagcaaaaccctaggaggcggaggcggaggcggattgttt

SEQ ID NO: 8380 - DNA, 95 bp, Zea mays
  unsure (1)..(95): unsure at all n locations; Clone ID: LIB3279-181-Q1-N6-H4
ggtgntggnnnggtnnttttgngggggtttttttttngggggggtttgttttgggtnngggtttttttttttttnnnnttttttttttggggggg

SEQ ID NO: 8381 - DNA, 571 bp, Zea mays
  Clone ID: LIB3279-181-Q1-N6-H5
cttggtttttttttttttttttttttttttttttttttttttgtgtgaagggatacaaggttaatttgaaatagatgtgagtgattatttgtaaaaatatgacgcagaacgaccgttgaaactagtacttttttgtttgtacagattactgatcaggcggggtacatgttgctgttacaacgattacaaggtatctacaggggggctgagagcttgacaaaacaggaatctggtaaaattcaacacggcaaaagactcgaatcgccgccaggatttgttggtccactcagattccagtaaagtaacaccgttatgatgactctgtccctgcaactggtatgctcagttaaacataaaccaatatcagaagtagccgacgcccttgacttcgcctaactttggagcattggcgtcattgcccagaaacaagagacgaccacttgaacgcacagctatttctcttatgcgtctaactagcccagtaattggatcacagaacactttggtctcaagatttccttccaaatagagaatagtgccagtcttgacgttgttgagcgcgacggtgccg

SEQ ID NO: 8382 - DNA, 604 bp, Zea mays
  Clone ID: LIB3279-181-Q1-N6-H8
gctggcctcttccagggctgaagctcctttcaccatcataaaaggatctggaaatcttggacaccttccaagtgccagttctttctgtggctggtggctcataacaaatgctagactgctgatcggcttggaaaaaaggcgtgaaccacccgactagatgccccctgtgtgatcaagaacctgaaaacatcaatcatttgttggtttcttgtgtgttttcaagagttttctggtataaccttttaagaaagtttgggctacacagcttatcccctcaacaagctgatgcttctttctttgactggtgggagagagcttcagctcaggtctttggtctggggaagaaaggattggactctctcattaccttaggggcatggatgatctggaagcatagaaacaaggtggtgtttgatgggagggctccttgtctctctttcctcctgcaggctagatatgacaatgggtacccgaaacccgataggtttttactccattagggtacgggtttcggtcaatttttatacccatgggtttattaatgggcataaatctatacccggcgggcggacgcgtgggcggacgcgtgggcggacgcgtgggc

SEQ ID NO: 8383 - DNA, 374 bp, Zea mays
  unsure (1)..(374): unsure at all n locations; Clone ID: LIB3279-181-Q1-N6-H9
aagaagcagcacggccccaaaaccccaaaanncgaannggccnacaagggggggncacggaagcccaaaaaaaaaaacccncagagacaagnangnnnacaggcgggggggccnangaaaccgccgaggggggaccaacccagggaaggcccagcnaaaancaagcggaacacaaaanccagggggggaacaaanncncacagcaccccgaaccaaccaggcaggngggcccgggaaccaancaaggggaacagcacagggaggancnaancancanaanccaagccancnncgncgncnagcccggaacnancaaccccacccancagcgaaaggaacacaagaacggcaacgagggggggggccaggaaaaa

SEQ ID NO: 8384 - DNA, 627 bp, Zea mays
  unsure (1)..(627): unsure at all n locations; Clone ID: LIB3279-182-Q1-N6-A1
aaataaacagagatgttatatttagcaatagtccactaaaccatgcagtgtgatcagtcatgttcgcacaacgccacaacagattcagccattatacgtaaagtggaataatgccagttcaagatggttaatttggcaaccaggaactcaatacaggcatatgtagtctgcgactgcgaacaagacttagttgcaaaaaaacaacccaatatgacaaacaaaattactagtaacatagaaaaatctgttggtatgctcagaactagtaggacatagatgtcgaatccagttgcctattaacttagatgatgccaattttagtggccacatcaagggcatcgtagtcgggtgtcagtttcacataagccttcttcttcccatcaggcctgntcagggtgttgaccttctttgctggaatgtcattcatcttcttgactgcagccttgatctttttcttgtctgccttgnggtgcgcctttaagaccgggtgttggtgtctttaatcttcttcattggccgttctgtggtgagggggttcttgaggatttggttcttgtcaagcttgtttctttcccgtgcgctgcttcttgggtcctttcggttccttggcctttttttggtttttgg

SEQ ID NO: 8385 - DNA, 634 bp, Zea mays
  Clone ID: LIB3279-182-Q1-N6-A2
aacaacaagctccaatcaggatttatccttaattgatgtgaataattagaaccattttgacaaaacataagccacagtttacaaagatcagcaatcatgtctacattgacaaatcattcaggggatcacaatttggaataaaactttattacgcgtcagccagaaaatagccaacatggtaacatgggaaactgagcatcgacggcgccaaactctctgagaagtcccaagttccgctcaggcgtctgcttccacaaggacaaaaactggcctgtccccaagcttgtctcggcccttcagttctggcaattcaatgacacaagcacactcaacaacctttgctccaacacgttcaataagtttgacagctgcacatagtgttccaccggtagcaataagatcatcgactacaagagcccggtcgttggcctgtacagctccgacatgcatttctatcttgtcagttccatattccaaagaatactcttcggagatcacctcgcctggcaacttcttcggcttcctcaaaggcacaaattttgcgccaatggctaaagcgataggaggaccaaaaatgaaccctctagcttcaacaccagcaaccacggtgatcccttggtccttgtaccgctcg

SEQ ID NO: 8386 - DNA, 605 bp, Zea mays
  Clone ID: LIB3279-182-Q1-N6-A3
ccagcaaaactttacatgcatattattgcgtatactatttttaagtcctcagtatataaggaaaattgtacagatccaaaacaacccaaaactggtgtactgtgtcaaggaagaatgatggtgcaacgaatgatagattcgactggaaaccaaacttacatatactctaattaattgaatcccctcaaacttcccgtagcatgaaagccaaaataaaaggagtaaaaaaaaagatactaccattgtttttagccattagcgacaatttcgtggatcctgtcactgatctctggatcatcagatctaactgccagcttcatggccacctccttcggtgcactaattccaaatgacagtctcaccaagactttcacgttgccaataaacacaccagagagcagacaagtgtgcgaccttgaattgcttgggaccacgtcagttccctcacaaggctgcatgccaaggatgcttataacagcacttacagcctcagccaagctctcccttactccaagcccatactcgtcaactcgctcagtctctggatccatgttttcccaggcatttcggaagttagatactcccaccttcaacatataatcagc

SEQ ID NO: 8387 - DNA, 339 bp, Zea mays
  Clone ID: LIB3279-182-Q1-N6-A4
gggggggggggccgtctggttggggggggggggggggcccaatgggccaaaacaaagtgggggctttttttccaaaaccccggggggggggggggtttctttttttcccgctcccccccgtttgccacaaataggggtggggggggggggggggtttttccccccccccgggtttcggggccttttttttggggggatatgccggtggcccgttttttccggggttccggttcccccctggggggggggggggtgcccccccggtgcccggggtcgcgccctttttggtggggggccccccccctttgggcctttgggttcggggggccggtcgcgggg

SEQ ID NO: 8388 - DNA, 393 bp, Zea mays
  Clone ID: LIB3279-182-Q1-N6-A5
gaaccaatcaatcaatttattgttcttatacttttcatgccctaggagtagcagtaacttagccttctcatccccgatttcacctctctttggctctacgtcgtctagaggcgtcttggtggattgccgattctaagacaaaccctagaatctctccttcttgacggggtccctccccaggggtcaatccaggtgttgttggtgaacgtcgtcgcctctgcgcacacacggatcaacctgccaccaggagcggaccgtccggcgtcagcgtagagaagaacccgctcctgccgcaggtcgtagactgtccggtcctaggtcgcggatcgtccatgctgtcgcagagagcaccgccgccgatacaccttgcagtgattgacgctcagatcaatg

SEQ ID NO: 8389 - DNA, 646 bp, Zea mays
  Clone ID: LIB3279-182-Q1-N6-A6
caacacaagtatagcatcccatattattgagaacgaatgaaccagaaaagtggagcgaaaagacatctcatgctgtaggcaactcatcaaaccgcgtccattccaaaagcaactccaaataattgtacaaacatgctgaccccagccatcccagataaacatgcgacttaaaataacagtctatcaaccaagaaaagctatgtagatgactgacgactctgatttcaccgaacacaaacattcatctcggagaaaacacaatgaaaatttgcggggaagctgaaccttggaaacgaaatgaatggaatggcatccatttgacccttgtttgccttcaaccttcactctttatcatccttcttatcatcggatgcaggagcctcctctttctctgcattttcctccttgctgggctctgccactgttaacttctgtgccaaatcagaagcggcagtggagacttcatcattttctttctcctcgctctttccttgctgttcagctatctcttcaacagtgtccttgaacttcttgcaattctcgacagatccaaaacggatagcaaacatctcctctttgagctcgccgtcggcgaagtccagcgcgtgccacacgcacgacttgtcgctccccgcgtgctcctgca

SEQ ID NO: 8390 - DNA, 623 bp, Zea mays
  unsure (1)..(623): unsure at all n locations; Clone ID: LIB3279-182-Q1-N6-A7
aatcccaaaaaaaaaaagcgaatgcgacctgcttcgtgaaatgggaccaactcaagtcaaacgtatcatccagatcactactaggcacaaaaccaaaacaaaaggtagaacaaataagtctcggctaggtggcgacaaaaatctaagtcggtttcctcatgttgcggcctgccctgatcacttcatccacaagcagcaactgggatgcaatgatgggtccagaattgatgatctggcgcttcatcagagtagttgtcgaagatgccttccatctggggatcaatcggatccccagagtgatggttcaaccccacaactaatccacggtcatgctcattctggagagaaacaatcacatcttgagtatctaaaccagagttctcagccaaagtcttgggtataacaagaagagcttccgcaaacgcctccaccccaagttgtgctcgtcctttgacggttttcttcacattgtcgataagatgcttctttgcagcaacctcaaaagcaccagcacccagcacaactgcttcatnctcaactgtgttcttaacagatcttagaccatcacggacagcatccttgatttgtgcaatggtatggtcattaggtcctttattagttag

SEQ ID NO: 8391 - DNA, 636 bp, Zea mays
  Clone ID: LIB3279-182-Q1-N6-A8
caatgaaacagaggacaaattataaaaataaataatgcttgtgacaaattgaaagagtagctttaccggctcctacttctaaaagaaaaggggaaaacagttcttcaggcataaaagataaaaaaaaagtcatacaataaagactttttttttctaaagacaattcaatagacaggtaggattgtacaaatgagttttttatactcaagaagtcgtgtaatagatactctttgaatgaagagacggcctcctgagtatgttactgacacgtcctcttgaaaatttctgaagagacagcctccctgttgcttgcgatgttgcagatacatagtccaacccttttacggccctgatcctggatttctgaatgatgcatatgatggcaatgctcgctgatgttgtgtgcttactcaatgtggatagatctcatcaataggaatagacctcacatatgatgcacggccatttccaacagaagggatcgttctcatgacttgttcctatcgaatatggttgaagctgttgaacatcccagtgtgggaagccttggctgcaggcttggccacttcagggtctccaaatacgttccagaagcgaagggtctcatccgcagcggctgatgctactgtgcaacca

SEQ ID NO: 8392 - DNA, 592 bp, Zea mays
  Clone ID: LIB3279-182-Q1-N6-A9
agcatcaattctaatttctaaatttaaatggcctgtgttcaacaggaacgagcagagtttgctttaccgatgaagcgacacagaccatctgcgtacaatccactagtagaatctatcatgacaaactcagctaatgttccagaggtaagttcaataggagtatttggaagattaagtcagatagcataatttctgacaatgaattgtaaatctagaaaacaggtagtagtcttccgtatgtcaaccagatgctctacatctgattttggagagattatccactctggttcaagggccaccatcgaaaaggttccaatcacgcacattgaaattcgtcactgcaagtttgaagacctcagacattggcaagcaccctacttgttcagcaggtattgccggaccagctgcaactgccacagcactttcactcagggggtttatcaacaatggctcatatgcggtgataagtacatcggttgccgcattcttaaggcgtatgtttgccaggtaaattcgaacaatgttttgtgcttctctgccctgcctcccttttgagacggccagctggccaactgcagttgcagccactgca

SEQ ID NO: 8393 - DNA, 605 bp, Zea mays
  Clone ID: LIB3279-182-Q1-N6-B1
ttttacagaaagaaaaacaagggatgaattcatcaatgaagagacgtctacaagcaacgccatgaattttttttggggcttcatgtagttaggctaaaaagtgcagaacacaatttctcagaacacaaatatccctaaaagcttcttcaactgagacccattgaaagtcaagcaccgcccgtacactccaggaaccaaggcaagctcctgcatgaagggctctcccctacaggtcgataactcgtgacagcttctggatgcggttcagcaaaaagtctccttgcttgatggttgcctggtagaaggcgttcctagcatcaggtcggttcgtttccaagacgccagcaactttgtctatcttgcagtggagcttcccagcggcaatgaagcgtgacagttcctggtctataaagtcgactgtaacgccaaatgcagcagccatggcttccattgtcacactcttgtacgattccagaaactgtgagtagacaacagtgcgcacttcacgcatgtagtagcgaaaagaggctgcaagtaacgctctaacttgattggttcagtcaagccagagaatgcaataaaaaatgacttgtactggcaattgt

SEQ ID NO: 8394 - DNA, 319 bp, Zea mays
  Clone ID: LIB3279-182-Q1-N6-B2
ggaaaagattcatgggctcagcgccattagcttcaatccgtataaacccgcagaatgaaaactattctgggttcttggtgaaaagagcttctgaaagactgagagactcaagcttccattacacgagcgggccaagcgcttctgtggggggagcaggggaacaaaaacaggacctgaactagaacgagacagccacgttgtcacaactccagtactactcttaatcttcctccaggttgatggcgtccttgaacttcccgtacagtatcttcttcagctcggccatctgggcgaggacggattccttcggacgcgtggg

SEQ ID NO: 8395 - DNA, 511 bp, Zea mays
  Clone ID: LIB3279-182-Q1-N6-B3
aaggaaaaaacatggggctcgaatgaacccctatgaaacaattgagcccccaaacgttgggggggaaacatgtttccaaatgttggcactaaaaaaaaacaactttttactaacaacatttttgctcaaatacagggatggggcaaaagtctaatttaagagggccaatacaataaccaaatgaaaacccccttatacatccatgggcccttactcctacaaaaccaatccatgatcatttgttcggcaacaaaatccggccagggaaaaaaactgaaccattgtttggagcaggcttcaaattgaaaatggaagccctgacattgtatatctccccattctcaaaagagggcccagttctaccaccctgaaaacgagggccatgggcggaaaatatgggcctcattgaaaaaaaggattggcgcacccaagggctccccccacttattttttttggagcgcttcattttgatcttatacccttccccaaccagcccgatgattgggggga

SEQ ID NO: 8396 - DNA, 561 bp, Zea mays
  Clone ID: LIB3279-182-Q1-N6-B4
cagttctcatagcattatcatgaatctcagaacataacaggggaaacacgaatcaagcagaggcgccatggggttcacagatccacacctaaaccgctaaattaaactgcgagcgatccatgataaactaagaccaccactcagatcaccaccatcttattcagatccaaaggaacggacccagggggagtcgacgatgacggagggagggcggccgaacagaccagatcagagagatctaggagagctgtccgcagtcagcgaccttgaccaccttggaggtggagccgttgcgggtgcccaccttctcgatggccttgacgacgtccatgccctcgacgacctggccgaaaacaacgtgcttgccgtcgagccaaggggtcgcgacggtgcaaatgaaaaactgggagccgttggtgttgggcccggcgttggccatggagagcacaccgggggcggtgtgcttgcgcacgaacttctcgtcggggaacttctcgccgtaaatggactcgccgccggtgccgttgccgcgggtgaagtcgccgccctggcacatgaact

SEQ ID NO: 8397 - DNA, 472 bp, Zea mays
  Clone ID: LIB3279-182-Q1-N6-B5
ggaaaaaggggaacaagggcatggggtggggttcaaaaacaaaacatcaaggccaagacccaggtgggaactagataatccataggggcccaaaaaaagggggggggggaaaaggggaaggggccaaccccccgggtctccgggaaattttaagcctaatgggaaaatttaaaacagccgggccccctttcccatagggcttttaagggacaagcatttaacattttgccaattttttttaaagagcgacccggggaaggggcccctcttttgcccattttggaagatctggtttttatccatgccggaggtgccaacaggaacccccatgcaaaggacctttttaagggggaacttaactggggcctttggctcgttaaccctggacccaagggattccggggggggcaccaagggggggaattttcctgccttggtaagacccggccccaaaagacgggggatttgctta

SEQ ID NO: 8398 - DNA, 529 bp, Zea mays
  Clone ID: LIB3279-182-Q1-N6-B6
cactggcaaaacgagacattgttaaatccccaatctgctcactgaaacgagcaacattttgttctgattttaagaaaatttatcctaacaacggagggggacggatgagtttacagcaacaaaaatgcccagggcagccaggtttcctccttaaccaaggggggagacagcaaccagttttaaaacgactggaccctatttacaggcctgggcatgggctcaccccgaaggaagggctcaaacagtttaaggccctgccggggccggggcagggaaacctcgtgccctgcgcctgggaccgtaaccagggtaagccccttgtacacctggcaccacccaccgaccttttggtggtcgtaccaaggataccagttcgtgatagtcggaaaaaaaagggcgtaaatggagtaccttgtcggggggagcgggacaacggaatcagcgtcgccactgaaaacccatatccttatgcccgcggggatgatttcacggtagataggaagcatggacctcggcaaatctttccaaa

SEQ ID NO: 8399 - DNA, 151 bp, Zea mays
  Clone ID: LIB3279-182-Q1-N6-B7
aggggccccacatttttggggagggcgaaaagggtagggaccaggtgaaaacctccattaaacattggggaaggggcccactttactgggaaaggtcgaaaagggccatccactcccatagggaaaaaaaaaaaggcacaccccccacaaa

SEQ ID NO: 8400 - DNA, 470 bp, Zea mays
  Clone ID: LIB3279-182-Q1-N6-B8
aaaaagggaaaaacaaaccatgagggccccaaacctccaaaaacgggaaaaaaatcccggggggggggcccacccccaagggtctccctttttcaagcccacaacgggcccttttggaaacccggcccgggccccaaaaggggcctgtgatttcagggaaaccttggcccccaggatcttgggcccctttgttctggggacccccccccccaccccgttggcaagccctataaacaaaaaattttcgggggtaaagccggctaaagcccccccccttgaaaacagggaaccccttttataccccggggggcccttgggtggaaaaatttgccctgccctatcccccaaaggagcagggccaaaaaaaaccctgtggccaattggatccgggggggaaaccaacactaaaaccccccccaaaagtggtttaaagggaaccccctccttgaaaaaaaaaaggaatttttggg

SEQ ID NO: 8401 - DNA, 551 bp, Zea mays
  Clone ID: LIB3279-182-Q1-N6-B9
gcagcaccaataagcaccatttttttccttaggatttaacttagaataaagcctgacgggggtaacagcacccatcgatccgcagtccatgctggttgatgcatgggtctgctggagccgaggatgaacacagcactaacaactgacacagagcgaccttcaatcaaaaacacagatgggcaacaacaaacacgagacgaacgaagataaacactctggactagggtaaacaacacggtagcgaacaggataacttggccgcgcgggccccaccgttcagttcctccagttcccgtcagagttgccgtagccgtcgccacggttgccaccgccgtagccgacgtcaccaccaccgtagtcgccgccgtcacacaccgtagccgccgccaccgacgtagccgccggcgccatcacggagcccgccaccgtcgtagccgtcgtctgcacgggcaccaccgtacccgccgacgccgacgacttcaagcctacgcaggactggtcctggttgacagagatgttgcggacgtacagctgcttgccgttcatgccct

SEQ ID NO: 8402 - DNA, 666 bp, Zea mays
  unsure (1)..(666): unsure at all n locations; Clone ID: LIB3279-182-Q1-N6-C1
cacgcgtcgtaacttggtccctagacggncgcctttttttttttttttaactccttcacatatatatttaatgagaaccacacccccttgtgagcttgaaagctcatcagatcaaaatgataacaggctcacaaaatagtgggctctacacttgcaatatatagccacatttggcttcctaaggtaaagtgtgcctgaaaaggtctttctttggccaagaaggttaagctgttgacttccctgattgttcggctaaataatgctcaagcatgtcctcttcgtcgtcttcaaaatcatcatcgaaatcaatgtcttcctcctcttcttcatcttcatcagcaactgtgcttgctcctttcactgcatgccttccagtttcaaaatactgccgtcccgtgagtttcttttcctttgtggctgtaagagctgaatctggcataagtttagcacgctgtaaggccaactcagcttcaaagcgttctctccaagccagaaagctctccacagtaacagcttcaccatgcggtataataacctcctctttttccgcttcagattcttcaggttcctcatcaccaccattctgaccatatttctcacttagccactctttggctgctgaaacaagagtgtggaccatagcctgccaagattctctgttgcctc

SEQ ID NO: 8403 - DNA, 595 bp, Zea mays
  Clone ID: LIB3279-182-Q1-N6-C2
gaagcacaaacaaattttacacatctttgcaatcttattacaaacaacacctagtgattcacagatcccaccctctcacctgccttcacagttcacgctccttgaatctaaaccggtgtttcccagattgaaaacctagaccagtgtgaccctacacagtgcatgccaaatgggcgaaaggcaagcaattacacacgaacaaccacaataaaagcgcatcaaacaacaacgaccatgaccgacaacgacagttaggagcgtttcagttcagagaggacagagagagacagtgcatcagcattgccagggacctacgaggcggccacctttttgggcgacttggcggcggcggccttcttgggtgacttcttctctttgccttccttggcagcagcgacagcggttttcttggggagcagcacagggttgatgttgggcagaaccccgccgtgtgcgatggtgacgccggccagtagcttcccgagctcctcatcgttgcggatcgccagcagtacgtgtcgcgggatgatccggttcttcttgttgtcccgcgctgcgttccccgacaactcgaggagctcggcggcgaggtact

SEQ ID NO: 8404 - DNA, 628 bp, Zea mays
  unsure (1)..(628): unsure at all n locations; Clone ID: LIB3279-182-Q1-N6-C3
cagcacaatttggaatatattagaaatttccacactacattgttcctcgagcaacctattagcactggcctaaaagtacgaggaaacgaaacagagccgtcgctccgtgcggcggcgatctaagaggaagtaaacttggtaacggccttggtgccctcggagacggcgtgcttggcgagctcgccaggaaggacgaggcgcaccgaagtctggatctcccgggaggttatggtgggcttcttgttgtagcgggcgagcttggcggcctcggcagccagcttctcgaagatgtcgttgatgaaggagttcatgatggacatggccttggacgagataccaatgtccgggtgcacctgcttgagcaccttgaagatgtagatcttgtacgtctcgacgctcttcttggccttcttcttccccttcttctcgccgccctccttgcccggcacgcgcttctccgccctgggcttcttctcggccttctcctccgtcggcttcttctccgcgggcttcttctcggccttgggcgccatcgggaattcgatcaaatggagcggcgaacgcgggatgggaagcggcggattgggaatttgttgattggaggtgacgagcgccgnacgcgtgggtc

SEQ ID NO: 8405 - DNA, 79 bp, Zea mays
  Clone ID: LIB3279-182-Q1-N6-C4
caagtatacgatctcatcgtttaatgggctaacaagaagacttaatacaacaaaacggacgcgtgggcggacgcgtggg

SEQ ID NO: 8406 - DNA, 544 bp, Zea mays
  Clone ID: LIB3279-182-Q1-N6-C5
ttttttttttttttttttttttttttttttttttttatttttttttttttttttttttttttttttttttttttttttttttttttttttttttttttttttttttttttttttttttttttttttttttttttggggggaaaaagggggaaaaaaaaaaaaaaaaaaaaaaaccccttggggggggagaattaaaaaaaaaaaaaaaagggcccaggggaaataaatttttgtggcaaaaaaaaaaaaaaaaaggggggggggggggaaaaaatttttttttttttggggcaaaaaaagggggaaaaaatttttttaaaaaaaaaaaaaaaaaaaaactcggttttttaaaggggggggggggccaaaaccaaatgggggggggggccccccaaaaagaaaaaaaccccccccaaaaaaaaatttttttgggggaaaaaaaggggggggggtaattttaaaaaaaaggggggaaaaaaaccctttttgggggggggggggccaccaccgacaaaaaaaaaaaaaaattttgtggtccccaccc

SEQ ID NO: 8407 - DNA, 602 bp, Zea mays
  Clone ID: LIB3279-182-Q1-N6-C6
gaaacattgaactgcggtaattgcaacgggattccacattacagcatccattacactccacattcaaaagaacaaaagttaaccaatggcaggtttttcccatcaaactattattcttcatcaaatccgtaacataaaagggtatggcagaggcgcacaagcttgaccgagccaggggaatgaaggaaggctcacagcgtcgaaagccgcaccttgccattcgtcgcggcaggccattacgggatgtcccacggcttaggctcggggacagcgacgaccatgccatgcagctccggcgtgaggacgacctggcagcccaggcgcgcgtgcttgttgagctcgcggttcctggacgcgcgcgtgagcacgtaccgctcctcgtaggacggtggcggcagcttgtcgagccactcctgcgcgatgtggacctcgcactcggcggagcacgcgtcgatatcctcgaggcggtgggaggccggctcgatgagctccgcgttggcgagcgcgcggaggagtgtctgcccggagaggccgacgacctcgcggcgcgccccctcgagatcgatggcgaggacgcgcacgatgcgatcggcgaccttggc

SEQ ID NO: 8408 - DNA, 504 bp, Zea mays
  unsure (1)..(504): unsure at all n locations; Clone ID: LIB3279-182-Q1-N6-C7
aaaaaaaataaagttactttccaaaaagagaattggggggccgctttgggaattttctaaatttgaaaccaacagtcccgaaagatttacagaaaccttgcggccaactgaatgggaaaaggggtaaaaactaattggaacaaacaaaaacgttacagttacttgcctccacaaacgctacagctgaaataccaagtgcatcagggcaggcgacaccaactcagcttggaagtcactttcaaatttcggaggcgcccggaattggattgcacttgcagacccgtactgctgcatttcgcgcttacacaagaaccccatcttatgctcattcgccttgcaaacagtatagctggcggatattccctggggcatataaccaatctttgaattgagcatgaagggcacatgccaattctttcttccggatatcatcgatctccagctccccnatattcttttgaatatcttccagagaagcatgctttttcctttgggacgcccaat

SEQ ID NO: 8409 - DNA, 647 bp, Zea mays
  Clone ID: LIB3279-182-Q1-N6-C8
ccgtgtaattttctattactttatttatatgaccatttacaacacctgcatcgtcatatttaatctatacaggatgtacaatgagcatttacaacacctgcacatagtttacaatcatcagctacacctttatcatctacgtacacaatagatcagatcatgaggattcctagttaccgaggatttatcaacgtaaacatctcctagatcacctaactttgccgtgaaaataccgataactgatagtctcctacagctctacggatcataatcagaatctctttggggagtcatatgggctttgtggtctgtggctgatgtcgcgccatggatctggaactgggtcgcttcctctcatctggttctgcatgtaactgactgtttgtgggccacagatcccgaggagaatgccagatgtgatggggaagcaacgcagctccagttcgattgcttcagctggcgtaacgggcttgagcatggagacaccgggagagacatgtttgctctcacatcaatatgcctgctggaagttttgtggggtgaaacgcatgctgaggaagatcccataaaacctcgcgctcttattccctccatgtcccgcagaggacaacacttctcttcaatgaaggttctttgttggactctgc

SEQ ID NO: 8410 - DNA, 619 bp, Zea mays
  Clone ID: LIB3279-182-Q1-N6-D1
ccaaaaattttcttccaataaacgaaatgatgacttctataaaattttaaatcttaaaaaaatgctaccaatctaataacttctaatgttttttcagaaatctaatgagcttgtttttttagacccgcaattccaatgtcacgacacacttcggcagcaccaaagatttgcacatggccttcatgtgttgaaaagcactgctcatgtccttttctagttcatcgtccactttctcctcggcccacatgaaaccttgaatgttctgcacgatcaatcaacatggcacaagaaagcagattagagcaaggaaccaatcgagcaatgaagcagcgacgaacatgcattttacctgaacccactcaattaaagtagctaacgaccacaccacctgaattagcatagatatcaggtaatactactactcccttctcggcgagaatctacaacatatgcaagaggcagaagctcggaaaaatataaaaaaaagttgcactcagaagtgataaaatacacttctcgcattaactgctccgacccaaagccaacaattttggactcacgcgtgtaaacaatattatctattgcatcgggtagatgtcgtatcagctaatacgacgac

SEQ ID NO: 8411 - DNA, 583 bp, Zea mays
  Clone ID: LIB3279-182-Q1-N6-D2
tttgaaacgaaaaggagaaagaaccacttcctagtgatctgacaacgacatgacatttaaaacagaacaaaaagctcaccctggcagcattccaaatgctgcaagcaaaggctttaagcagttcaagatgccacaggaacacaattcctaggcaccatatgcttcccacgttttgcaggtaatggcgtatgacctctcccggatgcctaccacatcatcatagattaataatatcttctcggcttgttctgctactgctcacgtccggaagcgacgaggaggagaatcgatgatatctgtagttatccaagggcgacacgggctgctgcggattcagagtcggtggcggcgtcaggttcctctgcgctgggagtgggactagtccgttgtacaaaaaaccctcgccgctaaggcttttcctttggaagctatctgcgccatctccaagagtctccataggaaggatggtatcttctcttggagcaagggaccagggacttggggcaggaggttcgtttgagaagatcttcttctataagcaagcggaaaaactgatcaggcttctttgtatatcttgcttgtt

SEQ ID NO: 8412 - DNA, 572 bp, Zea mays
  unsure (1)..(572): unsure at all n locations; Clone ID: LIB3279-182-Q1-N6-D3
cgccgccgtttcgcgcaccgtaccctagccctcgtcagcggcggcttcgagctcatccagccatgacgttcaagcggaggaatggcggacgcaacaagcacgggcgcggccacgtcaagtacatccgctgctccaactgcgccaagtgctgtcccaaggataaggctatcaagcggttcttggtgaggaacattgttgagcaggctgccgtgagagatgtgcaggaggcctgtgtacatgatggatatgttctacccaaattgtatgcaaaggttcatcactgtgtctcatgcgcaatccatgcgcacattgtccgtgtccgctctcgtgagaacaggaggaaccgtgagcccccgcagcgcttcagacgccgggatgatggcccaaggcctggtcagggcccgccgcgcccaggcggtgcagctcctgcagctgcagctgctgctgctcctcgtacctaagttctggaattagtttcggggcttagttttgtgaaacattacctgttttgagaaaccattgttactgtatccccttgatgtcaaactttttagcacaatttgtggnttctg

SEQ ID NO: 8413 - DNA, 518 bp, Zea mays
  Clone ID: LIB3279-182-Q1-N6-D4
ggttggaaaagcacgaaataatttcccattaataacatttacagaattacactgactgacaacaggggatatatggaacacttacaggcgcactacaacgtttaaacgttggagaaagtaacacaatagcagggatcgaattccttcaatagcttaacaatacaccgaccacccccttccctcctctcactacttgggcaaaaatcagatttttgcattaagacatgcgacaaattaaggatggctgcacgagaacataccacctctccttacgcgccagctcatgtttgaccttccaataattgtcagattctacaccttgaatgtgggaacatgcaggttgccttccgcaccaccatagagccttcgcctatggtccagtagcgggcaataatgtgagcccaagatgccgcctagcatggtctgggatcaacctgttgatgagctctggggaggcatttgctagttcctgtttaaagttgaacagtggaggaaatggccgtccacccacgcgtccg

SEQ ID NO: 8414 - DNA, 594 bp, Zea mays
  Clone ID: LIB3279-182-Q1-N6-D5
acgaaagcaagcagattttattcctgaacaccatgaggtccagccatcgcccaggttcctcctccgtgctatatactaatcagtcatcacttgtaccactagatgccaagcaggaccacaacattttctctgatccagctctttcggctctcacttcgcagacttgatcagctcctcgctgaagtcccagagctgcttcgccaactcctcgctcctcgccagtttgctcgtcttctccacgttgcagtcagcaaagtactttcctgtcactcccttgagttgagggctcagtcctacgtagcaagtagtcgcagctccctggggtacattcttccacagtatgtaagtggcaacctgaagcaccttcatgagaacaaaggagtgcctcatcaaattgatcatgatcaatccaggatggacactgttaactgtgatgtttgctccttcttccttcagccttctagagagctccttcgcatgcagcaagttcgccagcttagactgtccataagccattttgtcgttgtatattttctcatcgttgaggttatcgaagtcaattcccttcggatacgtatggtggtgggcgactga

SEQ ID NO: 8415 - DNA, 476 bp, Zea mays
  unsure (1)..(476): unsure at all n locations; Clone ID: LIB3279-182-Q1-N6-D6
ctctagagcggccgcccttgggtttgtgttgtttttttttcaagctagctttggcacatatctgatgctgtacaatatcagtatcgtacaaggcacaacagaacattacagataattgaatgcggngaaaaaagggaaatgcactggagagagccaaggcagctcacaccccgggggggacctagcacaagtgcacaagggacaccaaaaccggcaaattgacgccctactaataaaagtacactgcacatagggaagtgaatgtctcagttgattgtcgcgagcggcaagcgaggtatctgagataacttagattctttgctcgattcatgttcatacggatggttctcacggaactcattcatcatggtctccacgggcatggctcgcagcgattcaatcgagcctttgcttggcacgttcggctcagacctcaccggagtttcacctgagggttcgtagtccttgtaactggt

SEQ ID NO: 8416 - DNA, 414 bp, Zea mays
  Clone ID: LIB3279-182-Q1-N6-D7
gtggggggggggggggggaacaccaaatcttttttcgcgtgtttggggggtttttattttttttttcggggaaaaaaattttttttaaaaaaaaaaaaaatttttttttttttaaaaaaaaacccctcggcaaaagctccccccggagtcctcctttttaaaaaaaaaaaaatcccccctccttttaaaaaaaaaaagcccccccggggcccctttttatttttttcccccccccggggggcccaaaagagggggcgggattcttaagggttccccaaccccttggtcccaaaaaaagggggtgtctttggcccccttatttgtttaaaaaaaccggcggggggggccacccccccctttatggggccccgccccccctcccccaaaaaggggcgaacccctttttttttctgg

SEQ ID NO: 8417 - DNA, 599 bp, Zea mays
  Clone ID: LIB3279-182-Q1-N6-D8
tatgcaagcaagaccactaaaaatgattgacaggttttattccgttcacaagtagcatcagcagtgatttgtgtagctggtgctgaccgcttctagttaccgtacacgtgcggcggcacatcggccgcgaggtaagtagtactagtacgtagtagcaaacacccagaaaatcaagcgcagggcccgcacgagggacacgtcgtcacttggccgcctccgcctccgcctcggccttgcggttggcttcgatcttagcggcgatcccagcggcctcgtgctcggctgcctcgagcaggaagctcccgccctcgtcgtccacggcgacctggagcggctgggagccgagcccgtcggcgacggcgagcatgatgcggcgcatctcgtcgtggaactcggcgcggtcgacggcgccgctgtggtcggcgtcgaactgctcgaagacggcgtcgtagagcgcggcgacctcggcggggagcggcgccggctgggcggacccgaagccgccgccgtcgaggaggcggaaggactcgagcgcgcgccggagctcggcgcgggacagcacgccgtcgccgttggcgtccagcgcggcgaaccgcgcg

SEQ ID NO: 8418 - DNA, 598 bp, Zea mays
  Clone ID: LIB3279-182-Q1-N6-D9
gaaaggaactgaatctactttctgatttccgataacctgatgtatgatacaactcaccctatacagaggcataaacaaccagccaagcctcgtcgccgcaaggcaaactggaaggtgaaacgtgtaaaacaatcctcttttccctataaatatgaggcatgtatgaatagagcatctctacatctgcaacgatgcaaaaaaattgtggccaacacggaagacagttgctggcccagccattatgaaaatgggcaggagaactatcttcagatcagcgaaccgtatcgcgctattcaaacgaactgcggcgttcccggtagaatgagataggtatgtatgtcagaaaatgatctccttcaaaatcagaaggactatcatgatgaagattagaatgacaaggacagtggcacacatcaccatgccccctttcttctgggtcctctcagccttttgcaattgtttgtaaccctcctcaactgaagctgcaacattctgtatgttgtagtctatccgatcgatgatggttccctgatcaatcacgagaactgaaagaccttcatgatctgtgcaagttcgttgactgattcaacaacctgct

SEQ ID NO: 8419 - DNA, 165 bp, Zea mays
  unsure (1)..(165): unsure at all n locations; Clone ID: LIB3279-182-Q1-N6-E1
tggggtgtgtgtttttttttttttttttttttttttttttttggggnnngtggggggngggttttgttggttggggtttnttttngtttttgggttggggggggttnnnggnnnnntngttgngttttttttttttgttgntgnntgggtttggggggggggggg

SEQ ID NO: 8420 - DNA, 635 bp, Zea mays
  Clone ID: LIB3279-182-Q1-N6-E2
tgcggccaggaggcgcttcttgagcttggtgttccagtggttcttcacgtcgttgtccgtcctcccctccatctgcgaggctatcagcgaccacctgtgcgcgtcgatcggtcaaattaagggagacgctttggcatggcatggcatgcgctcggctcaagatattggaggatcgaagaaggaagaagagcttctcggattcacatgtgtacgatcagtactcacttgctcccgagctgggcgtagagggacatgatgacggcgtcctcctcggcggtgaagccgccgtggcggatgtccgggcggaggtagttgagccagcgcagcctgcagctcttgccgcacctcttgagccctgcacgcgacgccgaccggcaacgatcgacccgtcgtcagtgcacctgtgcatatatggctcttgctagctacatatggcacatacacacaagctaaggggagcacacgctcgatcgctcaccggctttcttgggcatggtgatccagttgccgccgctgccgtggcgctggacgtagctgcgcagcgcctcgtcctcctccggcgaccacgggccccgcttcacggccgccctgtcgcagcacggcgtccgccccatgaaacgacacacgcacacacc

SEQ ID NO: 8421 - DNA, 603 bp, Zea mays
  Clone ID: LIB3279-182-Q1-N6-E3
aaaattgtaatggcatgttgagaattctctcaattggggtaattcctggtggcataacagaatttgttccttattgaaaacttcctcagcctgtagtcacgtttaaacaaaacctgtcagcttgcttgcctttgagcaaatactcgcaagttccacatcacaggaagattggcgaaactacatccaaaaccgagcgttcctcacaatgtctggtacaaaggcatccactactgactgcaaactcagaagaaaggggataacgttgtgacatcatttcttctgcttgctcgatacattcagctgctggaggttgagcagcaggtcgttggagtccaggaacaccttgttggctgaggccgaaatggtgtgggagatctcccttgcagcttcaatctgcctcagggcaaggaaggcagggttgttcgctatggcttgaccaatcagctccgcactcttagcctctccctgagccctgataattgcacttctcttatcttgttcagctttctcgacaatgaacttagcacgctcagcttcctgtgcagcaacctgcttcgcttcaatggcatgagtaaactccttcccaaagctcaggcttgtgat

SEQ ID NO: 8422 - DNA, 453 bp, Zea mays
  unsure (1)..(453): unsure at all n locations; Clone ID: LIB3279-182-Q1-N6-E4
ggccgcccggggggggggggnnnggagaaaaagagcgggcgagaancnnngggacaggggcnaagggcacacaanacnccggcnccagagcacaggcggcagccgcggcgcnncnanacagagggcnaacaancgcaaagagaaggcaangggacagcaagaccggcgagggcacgacaagccgaannggagagcagnnannagcnccaacncggccangaaaacgcnnacnaggganaacagagagaccacnggaaaaccccannncggcccccaggagcnccnanagaacangaaangagnngaaaggacannccaancnnccaaggnnacngganggcgncncnncggaanacccgggggcaccaccccgggagagganggnnngncacacnaaganccacccccggaggcggggaannnganccnngcccangagnacgagccgggcgc

SEQ ID NO: 8423 - DNA, 449 bp, Zea mays
  unsure (1)..(449): unsure at all n locations; Clone ID: LIB3279-182-Q1-N6-E5
gnagaggaagaatgtantggtgtnagtaaatnaggtgntaggggaatggttngnttgttgtagnagtaaaggnaagttaataattanaatggaaagnaaagttttttttttttgtaagagaattagtggggggggattagaatattnngntgtantngttttaantgttgatgtggaggatatataggattgnnatgtnaaagataataaaggatganagttnnatngttagggtttttnatttaatgangntggnatgtttnaggatgganggaatggngatgtttnttattattgatgngnnngtnaagaatttngtgaagtttaaaaaggngtgttgggtattggaaattatggaggaagtattagaantgaggaaaaatatgaggggnattggtaggataaggtanatgagaantgttagnattggnnnaaagttgttatagaga

SEQ ID NO: 8424 - DNA, 454 bp, Zea mays
  Clone ID: LIB3279-182-Q1-N6-E6
aaatgggaacagaattgaacatttccaaacatagcagttttgttaggggtggtaataccacagggtgggggggggcatccatgacacaaagtcagcacaggggactttgggggagatcacacagttaagcacttattattcgaacaagttcaagaaaactagataattttattatattgggggaacactacttggccattcttactccttatccttataaccaggatccccgccaccggttggctttttttgatttttttttttcacccttcctggggggcctccaccgaatgggcttgacagggaaaagaaaatgggcttttaaaactccacccttaccatgaatgatgggacgttgacaatttgcctgccaaccctgatgggacgctgtttgatcaaaacacgagcatggggaatggacttggccatgccagccttgaagaaagtgtttgaa

SEQ ID NO: 8425 - DNA, 392 bp, Zea mays
  unsure (1)..(392): unsure at all n locations; Clone ID: LIB3279-182-Q1-N6-E7
ctggcatntncagtggnngtgaagggtgnntagaagacnnggtgcccnatcgtagaaaggcgatgcgcggnntggtgacgagggccgacgaggggcccgcggcggccttggcggcggcgcggtcggtggggcagctcagcgtgccgaggcggacctgcacgaccatgaccatggacgtcatcaggaagacgcagccgacgacggatccgacggcggaggcgagcatgccgaggcggagcacgcgggcgtcgatgtgggcgcgcgccgcgtcgtgcgggtccttggagttgatgaggttgagcgccagcttcaggccctgcgccaccaggctggggtaagaggaaggacgagtagggcaccatctccagtaccagcagggaccgggccacgcc

SEQ ID NO: 8426 - DNA, 594 bp, Zea mays
  Clone ID: LIB3279-182-Q1-N6-E8
tgtcaaatattatatcttatacatttttcgaggacaaatgtactgttcataatcatataaattaaattttcaggcatggggagctacagtaagcctgttccataacatggcgcaggctgatcttcatggaaacctatgacgatgatcagaccgcagcactaaaccctctcaatttagcatcacaagttcacagcgacgatccaccaaaaacaggacgtaaaattaccgctcgccacccatgcctccaaacattccgctcatctccttcgatcccatctgtttcatcagagactgcagaccgcccatgccaccaatctgtttaagcatctgcggaggaaggaccttgctcatgtgctgaacattcatgttgcgggacagtgcactcatctcccctttctttgggatcttgagacccttcatcttgccccagattttagcaagccgcttatactcttccagcatgtcgatgacatccctgacaggacgaccagacccccgtgcaatccgaatgatccgtgattcagtcatcagcttaggatttgtgctgtcaagctctgcatcagtcatggaatccatcattgtcatgagcgctta

SEQ ID NO: 8427 - DNA, 549 bp, Zea mays
  Clone ID: LIB3279-182-Q1-N6-E9
aagaaaagctttatcacgtgcattatccaaagatcatgtcaatagtagtatagtacaacagataaacatcactaattcactacttggtgggctaaatttggtgtaaccattaactcgaaagctgcatagcccacaaaaggctacgaactctgtgctaacctctctcaagtgcaaggtgaccaaaagcaggacagtgaccatagcttacaacacttaaaacaatcatgaatacctggaatgcacatattaagggccttggcagtaaagaaagactccatatcaaataggtagaaataattcctatcgatcagatctgacaacagctggccagcaaggcgatatagtgttgccattatgggaagagatagatgccatttcctgtaactagggccatttatgagcttcgtcttcatcaaaggtttgtgatcatagaaccattcatagacagctgcatcttcctcctcatccaactccaactgtatagcttcaagtggttcaacatccaacaaattatcagcatagtccagtgggggttcccggacgcgtggg

SEQ ID NO: 8428 - DNA, 636 bp, Zea mays
  Clone ID: LIB3279-182-Q1-N6-F1
gcaagaaaacactgtactgcttttatttcacagtctgacgcgatatacagaaatacaacgagtgtcaaaacagtagtaaaacatcacaagtctaaaaacgacgtgttctccagcgacaacagtgggctggacaccatcggcagggaaatgtacgtcgaaatcaacagaaggcacccgagctttatttttctgtgatggaaatgatgaacgtctcaggaaatagtttgccagaagcccagaactgtgtgctctagggctcgaccaccatgctttccgcttccttcttgatggactggaacagcaccgatgagaggtagcgctcgccgaagctcgggaacacgacaacaaatagctttccggcgttttctggcctcttagcaagcctaactgccgcagctgcagctgcaccagaagagattccaaccaacaacccttctttcagagcaagagccttggcagtctcaatagcttcatcacttgaaacctgtagagtctcatcaaggagatcaacatccaagactccagggataaaaccagctccaattccttgaatcttgtgtggtccaggttttccaccattcaaaacagcactctccactggctccacaccatagagcttgacattaggattttgct

SEQ ID NO: 8429 - DNA, 606 bp, Zea mays
  Clone ID: LIB3279-182-Q1-N6-F2
aactgacaggcaggcgtcatggtcgcaagtatttcagcttccacaaattgccagagcgcatcttgctcaatagataaccaatcaatcatacatacatggctcgttctagacagcgacttgtgtaaaactaaatatcagatcagaccctacgattcacgcagcttccggaatgcagattcacacggcttctcgtttacatgggcgtgatcgcctggacggatcttccaaacggtagaaacaggtccaccatggagtcatactcctctctgctaacctgagcagcgttcaacatcttttgcacaagcttcgaattcgaaaagactggagcaagggcgggaagctggtgcacagagagcgcgtcaagcattaccagaaccacagcctgccactgcctcgatcgcagagaaggcagggcgtcaacaaacgacattgtgtcaatcaagtagcccagagtaatctccagttttgaaaccggtatctgcaacctcaagtttggtatgagtactggcacggcgttacaaacgcaagaatctagagctcttctaatctccaatgagagcccatccttcagaactgtcttctcaggacattccctcccattggcaa

SEQ ID NO: 8430 - DNA, 555 bp, Zea mays
  Clone ID: LIB3279-182-Q1-N6-F3
agacatggcacaaacactggagaacgggcttccaaagtttctaaacacggtctggtggacagaaacatatgaaagtagattcaaaaaaacacaatacgagggggcaatgctcatcggttcttccacgtcaaactacaggggcaaactcaacagtggataatctacgtcatccgctgggcggcctccttggccagcaacttttccctggccttggtcttggcctgcgacttggagcccatgatgccacctccccacttcttcctgacttcatcaaacttgtcattgaagttcgccttaatagcctccaagatcttgctgaactcaagcttgtcctcgttcttgacagtggtcagacacaagactgatgcagtcttcttgtgaacgatcgatccaaggcgagcctttcctttaacaatgcagtatgggacctccatcttcctgcacagggctggaagccaaacaaccagttcaatcggatccacatcatgagcgatgacaacgagctgagccttgttctgctcaatgaggtaagtcacatgggtaaggccatacttc

SEQ ID NO: 8431 - DNA, 600 bp, Zea mays
  Clone ID: LIB3279-182-Q1-N6-F4
atggtgataacagaagaaatatctttgcaaaagtttgacgaagtacaaatgtttcctgatctaccgtctaacacagatcagtgttaccctagagtttgcccttacaaatccaaccagctacagatcgaagtcgcgcaaacactgcagatattactcacaacatcaaactagccaactaggaatcagagggccagattctaacgacatacgcatggcaacagcgctcagtctttgccgcagatagcctagacgaagcaagacagcgtcaagagagacaaggcaaatagctccgtccatctcagccacaccggctccaaccgaagcgccgaagagtgagccggctgcgccgtcggagtcatcccagcgttacacacgttgctggtggtcacattggcgaggatggcgaacgatgtgctgttggtgtacccggcgtatgagcatgctgtgctctcgcaggatgaggtggaggaggatgtgttgccgaggaacatgtctccgcacttggcggcagggcagaacgacgagctcagtccctgtgtcggctggcagtccaactgccaggtgctagagctgcagccacacttgacgcagttgttggcg

SEQ ID NO: 8432 - DNA, 572 bp, Zea mays
  unsure (1)..(572): unsure at all n locations; Clone ID: LIB3279-182-Q1-N6-F5
gcagcaccaagaagcaccatttttttccttaggatttaacttagaataaagcctgacgggggtaacagcacccatcgatccgcagtccatgctggttgatgcatgggtctgctggagccgaggatgaacacagcactaacaactgacacagagcgaccttcaatcaaaaacacagatgggcaacaacaaacacgagacgaacgaagataaacactctggactagggtaaacaacacggtagcgaacaggataacttggccgcgcgggccccaccgctcagttcctccagttcccgtcggagttgccgtagccgccgccacggttgccaccgccgtagccgccgccaccaccaccgtagccgccgccgccaccaccgtagccgccgccaccgccgtagccgccgccgccatcacggcgcccgccaccgccgtagccgccgcctccacggccaccaccgtacccgccgccgccgccgcctccacggncgccgcgggactgggcctcgttgacggtgatgttgcggccgtccagctccttgccgttcatgccctcgatggcgttccgcatcgcct

SEQ ID NO: 8433 - DNA, 568 bp, Zea mays
  Clone ID: LIB3279-182-Q1-N6-F6
gcagttgtaccggtttcttcaggcccagatcctaataagtacggacttcacaatttacatataaacaggaagagaaaaaacttgtcggatttgacagcacaaggcaaagaatgcggggggacttaaacagatgtgtaactggtaaattgcttcagtaggttgtcaagtgcttcaggattaaacttcctagcgaaaaaaagcacggtctttttgatccattccacaaacacggcttctgcatcacaagtttcttgtcatcacttgttacatggaagttctcatcaactgctgtaatgttcttcaagagatcataggtgacatcatcagcgctatatgaccttggatgccattttccctcagaccaatccacatgtgtaacagaccaattagagatcccaccaggatctaccatattgaacagggttggcaaataatgctcatctgcaatacagttgcgcccttctgctggcttgcagtatagcttgaacttcttgtagtacaagctgtcagccagaatcattaaagcatgtctccttgtaactgcaaaccactgggcaccctttctaaa

SEQ ID NO: 8434 - DNA, 434 bp, Zea mays
  unsure (1)..(434): unsure at all n locations; Clone ID: LIB3279-182-Q1-N6-F7
aaacgancaacgnccacgacccaccacccacgaggcgaaacagcgggggcaaagcacccacgggccacacaaaaccacagggggggggggcacagacagaagcgcacaaanggggncaggcccacggacccgggccggggcaaccggcacccacgaaacaccgggnacgaacgggggagacgagggggaaacaccanaaaggacgagagacagggacacccggagcgagcggaaaaaaccaggggcaggacgggaagacccgccgccaggcaggcancccgggcccggacgcgcacaggacgccccaaggaaaaaaacggggggcaggaaacgggggggcggancngggccgggggggcgaagccgcaccngcggggcagggcgggggcggggccgaagaaggggccgccccccgggcgcggggggcgacccgg

SEQ ID NO: 8435 - DNA, 591 bp, Zea mays
  Clone ID: LIB3279-182-Q1-N6-F8
agcatcaattctaatttctaaatttaaatggcctgtgttcaacaggaacgagcagagtttgctttaccgatgaagcgacacagaccatctgcgtacaatccactagtagaatctatcatgacaaactcagctaatgttccagaggtaagttcaataggagtatttggaagattaagtcagatagcataatttctgacaatgaattgtaaatctagaaaacaggtagtagtcttccgtatgtcaaccagatgctctacatctgattttggagagattatccactctggttcaagggccaccatcgaaaaggttccaatcacgcacattgaaattcgtcactgcaagtttgaagacctcagacattggcaagcaccctacttgttcagcaggtattgccggaccagctgcaactgccacagcactttcactcagggggtttatcaacaatggctcatatgcggtgataagtacatcggttgccgcattcttaaggcgtatgtttgccaggtaaattcgaacaatgttttgtgcttctctgccctgcctcccttttgagacggccagctggccaactgcagttgcagccactgc

SEQ ID NO: 8436 - DNA, 639 bp, Zea mays
  unsure (1)..(639): unsure at all n locations; Clone ID: LIB3279-182-Q1-N6-F9
agaatagagtctgatcttgccatccacagaaccaacaacgattgaaccatccccagtacttgcaaagcactggaaattggtgccccgcgagaactgatgaccctgtgaccagttcagcactggtgagtctgatgagctaccgattgtctgcacccggcctctggcgtcgcgcatatcccatctacacaacctgttgtcatccaggcccaagaatgtcgacccggagggttccaactgcgctcccttgctgtcattggcaatgtctcgcattgtgatatcagctccatccttctcaaaccgccattctgcgacaaccttcccagtctcaacgtcaacatggtgaacaccattggaatgcagagcctctcctgggctcatcagtagcatgttagtctcgccgcgcatcagcagtgccttcttcggcgtcgaataagcgctcccactgccgccacggcctcccgagatcttcaccgacgcgcccttcccgtgcaagccgtggcggaagttcttgaccacctgtatcccggcgccgccgactaagaagctgttgtcaagcgccccaagcgcgaggctctggatgctgtcgccgtcgccggcctcctcctcgaactncttaagcagtccttcccctgtgctgcg

SEQ ID NO: 8437 - DNA, 530 bp, Zea mays
  Clone ID: LIB3279-182-Q1-N6-G2
gaaaacgagggttttccattgataatggcaagttggtattgcaggaaatgggatacaagacaccacagaacacagcgacgatatagagaacggactacactagattaggcacacaacacgaccaccgccgacacacatgcagttcgccaccagatgacgaagcgacctagccgccgaagccgtagagggtgcggccctgtcgcttgagcgcgtagacgacatccatggcggtgacggtcttgcgccgggcgtgctcggtgtaggtgacggcgtcacgaatgacgttctccagaaagatcttgagcacaccgcgggtctcctcgtagatgagcccggagatgcgcttgacgccgcccctcctagccagcctccggatcgccggcttggtgatgccctggatattgtcgcgcaggaccttgcggtggcgcttggcgccgcccttgcccagacccttgccgcccttgccgcgccccgacatattgtcgaaaccgagcgctgcgctgctagaacttggatcacggaggaagatg

SEQ ID NO: 8438 - DNA, 265 bp, Zea mays
  Clone ID: LIB3279-182-Q1-N6-G3
gggaaaaaagccgggaaaatatttcggcccaagggaaagggcacatcacaggaaggccaaaaaaaaaaaaagggggggggccccaaacaaaaaatccctaaaaaattcttttggtggggcccggggaagcatcccccccccccaataacccgaaggggtccccgggttgatcttcaaaaaagcttcagggtgaccaaaagggggctgggcgaacagttaaacggggggatgggcattttttgccttttcgggcaagggacccctc

SEQ ID NO: 8439 - DNA, 494 bp, Zea mays
  Clone ID: LIB3279-182-Q1-N6-G4
gcagcaccaagaagcaccatttttttccttaggatttaacttagaataaagcctgacgggggtaacagcacccatcgatccgcagtccatgctggttgatgcatgggtctgctggagccgaggatgaacacagcactaacaactgacacagagcgaccttcaatcaaaaacacagatgggcaacaacaaacacgagacgaacgaagataaacactctggactagggtaaacaacacggtagcgaacaggataacttggccgcgcgggccccaccgctcagttcctccagttcccgtcggagttgccgtagccgccgccacggttgccaccgccgtagccgccgccaccaccaccgtagccgccgccgccaccaccgtagccgccgccaccgccgtagccgccgccgccattacggggcccgccaccgccgtaggcgccgcctccacgggcaccaccgtacccggcggcggcgccgccttcacgggcggcggggg

SEQ ID NO: 8440 - DNA, 629 bp, Zea mays
  Clone ID: LIB3279-182-Q1-N6-G5
ccttagaaaattgatatttgcactgtaatcagttcactcatccatacaagcagtattaaagtaatcctgcaatcattgcatagtacagtggaacaacactacaacaggctgtatagtgccttatttgtacaatgtctaggaagcaaactcaagtaccttacactgtttgatagatgaagaacacaaatacagtaaaatattagcgatgtgctatgtggtgctcagcttccaccgagacatctatgctctttatgtgatgtttctgtatatataattaatctttatgcttgccatgtacccaccattatattagcttgtgaaggttttctttacacctcgaactagcagtccttcaaaggtgatgcctgggccaaaagccaagatcaatccccactcttcacttattgcccctttctttaactcgtccctcaagtactccagcacatagaagattgtattgctgctcacatttccatagttcattaaggcttttctgctaatcttgagcttctctggctgaagtttaaggcagaactcaagcctgttcaatattgctggtccaccaggatgcacagcccaaaatatatcgttgaaatcctttatccctacctggttcatgagagtcctgc

SEQ ID NO: 8441 - DNA, 540 bp, Zea mays
  Clone ID: LIB3279-182-Q1-N6-G6
ctgggggttttttttttttttttttttttttttttttttttttttttttttttttttttttttttttttttttttttttttttttttttttttaaacctttcaaaaccaacttatgggtaattaatcctggaaggtggggggacaggaaggcttggggggggggggggccaaatggtacccccggttaaggataagggggggggggacaaaaccaagaaacccttgggaggttttagaaaaagccagttaaagccaggggaaggtttggggagaaatctttgggggaaaaattttttttccgattaaaggggaaataaaggggggttccgtttccaaagccaaggaagttattgggggcaaaaatttttaaaggggaaaatttgttcctcccccatgggaaatgggaaaggaaaaaaaagatccttccggttttgaaacctttctttaattggggccaaaagagtttaataaggggggagttaaaaaaatccttaggggggccattggaaggaagagggctaacaaatccatcctaaaaa

SEQ ID NO: 8442 - DNA, 387 bp, Zea mays
  Clone ID: LIB3279-182-Q1-N6-G7
gtgcacatattaggctattttcagattaaattaaacatagaaccccatagatttctaacatattgggcgccaggacatttcccccttgttttgggggaactgctggtttcaaatacctctctacaaaaatacagggataagactgggctcgattatttattccttccctagactctaaacataggggagctagccgccaacactcaatcgggcgttttcggcccattacatcaaagttgcataaagcccctgacctagggcctcatttatggcaaacaaagcacccactttttcctagttcctatatacccccacggaacaggcccggtcggccacagtagctgggccggttcgggcttgtcagcgggacggggggcccgttctaat

SEQ ID NO: 8443 - DNA, 623 bp, Zea mays
  Clone ID: LIB3279-182-Q1-N6-G8
aagcaactagctggattcaataagcattgttactgttccatcagataacagttgctaccggaggagaccagacacagcagcacctaactacagcaagacacgcgaacatacgagggaagcctgcaagcggaggccacgcagcctaggacgaggtgaacttggtgacggccttggtgccctcggagacggcgtgcttggcgagctccccggggaggacgaggcgcacggaggtctggatctcacgggaggtgatggtgggcttcttgttgtaccgcgcgagcttggcggcctcggcggcgagcttctcgaagatgtcgttgatgaaggagttcatgatggacatggccttagaggagatgccgatgtccgggtgcacctgcttcagcaccttgaagatgtagatcttgtaggtctccacgctcttcttgcccttcttccggcccctctttccctcgccgccctccttgccggcggacttgcctgctgggacacgcttctccgccttgggcttcttcccggccggcgccttctcggcagcgggctcctcttccgccggcttcttcgccgcgggcttcttcttcgccttgggcgccatcgatgcggggcgacttggagttcggttt

SEQ ID NO: 8444 - DNA, 478 bp, Zea mays
  Clone ID: LIB3279-182-Q1-N6-G9
gcagccacaagatcatagatctactagtttcagctggatacagcaccagaaattaagaatctaggcaaacggaaaatgggttccgattcaaccataggcagggggccaagaacagataaatttattacaaagaagacactagacaatctgatggttcaccctgaatcgcacgagtccatacaggcagcagtttgtgtcccgctccaggatatggaccatttaagcatcagcataccccagttcggagagcttgaggggggcctctttgtagtcatcaaagaatgccttctcatctgcagcatatttctccacaagagggcggaagacagggtcgctcagcagggctttgtcacttgggagctgaagaaggccctccttgtcgccactcaaaagttccttgaagtaagagttgtcaaagaccaaagggttcgtagtccaggccccctcaaaaccagaccgctctttgtggcaccttccc

SEQ ID NO: 8445 - DNA, 504 bp, Zea mays
  Clone ID: LIB3279-182-Q1-N6-H1
agcaataacatgtctttccaggcaataaatccatttaacacagctacagacagcacaacagcagcaataaaaaaaccacaggtccacagctacagcctacaagcaataaaatgctacagacagtgagacaaacagctacaggcaaatcacacatacagacatacagtctcaagttctcaactgtcaagttattacacacaggcacacagctcacagtcacaggctcacagcctcacacaactctttgctgaccgtggactggtaagctgcaacctccaggctttttgtgatcttgtaacttgtaagctgcaacctccaaactccaaacctccattgcatgaccaatgtatgaaaggctacagccttaagtagcaggtctttcatcagatttagagggagggcatctaatgctgcttggcgttgattgagacttggaagtggtaggattttctttcccttttcctttcccaccaaattcttcaattaaatgttgcaagattcctc

SEQ ID NO: 8446 - DNA, 657 bp, Zea mays
  unsure (1)..(657): unsure at all n locations; Clone ID: LIB3279-182-Q1-N6-H2
atgcacgcgtacgtaagtcggtggacctctanagcagaaaacactttttttttttttttttttttttttttctagctcaacagcaaaactgaagttccaagtagtgaagctcgtcggtgcatgcagcagacaagcacaaagtttacacagtggtaatggacttccattatcttgttttttctgacatacacagctgttgatgacgaaatatcaacaaaatacaggcagctcttgccctcaagactcgggcagagcacatccttcgtgtactgacatagacaggagggacaagaaaaggttacaaatcatacatgtggacacagcactaaaacaagcgttccacacagctaagcacggcactgatcactctgtctgatcccgtggagtgaagcggtgaacgatgcaactgaactgcacaggcggcgggcggcgacgacgagcagagcagggcagaggaattgatgaagggggagaggcccggtgggcggtgggggagggttcagaagaaggagcgcttggcggagggcgccctccccacggccctcatgaagttggcgagctccagcacccgcgcgaccttggtgccccgcttggcctccgccgacgcgcgcttcgcctccgccttgtgccgcgccctggccacctcgttctgcgcct

SEQ ID NO: 8447 - DNA, 380 bp, Zea mays
  unsure (1)..(380): unsure at all n locations; Clone ID: LIB3279-182-Q1-N6-H3
gnnccgcgaggggccgccctnnnnnnnnnnnnnnnnnnnnnnnnnnnnnnnnnnnnnnnncaggncaggcgggcccnaattgggcccaacggganccacaagggaggacgccccggagggaacggcacaaaggaagcccacgggggggcggacagcaggggaaaggccccccggggcccaaagcaggagacgggaaagggaacaaagggaaaacggccccggagaaaaccaggggggcccagcaagggggagggangggggggccacggcaaagccgaggaggaccaccaccccccggggaggccccagggcnaaacagcagccagaagaccccggagcccgggggccaccaaccacaaccacgggancgggcacaaaca

SEQ ID NO: 8448 - DNA, 607 bp, Zea mays
  unsure (1)..(607): unsure at all n locations; Clone ID: LIB3279-182-Q1-N6-H4
ggcccctcccggcagccccagctgncgctccagctcggcgaactcctccggccgcttgaccacgtggtcgtagcagatgtacctgccgccagcggtgttgtcgcccatcgcctcgtacgcgaggacgtgcgcctcggccaccgtctccacgttcgccgtggcgagcaggccgtcggcgagcattgcacgagcccctttgagatacgcgatggacgcggtggagttgcggcggcggaaccccgggccggtgacgagcgcggggcagatggtgaccagcttcaggtctcgtccccgcgccgccctccaggcagccttttccgctgccgtcttgccgagcgcaaaccacagcttgttgtcgcggcaaaagctctcgtcgctccagcagctctcgtcgatgatggtagggcaccgccggccatgagggttgttctgcctccacacacatgccagcaaggaagaggtgaagacacatttcctgacggaccctgtcctgacgcaggcttcgatcacccgctccgctgcctgggcttctaacgttgccatgtgtttcgtgtagccggacatgccggcggggtccacgaaggcggaggtgtggaacacgccagcg

SEQ ID NO: 8449 - DNA, 597 bp, Zea mays
  unsure (1)..(597): unsure at all n locations; Clone ID: LIB3279-182-Q1-N6-H5
aaagtatcacatgggaagtttatcagaaatcgactgtaacaagtatgtggttaaccaaccactcaaaacgaacaaacaaaagcttactgctgggtatctggttcagcaagtgcacacaagagctgatccatagttccacgtacatcactcagaaaccaagcatagttttgagtactatatatagaacattaagtgcaaacagcgacaatccatgaaaatccgatagcaacaagggttcgatttatgctaggctacggcgcaccatctcttgcagaaggctactctgaaacaggggtgccaacttagtactcgtggtcatgttcactggaagttcgagttgcctccttgaccctggtagccagggctgccaccagggtagccaggattgccaccacccgaatatggcggtacgttggggttgcctcctcggtagggaggtggtggccctggtgggctgcctcctcggtagggaggtggtggccctggtgggctgcctccctggtaaggaggtggtgggttgcttccttggtgggagggggnggggtgccaccttgataaccagtgttaccaccttggtaggcagggcctgggttccct

SEQ ID NO: 8450 - DNA, 534 bp, Zea mays
  Clone ID: LIB3279-182-Q1-N6-H6
atatggatgatctatggttttaaaaaggactgtcagaaatatgtaccatcaatacgagagtgtaccaggtgttacagacagagtatgcatgacgactgacagaagagatacatcacaaggcgacgataacggggcttgcattacgatttacgcccagctacgtgtatatagtatatctcagtcaaaggagcaacaactgctttggttccatcatctcctctatacaacgacaacgagagagaggggaatccaagcaggtgacagaaaaagataaacaagtcgattaagcagcgcacgttccaaaaccaagctggatgcctccgtctcttcaaatgatggagagaaagaaagagggcacaacgatgctacaggcgcactggctttgccctcctctttggatgtcatgcatgcagggcctacgctaggctgtcgttaccgaagagagacgatctgttccgcagacattgtacttgtcgtacactttctcacagttgtctttccaccatgattctgcttggtgttcaccaaatctcc

SEQ ID NO: 8451 - DNA, 274 bp, Zea mays
  Clone ID: LIB3279-182-Q1-N6-H8
ctcataattataaactagtttttttttaaaaaaaaaaaagaacagaggcgaacggcgagatgcctgtgcaatctaggaattgtacgttccacaacagtatatctgcgaggagggatcgaggccgtggcgctgtgcgttacctctttccggctagccttaacgcccgtcgacgcgtactccggagtgcggggcagcgcgggccacctctccggcgtcgtcggcgcagccgcagcgcccggcggcatcatgaagccagtgccccagtcgggcgtcg

SEQ ID NO: 8452 - DNA, 367 bp, Zea mays
  unsure (1)..(367): unsure at all n locations; Clone ID: LIB3279-182-Q1-N6-H9
ggccaacggggggaggnaggaagggacnngaaagagnaccaaaacncaggccaacaacaaggacaagcgggcccaagggaaagaggaggaaaaaaacacagacaacgcggggcagngaaaccaccaacagcagggacaanncggggcaacccaacgcgaggggggccgacgagnccnnncagcccggagaccggcccacagagcacaaccacacgaccngcgacnncaggacgcncaacncccgacacacacacccagcaagggcaaccnccacgcnncgcgagaccacncagaagngcnagcccancaagcagcnnccggacncagcaaagcccacaaccccaagcanncccagaacccaccgccg

SEQ ID NO: 8453 - DNA, 613 bp, Zea mays
  unsure (1)..(613): unsure at all n locations; Clone ID: LIB3279-187-Q1-N6-A1
caccatgccaaatcacattgagagacggaacaaacttcctattagtcctgccctgacactctgatttacagttcttttttttcatttctggctaggctcaagcactctatactaacaagcaaacagaaatcccaaaagaaaaagaaagaaagagagcaccggccggatggcacagtccggtcagtagcattagctggtggcggattcagagacgatgctgctgctgctctggctcgcggactcggagatgctctgcagcgccggccgccagtgccggcctcttccccggtgccggtccttgtcctgcttcccgtcctggctggaagagctccggtgagccccgtcgccgcgccggagctgctcgtgctgctgcctgatggcctcgcaccgctgcatcttctcgttcttcctcgcccgcaccgccttcgtcacctcttgcgcggtgatgaggcggtagacctggccaaggagaagcgtgtccttgggcttcagcagcttgaccctggtgatcttggcaccaccactgccggggccggaggacgccgcggcgtccccggcggcggcgggcttgttatttgcaggaacaggnagtatgacgagggcaacgtagtgt

SEQ ID NO: 8454 - DNA, 612 bp, Zea mays
  unsure (1)..(612): unsure at all n locations; Clone ID: LIB3279-187-Q1-N6-A2
gcggggaaggaaaatgggaaagatagcattacgtaggagacgaatttcatatccctgtcaagttacggaggaatgtaataggcaaacattgcaggtttacatatggtcaactgacaggcgacgttaaacccaagcagcagcaagttacacaactcggcgcagctctcctgtgatgagcgcaaacttacgatgctgtgacagaatggatgccaccatcgtgtctttcacttccaggttggtgagatcgtcagtatctttcaccttcaggttggtgagatcgtgaaggaaagacatgttctccttggctccactgaggacagcttgaaagatttgtagtgggtccccatggctgacaataagaattgcagagccatgaaaatgtgtctctgtagatgacagcacagctgaaaatctactagcaacatctgcgacgctctcgccaccttcaggagccatacagnggatgtgcttcatctactgaccatatgtctgcatactacttaataatatcagattcagtaacggaaagaaacaaaaaaatgaaatttatagtggcacacaaaaaacacaactacactatcaattactatgataactgaatatagatatctg

SEQ ID NO: 8455 - DNA, 597 bp, Zea mays
  Clone ID: LIB3279-187-Q1-N6-A3
agccatagagctgcctaatcacaataaattccaaggcccacagccacagcagttcgaatagaccgatgcacacacaacagttacatacgaagtactgctttactaacctctctagtttagttagcacgacagaacaacgtgcgttaggtttacatagttggacgtatctgactgtacacaacatgaaccacgttaagtttacaggtttgggagggaataaatgatgcttcaagagccgtgtgtcgctcaatacacagcattcagacaactcttatcacacaattactgagcacagatatgtggaaggaacctacctgcaggcaagcttaatgagcgagcttgaagtagagtatgaaaaggatggccagagcgagagccgtgatgattcccccaatgatccacttgttcctatccatcctctttgacattgcagccaggatcttcttgctcttgccaatgttatcatcaactccgtgcaaagtagtatgagcatgtagtagtgactgcctctgttggtgaaggtcctgaagaatcgagaaccaagttcttctgtctccaaatagttcttcggctctctttaatctgtcagtggactga

SEQ ID NO: 8456 - DNA, 544 bp, Zea mays
  unsure (1)..(544): unsure at all n locations; Clone ID: LIB3279-187-Q1-N6-A4
gaggaggaatcgtcgactcaaactttattccaaatttatccttgtccggaaccggaaggacggcagcagcaccatgactgactagcatccaaaagcctaaccggagctgatttacatgacatcgcaagagataaacgctgcggaatatgtaggggcagaaaaggacgtgaaacagctattgctagagagcttagggtattacagtatgaaagactgaaacgagttatattcttaggaaatcttgcagttgacgcaaggctgctgctgatttgcacataactggagttgatccgaattcaacggtagttgcggtagatggggctgtacatgcagctctctgcatatttcaccaggtcctttggccgagggcgcctacttgccaaaccaagttcatatgcctttgctgcaacgctggctgcaatgtgggcagagatcttcctgatgtttgagaagggaggataaatcagccccttctcaaaattttcttctgtgacctgctgggccagagcctncgatgctgccagaagcatgtcgtcatgaacgc

SEQ ID NO: 8457 - DNA, 621 bp, Zea mays
  Clone ID: LIB3279-187-Q1-N6-A5
gtctctgatgctgggcggcggcgacgaggcgcacaagttcatggcccggccgcgcctggaccgtgccgacttcgctagcatgatgaaccccggctcgcgccagatttatctgaccttcccggccgacagcacgttccgcgaggaggacgtctccaactatttcagcatctacggtccagttcacgacgtgcgcatcccctaccagcagaagcgcatgttcgggttcgtcaccttcgtctacccagagacggtgaagctcatcctggccaagggcaacccgcacttcatctgcgacgcacgcgtgctcgtcaagccgtataaggagaagggcaaggtccccgacaagtacaggaagcagcagcaaggggacttctccggctgcacgacgcccactggcgggctggacgcccgagatccctttgatctgcaccaactcggctcgaggatgctgcagcattcgaacagcgccaacgagctgctgttgcgccggaagctggaggagcagcagcaggctgccgaactgcagcacgccattgagctccagagccgccgcctcatgggtctccagctgctcgacctcagggctcgcgcagctgcgacagcagcagcagcatcggcact

SEQ ID NO: 8458 - DNA, 576 bp, Zea mays
  unsure (1)..(576): unsure at all n locations; Clone ID: LIB3279-187-Q1-N6-A6
gacacaacacaggtacttaaaatttaaggagatatcattgtcgattacacacgataatttgtctgctaaaaaattaggaaacagtacttgtagatgataaaaaagccaaaacttgcagcagtttgacgaaaacagcagctctagtcgtcgaagaggctgaagcccatttcctcgtccgactcctcttcaggctccgcagccttctcttcttccttgggagcagctgcagcgccagagtcaccagcagcaaccggggcggcaacagcaaacttgcttgggtccttgaggtactccttgatcttgtcagcatgtgggtatgagtagtctgtctcgacagcaacagcaagcacattcttgtacccattgatgaacatgtggggcacagcagcaagggtcgggtatgagatcgccagtgacagggaggcaaccatggagacaccagtggcaaacttctcaatcaggtcctcctcggaaaggtcgagcacctcagggctgaacacggacccatcctcgtagacactggtgacctggaggccatacgagaaggggncggatacccagcttggcgagcagggc

SEQ ID NO: 8459 - DNA, 607 bp, Zea mays
  Clone ID: LIB3279-187-Q1-N6-A7
aaaatttcagcattacttttattctttcatgtctcaacgaatacctcctgttagattcaatcgttcaagacggctataacagtatacatcctcaagaggtataacatccgaagccgccaacaaatttcaacttttttatatagaaacctattgtgtatccctttgaccttttgagctctacagacaaaatctgaaccgtcgacgtaagattggccacaatggtcacgctaaaagaatggcaatgaatctgtatcgagaaatgtgaggctgctgttcagctcacactgtgtggttactcgaatccagtagcctgtccccttcggaaggcatgtcagatgacatctccaagttttgtttggccgtcatcttgttccactcgttctcgacccggaagaacacccactgccaccgtctcaggatttccagagctgctatggtgaacactgtcaggtagttgtgccggagatgcgccgagagcttgtatgtccatgtgcatcgcagaaccaagttgctgcccagtacccagtagaatacccagttctgcccgtaaagaagatagtccatatgcttggatttttgaacatgaaaattctggttaggatgctca

SEQ ID NO: 8460 - DNA, 538 bp, Zea mays
  unsure (1)..(538): unsure at all n locations; Clone ID: LIB3279-187-Q1-N6-A8
aagcagggaaggcacggatacaactatattccaaaacaggggcgccaaatctaagaggcccattacaatccggcacgatttatgaagcaggcaagctagctactggcctttgttcacccgacgagaacatcaacgatttcacagcacatacataggcggtgaggggaggggtagaggacacgacgaaaaacccttgtaagaaggggagacctaacaaatccgtggacgctggaggctgctcaattgctggtgaacttggtgacggccttggttccctcggagacggcgtgtttggcgagctctcctgggaggacgaggcgcacggaggtctggatctcgcgggaggtgatggtgggcttcttgttgtaccgggcgagcttagcggcctcgccggcgagcttctcgaagatgtcgttgatgaaggagttcatgatggacatggccttggaggagatgccgatgtcggggtgcacctgcttcaggaccttgaagagtagnatttgtaggtctccacgctcttcttggccttcttcttccc

SEQ ID NO: 8461 - DNA, 631 bp, Zea mays
  Clone ID: LIB3279-187-Q1-N6-A9
gtggggggggggggtaaacgacaggtggataacaaaaccaaactacagatgtatcgcaacaacaaaacggtgtattgcagcataggcaacacaagggaaaatccagaaaccactacagtaaatagtagacaaaaaataccaaattccagttacggggccacaacaagaccaaaaaaacacaatttcattggatccttttgccgcatcctccgcgttcatcatcaatcatcaccaaaagtagtcttctttcctgcactgggagtgccagcgctgtgcttgttaccaaagccacggccaccacgtcctcggccgccatccctaccaccacgtcggccaccgaatctgccgccaccatccctgcccccagatctttcaccaaatctaccaccaccacgccggccaccagaacggtcaccaaatctcccaccagaacggccaccagatctaccaccaccacgctggccatcgcctcttggtttggcttcatcaacataaagctcatagccaccaccaatgtcagagccactgagctcaagggctttagacacagagtcctgatccttgaagtctatgtaagccattccttttattgcaccagattcatgatcagtcgggatagagacccttgtca

SEQ ID NO: 8462 - DNA, 528 bp, Zea mays
  Clone ID: LIB3279-187-Q1-N6-B1
gcagtactgtatcagatagcacgctatacataagatgccgaacttattccccaatgaccaaaatattatacaaatacacagatcatacatccacaaaacaacaataacaagtgtgaaactaagggcttgtttggttcggtgactaaaaacctgtttaactaagggcttgtttggttcggtgactaaagacctgtttggttcgtggctaactgcgccacactttgtctaagcttagtcgttcaaattgaaaaactaatcttaaacataaaagttagacaaaatgtgataatttagtcatcaaaccaaacatgtcctagcttaccacactttgactaacttttctgtctaaggttagttatttaattgaaacgactaacattaggcaaagcatgacataattagcacaaaccaaacaggcactaattatcatagagacgctgcagagataaagtagcatagagacgctgcagagtaacaggtgtgaccggctcacaaatcaattatttgtcgccagggcggctgtcgtag

SEQ ID NO: 8463 - DNA, 623 bp, Zea mays
  Clone ID: LIB3279-187-Q1-N6-B2
aatggagaaaattggtttatacggcaacgcatacatatgcaagtacattaagtatcacgagctaaccatctggtccatggaaacattaagtagaggacaggcacgcccatgtaaaggtacatcacaaaattacgattttgagcagtatcacaagctaattctaacagcattcatcacagcccagtcttctaatcctcatgcaaggccttcatcaggtatagcctgtcgaaattctgaccagcaaccccgttgatatggttgcagtaactgcagatctgattagttactagatagccctccaatcgtgagggctcaggaataggcttaaatataggattggatggatcttcttctggtagtggctcctcaccagctgctttcctcgccatgttctcctgccttctcttttgaagccatgcctgctgctgtgactgttgtcttgagagattgcggttataatattggaacttgttctgctctgatgaaagatcatccatgcacccaatcagaaattccaagttcctttccataaagggggcggttgacaatttaagtcggtccaggtcacactgggtaacaggtgactcaggtttcagctccttcataaaagcactgacaagcgc

SEQ ID NO: 8464 - DNA, 610 bp, Zea mays
  unsure (1)..(610): unsure at all n locations; Clone ID: LIB3279-187-Q1-N6-B3
ataggtatttaagatatattgatatccattcaaatcttacggtcatagaccaataatattcgtatctgatctaaatctaaaaagaaaattatctaatctaaatctaaagagaaaatatgatacaagcattacccatctccgatctgattgattgcacccctaggtggaaaataggtggacgctttgtcgtcgttgtttttgttcttctttggatggatgcattgtcatcgttcttggaccacttggtagtcagcacggtcatccggaaactgatgccaaaactttgtcacggtcatcccacgccaaatttcggacaacacaagcgttgcctcacagcaagtagaactgcgagtacagaagctccctgatcttgtaatagtcctcgcagagggggccctcgatgacgatctgctgggaccctgtgctgccctttaggatagaatcaccaactttgcgcaccatgatgtattcgccacaccgtaaagcacctccggcaaattcaacctgccagcctttgttttccaaaaattgtttaaaatcagacaactttagatcacccacaagaacaggcttatggngtgggtgggtgttgacgatggggggaaagcaa

SEQ ID NO: 8465 - DNA, 387 bp, Zea mays
  Clone ID: LIB3279-187-Q1-N6-B4
aagcacataaaagatagtccaggattcttgaattacatgagcactgtcagatccatatagcaaggattaacacagggtcccaagacaatagttggacggaccagagggcaagtctacctggtcacagattacaatatggtcatgggtgaccttatgagctcaaaactgtaaaaacatcaacagcaccagtgcttggtaaagttggctccagctttttgaccgagtcacggatcctgccggcgatctagtggtggttgttgccggaggggcggtagaggcggttgtagggggccttgccgacgaggtagatcccgaaggggacgatggtgatgccgagcccgggtgaggggtggggcagatggtttcccgacatagggtggcttctac

SEQ ID NO: 8466 - DNA, 409 bp, Zea mays
  Clone ID: LIB3279-187-Q1-N6-B5
aaccccccccacccagggaaaaaaaaggaaggggcaagggaaaagccaaacaaaaaaaaaaaaggggggcaaaaaaaaaaagaaaaacaaaaaaaaaccggggggttaggggcccaaaaaaaaaaaaaaaaaaaggggggaaaaaagggaaagggtaataaaagggggctaaaaaaaaaggggaaaaaaagggccaaaaaaggaccccaccaacaaaaaggaaggggggaaaggaagggggaaaaaaaaaaaaaccccgccttccttttaaagggaaagggagcggggggccccaggggggagaagaacctaaaaaaaaaaaaaactgttggtggtggtggggggggaggaaaaatggcccgggggcaaaattgaggccccgaaaaccgcaaaaaaaaaaggggggggg

SEQ ID NO: 8467 - DNA, 614 bp, Zea mays
  unsure (1)..(614): unsure at all n locations; Clone ID: LIB3279-187-Q1-N6-B6
agaaacatcagcgaaaaacagaaggattgaagggcatcattattatcagaaatcatgtaatgtgactgatccaacacagtgaagtagccatctactgggtagaacagaaaccatagtactagcagaacccaatcacatgcatgatccaacataaccaaggtagatactagtagtagctagaacggacacatcaagatttgcgctagggcagtagtaagagcactgtagcagagatccaatcacttggagacttgaggctagtgactgcaaatctgtagacacgtaggtagctaggtgacgatggctaataaggagtggaagcagagaccatgccatcgatgtccgacttgacgttgctgaagacgttgtggagcagcacgaagatcaccactgataagttgctcccgaggccgtggccggcgagcgcctgaccgtcgacaccggtgaggtccaccttcctggcgaacaccgtgcctctgtcaagaggggtgccgccgcaagcgctcgacaccatcttgcgcacgatctccagcttctccatgatctgcagcgccatccaccacttggcacacccnccctcggcagtccacctcactgactcaataccgggtaca

SEQ ID NO: 8468 - DNA, 547 bp, Zea mays
  Clone ID: LIB3279-187-Q1-N6-B7
ctacctatcataaatccaatgtgaacgttttgtcaccaactgcaattggaatagatggaaccaggtattacctagtacagcagtgcccatctagtcatttagtccacaaggtcatatctcactactagaagtattaggtgactcaacagttgctacgctgtgtaaagtgtaaacggacgcatctacagaagccaaccatgtagcagaatgcacgaggaaggtagttattcaagttacttcaagattgcatttacgctggacgcctgagctcttttgttgcatttacattacccatgctccgctggataagtcatttgctccctgcatttgtcccacgtcagtgagagttaatggtgccaacttcctcaaataagtacttcttggatttcaggtcgttcgcaaatttctgaatagagtaaattttctcctcaatcatcgggtggtttaacatcagcatcgtattgttgttaacgatagcccgaactgctagctctttagcttctgcatgtttccttttcaatagaatgcatataatcttaagctcctt

SEQ ID NO: 8469 - DNA, 401 bp, Zea mays
  Clone ID: LIB3279-187-Q1-N6-B8
ggggggggggaagggggggggaaaaaaaaacccccctttttttttttaaaggggaaaaaaccccggagaaaaaaaaaccgggcccccccccataaaaaaaaagggaaaaaaaaaaattttttttaaaaaaaaaaacacttctcccgaaaaaaaaaaaattttttttttaaaaaaaaaaaggggggggggggattattttgggaaaaaaagatttaaggggggggggcccccaaaaaagggcgggggggggagaacccttttggggggagaaaacgcgaggggagaaagaaaaaaacaccccggggggggggggggcccccccaaaaaaggggagaaactctctcttgtcggacaaaaaaagggggaggggggggggaaaaagagagggtttttttggtgcc

SEQ ID NO: 8470 - DNA, 408 bp, Zea mays
  Clone ID: LIB3279-187-Q1-N6-B9
ggggggaaaaaaggtttttaaaaagggggggaaaaaaatttttttaaaaggaaaaaagggggggaaggggaaaccccaaaaaaggggttttttttggggggggaaaaaaaaggaaaaaaaccgggggggcggggcccggaaatttttcccttgggggggggggggggcccccaaaaaaaaatggaaaaaaaaaaaaaggggttttttttggggggggccccctttgaaaaaggggggccggccgggggaaaaaaaaaaaacccaccggggggccccggggggaaaaaaaaaagggattttgcaccccccggaccgggggggccccccggaaatttcgggccgggccctggaggggaacaaattttcctaaaagggggggggataaaaacggggggaaaaaaaggaaaa

SEQ ID NO: 8471 - DNA, 386 bp, Zea mays
  Clone ID: LIB3279-187-Q1-N6-C1
aaaaacagaaaaaccctttttttttttaccccaacccggaaaaaaaaaccccctttaaattcccaaaaaaacccaaacccgggcggtttgtcaaaaggccccccgaaattaaaccccccttgggggtaattaagaaaaaaaaaccccccccggttccccaaaaaaagggggggaaaaaaatttttttttccccggccccgggggtcaccccggaaatttcgaaccgggccctgggggggacccaattttccttaaaggggggcttttaaaaattggggaaaaaaagggaaaaaggttttccctgggaaaaaatttaatcctttaaaaattcaaaaaaaaaaaaaacccggaacaaaaaagggaaaacccggggggccctaagaggg

SEQ ID NO: 8472 - DNA, 574 bp, Zea mays
  Clone ID: LIB3279-187-Q1-N6-C2
cttttgccaaattcattgctaagatatagattattcagagccactactacatagtaaatggaccacttgcaactgcttgcaggagatccatcacccagcacggacacttacgactaagacggtgacacaaaaacgacgacattgacttctgctacggtggtgtcaacgctaatcttgctgctaagctattacagacttcctagaagccaattgaggagcttattcagaatgttctggaacttgaaagatgcacgcatcatcccaacatgaagctccactccaccatcttgttcacttgctggggggacagccattgacctgacgctgcagctgaagcatggtctgaaacttgtcacgcaggtcatagaagttaatcttcactgtctccagtgtcttgaggcacccatctttgctcttctgctgacaggattcgcggaactgaatgcaagtgttcttaaccttctgagcaccaatacttgcactgcttcctttgagctgatgcacaaaggcgtcaaccctgtcaaaatccacgttgggcttctccagcagtttggccagctctccgatgatccgc

SEQ ID NO: 8473 - DNA, 600 bp, Zea mays
  Clone ID: LIB3279-187-Q1-N6-C3
agttaccacagcaagcacaagtcatctcattacccaaggcaatggtaggttaatgttggactagaactcggatcctagagatggatcggagaatgcacaaggaacagaagaacatacgtccccgataacagtttcatgggcaacaccacaatcgtctgcatttagccagtaacgccgaacatttcatcccatggcgtacttctgggtccagctgcgggctgtcgcctcgtacttaggccgatccgtcttgtacatgtgagcaatctcagggacaagagggtcgtctgggttgggatcagtaagcagggagcagatagaaagcaaaaccttagagattgtcaaagcagggctccactgcatcttaagaatgtcaagacatatgcttccattactattgatgtttggatggaagaccttcgtcttaaaagatacctttggaggcttgaaggggtagtctggcgggaaatgaatgttcaccaagaaaacacctccagcatatggactatcaggaggacccatgatggttgcctgccagtggaacatatcctcaccagcaggacctgcactgcatgatgttggagggtccttttgcaagtcctt

SEQ ID NO: 8474 - DNA, 520 bp, Zea mays
  Clone ID: LIB3279-187-Q1-N6-C4
ggccaaacgacagcatttcaatgtaaagagtaaacattgagagctcaagctcgaaactaacagaaacagttttgttcacctcgcaaaactttaaaacaaaaatgcctattgcagtactacagggccccgcataaaacagtacacaattgctgatcgctggattgagatagcactacttcgatggcaattaactttactcgtcgtcctcatcgtcgtcatcagcaccaccggaggagttgagttggttgagcctttcaatgaggctggccttcctctgctcatatgtcagcttcttggggttggacctcttatgctcctttgggggctgcttggttgacttaacaatggaaggatcggcacggatggcaacatggacctttttgtacagcgcttttatttcatcagcctcaactcccttcttaatgtacgcactgaaggggctctggtacttttctgggtcctcttcagcaagggtcttcatgtagtcagcaacatggccaccatagatgtacctgcgggg

SEQ ID NO: 8475 - DNA, 500 bp, Zea mays
  Clone ID: LIB3279-187-Q1-N6-C5
ggaaaacatgtttggattgggggacataccgaaccaacatccaaacctaaatcacatatgtttggtttgcaacctatcctccaaaaatacccttttgaaaaccttcagggctttgtgaagacactccaaaactattacagatatgcagagggcgcacacacccacacaaatgtttgacaaaatacctttgttaggctcgtttattttcatcattttttactttattggccttaaaaatagcacaagaatcaaacctaaaccttggggcttccgattattctgattggggactactcacacacagatacttttagtttgcagttcaggaaggattttattggtaaccaaaaagcttttctctgaagacttccttcgcttcagcgaccaaacttttgacaacttgagcagctggtatgatctccgtgattagcccaacaccctgacccgaaacatggccatgatggcgatatctcctgttgccgccgcgtttggaaaatacc

SEQ ID NO: 8476 - DNA, 630 bp, Zea mays
  Clone ID: LIB3279-187-Q1-N6-C6
gtcagttcccttgtcgaccatttcagcgcttgtgactcacaagcaccacacaatgagatctgctgcacactcccccgtgctagctgtgaaacaggaagcactgatccaacatgatcgcccccccatggttttaaggccatgcgcagcggcagccgctcaagaaatttgcgatatatggtgattaatcataagctgtggagctgcgttagcatggcgacgagctcgtcgctggatggccggtcggttggcgagtccgagaggcagacaatggcaacccgaatggccatcagcatctcctcctcttctccctcgtcccccaggatgctgctatccagcgtttctttcgggtccgcggactgctgcgtgtgccggagccatcttgggaggccgccctgcccggtactctctcccgagaagaaagagtctgtcgggtctctcccagtgagcagcacgcccaggatcatgccaagggcgtacacatcactcttatccgtgtacctgctgctttgatagcattctggagcagcgtagaggccagtgcacaattctggatcacctgaacctgctgcaatcagccttgcaacaccacaatctgccaataatggctccaaaccttcgtctagcatcaca

SEQ ID NO: 8477 - DNA, 557 bp, Zea mays
  Clone ID: LIB3279-187-Q1-N6-C7
agagaaaaatattaccttgacagcttcatcacaaatgtttagagcaaggtcatatgacaaggagcaagcattacaggtccgtgaacacatttattccctcttgtgccaacagaaacagtccgcaggacttgagataccaaacatagacaaataagcagacagcttgccttgtcttccccctattatgatgctccgggacacaaactcgtaggaaagctatttcttgccacgcaacttggttcccagggccctctcgagcttgctaatgatctgctggttggggattgccttgcctgattcatactcctgaatcacctgtggcttctcatttatcatctgagcaagttgtgcctgtgtcagcttcttatcgagccttgcttgcatgagattcttcttcagatcacttggaactcgctcatgggcgaggttttcggtgtcgtcgtcgaggcgcttggtgttgagggatgtaccgctggatgccgccttgttcgtaccagcgttgtacttcttcatggtatcgatctccgcaccggcgcggcgcgcggcgttgacggcct

SEQ ID NO: 8478 - DNA, 525 bp, Zea mays
  unsure (1)..(525): unsure at all n locations; Clone ID: LIB3279-187-Q1-N6-C8
cacataaccaagaatttttgatccgatgtatagaagacatccgccactacaaaattattaaaccaaatccttcaaattcgcccagaaagcatgatccaccttcttcaactcgatctctgacatatgtaagcaaatgaagtaccagctacaaactactacggaccgacctcatccgggccctgtcatgatccgatcagacgggggagaggagctggaagacggagggcttgggctcggagttcatgccgatgacgatgacgagggggatgaagccgtagtgcgccaccaccttcgccttcttcatcgtccacgtggtccactccttcatgagcctcaccgtggtcgccgccgcggtggcgtcctcgtcgtcagcggtggccttcttcccgcccttgcccttgggcttcgacttcagcgacggacgcgacgccatggaggatcccccgaactggatccgacgagccgagagcaaaaccctagggaggcggaggcggaggcggacgnacgcgtgggcggacgcgtggg

SEQ ID NO: 8479 - DNA, 628 bp, Zea mays
  unsure (1)..(628): unsure at all n locations; Clone ID: LIB3279-187-Q1-N6-C9
acaccagcacacacactgtaaatacttactgcagagatacaatctacatgcattcctgttctttatgtacaatttattcacaagccagcttgctgtcgaagctggtcaaacagatggcgaaggcctggaatgccgagagtgggtatcggtagtccatagtgaacatgtcattggcgaccttaccaaactgcaggatcactttatcatgatccgatgctgaagacgaatttgaaggctgggtttgctgctgagcttgctgtgacggttcagaatctagttgtggtgcagctatcaactggaagttcttcacagaagccacggtcacccgaccacggaagttgaggcaccaacactgcagctgctcgtgccaccttggctccttgttgcggagaaccaaaggcctcttcttagcctggtcactgtcattgtcgtcttgctgagccaatccgctcgtctctgagaatcgagaggagctccagtccaaggagcggtctgcgaccgagaaccttgagctggaagaggtgttgtttgcactgcgaaaggattcttcgaaggacgacgagccaggnatgaagagctgcttgggttggccaggctcaggcaccatgccttgagggtccagcgctga

SEQ ID NO: 8480 - DNA, 493 bp, Zea mays
  Clone ID: LIB3279-187-Q1-N6-D1
aaatgaccaacaagaactaaattctacgctcgtgaagggtcctggtctaaccattaaaaacaaatcagcagcgggggaagccgcagaggtgacataagctcctattatacactcacaaatattaagaggtctcaaaataagcagacgccagaagagctaaaacacgtcaaaaacaggtctatgtctcccttcgggtcctccgacgtgggcctgtctcctccttttcatcctctttctcatccttgtcaccactgcttccagcaccgtccgtctccgcggccttgggcttattcgcctcagctgcaggtttcacaggtgccactggtttcttgccaccaaacaggagcttgaagagaacggtaacgaacacgatgacaacggagaccaaaatgccaatagtgatgttgggctgtttctctcccttctcgataacatcaataatcttggtcttgtagggtgccaagaacggaatatcagcaatcttgtacaggac

SEQ ID NO: 8481 - DNA, 602 bp, Zea mays
  Clone ID: LIB3279-187-Q1-N6-D2
agcggagtaaaaaagcgacagcccgaatttgcattaacaagtacattacatacacgattcctcctctgctctccaaagttttccatggtatacatacaccttcccaagatccatgacggcggtcggacacctagcagttagacactcgaatcactcgagctgagcgtaccagaccccctggatcttgacatccttgggcgccttggccccgaggtcggtgtcggacggctgcacgctctcgaagacgccgatgacctcgccggtctccgggttgctcttggtgacgctcaacgtgatgttgccggtggaggaggcggcgttcttgatgttctccttctggagctcctcctcgtcacctctgcccccggcggggagcgcgacggcgttgtcgtagccggtggagccgccgcggcccttggggtcgaggaaggaggagccacggtagctgggcacgaggaagggcccgccgaagctctcgggcttgccggtggcgacgagctgcttgacggtgaagaggaacggcacgcgctcgccccccggaagctgcacggtgacggcggcgtagtcgatgccgtccttctcctcgaacttgagcgtgccgt

SEQ ID NO: 8482 - DNA, 591 bp, Zea mays
  Clone ID: LIB3279-187-Q1-N6-D3
ataaaaaaaataaacgcatcccttctctgcatttacatcaacgaaacgagttctagataaattaatgaacggaatatagagttacatactaagtactccagtatatatcacggagttcactccaactacacactggcactgctttgagttgtgaccaaaatgcttaaccacgctatcctggcagagtatgggttacacaaacggctccagcaaaatgcttaccaccattagggatcctccgtagcaaaaaaaagtacatgatacctgataagttcccttcacactgatgaagaatatgtcagttgtcaaatggaccgctgcatcatatcgtcttctgtgcaatttcctgtgcatttttcaaagaaggaagtgtgttcgttacatcattattgctttgagccaacgtgatgttcagcagtatcctgcgacatgtttctgccaatcgttgataaggatgtgcacaaaacaaaccaacttctgcggaactttcagatggtccgtccacagtttgtgcatccgttgtcctccgaagcttgatttcctcccgcggacttaactcctcttgcagtttggctgccatgacggatgccc

SEQ ID NO: 8483 - DNA, 534 bp, Zea mays
  Clone ID: LIB3279-187-Q1-N6-D4
ggttccatctatgtggtaagaaaagctacaaaccacataaacaataaaacaacactactaaaatttgaatagacaagattgtccgtttgtcactaacaaatttaccatgtcaataggaatagcatgagaaagaagaaggatgtggatacattacatgtttgtggaaggagtttacccatttagatactctgtggcgacagggatggtgggaagttggtatatacgtaggcacgcataatgtggtggttcaattcgcacaccctctcaagctgcaaagtcttggtgtccatggaaaaacattccaagtcttctatcactgccgatgagcttacatactcccctgctaagcttaggtgttcaggaaaccttagcaggagcagtgtacctctccatcgcacccctgatgtaataccgaaatccaggatccagcggaattatctttttcacctgccactggttggaattggaaaccgtggcatcggctcgccttacagtataatggaggctaaccggacgcgtgggcggacccgtggg

SEQ ID NO: 8484 - DNA, 584 bp, Zea mays
  unsure (1)..(584): unsure at all n locations; Clone ID: LIB3279-187-Q1-N6-D5
ttggaagggataaaaccaaatctgatagcactgtgtcagttctcccaatggatctgaaaattatgtagtgccactgtgtcggttcttttttatttgcaagctcggttcagaaatctagctaaattagaagactccatatagcatcatgaaaagggggaccagtccatcttgtacgatgatatgagaagaacaatgaattgtatgctccctcttgatccttttcaaggacagggttttcctgtttcacggactgtggttctggtgccgcactaatcatccaaagagaatccctgcggtggttggaactttgcacccaattcgctcagtttagcatgagcctcagcgtagtctctgaagaatgcgtcttggtcctctgcatatttctccgcatagaccttgaactttgggtcctcaaataaagcagcatctgtaggtaggaccagaagatcctgatctcgtttctctttgatatccttgaagtaactgttatcaaacctcagccattcaactgtccatgattgcccaccaggtgcaccaggaccatntttagtatattttgtttctggtttcccccaccactccgt

SEQ ID NO: 8485 - DNA, 305 bp, Zea mays
  Clone ID: LIB3279-187-Q1-N6-D6
actagtcaaacgtcaaagattcaatcttttattgttgcagcaatgttgtactctgctccttgcacagagcaccccctgatgacagatttttcagaatatggattctgactgcacatcagcatggcaggatctactcatctaaatcagaaacggaacacgactttaagcaaattcatggagacggaagcacagcatcactcgacctatgcttcgatccgcatgttccatgtcatggtgaagcttttcccgagcggcaatgccagcccgccgatctccaccatgacgccgttcttactatcctcgac

SEQ ID NO: 8486 - DNA, 536 bp, Zea mays
  unsure (1)..(536): unsure at all n locations; Clone ID: LIB3279-187-Q1-N6-D7
ttttgataactcaaaatcacgaattaggtgcaancttaaaaacaacacacctgacctcaattacctctcaggctctcacgtttgtgttcacaactcttattagcatggaaaactgcagaaactaaaaagtacttgcaatataggttgttctaacctctaatatattatccagctgatagtaaagataccacactgagtccagcaacactagtaccacgacaaggccatagcagcagatcaaaacttcccgagcatcggaccaccacatcatctcttgaggttgagcaagaccaccgcgatggcagccgtggcagctgctccagcagccgcggcaaccacaagagcgggagacaccacgccctcatccttaggcgtcccggccctggcaaaaacggaatcacgtccctcctcttcctccttcccgcccttgccctcggcagtggcggaacccttcagggtctcgatctcctcctcaagggcggccttctcctggtacgcggtctgcagctggtccccgagccttgcgcccctgcgca

SEQ ID NO: 8487 - DNA, 614 bp, Zea mays
  unsure (1)..(614): unsure at all n locations; Clone ID: LIB3279-187-Q1-N6-D8
gactaaatagctctcccttttctttcggtcatcaagatcctattattccattcataataggttaaccccaaagcctgcgatagaattaggagccaagtagggcgtgccctgaccatggtttacacggatgattccttccttcaccatagaacatgtgacgacaaagtcaaagtgaaggtaataacatctgcattgccacatgaccacataatcttcacaagtgtctacataagacatcagctacggctacgctcgaaatacgcttctttgtacagatccatgttagcttccaacaggaatttttcttagcatggacagaagcagccaagaaccgctagggttcagggtgacggtgaaatgcgcatttaccagtcttcatccagagtcgccctatggaagcacagcactgtgcatacaaggatgaagaaggacgtgaactcgatgaacatggccccggtctcgattaagccagcgtgcctcagaattgctggaatagcaaggcttcccatggccgacgcaccagtcaagaattttgcagcattaatccaccctncaccttctctgctggtcaagaagtgtgtggatccaccaccaaaaacaggcatggcattggt

SEQ ID NO: 8488 - DNA, 618 bp, Zea mays
  Clone ID: LIB3279-187-Q1-N6-D9
gccgcaattcatcattacttgcgatatatgattcagctatgacactctcctgggcctcgttctttctaaattccttcgcctttctctttaatgacttcgctatatcggctatctcactgttgtcactggcattcttgtcagatttggatggacctgcagtgttctcctttggaggaacaaatgcagcctctctttttcttttattttcttcagctctcccagattgcttgtccagcttctcttgccatttctttgctgatttctttttgtcactcatgaaatactcaccgttctcaagttcaagatcaatcttgctaggctgttgaggcggtggaaagggtgtgtacggtttcttctccttagtttgaggcttcttctgcttgacattcttcttcttgaacttcgggagaaatctgtcccaattttcattggctagagcaggattttttgctagctcacgtttgattagtagttccttgatgtggtacactggatgctttacattcttcatgcaatcctctacaatccttctcacttgtttcagtccccttcccctatagttgcccatggctgcaacagtatttccctgcactaagatgtagcagccagtcaaaatct

SEQ ID NO: 8489 - DNA, 545 bp, Zea mays
  Clone ID: LIB3279-187-Q1-N6-E1
gcaacataatagcattatagcatatacacccgaaattggacgaatagcgttgcaaaccaaagaaggatgatatgaacaatcatggccaatagggggctacgaacaatttactacatagtacaaaatggaaacacacacagcagcagtatccaatggagtggaaccatagagtatatactcaaaataacccaaccattaaccaccagagaactacttattagccagctactcaatagtcgtctccctcgtcaccctcatcatcggcaccctctgcaccgacttcctcatagtccttctcaagagcagccaagtcctcacgggcttctgagaactcacccttttccataccctcaccgacataccagtgaacgaatgcgcgcttggcgtacataaggtcaaacttgtggtcgatgcgtgagaacacctcggcaacggcggtgttgttgctgatcatgcacacggcacgctggacctttgccaggtcacctccaggaacaacagaaggtggcttgatagttgatgccacacttgaatccagtggggca

SEQ ID NO: 8490 - DNA, 607 bp, Zea mays
  unsure (1)..(607): unsure at all n locations; Clone ID: LIB3279-187-Q1-N6-E2
aacatacntgaaagcatccggcatggttcatacgaaaccgaagcccatacatcagataggaattggtagacagacaccgcgaccgaaggaagcaaacacgcacaccagaagcacccccactacagactacgattattcctcgccacattccacacaggtagaggtcctcacaactcgctggcactgctcccacatcttcagagccacgatcggtcgacctagtcccacctcaggcgaccttgacctcgatggtcttgggcttcttgggctcgggcgggggcagcttctcgacggtcacggtgagcacgccgtccctgcacaccgccgagatcttgtccatgtcggcgttgtccggcagcacgaacttgcgcatgaacttgcccatccgccgctccatgcgcaggtacttggcgtcctcgcgctcctcccggcgccgctcgccgctgatcaccagcacccgctcgtcctccacctgcaccttgatgtcgcccgtgcccagccccggcatgtccaccacgaacgcgtacgcgcccgggagctccttgacgtcggccggggtgaccgccatggcgcgcgcgtcgcggacgtaggtgcgcgtgggcccgcc

SEQ ID NO: 8491 - DNA, 584 bp, Zea mays
  Clone ID: LIB3279-187-Q1-N6-E3
aaccagaaatttctgttcactacatgaattgagtgaccaaacataaaaggagccatcaagtccaatagcacccttacaacacctgcaacacacaattgagatgatcatactcaagtctaaacacattccaacaagctctcaaacgatggcatttgctgcactggcgatcctaggccaaaggtcagcacactccttgccgataggtccagtgattgcagaacctttcatctcacccttgggattcacaatcactccagcattatcttcgaagtacatgtagacaccgtccttgctacgccacggcttgcgctggcggacgatgacggcgggcatcactttcttcctgaggtcgggctttcccttctttacggtggccatgaccatgtcgccgacacaggcggacgggaggcggttgaggcggaccttgatgcccttgacggacatgatgtataggttcttggcgcccgtgttgtccgaacagttcaccgtggccgtcaccggtagacccagtgacatgcggaacttgtttccagccgaacctaccctacctcgattagacatgacggctgctcggacgcgtgggc

SEQ ID NO: 8492 - DNA, 571 bp, Zea mays
  Clone ID: LIB3279-187-Q1-N6-E4
aagcacggataaaaatcatcatctgctcataatcactgatggaaaatacattattcttcgtctcgatttattagtgccgcatgttcacaagatgcatcatcgtacgattccggctcaaatgcagggaaatagttcaacatttgcatacgcctgtgattgctacaaggtttccagagcttcacttttttggtgtatctgcatacttccaggaggtatgtgcataggaattgtattgtcttccaccagccacatcttctgcacgtatctggctgccaatttccttcaggtcctcagctgtgagcttcaccttcaaggagtcaacgttggcatctaggttcttcgtttttgttgtccctgagcaattaacgaacacatctcagcaaccaaatgcaggacgatttgactataaaaaaaaattcatgtccgcgatgacttgcttcaaactttggagtgaataacaagcacagatcaattgacataagtttgaaagtgaactatattacagctaagtaaaaaacaatatatcacaaaaaactcaacaggttgtacaaaatactatgtatacatattc

SEQ ID NO: 8493 - DNA, 609 bp, Zea mays
  Clone ID: LIB3279-187-Q1-N6-E5
gtgtaaatgcaccaatacgtcacaagtgtttatctattcattggaaaattaatgtactacagctccgccgaaacaatccagtctctccttggcacaacaaacatatccagcttccttgcgggcattcttgcatggaaagatcctcaagtgttgattcctgctcttcagatagcagaaataatgatggaaaagcttccagagacattttccatgttatttgtgagggaaggtgtcgttcatgctgtggagtcactcatatgttcagaatcttccaacaaaatgccttctcaggtgccacctcaggataaagataaagattctgccatgccatcacgttctagacgtcaacgccggcgtgcgggtgctgttgcagcagaaaatagttcattggatgaatcaaatagttccaaccttggtgttatgtgctcaacagcaaccgcttcagaagctccaaacaccagccttcgtttcacagttagtgaccatgcaaagtctttcaaagataaatacttcccggcggatactgattcaagtgatatcgggtttactgatgaccttcttaaactgagggcactctgtgcaaagttgaatactgtctctgagaacgtc

SEQ ID NO: 8494 - DNA, 632 bp, Zea mays
  unsure (1)..(632): unsure at all n locations; Clone ID: LIB3279-187-Q1-N6-E6
ggctttatgaggtattaggatgatcctgagtacatctttagttctaaaagcagcgacccaattatcacatgcattatcaaaagtatagctggaacgaacaacagagggaaagtgactcaaagctcgattctgtaggcagccgatcacatcaaaacttgagttagggtagattctgtagaccattgtaggcagccgatcacatcaaaacttgagttagggtagtaaaagcagtgtagcagagatcctaatcacttggagatttgagggtggtgactgaaaagctccatgtggtgtggacacgtaggtaacgatgtctaagcagtgaaagcgaagaccatgtcatcgatgtccgacttgacattgctgtagatgttgtcgatcagctcgaagatcaccagtgataagttgctctcgacgccgtggccgcggagcgccgcctgaacgtcgacaccggtgagggcctccttcctgtcgaacaccgtctctctgtcaaaaggggtgccgccgcaagcgctggacaccatcttgcgcatgatctcaagctcctncgtgatctgcagcgccatccaccactgggcacaccccccctccgcataccactttactgacgcaaatacctggtacacattacc

SEQ ID NO: 8495 - DNA, 538 bp, Zea mays
  Clone ID: LIB3279-187-Q1-N6-E7
aagcaaacctatactcccataccaccttaaaaaacaattctcggcaccaataactgacataagaaattatagattcaaggtgtactgacaggtatgcacaaaaccatcgaatgaacatgtgctacaagtagccacaagtaactccaaattttctcaacaaacgtaactctccatcatgactggcttcacttgttccctctgaagtacatgtacactttctgaagaaccccaatgctcagcagtgtctccagacaaaacagtgcaaaccccacaaagtaaaagatcccaattatcacatgttcagagaaagtgtcaatcgcagccagaataccagttaatgatttcccatgaaatacaattggtggagcaatggcagcaattatgcaaaaaccaatgtggatcaggtaacacaggaaaaaccatccaaaactgaaagcactgttagtcctcattgcacggtagagtggcctgtaccatatcaaatatgacagagggaattccaagcaaagcatagattgttgcaaggaaaaacactttg

SEQ ID NO: 8496 - DNA, 448 bp, Zea mays
  Clone ID: LIB3279-187-Q1-N6-E8
gcctacctcttcgaccatgttgtgaacatatgcctaggccctaatgaggatcgatatcttgtaaccgggctccatactgtgaatgacaatgtactgtagctgctgccaacagattcttggctggagatatgagaaagcctacgagcaaagccagaaatacaaggaagggaagtacatcctcgagagagctagaatggtgaaagatgggtgacgatcatttggatgctcttgcttctaacatcccagaagcgcaatcttcttaactctggaaagattcagaagtatcccttaatttgcatgcctcagaacattcgacacctaattggcatcccagttagccaggaaaatcactgattgcagattctttgatttgtagaatattactgcccttagcttgttagcaatggtaacatgtgctgaaatattgatgatccggtgaattaaagtg

SEQ ID NO: 8497 - DNA, 615 bp, Zea mays
  Clone ID: LIB3279-187-Q1-N6-E9
tttagctcaatctaacatttattctgcttccaatatacgtagtacattattagaactaggagcgcaaccctaaaaaaagcatagctgcattattccaatttccaactaccgcgcatagctactcacaaaaaagctgattgattcatgagacagctaggcggccggcaagacagccctcggcgttgccgagatagaacgccaagacaacaaagcgcctttcagtcaagttgacggggccaggccgggtcactaccgcttgccagcagcccccaggactcggcaccggtactctcccagagcccagatcgggaaggtgttcctgtactgggagtaactgatcatgcagttcttgttgaacactcctatgatctcttgctggggaaattctccgtcctctgactgcaagtttatcaaaacccttgctgctcggtgtagaggcgcgggatctctctgggcctgtcctgcatcaatcagcgccagcatggcccaaccagtgttcgctgcatgagctcggttgcctttgagattggtgtaaacctggtcttgagacgataaatagctttctccccagccaccggaaggaagctcttttgataacagaaagctgcatgcctt

SEQ ID NO: 8498 - DNA, 634 bp, Zea mays
  Clone ID: LIB3279-187-Q1-N6-F1
gagcaaatcgcttacaaatgataatcagataagtagagtcaacaagacaaaactgtatctggcaacgcacatcgcctcaccccagccgactacaccattattcttcagcaaaagcaaacagctccttccctcccccctcagctcaagcgataaccataagaaaacctgctacgcgactgcgtatatgataatgcatatgcatgcaaaagataactgacaggccagtgtagcgaacttcatagcacacaacggcccgagtgagctgcaagccgtgtgcctagtaccggtagtgggcaggcttgtagggaccctcgatcggcacgctgatgtagtcggcctgagacttggtgagcttggtcagcttggcaccaagcttgcccaagtggagagcagcaaccttctcatcaaggtgcttggggagcacatacaccttcttctcatacttgccagagctcttctccttccacagttcaagttgggcaatgacctggttagtgaatgagcaggacatgacaaagctaggatggccagtagcacacccaaagttcatcaggcgaccctcacaaggacaatgatgccagtgttggtcttcgggaacacccagcggcagtctggggcttgatggtgatgccct

SEQ ID NO: 8499 - DNA, 517 bp, Zea mays
  Clone ID: LIB3279-187-Q1-N6-F2
acccgagacaaacatggataattttgtagcatcagactagatacatgcataatcacatgcacacaaaaaaagatatgtacacacattacaatccacattacaaccaactgcatgtgagaagctacagccaagcatataggagaacatccatagcagtgtttttaaggcgtcgtctaaacgaccaggtgctcgaataattttaggcgccttgctcgcctatgcgttaaggggggggtccaacgcctcgccttaccgccttaagaacattgatccatagtcagctacattttttacctggatccttcatgagctgtgcgatcattttatgaaacaccagcatactctcgcagtacttatcatacagtgaatcgaacccacacagggggaagccgtcaccgacacccgactccagccactccctggggctgcccccttcctcctcgtcgccatcctcctcgacctcggcgcactcgtcctcggggatgagcaccatgaagctgttcttcctgagctcctt

SEQ ID NO: 8500 - DNA, 444 bp, Zea mays
  Clone ID: LIB3279-187-Q1-N6-F3
ggggggaaatccagatgacagaggaatatgaacataaagcatgggcgaacaaactcatccaccattaaacaaataccaaggcataaccaagcgctaaaaggacttttaaagggcaggggtggccccaaaaaattgggttgccagcaaagggtaaaaaccccagaagcaaggagtagtagtagtatgccaaaaaaaatgcttaaattaggggcagggaaaaaattgttaactggaggcatgaactcaggagttttggcgggcaaaaaactttttaagccatgcatggggaaacgtctcccctcctaaagggtttaaaaaaaaacaagtgccctccctggcttgttaaccctgacttccgggttgccagggatgttccggaaaaactgaaacccgcaaatgccgacgggcacccccgttgccggaaaagggggtacacctcgggcc

SEQ ID NO: 8501 - DNA, 581 bp, Zea mays
  Clone ID: LIB3279-187-Q1-N6-F4
agcagggatttcgatagatgtttttttcccctttgcgacacgactgactccactcctcattacagttccagtcaaaggacgcacgattgctcttatcaaccgcgacaacaaaattcagccatgacaaagtatctacctatagacatcaaaatatccccactgctttcgtatcaaggatggagtgcaaaatgacaaggtctaggcagatgcagggccttgctgcctgaagccattgttgcgctcgaccctcagtccgttcccattgctgttggggcgtcgctgttggtagccattcccagagtagtagccgtggccgttctgatggtagccgtggccgttctgagggtggccgttcccttgcggtccacggacacgacctgagtagtcgttcctcatgttatccccgccgttgtagtagccgttgttctgaccgccccactgccgcttgtagccgtccccatagtaaccaccacctctgccagaatggaaccgaccggcaccgccattgccattgtcatccccacgggtgattacaccatcaacaactcgtgtttttggttcttttgttcctcacatatgat

SEQ ID NO: 8502 - DNA, 517 bp, Zea mays
  Clone ID: LIB3279-187-Q1-N6-F5
attgtgtaattgataggtgccaaaagaaccaaccatggagcatttgctgccgccgtgctcccctccccttctccctagttcatttcatctgctataacatcagcaacgcatgacaacgtgaatgccacaaagccaacactaccagcaagaactagcacattgtgcacgtagctcttccttctgaaccttgcaagctcttccatatcacgcctcttcctttcatccaaccattgagagaaggatccagcctgctcttcaagagcacacttgctgcatttcttctccatctgggaggcgaaggagcgagaggccgccgctcgtaaagggaggaccctcagcttgccggcgagagctcgcagcgccatggcaacgacggatcggccggatctgggggaggaggcgcggggggcgaggcgtacgcgttggctagggtttgccttcgtctgccttctttcttggcgagggggatgatgtttttggctttgctcctgaacggagaggtgcccgtagggctcag

SEQ ID NO: 8503 - DNA, 620 bp, Zea mays
  unsure (1)..(620): unsure at all n locations; Clone ID: LIB3279-187-Q1-N6-F6
aaaaaatatactttatgagcttcaaaagtttgctgataacggttggaagcgtaccggttcacaacagatacaggctgcagtgctgcactacaaacatgaaatatgtgggaaatcgttcctctatcaaagcagctctaaaaacaattcacgatgtttcagcctccatagcattgacttgatgacccaagtacattccctcgatctctgcttgtcaagaaattaagtctggacatgtgtgaagatactacaaaattctgccccaaaaaaagctgctccaaagataaggattagtttgtgatattctgatctctgttaagcaaacagactgaccataggatgaccactgtccattactcattcgtgttgctcgtatatttgcatgtaggtttctgagagagcaaccatttgaggaagggtctcagtaacatggagatcctgcatctcataccaggcctcttctgatttccgctgtacaaatactctgtagcatccctcgccaggtttgccatcatggacaatgtttgctatgaggtcatactttgaacgtagcttatgattctctttcggcttaggtaatggaatgtagtccttcaactncagttcttcacaggaaaataact

SEQ ID NO: 8504 - DNA, 430 bp, Zea mays
  Clone ID: LIB3279-187-Q1-N6-F7
acagggcaaaacagtctattgcacggccatataagttcaaaccagttgacgggtcaaaacaccaaagttactggcagaaaatggcatttgatgagggggggggcaacataaatacacatcaaccacaataaaaaatgctttttaaagggcaagggagctatcagatcatttcaaatgacatttttacacgatcctattgaataaaacatgaaattgtaccttaaggatcggaaaacttttttgccttggacttaacaattgctgggccttcggtttttttggggccaggggtcgcgctttagcagcagcaagggcgccatcacttttcttggagggatcataagaaacctttgctggctgaatgttttgggggatctttttagcatgtgatgaaacataagcaggatttttctcagtagatgcaggaact

SEQ ID NO: 8505 - DNA, 488 bp, Zea mays
  Clone ID: LIB3279-187-Q1-N6-F8
cttggtttgttgtgtgtttttttttttttttttttttttttttttttttttttttttttttttttttttttttttttttttttttttttttttttttttttttttttttttttttttttttttttccccaacccggtttttaaaaatttggggggggggggggggaaaaaaaaaaaggtaaaaaaaaaaattttactttttttcccaaagaaaaaaatttttaaaaaaaaaacgggggggaaaagggaaaaaaaaacccttggggggttaaaaaaaaaattgaaaaattcctggcccccaaaaaagggggcccccccccgcggcaaaaaaaaaagccaaaacttgggggggccccccttaaccgggaaaaaaaaaaatttcccctttttttttttgggggccccaccagaggggggggcaggggaaatttttttaaggggttttggggggggggccccccgaaaaagagcccaattaagcccttaaaa

SEQ ID NO: 8506 - DNA, 436 bp, Zea mays
  Clone ID: LIB3279-187-Q1-N6-F9
attaagctataaaattggtgacacgtagatactcacacttcctagggcgtttgtcctgtattatctgtagagtattgatttagctgctttcttgcattcgccacttatcagatcccatggtatactcagatacaagtttggagaatagggatgaactgtcctctagcagttttgctggggcgtcatgctctgcaatttcaccattatccagaagcaagactttgtcgctatcaagaactgatgtgatacggtgagctattgtaatcattgtgcatttgagaaattgttgttttaaggttttttgaatcaagctgtctgtaattggatccacggatgaagttgcctcatccaaaaccaagatcttcctccgtttcagaatcacccttcccagacacacaagttgacgctgacctgtgctccagtttttgcccttttc

SEQ ID NO: 8507 - DNA, 507 bp, Zea mays
  Clone ID: LIB3279-187-Q1-N6-G1
ggagaactgaatggttcaacgtttaaacataattttctgttctgttctatctgaaatcaatctaaacaataacaaattaggaatgaaacggcttcagcccactatactccggaaccgaacactaccttaaacacaccagacgctaagtggttacaggtggaccaaagaataatcaacactttcatctcagtgaacaaggtactacaaacaatgagacaaacaaaacaagggagactgacaaaaatgtgattgctcacggaccccgattacactcgattattcagcagtttctgcagcattgctaagctcttaaaaaccggcaatttattgtcatacctgccacatgcaaaaccgaactacaatgaatcactctaacagggaaattgttcctggcaacagcttttgattgacaaacacatcatgtgcacaacctaacagaatgtaacacgtcctactcatcagtgacgcatcctctagacgctggagccacaagcttgatgtacttcc

SEQ ID NO: 8508 - DNA, 596 bp, Zea mays
  Clone ID: LIB3279-187-Q1-N6-G2
ggagaagataaccgtcggcaacccagttcaacaaacaaatctcaagtacataatcgtgcaatctagtcgcctaacccaccccggtcacacctttgttcgggccgcaaaatggaatctgatgataaacatgtaaaagcgcagctcgatggcattcgctgcatcgcgctgagcctgcttcgaaatagacctgtctcctgatacaccccacctgaggcgtgcagctatctaagcagccctagttcgtcttcgccttgggggccttcttcttgccgccctgccgcttcgggatggagttcttcatgcccagaaagaagagcagagctccgatcagcgccaaatcctgggtgaacttcgcaaagaggcctgcaaattctgccttctccatatcgtagttgtagaagtcatggatgataggagtgatcaaagcaaggtacagcagcaggagataagcaccgagagagctgctcaaaataaaaaggaggcttccaagacccttaagaccaattgtagcagcaatcacatgcttcaactcaatgtgtggcacagctactcccagatgagcagatacatttttgacaaacacgttgaatttgggc

SEQ ID NO: 8509 - DNA, 557 bp, Zea mays
  Clone ID: LIB3279-187-Q1-N6-G3
ttacttctttcgcaaatgatacttttttattacacatacagcacttccatacagtaactacaaggactgccttcatcttgtgtcaataatgtgaatcacgacaaatccaaaatcacaacatgaaacaaattgatagattccacgcgtaaggtacccccctcacttagcattcttagacaggtaattcttttctccatctcctcagtttccttccctagaggtaaaaactaaaacacgttcagtaaggtcggtatcgccaatccgaccttgatctgctgcttccgctgctggggccatagccgtaattataatctagaccaccgcagaacctgccaaaagatctcattgaaccataagctccgtaaagatccatgggatcaatataaccaccaccagctgaatcattctcaagtggtgcagctgtgtctattgcaacctcatggcccagaatttcatggcttctacgagatacccgttctgccacaccctcatcagcgaaggtgacaaacccaaaacctcggtggccacttcttttggggtcctttggaatatacgca

SEQ ID NO: 8510 - DNA, 607 bp, Zea mays
  unsure (1)..(607): unsure at all n locations; Clone ID: LIB3279-187-Q1-N6-G4
tttttgacggcaatggctgatatcaatcaatcaatgggtggatcgaatcctctttacactagcagttacaaatcaaacaagccctgtctacaaggctctggaacccccacgggatagagaaaaaatcgggaccaacgggcggaaaattgatcggttacatgtacattgggggagggggaaactcactcacgctgttatggagcacaggtcatcgcagaccgtcttcatgctaggcctctcatttacagggaggatgcacctaagcgagaccgccagcagctcgtccatgatcctcggggactcttccaggccggcgatgtctcggtcgaagcagtcggtgccccgcccttccctgctgcacatctggacccagtcggtcaggtcgaccgcgccggactggcctgagatgatgtccccggcgctcctccgcgtcagcatctccatgacgatcaccccgaacgcgtacacgtccgccttgaacgtgggtgcaggcttggccgcgttcgccagctctggggctcggtaccctagcgctcctagattcagtatctgctcngcggtgccgcttggagtcatgaacctgtgcaggccgtagtccaccagcttt

SEQ ID NO: 8511 - DNA, 450 bp, Zea mays
  Clone ID: LIB3279-187-Q1-N6-G5
ggtgggtgggggcactttgtcttcaacagcaacaatgggcccaatcgacagaagtacatgccccctccctggggaaatttaaaacatgttaccgtccaagagacgaaaaaacaggcatgcataccactgatatcaccttttacgggactggatttgctcgctccggagccctatcaaaaatgaggcctaaacgtagggcaacctaaacctttggttttcatgggtgcctacaggaatatactggacaaacacaaaaggacccctaaatgagtttgaacccaaaaatagccttaatacaatgcccgacatcacacaggacaattcctgttcgtataaaaacccaaaccaaaggctgaattagtaatcaatcaaaacccatacacatttcctggggaaggccatgcccaccttaacccatggaaagaaattgcccggcacacttcatttgaa

SEQ ID NO: 8512 - DNA, 562 bp, Zea mays
  Clone ID: LIB3279-187-Q1-N6-G6
aacaacagagactagtagttaatatacgaatataaagataaccatcatccacataggaagcatgtttttttcatgtccgaatataaaagctctaacaagcaaacaacactcagcaacctactcgcaggcaggagttccaaaacaacgggatcgcaaagagaagcaactcagtacttgtagtccttgacgtgaaggctctcggtgtcggcggcagcatcacccttgtaggtgccgagggtagcctcggagttggccttgcacctggcgaggaaggccgctctagccttctccacgttctccaccttgccagcccaggccttgagggtgctcgcctggagggcacggccgaaggagaaggacagggcccatggcttcttggtgctgagcttgttcatggcattgagattcagggtggcctcctcctcgctctgtccaccggagaggaagacaacagcaggcacagcagcagggacggtcctctggagggtacggacggtgtactgggcgatcacctcaggtgtcaccttcttagagtcggagccaggagtcaccatgttgggct

SEQ ID NO: 8513 - DNA, 534 bp, Zea mays
  Clone ID: LIB3279-187-Q1-N6-G7
ctgggggggggggggggggtttttttttttttttttttttttttttttttttttttttttttttttttttttttttttttttttttttttttttggggggaaaacccccaggggggtagaaaatatataactaacaggaaaaagcacattagggggggggggggggggcctacaccaccgggggtttttggcgcattaaaaaaattataaaaattttaagttttaaattaaaaaccctactggaaccggccaaaaggacattttttgggcggggatgttgagagttaaagctgaggagggcataggggccatcgaaagaaaaaccaaccgccttggaaaaaaagaaaaaacacggtggtttgggggaggaaaaaatttcgaccgggcccgagccccaaaatttgaggttgagggggggattcataccaccgagattaaggtttttaaccgggccaccaagagtgaacatggggagaagggggaacaccaaaaaggcgaaaccggttgggaggggcttgagagggagaacgggga

SEQ ID NO: 8514 - DNA, 590 bp, Zea mays
  Clone ID: LIB3279-187-Q1-N6-G8
ctgtgtggtgtgttgggggggaacaactgacacagagcgaccttcaatcaaaacacagatgggcaacaacaaacacgagacgaacgaagataaacactctggactagggtaaacaacacggtagcgaacaggataacttggccgcgcgggccccaccgcggagggggctccagttcccgtcggagttgccgtagccgccgccacggttgccaccgccgtagccgccgccaccaccaccgtagccgccgccgccaccaccgtagccgccgccaccgccgtagccgccgccgccatcacggcgcccgccaccgccgtagccgccgcctccacgggcaccaccgtacccgccgccgccgccgcctccacggccgccgcgggactgggcctcgttgacggtgatgttgcggccgtccagctccttgccgttcatgccctcgatggcgttccgcatcgcctcctccgtggagaaagtgacgaagccgaagccgcgggacctctgcgtctcccgatcgaggatgatcttggactcgaggacctcgccgtaagtgctgaaggcgttgtggagggagtggtcgtccctgggccaggcg

SEQ ID NO: 8515 - DNA, 551 bp, Zea mays
  Clone ID: LIB3279-187-Q1-N6-G9
gaaggtaaaaatctgtataaaatatggtccaattccattcaatgacataactaggtagtatccccctctccttatggctacatcccagccaacaaaagcatgccacccacccaccccccaaaaaaaaatcccccagcaacaattaattcgattattgcaacacaataattggaaagctaaggtaaaaaaattgtaacagacttgtctctaccaaaaccaactaccatggtgcgaaagcagctggaatgttattacagagtcaagcagtaatagcatagaacggtcaaccctgtatccgtccgatgggaatcctatatgccgatcttcttctcaaacttctggatctgattcaagaatatccaggtcatcatgacatggggtgcaatcctgacgcagtacaccgggaaaccagtgtagaacttgaatgggccaccgctcttgaaggtcttcacagcacagtccaaagaccctgtgtatgggtacttgccattcgcatcaggttgcatcttctgaatctgtgtcttcacatagtcaaagggcaaactgcatgc

SEQ ID NO: 8516 - DNA, 352 bp, Zea mays
  Clone ID: LIB3279-187-Q1-N6-H1
aaattatatatttttttaattaaaaaatatttatattaaaaaattttttattttttttttttaattaacttatatatttaggggtttattttttaaggagggaaaaaaaaaaaaacaaacaagaaaaaaaaaaaaaaaaaaaaaaaaaaaaaaaaaaaattgaaaaaaaaaaaaaacccaaaaaaaaatagaggaaaaagaaaacaaaggtttttgtctgaaaaaaaaaaaaaaaaaaaaagaaaagggagaagaaaaggaaaggaagaaaaaaaaaaggaagcccgcgaaagagaagagaggaaaagagagctggtggggggcgaagaaaaaaaaaaatattacgtaggag

SEQ ID NO: 8517 - DNA, 621 bp, Zea mays
  Clone ID: LIB3279-187-Q1-N6-H2
ttcgagtcgaaagcaacatgatccttaaccaggataatttacaagaccatatcctaacaaccaggcgtccaacgcaagcggggctgataacaagtctacaaaagccggtgcaattggtggacaagtttagcggaagcaatgcagcaatgcccgcccccataaacatccgaggaaatggtgggaaagcgaccaccatgcagtgcagagcaacagaaattctacagctcgctcgacaacttactgtcttcacagtacacatggcaaatgacatcatctgtcatattatccggagactaaatttggtttcatagaaaggatctagcagaaagtggtttgcatgattaaccacaaagacacgtctctcaacccatcaaaataatcccctgcagttttgtgatccacacacgcagttcttcgttctacgagaacctgaaccactagattcagctccagcaacaccatagtcataagtcagttctgccatgggtggaatatgcttcagtgcaaagaacattatatgcgggtgtccatcatctccatgatcatattgaactggttgccaaaagacttgggtgagcaactgtggttcatgaaacggagacatttccatgttttttgcac

SEQ ID NO: 8518 - DNA, 508 bp, Zea mays
  Clone ID: LIB3279-187-Q1-N6-H3
gagggccatactgccatctgctgcgacgtgaaagcaagcacatcacatggtatggggaactgaactctacatatgagggattacaagtttgcatataccatataccaccatctgcaattgttctaccgcactgggtataacaatacaacaacgtacgcgcagtcagacgcagattagaagcaaagaagtagatgcagggaggtgctgcatgcatctcatacaaatggtcatctccgtttgctggtgctgccaaaaaacagagtaaccctagcggcgccattcttccagggttggcgtgtccactccgatgttcttcatatccctgatattggacaaatggatttctggtcttgcagcagctgttgcatcaattagaaccgtaactttctcatagtccagtgctatagcatcgaacacagtctgccgaatgcaatttggtgtctgaactccaaaataaccaagttctttattcctgcagttttcaggacagaatcaagatgtgttgcga

SEQ ID NO: 8519 - DNA, 586 bp, Zea mays
  unsure (1)..(586): unsure at all n locations; Clone ID: LIB3279-187-Q1-N6-H4
gtagccttagaattatatcaccttgcataacttgtgaggaaaaaaccatcttaaggcctagtttggaaactctattttctaatgggatttctattttctcatgngaaaaatgaactattttttcttagaaaaatgaaaatcctttcgaaaaagtaggttcccaaactagccctaaaagggagaaccacccttccccatcggactagaattttggggcgatcggatctctccccgagttttgttgtacttaatgaactgttaggctccagataaccctaatttgttggctctcggttaacctcactaggctgggtgtatcattttcctatatacatgtccgtgtattagcatcaaggaggcacacatttttccaaacatcctagcaccactcaaagccgctgtcagatttaatcctgatgtccgtttcttctgcagcaaccaaaagcgtgaagcttccatcttcagccctatcgaaaaagcagtgatgatgcatggtgcgggatttcagatactgcaatttattgcaatgccatcagcaccttatgattgtctgcaggcaatgaatgcgcaggccacatggtacttc

SEQ ID NO: 8520 - DNA, 520 bp, Zea mays
  Clone ID: LIB3279-187-Q1-N6-H7
gggtgggggggtgttttttttttttattgaaggctaccacctatgaatttttcatgaataaatagcatccacaaaagtccaaataagtaggagcctctcactaaatatccatgggtatacaaccagtattttcagcggaaaatgggcatggggggggagtggtcaacactattgaaggctaacacatacaattttttcatgatgtagtatactccaccaaaaataaaaaactaatttctagaagtaaagatgtatgtgataagtaataaagtctctcaccaaagattcatgggtatacgtcctgtatttttttgctaaaaatggccatatacaatcattttcgacaataatgaaggcttaacacctatgaatttttcatgaagaaatatctccacaaaaaatcccaagaaactaatttttggcatggaaatacgtatggggtaatgttggtcacctatcaaggctcttgtaaagatccacagtaggacaacacaattaagttgatagcaccttattccct

SEQ ID NO: 8521 - DNA, 537 bp, Zea mays
  Clone ID: LIB3279-187-Q1-N6-H8
cagggcaaaggtttaatttaaatgctcaaaacttaacattgttcacgtccactgccacttcaccgtaccaaattcctaggcaactttagcatcaaaactatgttttttgaagtacatagggggacgcggggtaacattcagaatcaacgaaatagagtggagatatccagagggcatcatatttatgcattttcggtcatagggtactcaaagaccacatttttcccacacagcctgcggtagaccgcagtgcaggtctccagcttgtattcagtgttgttcctctcctttgggtccaagaaaatcttgataatcttggaaccatccagacggtatctgacacgcttccccacaatctcagctgggtagacaacatcctccaagatgccatcgtgaacagcagtcagagtcctggtgcgagggcgcaaaacagctgaacccttcttgggtggcctcacaatcctccgtgtagcaacaattaccacatccttgccgctgaatttcttctccagctccctgacgagtctgacatggatc

SEQ ID NO: 8522 - DNA, 584 bp, Zea mays
  Clone ID: LIB3279-187-Q1-N6-H9
gcaaaagcaatgtcatccacgaattaacgttttggaggtacaagtacaccattttgtttgattgcacatcatgcttattacaagtttgatagatgcatactctagttcgcactttaacaatgggcacggttgaaagcaaaataaaatcgagccaggaggaaaacgacatcgtgccaatgtcagcatcacagatgtctcgagctcatgcttgctccgctttcggaggacctctccacttgaagttctcagcgtaggccttaggcctcagaagaggtgcatggcgtttccgaaccacataattccatccatgtttttcggcaaacgcctttgctgactctgcactgtcaaacgtaagtcctgcttcaccgacattagcatatggatccccagtagatgtccatcccatcaacgggttctcccacttttgggttgacaaaaaattaattttccacctcccgactttgcctgaaccttgctgggatgcagtcctagctggtgaataaattagaaccttacggcggagatgctcctcagggatgccggagaccatcccgatctccccgggcttgatctcaacgagggca

SEQ ID NO: 8523 - DNA, 562 bp, Zea mays
  Clone ID: LIB3279-188-Q1-N6-A1
gtttttttttttttttttttttttttttttttttttttttttttttttttttttttttttttttttttttgggttttttttttttttttttttttttaaaaaaaaacaaaaaggttaaaaaaagcagggctgggcggccaaaaaacccaaaaggattttcgaggcaaaaccaaaaggggaactgggggaaaccacaattcgaacaaaatttgaaaaaaaaacaaattggccaaacccccggaaaaataaaattgggaaaaaagttggcgggcaaaaaagctcccacagcacaggaaatgaaaccagttcaaaaaaaaaaaaatttaaagggaaaaaagttaaattttcaaacccgggctgtctttgaaaaaaaaagaaaactgcggggcaaaggaaggtttgcccaacccctaaccaaatcccaaaagagttgaaaaaaaccagggccaaggccaagctagggaaacgggttttggaaaaaaaaaaaaaaaaaaaaaacatggaatacaaaaatttggcaataccccgggggaggcccaataaaaaggagaggtttattggg

SEQ ID NO: 8524 - DNA, 579 bp, Zea mays
  Clone ID: LIB3279-188-Q1-N6-A2
agtaaaatagcatatataaacgattatgcataaaaccggggcttttgcctttaatttaacacttaaatagtgtttgttgggtggcactcgcttggcgagcatccactagttatgtccatccttccttgggtcgtccaccgactgcatcttgtgggtggcaccacatcacttgcacggtcgtcacctctcggtcctgcatcggctcaccataaacaaacccaaacggcgtttgcaagaacgacggtgattccgatttgtgcatagcttcgccatcgacgagcgttgagcggcttgccttctcctcgcaaaacacggggtttctctcctccaccaaacacaacaaaacagcacacacacacaattaatcataggaaattaataccgatgcggaatcgaacaaggatttacgtggcctcaccgggggtgaacaacgacgacgacggggctgcgcaaaaacagcaaaccaccgacgggcatcacggcgtgctgctcactgcgcaacacaaaacagcgagccgcgcggagacatcggagctgctgcgcaaaacatcgaacatgtagcgcgcgacttcttgttgc

SEQ ID NO: 8525 - DNA, 522 bp, Zea mays
  Clone ID: LIB3279-188-Q1-N6-A3
gtaaggaagaaaaacagtaaataatcgggtgcaaccactgcgtagtctacatggtgatgaagctgagctgaaagagagagggacacgtggggataccaaaccctaccatcaacctcacactgtcacatgtgatggaagatgttgtctgagatcctcatgactttgactgatgtcgtctgagggaatcctcattattgatgttgtcttgtctggggggagccgagagacgcagcacgcgacgcgacccaactaaaagctaagcatagaggtcgatgccccagagcttggcaggctggttagtccggtacttccggtcgacggccttcatcctctccatgtcctcgccggagatgtcgaaaccgaagacgtcaaagttctcctgcagcctctccaccttagaggtcttggggatcaccaccgtgtcccgctacagaccccagcggaggacgagctgcgccggcgtcttgccgtacttctcagtcaagctcttgatgacagggtcgtccaggccggacgcgtggg

SEQ ID NO: 8526 - DNA, 556 bp, Zea mays
  Clone ID: LIB3279-188-Q1-N6-A4
ggatccacgagagatatactccacttggcaccacatccactagaagcaaacacgagaagaatgccatataggcagaagttatcttatcactaaaatccgattttatataaataaaagtatgctttgtgatacaaaacttccacaacctcgacagtgggcactgccacactggtaaacaaaatccgcgcttggtggaaggagttgctggtgcttcacgactttgacagggtcgatcaaagaccagttactcccctttccagagctcagcaaactcatcaggctccagcgtgttctccatctcgtgcatcttccgcctcaccttggccttcaccttcttggcatatttgcctgccttctgcctcttctctagtgcacggatctgattgggggaaatgtagtatgggttctcataccatgtaggaccaccaaaactaccaccaaatatcttgattggattcaaacagaacctggggccaacctcaataagtgtcattttatccagaccacctttatcaactttatcaatctcattgtggggaaccgaaatctggtagtt

SEQ ID NO: 8527 - DNA, 443 bp, Zea mays
  Clone ID: LIB3279-188-Q1-N6-A5
taggaaaaaatggtatatagatcttaatagaatgaaaagtttacatatgcttattacctcactaaacgaaaaaaaatgactaatgtctacactatactctacagttaacactagtgattcacttaaaacatatagtattagagaatgtaaattgtatattactcagacaccacaatcgtgtacatataggaagatggggaacctcgtatggtaagcccatcgtccgtgatatgtttacattctaacactccccctcagttggaacttggagcactgcgaacattcagactgttcctaaactcgatgaagaccgaagtcggaaggcccttggtgaatatgtcggcgtactgagatgttgtgggcacatgcagaacacggacctctccaagggcgacacggtcacgcacgaagtgtagatcaatctccacatgcttggtccgctg

SEQ ID NO: 8528 - DNA, 568 bp, Zea mays
  Clone ID: LIB3279-188-Q1-N6-A7
gtggggggggggtttgcgaaataaaacacacaataatgcaacactggccgtcccgcactgtgcgtgacagcatataaacgatgatggtcgatgaatgaccacgcgatcgagtacatacgtacgttctttctagtgtgcttgatgagcactagtggcagctagctcctagttccgattcttgatggtggggcgagcgttgagcgtgatcttagcatttgtgcgcggcacgataacgacgtcgacggttttatcgccgtcagcgtcgatatcgaacagcacttcggtgatgcacagggagagcttcactttccgcgtcttcccggcgccggagcccggcacgacggcgaagcttccggcgtactccttgtactgtgggcctacctgcaacgctttgtccgcgggcaggttgatggcgacgtcgaacttattgttcgcctgggggtcgtactcgatgcccttgatcaccagcaggtgcttcttccccgggtccttggacggcacaggcacgggcgggacctccaccacctggcccttggtcagggcgagcgggaacaccggggccggcggc

SEQ ID NO: 8529 - DNA, 151 bp, Zea mays
  Clone ID: LIB3279-188-Q1-N6-A8
atggtatatcccgcaccaccattttggctgaacgtcatatagctttttggctcgcaggaagaaaacttcgcgctctatatgacaacaaaaaatggtccactcaagggtgtacaccatgtcccatttcttggttttgggggctatgcttccg

SEQ ID NO: 8530 - DNA, 623 bp, Zea mays
  unsure (1)..(623): unsure at all n locations; Clone ID: LIB3279-188-Q1-N6-A9
gttggtgggggggttttttttttttttttttttttttttttttggcagagcttacaccattctactaagggttagtttaatcacctgtatcatcacaacagtgagatccatccatgccacaaacgagcataggagctgctaataaacgggtggggaactactactactactattatttatgcctactactcactcactcacacttactatcatatacttatcataggcctaagagctaaaaaaacaacctagacttgtttctccttctgttgctggcttcactggcccttccctcctcccactctttgaagaagattacacctctccaaaggtatttcttttttctttgtcaaagcttctctacgcctggttgatggggccaatcatagccattagtcctcccagattagaggaatggagggggccccctccccattttttgttctgtgcacctcacatcacagcccaatggcttcatgcccaggagaaaacctgggcacctgaaagaacaggaggagctgtaggggggcagctccagggtggtggaagacgccggtgcnaaaaggccacatggcgagggctgctgctgctggtgctaccgttccgagcggtgcagcagtgac

SEQ ID NO: 8531 - DNA, 602 bp, Zea mays
  Clone ID: LIB3279-188-Q1-N6-B1
aaagttttaagtccgaaacacgaaatttaaagtctgcgacacgaagtttgaagtctcaacaaatgcgtctcgagacgacgcagaaacactttcagtcaactctctgcagtgcgacatttccacaaacacgtagcgtgcgctgccatggaccgtgaggcagcgacaacggaagaggtcactacctcaccgctagacatgcgaccacaggaccgtagaaccaaaccgcggagaagaagattcctcgagagagcacgctactggtcctcggcggcggcggcaggcgcagggtgggcggtgaagatgcggcggaggtgggacgcgagagcgccggacgagtcggcgcccgcctccgtgcggagcgcgtcctggaggtcccgcatgcggtgggagaggccgtcgcgctggcggcggaggtcggcgttgtcggcggcgaggtcgtggaggaggtgcttctggcccaaggtccgcaggctcaccaagaggacgcccgtcatgaggaacagctgcacgaacgcatgcttgttcttggccgcgttctgcagcagccccggcgggttccggcccccgaagccgttgcgggtgacgtccgccatctttgcctg

SEQ ID NO: 8532 - DNA, 609 bp, Zea mays
  unsure (1)..(609): unsure at all n locations; Clone ID: LIB3279-188-Q1-N6-B2
cttctttctccttccttttctcttcctccttggtaagttcttcttgcatctcaagaaattcaagttttctcctcctctcagaaactgaatcttcagatggcagtactgttccaactgtatccacaacttcatccggtagtgaagatagtgttgctacaacagcttcctcaggtttcactttcccagatacagtaaaagctcttgaaagtatgagaagtgaagatggcactgcatgatttaatgagagatccaaccagtctcggagctgctgtctcatctcttcagttgacagtagacctaggtgaccacgttcccgacaggcttgccgaagctcctcttcagaaagagattcaacaccctcagcttgaatcatcttatcatcattcttaatgtcttgcagttttttgcgaagcatgaacctcaagtagtgatctgtaccaaaaggccggatacccatatatttgcacatatttaccaagcgtgatctgctcatgttatccaaagtaagttcatcattgaaaagcttcgcaaagctcaagatttcgtcattggagacccgttcacctctcctaaccttgttcaanaactcgtncagcggacgcgtgggtc

SEQ ID NO: 8533 - DNA, 608 bp, Zea mays
  unsure (1)..(608): unsure at all n locations; Clone ID: LIB3279-188-Q1-N6-B4
ttaactagacgacttggtaaaaatccatttaacattgcccaaatgtctaacatatgtcatatatagcattcttgtattgcaataggtgaaataacaagatgctacataaacagataaacgggcacccaatagtagagctcaacagttcacaaggtaacagcaagtcagcaaccacagcatacaaaacttatgccaaaatggaacatctcagctacgtattggaaaagcagacgctgcatcaacgacaggtcgcatcatttcttcttggcagcagccttggtcaccttggcaccggtcgggtccttcttctccacactcttgatgactccaacagcaaccgtctgtctcatgtcacggacagcaaacctacccaggggaggatactgcgagaatgtctccaccaccatgggcttggtgggaatcatcttcaccataccagcatcaccgttcttcaagaacttgggctctttctcaagctccttgccagaacgcctgtcgatcttggtaatcagctcagcaaacttgacagcaatatngggaggtatggcagtccagcactggggcatagccgttaccgatctggccagggtggttcatgatgatgacct

SEQ ID NO: 8534 - DNA, 484 bp, Zea mays
  Clone ID: LIB3279-188-Q1-N6-B5
gggaagttgcttattctgagtcaaatttgtccacagaatattacgctgacaatagccaaaatggggtacgagttaagagcaccaactggaagcatatgtcaatgcgggaaaacaaaaattggaccagacatgggtttcaaactggtaacacacattctaaggggtagcggcaagagaaaattttcttccagcatctgagtgtacaaatgtccatagttaaccatgatatataaagtagaaaactcctgcttggtcactcggcctggggcttatcctcggctttttttggcttgatgccagggaacgacatgccaagctcctccttggggatgacgacgggccactttttcccgccgtcgcggaacattttcttcgtatcgatgagccggccccgtgcgacgatctggtcccggatgccctgcgccgtagctccctcaacaaagacgatggcctcttcagctccggtgaagtaggtcacgaggac

SEQ ID NO: 8535 - DNA, 506 bp, Zea mays
  Clone ID: LIB3279-188-Q1-N6-B6
agatcatgtaatttaagagctcgatgattgtatagctacaagcatcccatagaaaagggatagacattccacctccgaagttatgttgctgtgcaaaagcattagtcaaatacaacagggtccactgatatcttttacatcagttttcacgctgctagtgctaaagaacaatgattcactgtgacctcgcaactggctccagtgcctcgatcattacaacactgtttcccctgataaccaccattccaatatctgttttgtcatttccattgacctccacaatgttgtccaccaccagattcatgaactggtcgaatccacgaagtgtgccgataacaacacggtttgcattcatcttaatctgaagcttcttgtccatgtacttcttgagatccggaggctgccccgagcggctcatggtgacggctacctagcctcgaacgcgagagaggaaaggatttgcgagctccgaacgccttatacacgagacgaaaccctaacacaac

SEQ ID NO: 8536 - DNA, 526 bp, Zea mays
  Clone ID: LIB3279-188-Q1-N6-B7
gggaaaatagctaatgcttgctttaacaacctagctcgccagatatatacacaaaacacaccagctagctgttgcagtgcagtactgccctgcccccacagtcatgactcatgagccgtagatgagatcacagcatgagcgtccactgctgggtgggactcccagtggcgggcgacacgatgacttggctagcagtagcattagcccccgcagatggcctggcgtccaagaccatcccggtgccggtgttgaagatggtgccgtcgttgcggaacacccagcgctcgcaagacgatccagccccgtcgcagagtttcaccgtcacacccccgctggcatcagcagccaggcactgccattgaaggaggagccacgcgggcgggcgtacggagccgtcggggtagagcgaccactgcaagccgtcgcggcaggcagcgacggataccgcccccgcgtagtccgcctgcaggcagaggtcgcggaaccccacgatggcggggtccaagggcgcggggacctttgttcg

SEQ ID NO: 8537 - DNA, 614 bp, Zea mays
  Clone ID: LIB3279-188-Q1-N6-B8
aaaaaaaaaacacggaacatttttgctgagttttgcaattcggcgttggtggccctgcagctaaaaagcttcttgttatgataatggccctccagaattctgggaaaaggttacagcattacataagaacgcggcgactcgactgtgctatgtttgcagctcggcctgtctctctacctgaaccaccatctttggatcgcagaaatgggcgtctggaggaacggagcgtagcggtggatgtacgggttcacaatccggccgattttcgcccaggtactctggtgatagctggatgtcacgggagcatggtacatcagcttcaacacctgccagtacatagaatgtctgaactatgctacggcgccacgagaacagtgatatgatcagaagaaaacccaaggcaatctccgcattcgaactaaggagccttagtgtagtgttatttgtctctacccaaagacaaggttcttccaggtatctcctatagaaagaggatcgggcaaaattacgccttaagaatctggcaacatggtcaagcgcccagcaaaacacaggtagtgcagcaatcttcaagtgcaattgggatgtgaagagcatagaaagaaacattaaat

SEQ ID NO: 8538 - DNA, 623 bp, Zea mays
  Clone ID: LIB3279-188-Q1-N6-B9
ctcgaacaaccagaacgctgacatttttggccttttaaaagaattccactatcatatccagaaatataccaatgggagctaacgcataagaaacgaagaattaagacagcgtaaaaacaaccgcttgctgtacaggtcacctgccaccagcaaagacagacatgtacatcagcaatctttttttttcttcttcttatgttttccttctcttgtttcagtaggaccaagaaaaaagtttcactttcttctccccattaataatttccttattcacctcttggatgtctttgtcctctctttcagagcctctgttgtcgctttcttccatatgtacattcctacatgaagatatggacgagggacgacgttccacaagcacaaaatctgaataaggttaacaaacccctagccaaattgacaaattaccaacgcctgctgcttccatagccaaagccaatattactctctcttcaaacaagcacctgacattatgtgcattttggggactacaaatatgttcacaatcaatgtccaccgctgctactttgctctaagttacaaccatccttgagtgcttcttgtgcttcattctccatgccttgtgataatagtgctgctgcctg

SEQ ID NO: 8539 - DNA, 580 bp, Zea mays
  unsure (1)..(580): unsure at all n locations; Clone ID: LIB3279-188-Q1-N6-C1
gcaattagcaaggaaaatgcatggatgtactagataaaccgttccagatggcagcagggacaagaacattgcggatctacactaaacatgatctagtctaactgcacggccgctaatggtaatattgttctaagacaggagatcactctacgccttcttgggggacttggcggccttcttgggctccttggccgccttctcggccaccttcttggggaggagcacagtgtggatgttggggaggacgccgccgtgggcgatggtgacgccggccagcagcttgccgagctcctcgtcgttgcggatggcgaggagcacgtggcgcgggatgatgcgcgtcttcttgttgtcccttgccgcgttgccggcgagctcgagcacctcggccgcgaggtactccaggacggcggcgaggtagacgggggcacccgtgcctacacgctgcgcgtaccggccctttttgaggtaccgcccgacgcggctgacggggaactgcagcctggccctggaggaccgggacaccgacttcttcttcggcccgccggccttgcgcccggccgagcccttttttgncttcccg

SEQ ID NO: 8540 - DNA, 507 bp, Zea mays
  Clone ID: LIB3279-188-Q1-N6-C2
gatagaactttcttagatcttataatatttggcaggaagacttcaaccacaatgaaacattcgctactggtacaaaactcagaagtacaagatcacagacaaaacagcttcctccgaactccaaaactaagagcttagaagaccatctcatggggcttgtcaccatccctgaaagagaaccgggcgccaagataggttttcagctccgggacagcctcgatagccttgatcagagcaaaatccacagccttctggtcatccttcttgaagtcaggcagtgacttggatgcctccttttctgtctcaaaaagctcgccctcggtcttcttcaccttttgcttcttctccctggcaaagtacttgtcatcaaacttggcgacatcaacaccagagatgtcaactttggttgatgtagcaatgacataggtctggttcacacggcggatcggtactccattgatcttgaaaggcccagagataaggagcaggccggacttgagctgcttg

SEQ ID NO: 8541 - DNA, 445 bp, Zea mays
  Clone ID: LIB3279-188-Q1-N6-C3
aaaacgggcccaaggataaaaaacgagggagagccggccactgcactcacttgccctggcacaaaaaaaaagccccacatggggttcgggagggctcatgcaaaaactcacactcggggggaattacccaaacatgttgcgcccagggaaacgggaaggcatcgatgggtatgtattcttgaggcaagggggccatgcaaaaaaaaaaaacaactgtttaaagccaaagccaaggattgaaggttttttttgacctgcccaacgggccatggttaaagcccctgcaggggccggggccggaacgggggtttttgttggagggagggacaccgagcgcaaaagttccagggagctcgcccccccaaggaaatgccacaggatggggttccctgaaccctgaactaggaaaacatttaaagccaaaacagggctttggccaacaccc

SEQ ID NO: 8542 - DNA, 586 bp, Zea mays
  Clone ID: LIB3279-188-Q1-N6-C4
gtacaacatattccaacataacaggttcgtttaaatatttatgatcaagagacaaaagtctgctccaacagcataggataacaaaatgtattaatcccaggaagtttagcttcaagctgtggagacaaaagtttcacggtatcttattaatgagatagcatcaccgaaagaaaatccacgaataaccccagaagcagcttaggcagacacaccaccacggcggcactcgttcagcatgtctaggtagaactggcacttgctgatctcgctgccatagttgttgagacaattcttagaaagccttagaatggatgctgcaagcgtcagcattcatcactggaggggcaggggcagcagcagcagcttctgaggcaacagtctcatgctgaatggtccggggacctaatacagcatcaacagccctgtgtgccatggcactacccgtgccaaacgccataccttgagcaatggtggacccaattcctccaaacatggagccaccaccatctcgaacaggagctggaggaggagcctggcgtgctggctgtggcgggttcctcactggagcacacggggagctgggcgt

SEQ ID NO: 8543 - DNA, 610 bp, Zea mays
  Clone ID: LIB3279-188-Q1-N6-C5
aaattagtctagttcaacacatattgatcctttcagaatttactccatagaaagtatattttgccttctagcttaatcactcaacggttcatttaattacacgagcattgaggaagccagtttgataatttacagagtattaacacaatatgcgaaaaaaggtgaatccagacagaagttactacgtaagcaccgagggtgcatcatcttagcaccacaaactacagcaaaaccagacagtatctcatcagttgagaactcggtcttgctaggagcttcattttattaggtgtcgaaagtccccgctggcatgtacttgcttcacctgtttgtcatactcgtcctcgccgtcgtattgctcatcctccccatcctgctcgtcatcctcaggtttcttcccatcttcctgctcttcttcctctgcccaaccaaaaccagccactggagcaggcgactggggcggcgtgcgggcctcctctacgatcttcatgatctcttcgactgtttgatcagagaaggtgggggcaccgttgtccttcttgtagtacttcgcttgtgcagcttctgtaagctctctgggcaaattcttcaggaaccagggtgattccta

SEQ ID NO: 8544 - DNA, 563 bp, Zea mays
  Clone ID: LIB3279-188-Q1-N6-C6
aactagacgacttggtaaaaatccatttaacattgcccaaatgtctaacatatgtcatatatagcattcttgtattgcaataggtgaaataacaagatgctacataaacagataaacgggcacccaatagtagagctcaacagttcacaaggtaacagcaagtcagcaaccacagcatacaaaacttatgccaaaatggaacatctcagctacgtattggaaaagcagacgctgcatcaacgacaggtcgcatcatttcttcttggcagcagccttggtcaccttggcaccggtcgggtccttcttctccacactcttgatgactccaacagcaaccgtctgtctcatgtcacggacagcaaacctacccaggggaggatactgcgagaatgtctccaccaccatgggcttggtgggaatcatcttcaccataccagcatcaccgttcttcaagaacttgggctctttctcaagctccttgccagaacgcctgtcgatcttggtaatcagctcagcaaacttgacagcaatatgggaggtatggcagtccagcactggggcat

SEQ ID NO: 8545 - DNA, 460 bp, Zea mays
  Clone ID: LIB3279-188-Q1-N6-C7
aagccagggaaaacactaattccagggaaaaaatctccagcctattttttataaaccaaagggcattaaaggaggccggaagtttaaggggttttaaaataaaaaaaataattgggttttaaggccccgttcgaaaacagggaagcccactcctaacttgaaaagaaaagaaaatttttaattgtaagttttccaaatgggagcccaaaaaaaacaacattgacggattggcaaacttaaattaaccggtttgaacagttttaacttaatgggttttccagggctttgaaaggttatccaaaaaagggtcgtttgaatttggcccactaagaaaagcctgttacctaaaaaaaacggttcaaatttaaagggctgggctcaatttgtccttgaaaaggtgaaggcaaatccaaccaaccttgccaatgttggaataaaaaatttttttaaaaaacctaac

SEQ ID NO: 8546 - DNA, 531 bp, Zea mays
  Clone ID: LIB3279-188-Q1-N6-C8
gaagaaaaaaaaccagattattacggctaaacatttaaatgatgaagacttgaggtatcacaagatgcacaaaaaatcccaaaccagcacaaactttaaccagttcatagcaaggtataccagatcaacatcgacactagtaaaagggcaaactcttccatagacaaattcaagggctaaacagttctgtctccaggcaagcacactcacttgaagcatttcgcgtcaagcaaggcctcgccctcaaagggctcctggtcctcaatcatcgcattgacacgctccttctgggcctcatcagagatgtccaccttggtccactcgtagagctccatgtcatagacctcatccattacaaacttgggaacatcctggccacggaagagccaaaggcccttcagcttgaagggtggctcagagcctatcacgagcatcttcccaaaggcgtacttgcggcacaggtccatccgctgcaggaatccaccaaccttgttcagggtcacaaaggagacggtgttctcatcattgtac

SEQ ID NO: 8547 - DNA, 77 bp, Zea mays
  unsure (1)..(77): unsure at all n locations; Clone ID: LIB3279-188-Q1-N6-C9
agagcaaccactgacatgctttctcaaatccagtggaataattaccacgtccacacggnatcttaatgccaactagc

SEQ ID NO: 8548 - DNA, 600 bp, Zea mays
  Clone ID: LIB3279-188-Q1-N6-D1
tggataacaaaaatattatatcaagaattagcacaagttctctagtgcactttatcctgtttctatgactcacaagttcagcaaagcgcatgagtctaaatgcaaagtcaatggcagttcattacaagactaagacgttattatctcaccatatatcctcacactactccatagtcttatcgaaacagcacatgcgcatagcaacatgatggacctcagtacctcacactactccataatctaatcgagcaagtccgatactgatttcttcttgacgaacggatcagtagcggcaatcagagttgccacggcactgttggggaaaatgttgtcagccttcatcctctctttgaatccatacgcaggggccttagcatgtagataagaatggagcagaaactggtacatcctgatcctcccagtgtagcctatctgtctcaacttgttgaacactttctccgagttgtggacgtctcctttcttcgagtagctatcaagcagtgtcatgtatgagctgtaactgggcttgacgttgttcttcagagatagcttgtgcaatagggactcagctttctccacctctccagcgtcagcatatag

SEQ ID NO: 8549 - DNA, 459 bp, Zea mays
  Clone ID: LIB3279-188-Q1-N6-D2
ataaagcagacagtattattgggactgcagatgccgcattcatatccaggttacaggcttacagaatacagccgggggccgggggggggggggtggggggggggcatacaaggtcttatcggagaactaaaatgagactgaatagtatgtctcagttctgttcacaccttaaatgtcacattgttctggaaacgagtggaagctcaacgggtaaaacgctctgtaatcgacttgggtatgaagctggttgtgctcgattgtttctccagcctttcaatctcttccacagatttcattatctgttctgaacttgtttcgatcacctgtccccccgatatcatctcatccaaaatcgtgtgcagcttgttgaagttaaatacgatgtcaagctcgcatacattcttgaagcacatgtccaatgtttcaacaaacacttgtacgaggtcgagcatggcaagc

SEQ ID NO: 8550 - DNA, 590 bp, Zea mays
  Clone ID: LIB3279-188-Q1-N6-D3
caacttccaaaatatttcttccaataaacgaaaatgatgacttctataaaactttaaatcttaaaaaaatgctaccaatctaataactcccaatatttttttagaaatctaatgagcttgtttttctagacccgcaattccaatgtcatggcacacttcggcagcaccaaagatttgcacatggccttcatgtgttgaaaagcactgctcatgtacttttctagttcatcgttcactttctcctcagcccacatgaaaccttgaatgttctgtacccactcgaagtagctaacgaccacgccacctgaattagcataggtatcaggtaatactactactcccttctcggcgagaatctacaacatatgcaagaggcggaagtgataaaatacacttctcgtgttaactgctccggcccaaagccaacaattttggactcgcacgtgtaaacaatattatctcttgcaccgggtcgttgtcgtataagctaatacgacgaccatttaggagcactcgagcttgcacgccaacggaagcaaccatcatctaggctctaacttctagctagtattcatacggacgcgtgggtc

SEQ ID NO: 8551 - DNA, 450 bp, Zea mays
  Clone ID: LIB3279-188-Q1-N6-D4
atgaaaaagggtttttcaagaatcggttggtgcgaaaatcttacaattgcggtttctaaatattttcagggggtcaaataaaatacattttttcctagtcgggttggacacatgcttttcctagcccttccagggttcctcttgatttgggcaacttggcttttcaaattctaaggggcccaacattaaatcctaattccatcatctctcaaaaataaaaaccccccatctcaaatgttctagtaatggcccccttgttttttttgaaaaaaacattccattttttgacaaaacaatctctaaatatacttcctggggacagggcaattttacatcccaaaaacaaagcaatttgaataacatgggacctataatgcattgttttcccctgcaactggctgcctgaaagggtttacctggattggaattttaaggggttgaccagttttg

SEQ ID NO: 8552 - DNA, 477 bp, Zea mays
  Clone ID: LIB3279-188-Q1-N6-D5
ctgtggtgtgttttgttttttttttttttttttttttttttttttttttttttttttttttttttttttttttttttttttttttttttttttttttgggggccaattcatattattccgggacattaaaccaaacaaacagctttgcaaaggcggggggggggaatccccgccaaatatggggcattctaaaaaacaacgctgcaacaggggcagggctttttttccctggaaaaagcaaaaggcttggggcccgaaaaccagcctccacccctcatttatcaactggggaaacgaaacaaaacaggggggcaaaacatttagagggggggcttaattaaaaacaggggcaaaggcaagggcaatgggaggcagttttagggcacccccaccggggccgggacaaaaaaaacaacacgagggggcctaaaagaaagctttcagaaataaaaaacgggacagccctgggaaaccccc

SEQ ID NO: 8553 - DNA, 493 bp, Zea mays
  Clone ID: LIB3279-188-Q1-N6-D6
ggggggaaaaaaggttttttaaaaaggggggaaaaaattttttttaaaagggaaaacaggggggagggggaaaccccaaaaaaggggtttttttttgggggggaaaaaaattgaaaaaaaacctttggccgggccccgaaaatttttccatttggggggggggggggcccccaaaaaaaaagggaaaaaaaaaaaaagggcttttttatgggggggggccccttttaaaaaagggggcccgccgggggaaaatgaaaaaacccaacggggggcccccgggggaaaaaataaagggattttgcaccccccggacccggggggccccccggaaattccggaccgggccccgggggggaaccaattttccctaaaggggggggaataaaaagggggggaaaaaaagggaaaaagggttcccgggggaaaatatgtttcccctaaaaattccaaaaaaaaaaaaagcgggaaaaaaaaaaggaaaaccccggggggc

SEQ ID NO: 8554 - DNA, 421 bp, Zea mays
  Clone ID: LIB3279-188-Q1-N6-D7
gcctgggggacgagcagtccaatagtctttggacatttgctttctcgccagagttcaaaaactgaaaatacatggattagggttacaggggggggaaccagaacgggggagtttcagttttattacatgtcttgatgtactaagtattaaacattcattgacgtcgatgcttgccggggtcaaaatccagtcgatgaactgctccgaattctcaacatcaccagatgctatatgttgcaggatccattgatacaaacaggcagcacttttgatctacttgctgcacttgcacaacttgtttttttttcttttcgcgcccactgcccacgcatgttggcctaaattaacccgatcagccggaaatttttactaatacaccggccgatcagctgggacaccatttcgacggcaatgacgtcat

SEQ ID NO: 8555 - DNA, 439 bp, Zea mays
  Clone ID: LIB3279-188-Q1-N6-D8
atgggggtcggggatttaaaacaggccccataaatgcttggggcaaggacagactgggggggggagatcccaatccaacaacgggcgggtgccgatgaagcgaaaaaactacaaactaaactgcctcactccaggggcgggacgacccttgcagggaaactactcaaaaaacgggcctaatctactggatttaaaaaggccttcgaaaaaacccggttaggccgacaacgacaagattttttccctgactggaaacacttggacagagtttaatccggaatacataactcggcaccctcctcggcctcggcgttcacctcggacttggacttggcggaataccaaaccccggggggtctccaaactgcttgttgttgaaagcgtcaatctttttggtggacccagccttgagcttttttgccttaaaacgtagggagcc

SEQ ID NO: 8556 - DNA, 469 bp, Zea mays
  Clone ID: LIB3279-188-Q1-N6-D9
tggttccacacatgatgatgacatgaatatacgatgatccaggaaaacaagagagaagagaccctgcctacatcctacgcaggttcagcaacagcatatgggatatacatttctacagagcatccatgtccattgagaccgggaagcaacaaccagatactggaacacaccccacagctgaacgtcctgcactctagggctcgaggcgacagcagacaggaagctcctgcgtttctccggtagcgtggattctcaaactcgaggttcatgcctgcgcaacggggagcagcccaagctctccgatgaccccagccgcgccgcgcagctgcgcgccagcgctggaaccgcaggtgcgcacctcgtcaaacatggaggctgatagcgactccgagacgaagccggcctggaactcgatggtgccctggtcggggtgcgcgaccatccccgtgacgtagacccagaggaagag

SEQ ID NO: 8557 - DNA, 611 bp, Zea mays
  unsure (1)..(611): unsure at all n locations; Clone ID: LIB3279-188-Q1-N6-E1
aaatcaaagatgtgctcactagtaaataaactgtcagaaacatacgtcacagctcatcgctgtttcttatagacaggcccatacacagcagggtttgtaccacaggccccaatgacacattcttcttcgttacattacgtctctccagaagagaagagcatacaccagaagttccagtatatataaccgatcaccgaccatcagcatcagcataagtaggacgacgcgcacatcccctgtttattcaattatattggtgtaaacatcacacgctccatgttgcgttgcaaccttggccaccggtgcctgctttcttcctcgtcgatcttacatgttcggcttcaggttcagcctagaagccagcttctggccaagagcggcgtcacactgggaccagtaggagatccaaatggtatggtgttcatgggtcacgcgagggtctgtcagtgcgtcaacccatcgctggatgaaccggtcttgccttgcagggtcgaaggatcgatatctctcgccagcctgcttgaagttgttctccttctgaatgatgcacttctcacgacagcctgttagaacacggggnaggaatggggaccttctccgcgtgacgggcg

SEQ ID NO: 8558 - DNA, 443 bp, Zea mays
  Clone ID: LIB3279-188-Q1-N6-E2
accctaaaaccccggggaagggggggaccccaaacacccgggtttttggggaatttccccccgggggccccgggaaaaagggttccgggggggggggggggccctttttggggggcaaacggccctttttttttggccaggctccagcttaaaaaaaacaaactttatctgggttttttcccggggggggggggggtaaaaaaaaaccccccaaaaagaggggttggtttttttaaagggaacccccccccctggggcccccttttgggcaaaaaaccacactttgggaaaattgggggggggggggggaaccccccttggggggcccaaaaaaacccttaaaaaaatgggccatttttttcccctttgggggggcccctatggggggggaggaacccctaagggggcccagcaaatgggtggaacccttaagttccaggggg

SEQ ID NO: 8559 - DNA, 618 bp, Zea mays
  Clone ID: LIB3279-188-Q1-N6-E3
tttttgtctcaaacaggaaaaaaattaaattgagcaacctggttatataagactgttatgccccccacccacccaaaaaagaaaaccatttcaagatgaggccgcgtgtactttcttccgggtctaaaacggtacataaattttcaactaaaaatggcaatctcttaaaagctgtggtttggtttctgcgttgagatctgggggagaaccgaacccccatcctagatttgcaggtagcttcatggcaagacccatactactccgtatcacacagacgactgcacatcttcaccgttggcggtttgtggtcctgcttgcgacaggaacctgggtgtctcgctgtcctgtcctcaaggacaaccaggccaattcagtgaaagaatgtcagggtctctcaagttcccaggtgcaaacaccttgggttctttcacttcagtagataggtgaaattccttctctcaaattcttcaacgggaatttgctcctccttagagtatctgagctctgagaagtctcaaactcgtcaaagtaacacaactcaatgttagtcggtgatgagagaatagagataacaaatgctcctgaaaaagcagacagtagtcggtacatcatgttact

SEQ ID NO: 8560 - DNA, 577 bp, Zea mays
  Clone ID: LIB3279-188-Q1-N6-E4
gaacaaaatgagatggatgtatattaatatgatcaacgactattcattttcagtagactactttattggatgatcatatccacactccctacaccgccacacatggggatgaaattaaatcgaacgagagtggcagcagctagcgatcgagctaggctaatcgtccatgtcgggacgaacaaccagatgttagctttgtacgctagccacttttatttttatttgtggacgtacgtatactagcaagtagccgcgcgcgctgcgctacgctacttttagcaagtagctgagctgagctagttgctcgtactgatccatgtcctgcacttgggaccaggatagccgtggaagatgtctcggcattggaagcgaggagggtccgaatgatacagaaactcgcaccgttcgcagttgctcgagcacgactccaccttgtccaggcacatgcagttggggatgtagtcccttgtgcaggccacgctgtcgcagcagtcccacggcctcggtgtgcagaccgggggctcggtcaggcttaagataaagtcaccgcagacgaaaccgtcgccggccggcgacg

SEQ ID NO: 8561 - DNA, 417 bp, Zea mays
  Clone ID: LIB3279-188-Q1-N6-E5
ggggggagggggggagcaaaaaaaaaaaaaaaggaggggggggggggggaaaagggccccggaaaaaataaaaaaaccaagaaaaaaaccccaaaaggggggggttatgggcagggcccccaaagggggtttaaaaaccagggaaaaattttaaattcaaaaattttttgaacaccccaaaaattttaagggggaaaaaaaaaaaaccccaaaaaatggaaaaaaaccacccccccccccccccggggaaaaaaaaaaaaaaaaaaaaggggcccccccttgatcccctcagaaggggggggaaaaaaaaaggagggcccccccaaaaaaagaggggcggggggaaaaaaaaaaggggccttttcccgggggggtttgaaagggaaaaaaaaaaaaacccggggaaaaagggggggg

SEQ ID NO: 8562 - DNA, 560 bp, Zea mays
  Clone ID: LIB3279-188-Q1-N6-E6
ctttgttttttggtttttttttttttttttttttttttttttttttttttttttttttttttttttttttttttttttttttttttttttttttttttttttttttttttttttttttttttttggggaaaccccaacccctaaggggggggggggggggggggttttttcccccccatagttgggcccggccccttacaaaaaggggggggggggtaattccccggggaaaatcaaaaccctaacggggtcctttacatttaaaacttttaaaaggttagatttgaaaacccccaaagccccaaaatttaaccctactgggtttttcccccctttttggaagggaagggggttcggtttcctttaataatccacaatctttatttaaaaacaaaagcccgcttttacacccaatgggatccgttcattttttgtaaaaactttattaggcccaaagggttaaaaccccctttttgaagggggtggcgaaaaaaaaaagcccttttactttaaaggacccaaaatttttgaacatttattctcccccatttttttttttt

SEQ ID NO: 8563 - DNA, 604 bp, Zea mays
  unsure (1)..(604): unsure at all n locations; Clone ID: LIB3279-188-Q1-N6-E7
accaaactttgtttgctgcttttcntgaaaccatacaagtccaatcacgaacgggaactttgttatcacgcggcatgcgatgccactgcaagtatattacagatcgggtaacatgtggtccaaatgcaacttttaatcacttctaagggagagggccaacaacaacacatgcgtccatatatgggccaccaaattcatggctacattaagcacaaatacaaccaaggcaacacgagagccagatggaaagaggtacactgatggcctaatgcaagcaacctgatgttctcctttacctttgttcttctccatttattcacaggctaactttgtatcaaagctactcagacaaatggcaaaggcctggaaagccgagagagggtagcgatagtccatcgtgaacatatcccttgccactttgccaaactggagaatcaccttgtcgggatctgacggggcaggctgagagggggttggcgcacctgccggtggcggngtagccgcggcgatcagctggaagttcttcaccgaggcaattgtcacacggccacggnagttgaggcaccaacactgcagctgttcgtgcccacctagcggcttatta

SEQ ID NO: 8564 - DNA, 471 bp, Zea mays
  Clone ID: LIB3279-188-Q1-N6-E8
gggggtgggggttttttttttttttttttttttttttttttttttttttttttttttttttttttttttttttttttttttttttttttttttttttttttaacaaaaaaaaaaaaaactaacgcccctttgttttatgatgattaagggggggggggggggcctaaaaataaaacaattttttttgccaaaatgcttttaaagaaaaaaaactcccccgggggtcctaaaaaaaaggcgggggaaggaattataataaacagatttgcccatccccccccctttaaaaaggaattagatttccaccaattctttgggaaaacctaattactgcacatttggtggttcgggaccttgatttccttttttttttaccgaaccccaaccctgcccaagggaactaaaaaaaaactggccaaatgtgtgtagttttgtgacaacccaaaaaaaaccctcccggactgggaaaag

SEQ ID NO: 8565 - DNA, 577 bp, Zea mays
  Clone ID: LIB3279-188-Q1-N6-E9
caacttttgataattggtatgtatgtatacacacaaggccgatcttctaatgttgagtggcttctatctaataacaagccacacaagacagtttagaactggcaacctcctaaatagtttttcaagtcagcattagcgttggtgagcccaccaaagcctctgttacatcatttaccacaagcctgcacaacttcaatcactcatcattcactatactctgaagaatatgatgatgtaccacctccatcctcatctccgttggctgctccatctccaccgtcgtcgtcatcaccatcttcaatgtcatcatcctcatccatctcaatgtcatcatcctcatccacctcgacatcatcatccccatccatctcaacgtcatcatcctcatcaccaggatcttcagcttcatagtcctctccatcttcctcaccctcatctccttcagcatcctcatcattatcgtcgctcccatcacccatcatctgtacgggtctggagtcggaattgtctcttggatagcctgaaaatgctcaccatattcctcattcataggttcgacattttcctcagactcatc

SEQ ID NO: 8566 - DNA, 619 bp, Zea mays
  Clone ID: LIB3279-188-Q1-N6-F1
tgggcccgcggttcttcacgacgcgcgtcgccgtctcgaactcggacgccaccatccgcaccttgcccatggcgtacgcgttccgcaccgactgcagcagcttgtagccaccggacgccgccgtgtactggtgcaggatgtactgcgccgacgacgactcaatggtggttcccttgatggagaggaggggcagcggctcggccggcttggacgggatgggcgcgagcggcgcgcccatgacgccgaggagcaggcggaggtcggaccgccggaacgagccgtcgggaccacctgcggcggccatggatggcgcgcgcgtcaggtggccgcggacccagtgcccgaacccctcgcggcgccctgagtcctcgccgtcggggtcgccggcggcgaggcgctcggcgtcgggcccttcgatgagcggcgccagagcctccccgccggggcgcaacaggctgccggagcgcgcgacgagctgctcccccaggtactgctgcagcaccttctccggcggcggcggcggcggcggcggagccgcgggcgccttccgccggcgcgggatcagcatcctcgcgggcgacgcgctccgcggcgccggggacttccctctggtcctttg

SEQ ID NO: 8567 - DNA, 531 bp, Zea mays
  Clone ID: LIB3279-188-Q1-N6-F2
cacagccacaaaatcattcctggatttattgactgggagccaaataatcccatgcggggtattggttatttaaaaactatacaaaggtatgccaagttaaggcctttagaaccatttgaccactttatatttacatgaccctgtatggttaacagtgcccaaaacatactaagttttttatttacactgaacgccattcctaccccagtagatgggtataactattctcccggaggtgccactaccaatgcctgatttcctaatacgcatgaggtactttagcacggtcaactgatacaacagaaattcaattacaaccattttcaatgcggacaaaggaaaaaaaaaatccatgcggagaaatcgagcagtatccccatatttacgtgaccaaacagacgatgcctaaggagaatgatttgatacatgccctcccctattatttgaacgtttccttttttcttgccttgtagttgggctacctatacggcttgacccttcctttctaattgccttcctatgaacttcccg

SEQ ID NO: 8568 - DNA, 472 bp, Zea mays
  Clone ID: LIB3279-188-Q1-N6-F3
ggcagcaccaaaaagcaccatttttttccttaggatttaaattaaaataaagcctggcggggggaacagcaccgatcgatccggagtccatgctggttgatgcatgggtctggtggggccgggggtgaacacagcactaacaactggcacagagggacctttaatcaaaaacacagatgggcaacaacaaacacgggacgaacgaagataaacactttggactaggggaaacaacacgggagcgaacaggataacttgggcgggcgggccccaccggttaattcctccagttcccgtcggagttgccgtaaccccccccacggttgccaccgccgtaaccgccgccaccaccaccgtaggcggcggcggcaccaccgtaaccggcgccaccgccgtaaccgccgccgccattacggggcccgccaccgccgtagccgccggcttcacgggcaccaacgtacccgccggcggc

SEQ ID NO: 8569 - DNA, 592 bp, Zea mays
  Clone ID: LIB3279-188-Q1-N6-F4
cttgaaattgatcacagaaggtcagcaacattggcaggcagctcctcaatcaacacgttgtagaacttctgaatgtcaaacagcatacgttcgtcgtcgcgggtcacaaagttgatggcaacacccttcctaccaaaacgaccactacgaccaatacgatgcaggtagttctctggctgggtgggaagatcatagttgatgaccagggacacctgctgaacatcaataccacgagcaagcaggtcagtggtgatgagcacacgggaggagccagaccggaactccctcatgatgatgtctctagtgttctggtccatgtcaccatgagtggcagaaacggtgtggtccctgctcctcatcttgtcagtgagccagtccaccttgcggcgggtgttgacaaagatgacactctgggtaatggccagggtctcatacaggtcacacagtgtgtccagcttccagtcttccttgtccacattcacatagaactgcttgataccctcaaggtcagctcatctctcttcacaagaattctcactgggtttgttcatgaacttgcgggtaatctcaagggcctcaggtggcatggtag

SEQ ID NO: 8570 - DNA, 592 bp, Zea mays
  Clone ID: LIB3279-188-Q1-N6-F5
tttcttcttctttggtttgctacgcgtacacggaaggccacacggaacttgcagcacacagccgaggcgcgcgcgacgggggcggtcaccgctcgccggggggtggggggccggggtggtttttaccggatcactcgaactccgggtagcggagcagcggcgtctcgtcggcggggaggggcacgtgggcgcggcagagcgggcacgtggcgcgctcgtaccggagccaggtctcgaggcaggcgcggtggaagaggtggccgcaggggaggcggttcaccacggccctcgcccggaacccggccaggcacacgctgcagtcgtcgccgtcggcgccgccgtccgcctcgcacgtcgtcgccgtcgacgccagcacctcgtacagcgccggccggaaggccctgaggaaccgctccgccagtcccgggcccgacgccgccagtcggtccccgccgtcgtccccgggcggcagcgcggcctgcaggtccaggaacaccagcgccgcccgcaccagccccgccagcgccgcgatcgagatcaccgtgttgtacaccaggtaccccagcaggctgtccccgcgctccggcatgct

SEQ ID NO: 8571 - DNA, 615 bp, Zea mays
  unsure (1)..(615): unsure at all n locations; Clone ID: LIB3279-188-Q1-N6-F6
gcatcaagtaagtttattgcagccgcctacaagtcacaatggaagccatcagattacaatctttgacgagaacttgacttgaggcgccacacaaggaactccataaactcgacatccacggttacagaatgctaaagtttcacaggatttaactcgtaacaccaatctgctgtatgtagcatgaggtgacaacggaattatttcattacttgagaagcatggccaacgtttccatagctgacagatgcgaattactgggcactgaggacttcaatctcgaacacaagcactgagtttggttgaattccccaggctgggaacccgccggctccataagcataatcaggcgtgcactggatacgagcaacttcacccacttgcatggtcataactccctcgtcccatcctttgatcactgaaccctgaccaatgctgaaactgaatggctgctgcccagggtccttggtgctccaaaatttcttggacagatcacgatccttcccgtagccggtgcagtgaacggtgaccttctggccctttatcggcttngggccggtgccggatctcaggatctgcttctcgaagccatccttctcttcagttctcactatcttg

SEQ ID NO: 8572 - DNA, 584 bp, Zea mays
  Clone ID: LIB3279-188-Q1-N6-F7
aataaacagctaaatatcatatatctgttggttatatactaacaaaaggtgattatcgcttcttgtgcatctaatatacactggctggtttatctctcagcctctccagctacatgaagtcaagcttgcacttgcaccatgcgagtgcaaggcttttgctactataaatccccagcaaccggggggactgttaaccgaaatatagaaatgaacatcagaggtcatgatgtcaatccttgtggcctttggtggactcgtcctgctcgccaatcttttggaactcggcctggatgacctcgacgatcttcgcgtcgtctgggtccggctcggggatgctgacatgcaacgatcccatcttgatgagctccctgcgcgacgcttgctctctgatgtgaccgtacagttctttgtggaatggatggtcaagggagaagcagttgtcgacgtcggtagacgaatgcttcgatgatccagagccctcccggcggcagaaatgggggagtgatgagtagtccatgatcttcagaagttcatctctcccgcagccagtcaaaactttgaccttcttttttgtcctctcctgc

SEQ ID NO: 8573 - DNA, 390 bp, Zea mays
  Clone ID: LIB3279-188-Q1-N6-F8
ataaaccagtttattaaaaactaggggcttctaaatatgcccttagtagcttccaaccgtaccaacaagaatacacttggagccttggaggaactcagtactgttccctgaaaactcaatggaggtcacaaatgaacagtcaatgattgcgaagtgctaggaaattatgcagcatcaaaatcatttgaaggctacgatttcctccctcaaacgtgtgatgaggccatcaacgctcattgtggccaggtcggcattatctcttaccctaacgcagacatttccagtctcggcctcctgtgcgcctacgacaagaatgtagttgaattgagctacctgggcttcccgtaccttcttttgtattggcctgtcactcacatcaatatcaacatg

SEQ ID NO: 8574 - DNA, 498 bp, Zea mays
  Clone ID: LIB3279-188-Q1-N6-F9
gatctataaccggtctctttttttcccaaagctcatccgccgtctgacgaatttttcgtctagcccggtccgccccatatacctaagtggccgcctccggcaccccggcgaccgacaatgatctcccccgacgcatgccaaaacgtcttcggcattgggggtattgtgatctccttctgactatccctgtcacgagggcttaccatttcgcttgactacatggccatagacttggaagcagtcaagcctgcacccttacctgtctaccctagtgaaatgcgtgctcttggcgctttatggctttcccggcggccacccctacaagcttggtcctaagaccatcaacgggatctttgctgtttgtcaacagccttgctacctcactatccccttcctatattccaacaggccccagctctgaaccttttcgagatcctgggcttttagattctgttcatggccaaacgtggtgctgagtgtgattctctgcgcgcgcac

SEQ ID NO: 8575 - DNA, 448 bp, Zea mays
  Clone ID: LIB3279-188-Q1-N6-G1
aacagtcaaagatcttatattacagaaggaaagggcacaaaaggggacttagggtagagaacacaccaccgcatctagttctattctagacctagaacatggcagaagcatctcagacccaaacaagtcaactcagggaagcccgctgcagctcagttcatacacaagagtcagctgctcaacaagttaaaaaaaacgaaaacttaaggttcatgctcatctagagtgtaccagcaagacatgacattcgaccatggccttccacaaaatcttcttcgtcgttttttttttgccatgccgttgtgcaagacatgatatccgataatctcccatcatccatcatcatagaaacccccgtaattgcgaatctgtgtccagaaggaaacttgtgagttgagctacttaccattccctccagcaagggggtagaacttatatatctctacac

SEQ ID NO: 8576 - DNA, 411 bp, Zea mays
  Clone ID: LIB3279-188-Q1-N6-G2
acattgaacctaaatgcgtgttgtaccgccacatttaacatgcattactgtcccaatctttaaattgcccattgctcttggcgcgcccgaaacaggactcattgggtgcccaaaggtacggagcattgtattttgtctctggaactaaaactggataaaattccttggtaaaaaggtcgttgatcttcaaattttctattttgagatagggaaacccaacatgtcattcccactgtttggggtttcaattgctgcaaaaagcctccattaacaccttttttgtgtttccctctccaacctgtgtggaatcatatgggcctttcggagcgcttataataaacggattggggattgtgagattaacccttggggatatctttcaagaccttgtttaaatcatgcatatcagac

SEQ ID NO: 8577 - DNA, 524 bp, Zea mays
  unsure (1)..(524): unsure at all n locations; Clone ID: LIB3279-188-Q1-N6-G3
gcttgaacaaaaagaaaagatctatatagacatatccgtgccctaccttaccccaaaaagttggccacaattgccttaatttatcatctatatatgtatgggggctcgttgaattgacacacatttataatgatcgttaacaatcaacactagctaccctgtagatttctttgacgactcaactaatggtaccgttagttatataaagttggccatcagggcatatagaagccgtggcactgttagcaaacttttacggttagtagattaaggagagaaaaaaaaagcaccacacacgcaaattgatagtgaagtacatctgtcgctttcactgcatcattgtaaatatcttttctttgatcacgagttgatcaacagctagctagctagctagcaggcaatgagagccggaatgatgtgggggttccccaaatttgatccagtcttcttatcaaacaagggtttncttgttgcgcccagtagctaggtggcatcatgctctgcacaacatgtttttgtaatgc

SEQ ID NO: 8578 - DNA, 622 bp, Zea mays
  unsure (1)..(622): unsure at all n locations; Clone ID: LIB3279-188-Q1-N6-G4
ggaacaggtaaaacgcaagccttctcatagtataatcttttcattaaacaagcaaactgagcacaaaaccttggtgggtcaattttgcaacccccgctgagcctagccatcacctcatacacgacgaaggggccaaaatttcacgaatcgtcgacgccagtcatcggctcattatcctccttggcttcatccccagcgtcttcgtcttcaccatccgcggcgtcctccatctggtaatccaccttgaaatcgtagtccgcgtccatgtcgttcagcacactgaacctgttcgccttgcgccgtttcttctctgctttcctcttgcgagggtcgagtatgccctcggcggtgtacaacttgtcgttctgcgtgctggcggtggctggcttgcttccttgtgggtcgttcgcgtcagacatttgctcctcccggttttcctgagcgggttcacttggtttgctgccatcctctagcatctcttcgtcaattgccggtggagcattaggaggaatctcaatatgatggaactcctcaatggacttcaaaccaccaatatatgaagactcagctntgttaatttcatcaatattaaattctttnccatcttctgatataatcacta

SEQ ID NO: 8579 - DNA, 561 bp, Zea mays
  Clone ID: LIB3279-188-Q1-N6-G5
ggacaaacattgaaattttctggtttaagtcaagagtcccctcgaggccatgtcggcgctaaagaacaggtatggaaatgtctgttcggcgggatacaaacagaggctcggttcttcagtttactcctcgtcatcatccgctgcatccccggacccacctttaaggtgcagatgcttctccctcctctggaagtcggtcaggcccttgccactcccagtgacacccaccttacctctgtggtcgtccggtgacttgaagatgctctccttcttgcgaccggagaagaaccccacctttttggctttccccttggtttgaaactgctgccatgcattctgccttttgttttgggcaaattcaagctgctcaaagcgggattttgatttgaaagcatgtattttcttacgctttgcagctttaacatcctcagggtcacttggttcgatacgaagtttggccggcaagctacgcgcctgaaaatcagatgttgctgcttgttcaattttcctctttattgccatttttgtagcttcagcttccttttcagcttgtcccaaggc

SEQ ID NO: 8580 - DNA, 482 bp, Zea mays
  Clone ID: LIB3279-188-Q1-N6-G6
ggcggggctaacaagggccgagaatcaaagatcggtagacaaatttgtcaaaacatacaaactggaacatggggccactttgttcattcccgcgcccccccattttggaacaaataaaaccatcgcctgaaactacttttatccacaaaggcctggggaccaccgcttcactttttttggttggcccccacgttcaactggtgaaaaccaaacaaaagggccctggaatcaaagaacaccttgttgctggaggcccccatggggggggaaaactccctggcagcttcaatctgtctcaaaaccaaaaagggggggttgttggcaatgggttggccaatcaactcaacgctcttagcctcaccctgggccctgataactgcactgggcttggcctgctcaaccttttaaacacggaacttggcacgctcagctttttgtgcagcaacctgcttggcttcaatggcatgagtaaactcttttcc

SEQ ID NO: 8581 - DNA, 493 bp, Zea mays
  Clone ID: LIB3279-188-Q1-N6-G7
cttgtggttgtggtgggtgtttttttttttttttttttttttttttttttttttttttttttttttttttttttttttttttttttttttttttttttttttttttttttttttttttttttttttggggaagggttaactttaaaattttggggggggggggggaaaaaaaaaaaggttgggggatttaacttggtaaaaaaaaggaaaaaaagtgaaggggaattgccaaaggacttttgggaaaatacaaaaacggggaaaaacttattttaaaaaaaaaaacccggaggggggggggggaccgaaaccgggcccgccatggtggaccggttttaaggaaaggggaaaataaaaaagggggggggcggaaatttaagggttgaaccaaacctgggtgaaaaggttgccgggggaaaacccaaaagggttccaaaaattttaggggaaataaataatttacggagaagggttttgaaggggtttgggtttt

SEQ ID NO: 8582 - DNA, 565 bp, Zea mays
  Clone ID: LIB3279-188-Q1-N6-G8
gggccatcatcacattcataggctaccctcgaacgcagaaaaaatcaacaaggcaagcactggcagttcccaagaaatagaatgcgacaggtctttcaaatagagaaggaagacgggacactatctcaccatagcgacagaaacaaccaattcgcaccacaacaatccgagacacgttcaaaaaaaaattcgaaacacacaacccaaatattgaagtacacaaaccacagccttgttttgctacatcgaacgcatagcccgtctttaaacaaaataaggttaggcctacttccaccgacactctttcgagactctcgcttaccctcctctcccatgtttcgcatttgttgttgactctattggacctgcgactcacttgcccccatgcttcgccttcgagtgagcctgaagtgccgtctcactgatgaatgacttgctgcacgatttgcaagggacaccagattttggcgcagattttggagacttgaccgatttgtcattgtttacaatggtcttgccttttgctgggtgtggagttgccacatggacggcggcgcccttcttg

SEQ ID NO: 8583 - DNA, 600 bp, Zea mays
  Clone ID: LIB3279-188-Q1-N6-G9
atgtgcaaacaagagagatactttgtataggaaaacgacggaccatttaacgcacagttgcagattactattactggctgcagtgtaccatataatacccagggacaagacaacagtacatcacatagctagataactgcgaagccaaatacccgtctcagcgagaccaccataaatagagcttacacaacatagccaacatgcaaatcatttttgaactgaccagatgcagaggcaggagaattctcggaggcgggctacacaagtgtgcaccgtgcactgcaatgcccaacaacaagattgtagcagcaaacatggaagagaaaggcgcggggagcaaggcagcagttccgcatgacgagttaccgcggtttacaatcttcctgacaccaaccgtagggaaccccccctagatcttgtcgagcttgtctgccttcaccaccggattagccttggcaatggcgtccctggcagcagtccggtagtcgaacttgcagtcgtgcttgtcggagtagcggtggagcgcgcagtacaagttcccacaccggcagttgaatcccgtgagcccaaccctcttcctgcaggcgctgcaccggttcg

SEQ ID NO: 8584 - DNA, 566 bp, Zea mays
  Clone ID: LIB3279-188-Q1-N6-H1
aatggtatgatcatattcaatcttattcaacaatccactctcaaagcttttagtaaccagaatcatattttcaaagaccaattggtcaaagacatgacatcgataattgaaacttaaaatactacaatatttagtatacaagataaatagaataatcaataaattatttcattaacaaagttagcaaataaatatacatgtatacaataggatgttagaggtaccttatgatttgaactttttgggcttgtttggttcgctacctaacttgccacactttgcctaacttttctggctaaggttagttcttcaattcgaacgactaactttaggcaaagtgtaacacagttagccacgaatcaaacatgccctttgtttcctaaatatcaggacacaaagcaagcgacggagggggatcgttgttgccgcgttggctgcctaccgctagacgacgaacgagtgtagtgtagacgacagaatcacgttgtgcgctggtggcaggcgaaacaaatgtccgtgatcgtcgcccatcaagcagcagcacactgggcgcttggcagcaggcg

SEQ ID NO: 8585 - DNA, 601 bp, Zea mays
  Clone ID: LIB3279-188-Q1-N6-H2
attgggaagaaaacagtaggctattgatgttgatgccatggtacttcttgtctaaagagcgaagaatccaagtaacaaaccacgcaacaattctcctactagatgcactgttcactcacacacacacacacacacatcacttatccgggacacaaaggtttgttacccgcagttttcagacactgaactggtacaggtacctctaccacaaattcctgggtgcttattgatgatttaatgagtggttggatgatctgattagagagcagcgatgcactcaatctcaatccgggcattcagtgagcagcgccgccacttggtaggttgatcgtgcaggtgctggcgccgggaaatatttgccatagatctcgtttactttattgaaatcctgcagatcagccaacatgatcgttgtcttcacaactgaagaatagctagcaccacgagctttcaatatctcgcccatgtttttcataacctgctcagtttgctcctcaacattttcagagataaacttcctggtctcgggattcaagccaagaactccagaaacaaacacaagattatttgctttgatggcctgagaataagggcctagtgc

SEQ ID NO: 8586 - DNA, 627 bp, Zea mays
  Clone ID: LIB3279-188-Q1-N6-H3
ggaagtgggagacccgcgagaggctgccgtgtcgggactagggaccgtagagtaagcgacagcgaaggagggagagggggatggccgggatcgggccgatcaggcaggactgggagccggtggttgtgcggaagaaggcacccaccgccgctgccaagaaggatgagaaggccgtcaacgccgcgcgccgctccggcgcggagatcgagaccatgaagaagtacaacgctggtatgaacaaggcggcgtccagcggcacatccctcaacaccaagcgcctcgacgacgacacagagaacctcgcccatgagcgagttccaagtgacctgaagaaaaatctcatgcaagcaaggctagataagaagttgacccaggcacagcttgctcagatgatcaatgagaagccacaggtgatccaggagtatgagtcaggtaaggcaattcccaaccagcagatcattggcaagctcgagagggccctgggaacgaagctgcgtggcaagaaataaccaggagcagcatagggaagacaaggcaaactgtctgcttattatttgctatgtttggtatctcaagtcatgcggactgtttgtgttggtacaagagtgaattaactgtgttctcctg

SEQ ID NO: 8587 - DNA, 509 bp, Zea mays
  Clone ID: LIB3279-188-Q1-N6-H4
ggggggttttttttttttttttttttttttttttttttttttttttttttttttttttttttttttttttttttttttttttttttttttggaaattcaccccaacccaacgggggcctgggtttgggtcccccggggccggggggggggtgcccaaaaaaggggggggccccattcatggggggggcttaccgccccggtcaacttggcgcccaaccccaaaaaaaaaaaaccccggggggcggggggatttgcaatgccccaaagggtatcggcgaccaggcctcccggaagtttcggatggccagtttcctgacatcaggcattccctcatttgggaaccccccccccttgagggggggctccattgcccaaaccccttcctttttaagttcaggcaccccacttttggcaatccccaattcaaggtctttctcgatcttaggaagaacccccttcccgaagcccacctttgggttaatcttggcaaaccccgccacaaggggggc

SEQ ID NO: 8588 - DNA, 598 bp, Zea mays
  Clone ID: LIB3279-188-Q1-N6-H5
accaaatagcgtttattcaaacatgttctgataaagaagcaagccatcgatgttcgatggagcctcgtagtacaaggttcgacacgacggtaacaagcatacacgcagggaggggcctatatgtgtaataggaggaacgcgcaggcggcgtactaggcctgcttgcagtacacagccagatagatatgctccacctcagatattatatataataagctggccctgcatgcagggttggtttgctatggacccggcggttgctcagaaaccatgaatcttgatgtgctccttcttcacaatgccggcctggacgaggaaattcgagacgttcttcctctgatcaccctggagctgaatgacctgtccaagttctgggtcctggaccactgtaccattgcagcagaactctttcttgagatctttgaggatcttgctgtagctgaactccttcttcaatccctggacggtggtcaggctcttgcgaccattacgctgctggatgcgcacgtgtacgtagtcctttgaccctgctgccgcaccagagtccccagcattggcctcagcgaagggatcgaaggcagttgggatctgaatgtcg

SEQ ID NO: 8589 - DNA, 558 bp, Zea mays
  Clone ID: LIB3279-188-Q1-N6-H6
cttgggtgggggggggttttttttttttttttttttttttttttttttttttttttttttttttttttttttttttttttttttttttttttttttttttttgggcgaccaagcaagggcccacccccccaaccaaaaaattacctttacaagggggggggggggaaaaccccaggccctgaaaaaaaaaaaggggggggggggggaaaaactaaaaaggggcaaaaaggtacaggcccatgccccacgtaagcaaagcctaagaaaccccccgcccccggtctgggggaaggagggggcccccatccccaaggacaaggacaaggacttgcccttggccatcctggacaattggcccttaatttccttggacccccggtccaactccaccacccgggtttgaattttttggagggtcagccgaaaaaattcctttttgggggcggcgccgccgctccttttggcgagggccaccctggggggggcgcggggggcaacccccctcctctgcgtttgggactgggagcaaaaaaacgggttgggccggggctccttccc

SEQ ID NO: 8590 - DNA, 568 bp, Zea mays
  Clone ID: LIB3279-188-Q1-N6-H7
cttggggtgtgggggggtgtttttttttttttttttttttttttttttttttttcacaagaacctggtcctcacatacaacgaaaatcctgacacatgttttcagacggggttacaaattcaccggggcaacatcaggtcatagttatacattcctggggggggggcgggtcccaaacatgagacgtacaaacttttcggcgtgttgcctgtaggcttaacttcccttcacccaaattacggaaacaccggggacccttgtgctacggatcgctgcaaaggatttcggtgaaaatggaaagtgcgtcctgcaggtacaacaacctgctttcgtccggaaccggagcattgagcaacgttagaaaacaccccatgggtaggttcagcatctcgcttggggtgtccaccaaaagcgcgcatagctcctttgccatcttcgagtagcatgcccttgactcaacaggtaattggtttccccagactaacaacgactcgtttaatcggccaaagaaacttttgcatgattcactcatctcctggagggaacccgaatcatcctggcatttttt

SEQ ID NO: 8591 - DNA, 554 bp, Zea mays
  Clone ID: LIB3279-188-Q1-N6-H8
agaaaatgtaaacttcatatgaataagggataaaaggaccatagcaccctccacaggggaaaaaataaccaagctatcccattctatctactgactcacttccatttacaaaagggggggctaatatttatttgatcttgtcacagtaatacaagattagaccatccttgcaaatctgcctggtaaacatagttccattgctgccaagattgagaatatgtcctgcacaaacttagcttccattccagctttgggcatttgccttgtaattgtacgaaactatgaatcaatactccgagcatcaatactattactcaggacatcaaaaatgatgctaggatatggtgtctggctggggctgcatgactgcgaaaaatgtggccttagtccttctgaaaaggggtgacaggttccttttgatgattggccgttattattattttttagtcatggatgggttcctttatgcttgttggtagccgccgtaaggaggccctttgatgtttgtactgggcatctaggaccttagtctttttcttcttaatataatgaca

SEQ ID NO: 8592 - DNA, 584 bp, Zea mays
  Clone ID: LIB3279-188-Q1-N6-H9
aagttgacattataaatgggatagttgcaaacacgagcacttgcgagattagacacggatataagaagccaacgacggcatcacacgattacaggcgaacacaccaatcagcacaaacatcaccaaatcctttattctagtgactcagtgcagatgcagcctactgctagcagggcactgaacatcaccatcccgtcgtatggattctggtaagggaacagtatcccttcattcgatcttgtcgcagtcgatgtcgggggtgatgttgtaggacagcgagaggccgcagtcgccgggcagctcctgcgccgcggagagcacagcgtggacctgaacgtaggccgccttgaggcaccggcacgtggcctgcctgtcgggcctggtgtccgccgccgcgtacagggtcctcacgccgtcgcagcactggttgttgctctcgctgggtttggctgccttgccctgcaggaagggcaggcacggcgacaggtcgttgagcacgtcggagcacgagatgtcggccaccgcggactggactgccagcatcgccaccaggaggacgactgcaatgcccgagctagtagtct

SEQ ID NO: 8593 - DNA, 409 bp, Zea mays
  Clone ID: LIB3279-189-Q1-N6-A1
actaaatcttcagatttaagggaccaggggaaatcacaacattgcatatagggacatgaattcaaaacatagctaagggagggtccaattcttggtaaactagatgtaaaatctactggttgatatcagccttttttttttgccacagcctgtccaaggggctgtctggatcgccctgggcacgggcaaacccagagagagcaaatgttgggaagtgaccattatacaggccattcgcatccaagtggccaatgttgatctggacagaggcatggtccttggcagggatgatcctgtttgtggccgagcacttcctgggaacataaaggtccacagtgttacccttcttgttttgtatggggacagttgggggaactaccgcaaggacaacttgcaagaaacagaccaa

SEQ ID NO: 8594 - DNA, 556 bp, Zea mays
  Clone ID: LIB3279-189-Q1-N6-A2
atccaagctaaccaaacaaatggcactttcagttaaaccctgacaaataacgccaccagttgatttcatttgcattgccactccctcagcaaaagccaaacagcaccatattagctggcactacgctcaaacaaagtgcaggtttacacaagcattgtcaggccacgctaacagccataataattaacaaaatcctcaccgagtacatatcctgagaaagttgcaaaacaccaaatttatctcttctcacgttaagagaagcaggacctaatcgcccttgcgacggaaggagcacccctcggtgagcctggccttcccaccggtaggttggcacaaaacagtttggcagcctgggcacacaaccacagtctgggagtggctgaacacagtggttatgctgaaacagccctggcacttgacatccatgaagaaggagttgggggactggactatccgcttcttcttgtgctttagcttctcaagctctgccggtggattgagtaagtcaatgtcgttttgcagcaccatcttggagacgctagcgccttgggcgttc

SEQ ID NO: 8595 - DNA, 583 bp, Zea mays
  unsure (1)..(583): unsure at all n locations; Clone ID: LIB3279-189-Q1-N6-A3
acacttctgtccacaacatagctttttgcagagattcagtacataaggattcttcaaattaaccataccacaccataacatgggacatttgcgaaactacgggtacaggtatcaaaatgcaacgagttcaatactaaaatataagcgtagtgcaatctaatcttcttcctcgccctcgttctcagcaatgttgaagtagcggagctcatagacgtttcggtccttgttggcagcaaccacgcgtagccaatcccgcacgttgtgcttcttcaagtacttcttggtcaagtacttcaggtacctcttggagaagggtccgtcagaggtgacggtgaccttggtcttctcgcgagagatggtgacggagtcgccgaggttgccagccttgccgccggcgaccttgatgcgctcctgcaggaacttctcgagcgaggcgacctccatgatcttgtcctccactggcttggtgcagtcgatcgtgaaggaaaccgaccccttcttcttgcccgcgaccgcgccgnccttcgccgacaccacgccgcgcgccatcgttcctcaccttccctcggcttggtgctcgagt

SEQ ID NO: 8596 - DNA, 540 bp, Zea mays
  Clone ID: LIB3279-189-Q1-N6-A4
gtctaaaatcgcttcaaaatccaaacctttttcagtactagcaacacgcagaagattagtaccgggaaatgcgagaactccaaaacttattatctcccggcgcagattattggaagagatccaaggcctgggacaatcctctgccagtgccaggcccccaaaacatacgataagccaactcatcgctcaactccacaatgacagtgcagggcaggaatggcgggcgggcctcgcctcctacttgggccccatgccgcacagcaccgcggcggcgtgacgggcgaagtaggtcaggatgacgtcggcgccggctcgccgcaggcacatgagcgactccatcatcaccttctgctcgtccaccatgcccagggccccgccggctttgatcatcgagtactcgcccgagacctggtaagcagcaatcggtagggctgaatgatcccgaagcagtcggataatgtccaagtacggcaatcccggtttcactagcagaatgtcgggtccttctgcctcgtccgctgcggtttctatgagggcttc

SEQ ID NO: 8597 - DNA, 219 bp, Zea mays
  Clone ID: LIB3279-189-Q1-N6-A5
aaaaaaaaaatgggggacagacatgacccttacttgggaaacaccccttgccgttcggggaaaccccccccaaaatcatttttcatccgacagggacatttttggtaaacagttcggaaaaggggggggaatgcaaacaaaaaaacatgggcacaggatacaaaacgacctgctcacgaaagcagttaaaaaaaaggggggggcttgggttggccccaa

SEQ ID NO: 8598 - DNA, 583 bp, Zea mays
  unsure (1)..(583): unsure at all n locations; Clone ID: LIB3279-189-Q1-N6-A6
ttgagagaagcacaagaatatttgcatcctttcatcgtacaaatgtaatgtcacaacacaaacgactagtctaaaatgtgggcacgccgtacgtggcccgctagctcacaagaccctggcgcgaacttggtggcgtagacccaggcgttgttggccacggggtcgtcgagcaggttctcgaggggtcccttgccggtgacgatggcctggacgaagaagccgaacatagagaacatgacgaggcggccgttcttgatctccttgaccttgagctcggcgaaggtgacggggtcgtcggcgaggccgaggggtcgaagtactggccgccggggtagaggccgtcgccgtcgccgacgccgtcgtggccgttgacgcggaagccctcgacgaggcccatgaggacgacctgggagccgagcacggcgaggatgctctgcgcgtgcaccgggttggggttgcccaggtaatccagcccgccctcggagaagatctgcgcgcgggccttgaacttaccacacgggctccctgaagtccacgcgcacccagctctggagcacctncggggtgacgcagcccagcgccc

SEQ ID NO: 8599 - DNA, 564 bp, Zea mays
  Clone ID: LIB3279-189-Q1-N6-A7
gagagggtaactgagataacaagtaactgaaatttccaattccactgtagatagctgaacaattcccagtctgaccttacaaaaggacagctagttcagaaatacctcaaatggggtatgttttgtatgggtgagaatacatgaagaaaggggcatttaaaagaaacaaaaacattggtgacatctgcagacttcataacatccaactgctatagcaagtgccatgtatgtatgaggggaaaaaactgcctttctggataatgtcaataccaaaagcggttatgtttaggccacacaatcttctcggcaattggagaacgaagacggctcgtcccgacgccttctcagtcgatggctagactagacatcagggcggcgattcttcactcctgctcactttgggggccgacatgggcgggatactttgcagaaacatccgcccatgtgctttggccttccgtcagctgcttcaccacaggcgccacctcgtcgatgtccacgcggacctgctccttgctgtccctctctcggatcgtcacgttcgttgccgaatcactgttacag

SEQ ID NO: 8600 - DNA, 430 bp, Zea mays
  Clone ID: LIB3279-189-Q1-N6-A8
gtgtgtggggtgttttttttttttttttttttttttttttttttttttttttttttttttttttttttttttttttttttttttttttttttttttttttttttttttttttttttttttttttttttttttaaaggaaaccaaaaagggggggggggggggaaagccacccaaaaaaaaagggggcatgggggcgtaaaaaccctgggaaaccccaaaaaaaaaaaggcgacaaaaaaaaaaaaaagaaaatttttaattagggagggggggaataaaaataaaaccccgctgggcggcgggaaaaaatttaaaaccaaaaaaaaattcaaccaaaaaagaattaaaaagggatggttttgtttgacagggggggcaaaatttaaagggaaaaaaataaatattggaaaatttttaaaaaaaagaaagg

SEQ ID NO: 8601 - DNA, 513 bp, Zea mays
  Clone ID: LIB3279-189-Q1-N6-A9
cttggggtggggttgttgggtttttttttttttttttttttttttttttgaagcaacaacagccccagaccggacctcaagccgcccagaggggaaaaacagcctatactgatgaattattggcaaaaaccaaaagaattgtcagccatcaggagggggggggggggggcgctgcagccgtgacggggagcaagagtatagtcattcgggggggaaaaggcctacatagctacctttacagagctgttgctatgtatgtatggaggagcttcaaaagtttcgtatctggtatactactactctcaacaaagctgtatttacacaacaggcctcacgagctcgacaggctcgtcgcggcaggtgttgccggcaccgcgctgctctgcgtcgagttgttcttgttctcgccccagtgccatagcatgctctcccagaagcagaacttctcgaagcaagtcttcagcctcggatcggttatgttccgtttccaatgcccgtcggtgaagttcgcct

SEQ ID NO: 8602 - DNA, 597 bp, Zea mays
  unsure (1)..(597): unsure at all n locations; Clone ID: LIB3279-189-Q1-N6-B1
gagctgatcaaagtcatcgttctgctaagttcaaaaaccaacaacgtttgcatcatgtcaggtacagagtagtagcatacagtgatctcctcaaagaacagagtatttgtaaaaatatggaagggacagcaatgctactagcacagtgctcataatccgtacagcaatcttttagctcgagctctgcctttctgaacgtttcaagtgcagaatccgattcactctgattttgccggagaacaagatcggggcagactcttgctcctggcaggactcctgcttgcagacttgtcacgccggggagaaacaggaggggatctggatggtgatcttgccttaacaggtgattttgactctgaagcagatctagatcttgggctcctactcttgctataactgcagcttctgcttcttgagtacgagtggctgtggcttctgcttcttgacttaaagcggtttctgcctctggagcgagaacggctgcgcctagcattatacttcctcacccggacatatgtccttggaaaagcttacggaactcaggatcatntagcttcctttatcgcgggtttcatatcttcatagttagtataatca

SEQ ID NO: 8603 - DNA, 607 bp, Zea mays
  unsure (1)..(607): unsure at all n locations; Clone ID: LIB3279-189-Q1-N6-B2
gccatgctgtgggtgtgcgattgaaggctccacaccttgtacgcgtttacaaaccaaatcgttcaatgttttggcaaaggcaaacacacacacacacacgtataccacaggaaattgttcaatgatttggcaaacaattgcaccatgtgattaaacgattacacgtatacctgtaactataacaaatgattatttgtcagtgtcgtccttgtcttgtttgaggctcaccggcaggtctttgccgcggcgctccttgccgcccggtttagcggacgcgttcccgtaccacaccatcccgaggacggcgagggccatcccgacgacgacctggaggctgaggccttccttgccgaagaagaggaagccgagggagaggacgagcacggtcttcatgtggcccaggacctggaaggacacggcggagaagcggccgatgcagatgaactggctcaggttgaccccgatcgcgatgaagcacgacagcgcgaggaacaacagagcgagagacgagaagctgaagtggtccaccctttgccctgtcagcaggtagtcaacgaacggccctgccagcagcagcgaccctgcctgcgcncgcgccgtgtggccc

SEQ ID NO: 8604 - DNA, 528 bp, Zea mays
  Clone ID: LIB3279-189-Q1-N6-B3
aaacgtcaagcatggggcacattaactaaaactggatcacgtttgggtacatgtccgtaacatgttacatgttggatattattgctaaaatctactcagggcactccaagagtaaaatctgcaggtcgcagtaaacagtttcacaggacttgggcagacataaaagcacttgcatcccgcccgtttagtagggctccacaggtgcacggaatttggcacctgcgtaaacagcaatagcgccaagctttttttcaatcctaaaaagctggttgtatttggcaagacgctctgatctgcagggtgctccagtcttaatctgacccgtggacaaaccaactgccagatcagcaatgaaagtgtcctcagtctcaccactcctatgactagtcatcacaccccagcccgcacgctttgacattttcacagcctcaatactctcagtcacagatccgatttggttaaccttgagcagaagggcattgcatgatttctccttgatagccttagcaaccctagtggggttggtga

SEQ ID NO: 8605 - DNA, 355 bp, Zea mays
  Clone ID: LIB3279-189-Q1-N6-B4
ggggcccggaaaaaaatcaaaaattgggggggggaagaaaaaaaggaaattttttaagggcaaaaatttagttaaaaaaaaaaagggttttaaaaaaacttttgggttttgggaatttagggaaagggggtgggggttaaaaaaaatttaaaaaaaaggggaaaaaaaaggggaattggggttcttataaattaattgggggaaaacttttttgccaaaaaaggggaagaaaagctttttgtttaaacccctgagagggggggtcctaagggggggggaaaaattttattggtttttttggggcgagggggaagttttttttttggaaaaatttggggggaaggggggggagaaa

SEQ ID NO: 8606 - DNA, 629 bp, Zea mays
  unsure (1)..(629): unsure at all n locations; Clone ID: LIB3279-189-Q1-N6-B5
acacttacttaagagagagcaacaaccatctgtgagctgcaactgagaggcgaaaccacccgccagcgatggggccatgcacctgccgcgcctacagcatgctgtcggtcctcgccggcagacgcctgaagaagttgagcgggacagatggcatcttgtggcggaacctggggtgcctcagcacgtacaggcctgcgaggaagaccacgacgcggaacggagtgacatacaggacgatggcggcgacgaagcagaagaccacgaacagcgcggtcgcccttgggtccctccagctcagcagcgactgcagccgctcgccttgcgtggcaaggtcgccgaccacggtctggatcctcccggcgacgctgcgcagcttgtcataccgcatccgcaccaagtccggtgggcgggaggtggggaaggtgtcgaactcctcgtcaagctcgtccgggtgggcggtctctgcgtgggagaggcgggtgtccatgtngcggtggctgcctcggccgccacctgtagtaccacaccccgatcaggaacaggtagaggaagattgtgggcagtatcagctctgggtatagaaccagtatcataaagagtacatggatcagtacggtggtcagcgggtt

SEQ ID NO: 8607 - DNA, 599 bp, Zea mays
  unsure (1)..(599): unsure at all n locations; Clone ID: LIB3279-189-Q1-N6-B6
agaaataaaattttttatccaaaagtacagtagtcttatgcaggaggagtatttcctgcgtacaggtgaaaagaacgcgagacgcaaacaactccagccgttcccgttcccccctgactacacccgtcactcctccttgtcctcggcctcggcctctgccttgtcccgcccggcggcgccggcttcggcttgcggctgggggcacatcatcttcttgaagtcctcgaacccgacgcagccgtcggcgtcgacgccggcgaccatccgctcgcactcctcggcgctgcatccgccctcgccgatgcgcgcgagcaccttgcccagctcggccgccgtgacgcggccgtcgccgtcgacgtcgtagacgtcgaaggcggcgcggagctcggcgtcgtcgtccacgccgccgccgccgcgcgcgtggaacgccctgaactcgccgaggtccacgaagccgtcgcggtccgtgtccagctcgtccatcatggcggccacctcgcggcgcccgtgcgaggagctcgctggcggngagatggcgcgcgtcaccgcggccagctccgaggcggagatccggccgtcgccgtccgcgtcgatgcggc

SEQ ID NO: 8608 - DNA, 423 bp, Zea mays
  Clone ID: LIB3279-189-Q1-N6-B7
tccgccgcgccggcgccgtggacaccagcaccccgtacagcgccggccggaaggccctcaggaaccgctccgccaggcccaggcccgggcccgggccggggcccgacgccgcgagacggtccccgccgtcgtcgtccgcgcccgctcccgcgcggcggggcagctgcgcggcctgcaggtccaggaacaccagcgccgcccgcaccagccccgccagcgccgcgatcgacaccaccgcgttgtacaccaggtaccccagcaggctgtcccgcggctccggcatgctcgagatccccatcgccgggcgagctcgggagggttcggtttgggggatccgacccgtggacagggttgcaatttccgattatttcggggaggccggcgcgaggactggcagcgggatggatggatggatggacagac

SEQ ID NO: 8609 - DNA, 522 bp, Zea mays
  Clone ID: LIB3279-189-Q1-N6-B8
cgccatcaaaagcataaggtcaatagctgctggaagctgcaagtctggagccgcaaaggcgaaccgttaactgttcaatcatgatcgttcaccagatactaagccttactacaaagttagaactaaacgtgtgtccctcaagtaacaccctactactgatgccatataaatcatggggacaggcacaactcataatgattgccgaatgaaaattaggctatccacgaacaaaacctaacaaaaagcacgttcatttactagggtccccaggcacaggatggtacagatacccagcaccaaaagccaccattcatcattcctagggagtccgtgccgaggtagccttaatcgctttcctttccctccgctccctaatcctcctaaggaaccacgtaagcgtcgtcgtcgtcctcctccgcggcagcctcctccggagtgacaaggtaccccccgggctgcgggggggcccggcggcggttccccaaggggaggatgttgctgaggtctacctcggccatcggg

SEQ ID NO: 8610 - DNA, 622 bp, Zea mays
  Clone ID: LIB3279-189-Q1-N6-B9
ataatttaaaaccagacaaagctttatgatttgaaacgggaatagtaataaatgtgcacaatgattacggtcattatcatcatcataaaacagcagcaacaaatggcactaataccataccaggttacaagcagagtctgcaccggcaaacgaaccacccactcatttcattccgagcaaaccaaccaccggacttagccccacatacacaaacaatccacggaggaaaatcaaaacagagcctagcagcagatataacaagagtctgacaaaccgccccaatcatggggccaacagttccatcgccgccacattcatcagtcgctgataacaggcgacgccgaccttgaccgtgacccaggaggtgacatggacgctggccggggtgacctatgatgaccgcgccgaggctcctcatcctcctcgcctgctggggacctcttcctctcatcacgaccattgtctgcaccacggcgatcatttatatcatcaggagtataggatctcctcctatccctgttattttctttaggctgttttgatgacctcgggtgctcttcctttgcccgaggtggggaagcagagtagtcatcacgccttttcggggcaggggagtatgact

SEQ ID NO: 8611 - DNA, 522 bp, Zea mays
  Clone ID: LIB3279-189-Q1-N6-C2
gcatgccggggctccctccagggggacaattatagcgggtcacatgcatgtcttcgggtcacaatttacattcacaatcagcttactctggaacctaagcagggcaatgaaaagggacatcttggatcctggtcgggatataaggggttatatacatcctatgatgctcctacgatgagtccaacacaatacatccatcgaaacttcatgtattataactacaatgcagctcgtccttggcccttcggtaacttttttgttccggagtcttccacatcctttagttgggaataatggggggctatttttaccagccattcaggctttagttccgtcacctggcgcataaactttttcgtcgggagaactaattcgtgggacactacccaccggggacgtaccttcgctaatcctgaactaggatggatatgcacggtctgagggttcttgacagtcttatatgtaccatccctctgcaaccgtgcagagtgatggaagaaacctgatgttatagctttttta

SEQ ID NO: 8612 - DNA, 531 bp, Zea mays
  Clone ID: LIB3279-189-Q1-N6-C3
gcagcctaggccgaggtgaacttggtgacggccttggtgccctcggagacggcgtgcttggcgagctccccgggaaggacgaggcgcacggaggtctggatctcacgggaggtgatggtaggcttcttgttatagcgcgcgagcttggcggcctcagcagcgagcttctcgaagatatcgttaatgaaggagttcatgatggacatggccttggaggagatgccaatgtccgggtgcacctgcttcagcaccttgaagatgtagatcttgtaggtctccacgctcttcttgcccttcttcttgcccctcttgccctcgccgccttccttggcagcggacttgccagcggggacccgcttctccgccttcggcttcttcccggcgggcgccttctcggccgcgggctcctcctccgccggcttcttcgccgcgggtttcttctcggccttgggcgccatcgatgcggggcgagttggggttttggttgcgaaggggggatcggatgggaagaaatgcgagcggacgcgtggg

SEQ ID NO: 8613 - DNA, 364 bp, Zea mays
  Clone ID: LIB3279-189-Q1-N6-C4
ggacaaaaaatgggaggaaaaccaagaagggggccaccaactggccactgggtggaaaaaaaaaagaaacgggagcacagctacccttattttgatttttgacaaaaagggaggggtaaacttccattcctagcaaggtggcagaggggacagtttacagctacttccagtttttgaaaaaaaaggggggggcaaaaatgatgggcttgccaacctgggactggttggattttgggaggcctgaatacaccagggctagtcattattaaaatctgcaccagggggtattttgtcccacaaatacattattactgaacagggacctaaaagggcaatgttaaactgttttgaagggctggccttg

SEQ ID NO: 8614 - DNA, 594 bp, Zea mays
  unsure (1)..(594): unsure at all n locations; Clone ID: LIB3279-189-Q1-N6-C5
cccagcaaattttacattattataatagaaggatatttcacagatcacatctagccatcttgtctaatctggacgaacacctccaaaaacaccgcagccgccagcccgtgtacgtagactgatggcagtcagcaggaatgcagaatggagatcaaaatgcaacaagtctgtttagctggattcaggctaattcacaaaagatggagagactcaaaccgcttccaaccactgtacaggaggaaaaaggaggatcctcacccaaaaacttctgcaacatccaaatatttctctatattttatcatgccgacagctttctccttttttttttcttttcgaaggcacagtttggcccaatagcttggattgccagtgcttttgttctagctgcaacgagccttggttgcagtttgctaatttaaaactggataaagatcatatgcttcagtaactcctcgtttggcagagaggatcatagtcatatgcttcaccagccttaacaaaccgaccctttaccctctttcgcacatctgctctagccttacgagaagcgtacctgattntcttgtcgaactttcttctcattttcttctcct

SEQ ID NO: 8615 - DNA, 551 bp, Zea mays
  Clone ID: LIB3279-189-Q1-N6-C6
tttttgtttttttttttttttttttttttttttttttttttttttttttttttttttttttttttttttttttttttttttttttttttttttttttttttttttttggggaaaacccccccccatgggaaaaaaaaccttggcccccaaaaaaaaggggtggggggttttgggggggaaaaaagggggccccccaaagaaaaaaaaaagggggcccaaaatttttaaaaaaaggggggggggttttttcccaaaaacgttaaaaaggggggcaacccctgggaggggggggggtttttttttaaccctaggggggggggggggggcccaaaaaaaaaaaaaaaaacgggggcgaaaaaaaatgggccattatcttttgggataaggggcccccccggccccgggtagtttaaattcccttcaaaaaaaaaatggccaagggggcaaaaaaacaaacccgggccccaaaaggggaaatacccgattttttgcccaagaatgggccaaaaaaaaaaacccgcgcccctaacaaaagggggggaaaagggggc

SEQ ID NO: 8616 - DNA, 575 bp, Zea mays
  Clone ID: LIB3279-189-Q1-N6-C7
acaatgtagacatagcactatagcacagaattcattaaaagttgaaacaaacgccatggcttctctagttctttttcgcaacacaggtcacaagataccattgtaccaccaccaggactccagaagtaacacaacaagaaccatcaccgccaagaagagcgaagacgcctttacaccttgtgctgctcaagctggtcacggcttatgtcctgcagctggttcactggctgagcatggttgtgctagttctcttcacctgaaccacatcctcacaaggctctgcttcagtgcacaaagaaacaataactagatccgattggttgacagaacttgggtttgcccaggaattctctgtaacttaaacttaaacaccttggagcctggttggccttcgctccagcaatctacaacattatatagcccgtcatatgtgaatattgtggtttctttggccatcgaatggttgccttcctctctgtccagacatttgaaggtgtgaattactcggacaggactttttgttcggatgcagttcttcaaggctagattacccctctcaagcttttgatccccct

SEQ ID NO: 8617 - DNA, 587 bp, Zea mays
  Clone ID: LIB3279-189-Q1-N6-C8
gttgggaagttcatggttccacacacgatagtccgggactacaagagactgaggaaggcttaatttgcctacatcctacgcatgttccgtaacagcatattatagacatacatttctacatatcatccatgtccatttgacaccgggagcaacaaccagacactggtacgtacaggcagaagcagaacacaccacggctgaacgcctcctgcactctagggctcacgcgacagcagacggtaaggtcctgcggttctctgggactgtatgtggacttctccaacccacattcaggcctgtgcaacggggagcagcccaagctcgccgatcaccccagccgcgccgcgcagctgcgcgccaacgctggaaccgcaggtgggcacctcgtcaaacatcgaggccgatagcgactccgagatgaagccggcctggaactcgatggtgccctggtcagggtgcgcgaccatccccgtgacgtagacccagaggaacagcttcttggcctggacgccggagaggtccgagatggcgcccttggagagcttgccggttatggtcctctcgtagtagacgaggtgggagccgaa

SEQ ID NO: 8618 - DNA, 550 bp, Zea mays
  Clone ID: LIB3279-189-Q1-N6-C9
acagaaacggggtccgctgccttgtacagcagcagcacctatgttgccaatcatattgtacagaacatatatggcatgtttggtttatgactaaatatgccacactttgcctaatgttagtcgttcgaattgaataactaaccttagtcaaaaaagttaggcaaagtgtggcaactgaggtagtgaaccaaacaggccaatttttttttcgcgctctctttttcatttccccccttgaagttgaaatacaatcgtctctgaatagtaatgccacacaggtttcaacaacgctctgctctgtagtgtagtaatcacgtcgtctcctgaaaagactgcgagcgcgacaaaaccgccgggttggcctgcagggcgcgagcggcgccggacgcttgcagctcctgctgccgtccatgctttgactggaacggcctgaacatgccccggtcgccaggctcgatcccgaacgtcgtccaaatcgagctcttggcggcctcgacagggtcgtcgatccggagcgtcttggggatccacaggcaccgtcgttccgcct

SEQ ID NO: 8619 - DNA, 241 bp, Zea mays
  Clone ID: LIB3279-189-Q1-N6-D1
gggggggggggggggttttaattttgggaaaggggggttgggggggaattatatttagggggggggggccgcggggagtggggggggggaggatggttgaaaggagggggcggctttgggggtaagggggggggaaaaaaaagaaaaagaaatgggtgagtaagtaaagggagggggtttttatggggggggaggggaaacttgacaaaggggtgtttaggtaggagggggggagggggtg

SEQ ID NO: 8620 - DNA, 457 bp, Zea mays
  Clone ID: LIB3279-189-Q1-N6-D2
cccagaaaccgggatgagaagcatcgagctagctttgtacaggtccgcatgttaccgaccgagctttttttactagctccaccaaaagcacagctgcgactgaaaaaatgggcaggcaagccggggctttacaaaaagaaaaaaaagggggggaaaaaacctcacagtcacaggatcgggcggccgttggtcttcctttttgggtcctcccacggggccgaagcagcagcaggaggcacctgtgccaaaggccccatgtccagtttttttccaaccataaatgccggaaggccgcggttggccgtggagccccccatggtccctccgatgccgagcccaaggaagtccagcgtcgcaggcttaggacccaacaggggcgatggtcccgtcatcaggtcgggcaagggcaagcctgggtttccattttcgtatgcgaggccaaggcccaaaccacccc

SEQ ID NO: 8621 - DNA, 529 bp, Zea mays
  Clone ID: LIB3279-189-Q1-N6-D3
acatcagatatgaatttataatgtgccttcaaccaaccacaaaattgcatcacatctgcaggtgcaatacaaatgcaagtagccctgcagaagacaactcccacagatttcttcagaaaagacccatatgtggcaggcttaagattacactactgacgggcacataaatttctgcagaatgattttctcagaacatggcatcataatcatctaatgcatcattgtactccatgaccttcctcttgatctttgaggaatccacccaggtgatgaagtcctccatgtttctggtcacaagaaaggctgggtccgtgactgcatctggaccgacacgcacatgcccctgttcgatgtacgtcacagcctccttaaggtgctctgcaaacttgagcttcaccataactgttgcaagtctccgcctgcaagaattgagtaaacaaggtaaatggaactgcacatgtcattgtttcctacttgttctaccttaccataaaagcggctagcaaagtgaataatatgatatactcta

SEQ ID NO: 8622 - DNA, 565 bp, Zea mays
  Clone ID: LIB3279-189-Q1-N6-D4
aatacaatgtcgcttcacatagaatgccattatttgctgtttatataagtctacaaaacagttgtagactgtagtagctagtgtgtcccgtccatgacattccatggttacacttaatattaagttttaaaagttggctggaaatcaaaacaaaaaaaaaatgtgccgtgaacaccaaataagaactatgtaattcaagatatagatgccgacgacataaaacatgagcagcaaccatttgtaaaataaaggtgttaagatacccaaagcttgtacaacgcatgcagctggcccagggtagaagatttgagcgacaaacgatacatctctttcagcttaaaagtttctgttctgctgctagtgctggcttggctgacagaggctgctctgcccgtgctgctaggcagggatcccgccagcatcctcttcagcaggctctgcagctggcaccagaacttcggttttatgtccagatccatatcgttggagttgtcttcatttgcttcaaccacatgccggccttccaacaagtgagtcagagcggtgtcaaacatcgcggttgagt

SEQ ID NO: 8623 - DNA, 532 bp, Zea mays
  Clone ID: LIB3279-189-Q1-N6-D5
agatactaaatactgattgaaactgtgatacaaatatgaagtcatatgtctgaaattgcagaaaataaaaggagtaaatttagtctagccagacatgtggccgaacagcccaaccaagcctggcgtgccaggtgcggcccaagtggcacagtgcggctaagctggccggtccaggcagccaggcgagcggcccagccgagccagcccaggcgaccaggcgagcggttcaaccggccggcccaaacagccaggcgagcggcccagccgagccacccaggcggccaggagaaaaaaaaaataaggacggctagggtttggtaccctaaccagtccatttttttcatttcagccgccgccatggtgattccaccggtcatgggaggtccgatccgagcacctccggcatgggcgggcgcgggttcctccccggcggcgaggccctagcagcggcctctcctggtgggcacggcctgccccggcgacgcggtagcagccgtcccggcccgtgcgcgggtgcggcggtcaaagggcg

SEQ ID NO: 8624 - DNA, 522 bp, Zea mays
  Clone ID: LIB3279-189-Q1-N6-D6
cgcggaagagagcttaaattaacataggtgaacaagatgagtttactagaactgtgccaacatgcacttaaactaagatagcacaagtacagaacgagatgggactgtagtcaggcagaagcagcagcacggcctggattcactccttggcggtcttgttgatgagcgacttgtggatgtgcgggatgacgccgccaccggcgatggtgcccttgatgagggtgtcgagctcctcgtccccgcggatggcgagctgcaggtggcgcggggtgatgcgcttgaccttgaggtccttgctggcgttgccggccagctcgaggacctcggcggtgaggtactcgaggatggcggcggaataaacggcggcggtggcgccgacgcggccgtgcgcggaggcacgcgacttgagctggcggtggatgcgacccaccgggaactggaggccggcgcgggaggagcgcgacacgggggccttcttcctgtccttgtccttgtcggtgctcttggccgccgtcgtcttgg

SEQ ID NO: 8625 - DNA, 416 bp, Zea mays
  Clone ID: LIB3279-189-Q1-N6-D7
ctgtggtgtggtgtgtgggttttttttttttttttttttttttttttttttttttttttttttttttttttttttttttttttttttttttttttttttttttttttttttttttgggaaacgaaaacccccggggggaatccagacggggggaactttggggggggaggggggcagtttctcgaaggggcctcccggggggaaaatcccacaggggggccctaccacaggggggatttctcaaggggggatgggggggaggggggggggcaaaaaaaccccgggaaaacccgggggggttacaaagggggtaacaaaaggccgccgaaagggccctgggggggggagaaggggcaacgttaggaactatgaaccccggagggggggggggttacaacagccaagccgggggaaaa

SEQ ID NO: 8626 - DNA, 594 bp, Zea mays
  unsure (1)..(594): unsure at all n locations; Clone ID: LIB3279-189-Q1-N6-D8
ataattcaaatatccatttggtttatcataatccgaaccaaacaagctataagttcagcaagaaccaacgtgcgatacatagcagcacagaacaacatgcggaaagccttagctaaggaagttcatgaccctaacgtctggggcacagagcaaaacttgaagaccacatactggagattgacaaccgatccagtactaataacagactcagctctagtctcccttccggcggaaagagcatccctccgtgagcctcgcctttcctcccgtgggctggcagagaacagtttggcagcctgggcacacaacaacagtctgggagtggctgaaaaccgtggttatgcgtgaagcatccctggcacttgacatccatgaagaaggagttgggggactggacgaggcgcttcttcttgtgcttgagcttctcgagctctgccggcgggttgagaaggtcgatgtcgttctggagaaccatcttgcctcgggcggcggcggaggagagtgcgtttgatacggcggcggaggaggagctgcagcagacgagtctgagcagggagggttntgcgcggacggatgctaggacccacgcgtccg

SEQ ID NO: 8627 - DNA, 570 bp, Zea mays
  Clone ID: LIB3279-189-Q1-N6-D9
gtacgaaactgtatattcttatcacatacagtatcaatctttttcatcaagtacaatacagctctagggtacagattaaggtgacaggggtaaacaatgatggcgacaaagcctagcatctctcgtcgccttcccagttgttcttctccttgggccccgtaggaccttcctcctcgtacagttccgccggaaggctgttgaatattgcctctgctgtgaaccggagaaagaacggcaggaagctcagcgccgtgtctatctctgaacgtgagctgtacgtgatggtcggtccccactccctcatgtactgcagccagcacggttccgcaacagcgtcctccccgagatgccctgccgagatgatctcataccgcgtgctcgaatccactgacagatcacttcgggccacatcgtttctaactccgacaccgagcgtctcggaacccatcaggtagcagcctgggtgggggtagctcgcgtgcccattcctggacgagtaaacgatcgccttgttcccggagatgaactccagatcgcaagcttcaacccactcgcccccgctgtgctgcg

SEQ ID NO: 8628 - DNA, 627 bp, Zea mays
  Clone ID: LIB3279-189-Q1-N6-E2
acagcgctaagagatagatttatactctttcaggaatcagtatgcatcaaagcagatactgtgattccatgagcaagtcaggagaaacaacttgttgattttgccatgagacacctgtatcaagccagcaaccgtctccctttcacaatacaaacactcatcaccactcgagcactccacacagaagagcaagcacgcaaacgacaagctcttttcatatctacaggaagcttatctttgggtcaaggctaggggtttctgtatacaccaattgcggcgagcaggggccgcttctatggttgatatgcactcaaacaattacacgaatcagctacactcagtgaggtcgaccgagcagattaggaaacgcttcacacccaacaaatggttacagctttttattacctttaggcacagtctccggtgagaaaacatgaggccgtgtgatgttgttagtgaccacccaatgtggcgagggcaaactgatctacaactgtgccaggctctgcttttggtttcgctgtagcatatgagtttgcaaactgcagttttttacatgtattgctgcaaccgtggacaagagatcctttgattggtccaacaacatttgttcttgtgttgcaagtt

SEQ ID NO: 8629 - DNA, 574 bp, Zea mays
  Clone ID: LIB3279-189-Q1-N6-E3
cttcaacttcttttacttctcatgtgcttaaactccaaattccactctcattgtacacgagtgggtctttaagatttattataaagcaaatagatcgtactcaacacataattcatgatacagctgcttgaaatacttgttcatttggatttgcaaacgttgtccgtagaaaattttcaacgacggacaggaattcctcaggcctttcttcgtggggcaagtgaccacaactcttgatcgcctcaaaagttgctccaggtatagcgcgtgccacacgctcggcattccaagcaggaacaatgcgatcggtgtcacctgtcaccactagcactgggcatgagatctcagaaagcctctttgaaactggtactcttgatgcagacacagaatctatgatcatggatacggtgtgttccagcagagctgtctcccaacccttggattttagaggctttgtgtagccttgtatgacatgatcagttactttgctcgggtcataccatgcattccggacgcccagtataccaaatttatccatcacccatcttaccagcaccacacccaacgatgaccg

SEQ ID NO: 8630 - DNA, 610 bp, Zea mays
  unsure (1)..(610): unsure at all n locations; Clone ID: LIB3279-189-Q1-N6-E4
tttttagctaaaaataaagaaaccattcattaaaaacatagtttctattgtcataacaaatatatatagaagctaacttatagttataatctccatcttaacagaccccagatatgctcgtcaccacgaactacttcctgccgcaaataaagctatgaaatgctagtcctaagcaatattttgatcacttgttatggtaatctatggttccccttcttctcactacctcctcctactactacaaataaatttgtacaatacattccaaattaatagtcttccttggcagcccaaatcttggtctagaagctttaataatatccctcgggtcttattcggttggtggagtatggctgaaggtcttgtgccatttttgcatggggaagggttcaacacattggttattctcgtggcttggtggatctggaagcacagaaatgtttgtatttttgatggtgtctccccaaacacgaatacagttctgcaacagatccaggaggatgccaggctttgggagatggcacgtgctaaggctaaattggggtcttgggttgtctttctctttnccccatatttttcttcttttttctcctctttttctgggtttcct

SEQ ID NO: 8631 - DNA, 310 bp, Zea mays
  Clone ID: LIB3279-189-Q1-N6-E5
gggacaaccctccaaaaagacgtttttaaaaacccagggggaaagggggggggacaaaaccagaaaggtttacaaaataggggggggaaaaccaaaagggggaaaaaagcaaaaaaaaagcctgacaaaaaccggataaggaaacttttaggactaaaaaccaaaaaaacctttctcacccttaaaaaaataaaaaccaacctccttggaatcctttttgagggctgccaaaacctcacgggcctaaaaaaaatcgccctttttcatacccttaccaaaaaaacaatgaaaaaaggcacccttggggtac

SEQ ID NO: 8632 - DNA, 628 bp, Zea mays
  unsure (1)..(628): unsure at all n locations; Clone ID: LIB3279-189-Q1-N6-E6
taaagcgcaattatctttttttcccacaacaatacaacactatcttcagacccaaacatcgtccgcgaccacactacagtatatatatagtatagggtacacgcatttcccagttcaacccatcataatacacgtttcctaccttacgtagttacgtttctccatttaacatcgggaaatcaatcgacgcatgtacatcagagcacaccactgcgtaaaataattttactgctacgctttaagcgtatccgctgctaccttgcccatgcaagaagtgcacgacgacgcaagttatgttgtcactgctctccctcttgtacgcctcttgcaagagcatctttgcagcctcttctgggtccttaatggatctagtcatcgcaacagcttcctcgttagagaccacatcccacagcccatcacttgcaaggataagaaactcgagtgtgtcatcaacaacttcctctcggatctccggatccacaaccacatattgctttaagagtttgtcaccaaaagcacgcgaaacagcaagtacaccaccaacgcgccatgttcctgcccaatcacaaaacctncacatcttcaaacgctgccgctcatcagtttgatcaggcttgtgatcctttga

SEQ ID NO: 8633 - DNA, 591 bp, Zea mays
  unsure (1)..(591): unsure at all n locations; Clone ID: LIB3279-189-Q1-N6-E7
ttagtcgggcaaggcgccgaaggcacgcacgnnacccgaatttggtggaggttttattggggaatttggggcgaatggcaaaaacacccccncaaaagcacagagatctttagaaccaagagtgcttaaagcgacagacttcaattacaaatgcaaatactagagcagttcagcaagtgatgatggaaggaaacacccaaacattacccaggacacaaacaaaggtttttcaacaccacaacctggctcgacagccaaacagattcatgcaagcagatcagtattcctcctcctcgtcgccgtcatcactgccgccctctgcggcgatctcctcgtagtccttctccagggcggccaggtcctcgcgtgccttggagaactccccctccttcatgccctcgccgacgtaccagtgcacgaacgcgcgcttggcgtacatgaggtcgaacttgctgttgatgcgggagaacacctcgacgacgctggtggagttggagatcatgcacgcggcacgctgcaccttggcgaggtcggcacccggcaccactgttggcgcctggtagttgatgccgcacttgaaccccgtcggca

SEQ ID NO: 8634 - DNA, 573 bp, Zea mays
  Clone ID: LIB3279-189-Q1-N6-E8
gatggggaggacgagtataatacagacacgagacacgacgaacacgaacagcgcgcggcggcagactacgtacaccgtacacgtaccaacagggtgggcgaggacgaggaggctacaagaacacaggcagcagaagaatttcttaccaccacaccacgcacgcaccagctactgcgttacaaatcgtcaagtcctttatttatctaccatgtttcgatgcctttcgtcttgccttgatccggtgatcgacaccgatcgtcgtagcggtagcagtagagcggaccacatgcacacacacgcgcgcgcgcgccattgttggacgggcgaggaataaccgggcgctactgcatggagcactcggcggggaggccctgctggtagcgcttggggtcggtgcagtagttgtagatcatgtacttgcgctgcacccagcgcatccgctgctgcagggtgaggtccagctcctggttgtaccagtccccggcgccggcggcggaggcgggggcgccggtgccctcggtgccgacggtggcgccgcagcgggtccggccgcccgcgacggcgacgcaagcg

SEQ ID NO: 8635 - DNA, 612 bp, Zea mays
  Clone ID: LIB3279-189-Q1-N6-E9
aggaaacaaacggcacagtgcatatatagcatcacagtagatatgcaaatacacagtaataaaggtaacacaacagatccgagaaacatggaaagaaactaagaaagcatgtctcaacacagcaatcacagtagagcgccacttgttcacagcgcatatatgtcatatactaataaatagatgaaaccgtgccatggggccatcaaaatcaggagcctttcaaaaccacctcaattgacaagaatgcaatatgagagtgtcctgaaataatatttaattaattccgtcgcgacaacccaatgacctacccgagcaaacaggcatcactgttgttgctgttgctgctgtgcagctggttgctgttggtaattgggataaccgccataagcgccataaccatacatgttaggatcctggggttgtgcatacccactgccataagcctcataaccttgtccatagcccccatagtagccaccagcaccagcagccgcaccccattgattggattcctgctgaggctgagcctgcttgttcgacaggcttctaccccatgaaagtcgaacattctgtgcaccaatcaaggccccttgcagcattagcagcgcttgt

SEQ ID NO: 8636 - DNA, 606 bp, Zea mays
  Clone ID: LIB3279-189-Q1-N6-F1
cctattccattaggaatgacataaagcaacttgagcgaagcagatacacagccaatcacattgcccgcttacaacctacacatgacaacatcggatccgcctccaaaccctatgccttcttgggggacttggcggccttcttgggcgacttggcctccttgctcccgccgctggacgccttctccgccgtcttcttgggcagcaggaccgggttgatgttgggcaacacgccgccgtgggcgatggtcacgccggtcagcagcttcccgagctcctcgtcgttgcggatcgccagcagcacgtggcgcgggacgatgcgcgtcttcttgttgtccttggcagcgttgccggcgagctccaggacctcagcggcgaggtactccaggacggccgcgaggtagacgggggcaccgctgccgacgcgctgcgcgtagcggcccttcttgaggtagcgcccgatgcggccgacggggaactggagcccggccttcacggacctcgtcaccgacttcttcctcggcccgccggccttgcgaccggccgcttcctttttcggcttccctccagcttcagtgccggtggcgtccatggccgcagttgcgcttt

SEQ ID NO: 8637 - DNA, 501 bp, Zea mays
  Clone ID: LIB3279-189-Q1-N6-F2
agagaaccagggcctatatgtagtatattaaattagttccaatcctaccaacggcagatgcggatgaacgcggctccaatgctacatttgaagtgaaaccatgctacgctgaggatctactcgtatcaactcatgctagccacgggctttggcttttcatcacccttgcactttgtggctacagctggactcctttgttgatgctgcatgactgccaattggtctgtgaaaagtagatcccttaaaaaatggagctgctgccgctttttctccatcagcatttccttttgctcaaaccggcatattttatcttggatttccttcatctggacgtctactatgtttgataaagattgctctatgctgttcctttccttctcgagttgtgcccgtgcattagcagctgcctttttcagtaacacgttggctgagagcccatttgtgtgagaagattcttcttgcttaatgctatttattgaagtttcaatctcgccgtcatta

SEQ ID NO: 8638 - DNA, 448 bp, Zea mays
  Clone ID: LIB3279-189-Q1-N6-F4
ggtggagccacaagatcatagatctactagtttcaggtgggtacagcaccagaaattaagaatttaggcaaacggaaaatggggtccggttcaaccatagacaaagtcccaagaacagataaatttattacaaagaagacactagacaatttgatgggtcaccctgaatcgcacgagtccatacaggcagcagtttgggtcccgctccaggatatggaccatttaagcatcagcataccccagttcggaaagcttgaggggggcctttttgtagtcataaaaaaatgccttctcatttgcagcatatttttccacaaaagggcggaaaacagggtcgctcaacagggctttgtcacttgggagctgaaaaagccctccttggcgccactcaaaagttccttgaagtaagaattgtcaaaaaccaaagggtttggtagaccaggccccc

SEQ ID NO: 8639 - DNA, 639 bp, Zea mays
  Clone ID: LIB3279-189-Q1-N6-F5
aaaatgcagctatccgtgtcataaactacgaagcaattattttggagaaacttccaaagtatactatccggcagctgtttttgccagaggagttccgtgttctcattaggagcattaagcggccctactgaaaacacaagaatgaaatacctgtcactgttcagccactcacatttcgttattccagaaatattcaagtatctaaacaaggtggtcgtgttggatgacgatgtagttgttcaacgtgatctgtctttcttgtggaatattgatatgggagacaaggtaaatggcgctgtcgaactttgtggtctgaaactgggtgagatgaaaaatgtcttgggtaaaacagcatatgatccaaagtcgtgtgcgtggatgtcgggggtgaatttgattaatctggataaatggagggagcataatgtcacagagaactatctgcggctcatgaaaaagttcgaagtcaaggatgagctgtccctgcgagcagcagcatttcctctaagcttgctatccttccaacatctaatataccccctagatgaaaaattgacgctggctggacttggatatgattaccgaatcgatgaagaggttgcgcggagatctgcatcattgcactacaatggcaacatg

SEQ ID NO: 8640 - DNA, 444 bp, Zea mays
  Clone ID: LIB3279-189-Q1-N6-F7
gtagaatacatatatttcgtataaactagcataaaatgtttctgtgtagtacataaaaagtgatttatgagaggcccgattgaagttcatgtcttcagtcagtagcctgtactaggttcatggcgacgtcagaatcaccagggggtataccatgcttctctcgtcctcatctttcaagtcgccattcactgatcaccattccgcctcagagcggtttcaacggcggcgatgtcgtcgaagtccacgctctcacaggcaagtgcgatggcgacatcaccgaccggatcttcttcacatatggcgatggacgccgctgcagaggccggtagcacccgctgctacattgatttgttgtacaccacaagcgtgaggctttggcggctcgcgtgggagagtagatcgacgtcgggcggggttgggtttggcggcggactgcgtttaggc

SEQ ID NO: 8641 - DNA, 512 bp, Zea mays
  Clone ID: LIB3279-189-Q1-N6-F8
acgccaacaagggatagtccataatatataggtaaactcatatagtcatatccctccagccaccatgcaaagcatactggtgcggttcacgcaagcagggcagactgacagggatcagggggcatagtacgccaagaatgtagctgcatgattctcaaatgatgtggtccctgaatgggccttagaacattgcagatgtagcctcagcaacttccgttacaacttggtcatagtctgacttcagtttatccttcacctcgtcactgagctcccccttgtttggtttggtcagaaccaggacgcaacaagttggcctcttagtggttcctgcggtcgcaagatcctcttttgatggaacatatatgtaaggaacattagattcctcacatagtattggaacgtgtgtaatcacatcaataggagaaatatttccagcaatcacacacaaccctttgttcccgcggggaatgctcttgactacctctttgactccgcgcttgaggcacttggcc

SEQ ID NO: 8642 - DNA, 263 bp, Zea mays
  Clone ID: LIB3279-189-Q1-N6-F9
ctagtttggttccacacatgatgatgacgtgaatatactgtgttccaggaaaacaagtgagaaaagaccctgactacatcctacgcaggttcagcaacaggatatgggatatacattagatacagagcatccatgtccattgggaccgataagcaacaaccagattctattaacacacccaacagctagaagtactggactctagggctggtggcgacagcagacaggaagcttctgcgtcctttcggtggacgtggattctc

SEQ ID NO: 8643 - DNA, 352 bp, Zea mays
  Clone ID: LIB3279-189-Q1-N6-G1
ggcgaaacacgctccaaattctgatattatagtattccaaaacgcagatatcacggtacgcaaaaaaaaagcctccatttacaggttgcagcgccaaacacagaacaaagggaatttgattttcgtatcagagtccctcagaaacacaacaaaaccgtcaactgcctaggctaagttgaacgaactattttgacttccaaaccagaataacgggcaagctagcttatcttacaaacttgcactgattgacttcctatctctgattcagttgcggcgcgccaggtgggtgtgttagtcaactccagaaaacactcggtggacattgcattatccttttggtccatgatccttg

SEQ ID NO: 8644 - DNA, 566 bp, Zea mays
  Clone ID: LIB3279-189-Q1-N6-G2
aagatcagaaaccacagcggcaacagcatatactttcttttaacaaaattttgttccatgtaaagtacacaagggcgaaaatgtcaacgaagatgtttacggttttcagcacctccttacgcatttatttttctgcaaaagtcacttgtgaagggctaccctcaaatgtctcattctagatcctcaaaaggatttaactagcctggagagcctcaggtctgcttcttcttggatttgcttctctgcacaaacgaagtgccctccagccactcatcgatgttggcatcagttgttccagttccgagctccaccttgggtgccttctttgttttcttcgagagctgctgaacctggccatatgcccacaatccaaacagaccaagaagtgcaaatccaagggtgatgaggaacacagactcaacactgagtaagcctccagcctcaacaacctcgatagtgccattgtagaatacattctggtaagggtgctggtcgatctcatacactatgtaaccaaccagatcatatgctccaggctgcaagaacttgctcacaacgaacttgta

SEQ ID NO: 8645 - DNA, 532 bp, Zea mays
  Clone ID: LIB3279-189-Q1-N6-G3
ggggccaactggcccgcttaatttggggccaaaaaaaagggggggggtcagggtttaccccaaaaagggaacccaaaaaaatttccctaatttaaaaaagccacaggatggggtttaaaaaaaaaaggccaagggattttttcctttaaattttaaaaaaaaaaaactcctttttgttacaaaacagagatggaacgttccaaaagtggaccacggttccaattgaaaaaaaaaaaaaaaagggtgttggaaaaaaaaagctaaaagaaaaagccttttctacagggctgggttacaacccccgccaattatagggtccttgaacagggccccccaaaagatgggccccgagaaataaaaagaataccccaaacacatttttgggggggggacacagggaaactattggatccggagtttggtccccaaccaaaaaaaataaatcctaaaactgggacaccttaggtgccaaaggtggacacaccgggcatttttttttttaagggagcttaaaatttttaccttggggggg

SEQ ID NO: 8646 - DNA, 476 bp, Zea mays
  Clone ID: LIB3279-189-Q1-N6-G4
tttttttttttttttttttttttttttttttttttttttttttttttttttttttttttttttttttttttttttttttttttttttttttttttttttttttttttttttttttttttttttttttttttggggtggtttttttagagaaaaaaaaaaaaaaaattgggggttttttttggaaaaaaaaaaaaaaaaagagggggggtatggggggagagaaaaaaaacggcccaaaaaaaaaaaaaaattttaaaaaaaccccggagaaaaaaaaaacccctttttttttttttggggggagggggggggcccccaaataaaaaaaaagggggccgcgaaagaggccaaaaaaaccaaaagcggggggagggtggggggggggggcccctaaacacgaaaaagagagaagagcaccaaaaaagggttggaaggagaaaaaaaacagaaccaccctcttataaaaaggggggtgg

SEQ ID NO: 8647 - DNA, 544 bp, Zea mays
  Clone ID: LIB3279-189-Q1-N6-G5
gccaacaactgaacaccttgttaccatttgccaatcaccaggggtaatctcgaaacaaatctgcaagtaagtataaaggtattcacatatatagagcccatggccgcccgctgcatcccaatcccaatcccaatccgagtcaaagtcaaatataaccacacgtttcctgcgcgaaaccaacctgagacgccgaggtgtcgaaaacgaccctcaggttcttctgctggtagttgccgatgatggaggtctcgtcctcggatttcagggaggccacggccaggcacacctgtgaggagtcgctgctgacgaagtaaagcacgccgccggagtccaccttcaccttcgcgccgccgtcgaacacgaaagtcaggctgggcacctggacttccttgagcccggtcatgttgaagcaggtgtcgaggatggagaaccctggcgcctgcgggtactccgcgagctggctcatgaactcggccctgacggcgttgtagaccgacggcacgaggctggtgatcacggtgcccgagtcgacgatcgccctggc

SEQ ID NO: 8648 - DNA, 555 bp, Zea mays
  unsure (1)..(555): unsure at all n locations; Clone ID: LIB3279-189-Q1-N6-G6
aataataccttgggacttggcatatagcaaccacgtgctgaacaaatagttcgccgccaatcatcaaccagatggttaccattttataccaaacaggatgtgacattagtctatccaacaagaaaagctaataacaatttaactacattggccattaggggggattcgacttcaacgcaggctctatgacgatcaattagggggactgcatgtcactcgaagaatgaagaatatcaatcaggatgctgcaaaaaaggaagcggaaggcgaaaaaaacttcgtcgaaggcaacacatgttggcaagtggagatcgcaaagcaaagccaaagtcggctcaacgtagcatttggcctggtcaattcacttcctggcgctcactaacttgggtcctctgaaggcatgataacgggagtaggtgagtcattcagtcatcctcatccatctaacatactgcagttcctgaaccaggagcagcgcacgcagcacggagaccaaacctacgggngagaaacttaccagatgctgcatttgtcagcaaatcaaaccttaccaaa

SEQ ID NO: 8649 - DNA, 558 bp, Zea mays
  Clone ID: LIB3279-189-Q1-N6-G7
ttttaatacaacacaaaaccataaagcatgaactttagtttacacttcctcttattttggccaattgtattcacaaggtatgacgctactgatgaaactgcacaaagtccaccgaattgacaggcgcccttgggggcgtagcagtgagactggaaaggtaacaaatggaatacggatacgtagataaccacggagacccagcaatgctaaggtattgtttggtcactgcataaccgacgatgatgatcacaacgcctcgtgatgcctcgtgccttaacagcaaccagatgatctctgggcccggttgccacccaccacgtccacggtatctggcacatacagttcttcctctggctcattcttcagagcgttcttcacgatacactggaaggcgtcttccacgttcgttccgtccttagcagacgtctcaaagtacgggatgttccctttggaagcacaccatgcctttgcctttttctcagataccacgcgggtgttgccaccatctacatcaactttgttacccaacagaacaaaagggaaattatcagggatctg

SEQ ID NO: 8650 - DNA, 583 bp, Zea mays
  Clone ID: LIB3279-189-Q1-N6-G8
gaaaaaaaaagggctaaggaatggtctaattcaaacgtgacatgacaagcagctatctttgttcggcccaggcgaaatggactatggtgtttcgtcataaaaacgtacatccacgagatggggcaaacacaaaaggcaacgataggacaggacagtcatgatgtacacccggtagggcgcctttgtgtcagtcaggtaagatttttcagcttttgggtcttctgcgtcacaataggaagcttatgggcaataaggttcgggtccgcgtaccctgcaaagtccgaaggatatcctttcgcagacaaagtagcaaatgttgcttccctccagcagcactcacgaagtaccactggcttggctccgtcgccgtttccaaacaggcaatgtaaccgagtgtctctcaacctcatcagtacaccatcaactctaagccaaaaacgcaaaagcagaaaccaaccagttggcattaccctcacatgcacagtaagaaatgagataccattgtcagctaactcatcttcatacaagataacctcgtcgtagaaaagaatgggttcttttgctgaaagggcacaatgtcaat

SEQ ID NO: 8651 - DNA, 606 bp, Zea mays
  unsure (1)..(606): unsure at all n locations; Clone ID: LIB3279-189-Q1-N6-G9
ttatatacacattttttgccctaggttattattaaaataccaattaacaaaggttcanngaataaaaaaacaacagttgtacatcgattaaaaccagttcagctactccagcttcttaacaaatggagaggcgcagaagtatgaacatcagggagattccatcatagctacccgaatctcaaagaaaaggatgggaaaccattccagctaacagcacttacatggtccacggaaaagctgtttgaaccgattcctaatttcagatatccaagtcatcatcgtacatgcctccatctgagactgtatcatcgaaatcatccatgtcatcataatcagcatcatcatcttcagtgaccacatccagcagatcatcatacatatcaacctcaaaatcagagcccgagttggctatgctgctgacgatgtaagcccgatacttgaagtcggagatggagtcgtgaggaagcttcagatatcgtatcctagcgcatttcgatctcagcgcgtcgtccatctgtatgttgtagcattggcgaatgtcaagggattcaaggcgagggcaacggtcaaggattgccacgagtccgtcgttggtcaggttgttac

SEQ ID NO: 8652 - DNA, 451 bp, Zea mays
  Clone ID: LIB3279-189-Q1-N6-H1
gacaacaaaaagaaataggcaagggttcttccattgggcattgcacatacagttgtcccgaaggacccagttctcacttcacattattcacctttggccccgccccggacccctttttttcccgaaagccaggtcatcagatgcctctcctcccctaattgtttgtctcccagcttaaataagcatttgctgagtttccgataaaaattctgaactttaaaccctttttttttttcccaggacgttccgcctataatcttttcaagctttttttccgcgcatccagcttttttttatccacaggaactttggaagccattgggccatcctttttttgtgccgccgcagctcctacagcaggatcaaaaacagtggggttttgatcctgcaaactcttaccaaatgctctggatgcactggagggagataccgccgggggcatcgaaggggt

SEQ ID NO: 8653 - DNA, 535 bp, Zea mays
  Clone ID: LIB3279-189-Q1-N6-H2
attgggaagaaacagtaggctattgatgttgatgccatggtacttcttgtctaaagagcgaagaatccaagtaacaaaccacgcaacaattctcctactagatgcactgttcactcacacacacacacacacacatcacttatccgggacacaaaggtttgttacccgcagttttcaggacactgaactggtacaggtacctctaccacaaattcctgggtgcttattgatgatttaatgagtggttggatgatctgattagagagcagcgatgcactcaatctcaatccgggcattcagtggcagcgccggcacttggtaggttgatcgtgcaggtgctggcgccgggaaatatttgccatagatctcgtttactttattgaaatcctgcagatcagccaacatgatcgttgtcttcacaactgaagaatagctagcagcactagctttcaatatctcgcccatgtttttcataacctgctcagtttgctcctcaacattttcagagataaacttcctggtctcgggattcaag

SEQ ID NO: 8654 - DNA, 614 bp, Zea mays
  Clone ID: LIB3279-189-Q1-N6-H3
ctctgcagtgaaatactgttgaattgttttcatgatgctgatcgaatcgttcagacaggttggagaacataccgcaggccagacgacaagtccggtggccacggagttggctggagccccatcatcccgtacagcttcaaagttccagacggctgggatgaggtttcgacctggtgctttttctgtttctgatgcggaaggaaactaggtgctgtttggttcaaaaaatgtaacgcaaatggtaatggtaatggtttcggctcgattactgacggtaacaaatttgaataggctggtatcaaattatagtgtggtatctgattacggttggactaaaacaaacatgatttaacgttatctgttacccattacgttacaaatatgtgaaccaaacggcaccctagtgtttctcttaccatggctccaacttaggtcccggtgtccattgctgatctgggcggcacggagatcgacctgcgcttcgcaaaccccaaggaaggccggctgttcgtcatcgtggccccagttcgccggttcgcaggtgagctgagacctgaacctgaacaaaatgctcaagaaatgttgtgatatggttcccgtcctacagatgacct

SEQ ID NO: 8655 - DNA, 423 bp, Zea mays
  Clone ID: LIB3279-189-Q1-N6-H4
gaacagaaccattcaatcaagggatcaatttactgagcaccagttcagcaagcatctcgcactcatattatctctttattctctccttaccaaggtcagaaccccagaagcagcaaagtcgacaagtcacgcacccagaacatgaaacgaaggcatacaattacaacacataatactagctactgtcttccacaacgcaacaggtaccctcctatagctccccagcatgtaacttgtgccaagagcacccaccagtcctccacaccaagcatcaacaaataaacatgcgtaatctttcgagtcgccgcaactatccctctaccttctctgttcagcttcggctacttagaaagccagtggtggcagaggcaagctgttgttgagccccgaccgcatcctcctcttcctgagcctctctgcaat

SEQ ID NO: 8656 - DNA, 532 bp, Zea mays
  Clone ID: LIB3279-189-Q1-N6-H5
accaaatagcgtttattcaaacatgttctgataaagaagcaagccatcgatgttcgatggagcctcgtagtacaaggttcgacacgacggtaacaagcatacacgcagggaggggcctatatgtgtaataggaggaacgcgcaggcggcgtactaggcctgcttgcagtacacagccagatagatatgctccacctcagatattatatataataagctggccctgcatgcagggttggtttgctatggacccggcggttgctcagaaaccatgaatcttgatgtgctccttcttcacaatgccggcctggacgaggaaattcgagacgttcttcctctgatcaccctggagctgaatgacctgtccaagttctgggtcctggaccactgtaccattgcagcagaactctttcttgagatctttgaggatcttgctgtagctgaactccttcttcaatccctggacggtggtcaggctcttgcgaccattacgctgctggatgcgcacgtgtacgtagtcctttgaccctgct

SEQ ID NO: 8657 - DNA, 620 bp, Zea mays
  Clone ID: LIB3279-189-Q1-N6-H6
atgtaactctatatgtatattatgttcagggggaaaatccctttacctgacatgattacaaaagtttgatgcatcgtgcatatctttccttcgactactgtcattacagattgatggattatgtatttccttctaccgaacaaactcttcacacgtttgcacatcttactatactacgcttcttatcacacgggttactgagatcgcttccaggatagccgtgtagtactagtctactactcgagtgaaaggtttctaatatcgcgttgctgaccagcaatccctttggctaaccgcgaaggtagtggaagcaagtcagctgggccggcagcagaggatttgctattcagttttggattgaaccacctccttatcgtgaggccattgatcctcatcctcccatgagattcctccccctggtatgaaattcctaatcgcctcaggagagagccaactgcttgaccaattcttccagcaagtttaagtgttttctccttttcatcaatgtcaacttgtttcttttctgtaggtaacaagattgtcacgtttggtaaccttgaacctgcatcattattaagaaatattaaaacagaaaacctaatgtagaatggtacatgagt

SEQ ID NO: 8658 - DNA, 350 bp, Zea mays
  unsure (1)..(350): unsure at all n locations; Clone ID: LIB3279-189-Q1-N6-H7
ctaaacggcccccctttttttttttgtttgttttttaatttttttttttttttttttcttttttttttttttttttttttttaattttttttttttttttgttttttttttttttcttttttttttggcttttgttatctttttttttttttttncatcttttttttgtttgttccggggttctttttttttcctcttttttttacatttttttttgtgatttttttttgtttactttttcttacctttcttttttctaatctcgccatttttctctctttcaattgtttcccattgtttttttgtttgttttttttttttttctcccttttctggtgatttttttgtta

SEQ ID NO: 8659 - DNA, 518 bp, Zea mays
  Clone ID: LIB3279-189-Q1-N6-H8
gggtgtgttgggtttttttttttttttttttttttttttagaaaatgtaaacttcatatgaataaggggtaaaaggaccatagcaccctccacaggggaaaaaataaccaagctatcccattctatctactgactcacttccatttacaaaagtgggggggtgaatatttatttgatcttgtcacagtaatacaagattagaccatccttgcaaatctgcctgggaaacatagttccattgctgccaaaattgagaatatgtcctgcacaaacttagcttccattccagctttgggcatttgccttgtaattgtaccaaactatgaatcaatactccgagcatcaatactattactcaggacatcaaaaatgatgctaggatatggtgtctggctggggctgcatgactgcgaaaaatgtggccttagtccttctgaaaagggtgacaggttccttttgatgattggccgttattattattttttagtcatggatgggttcctttatgcttgttggta

SEQ ID NO: 8660 - DNA, 478 bp, Zea mays
  Clone ID: LIB3279-190-Q1-N6-A2
ggaagcaaataaagcccggccgtaccaaagcctacacaaggagaaacacttactgccactgccggggggtttttaaaggacacggaccttgaccacccgatccaccttgaaacaaacattgggaaaattaaaggagggcagaaccacacacacgccaacgcaacgtttttgatcgccggacacccacacgctgggaccttaggagctggttttgggctcgccgggggggtgcttgggggttttttcacccgagcttttgggggagccgggtattttggccatgatcttgcccaagaagccctttttgccatccgggctgttgacgtcaacctttgcttgcggagccgggggtggcccgtggacggccggggcgggggggggggaaccaactttttccggcttcttggggccaccggggagctttttcttgatcttggccaagagggcctttttttcatcctccggggcctgggggggg

SEQ ID NO: 8661 - DNA, 595 bp, Zea mays
  Clone ID: LIB3279-190-Q1-N6-A3
agacaacccaacgatcatctattcatcttcttagcattatcccacatcacagttcacagagttcaagcaaacaccttcagctactagataccagacactgaacaaaactactctcgtagtccacacctcaaaccagctaacattacaagcatatatatgaacccaacctccacacaccgtcagtgatgacatacatagcagagcaggaggaaacacacgacacggcccacggcgagatccaagctgcggcatagcgcacacgaatccctgaccctgaggcacccacccctatgcacatggcacacacagcacagtaccatgagcgttcgacgtattattattatacatcatatgccacatactaggaaggaaaccatacagatatatctacaatataatatatcacagtagaggtaagacaacccgcgactagattatccccgttcccctcttgatgtcttctccggtcctccctgtctaccgtagatgatgcttgtcaaggagcaaaagcaagtgcgagggtgcggtcagttcacacgtcgaagggaggagggtggctggtcgtccctggtggggtcgccctctcgtatgcgtc

SEQ ID NO: 8662 - DNA, 473 bp, Zea mays
  Clone ID: LIB3279-190-Q1-N6-A4
aaaaaaaacgtactgcacaccctttattgaataataatttacggccaaagtttcccatcgttcgggatcagtacacccccacgggttaacgaatccaaggggatcaataggatcacacacgacgggggaataaaaaaaaaggaccccaaaaaagcttacatattcaaataatgttacaggggtaaaatcaaacagcacgaaaaaccacaaaaaatgggggagacgatttatcaaaaggccgttcctgttcaggctcgtttaaagaagctttttttgttttggcaatgctaaggaggtcaccaaaaagcttgttttcgggcttcgttggtttaaaaggttgccccggggaggggggcgccgtcttagtttggaaaaacaacctcatccccatggacaagttgtcctgcaccgaaaggccatacatgctttgtgacagcccgttcgcaccggggaagccatacatcccctggttg

SEQ ID NO: 8663 - DNA, 562 bp, Zea mays
  Clone ID: LIB3279-190-Q1-N6-A5
acgtctcaatttcactctatcagggtgaacttttcttatcttgaaacgaaaagataggaagtctggtcctatgtctaaacaaaactattacatttagagacacaaaggaaggaaacaaggattaaagatatcgccctcactcagtgtgtctgtgatatatcaaaattgtgatactaacgtatgggtgctagcttcgcaattttagaaaggatatatcacagttacactgaagaaatgactagacaaatagaactactggacctaggacttcatataactttttttcttgatgtcgtgccgcctatggaaccatattgctcatcccctcctgctcctcctgctgctattattactgttgttcttactgttgttgttgttgtcctgcagaaagtcaaggagaacagggctcttgcactgggggcaccgagggtcatcttgtgggagcatgacgtagatgaagcagcgaggacaggcagcaagaaccatggatgtggcctcagggctgttggaccactgcaggccatgctcgttctctgacgataggcaggagcctcgggatgac

SEQ ID NO: 8664 - DNA, 630 bp, Zea mays
  Clone ID: LIB3279-190-Q1-N6-A6
tcctcgcgggggacgacgcgccctggcgcgccaccgctgccaccgccgcggggcaggggatccgacccgtcccgcgcatccaccatgcccccgtcctcagcgttgctacgcaggaagactacgccgcctacgccctcgacatcatgaagcatccgaatccgataggggaggggctggccatggaggcgttcgcggaagccgccgggccggagtgcatcgtgcccggacagcaagcgcctctaaggctcatggggctcaaggtttggccccttgatatagatatgaagttcctagagccatttggacgggagttacattcaatgaaaaaattcatggacaagtcgtgcagtgttatggactcatctatggctaacaagtaggcacatggcacatcagttccgaccaatacggctattgttgtatccatctgcttgctgaagttacaagacccgaaaaataggaaattggaagaagggccatggagggaagccgcagtgttttgcatatattgcccaccttcacctgagagaagatatcgggcgcgcaataatgattagtgagcagtcctgtatggagcctgggtgcagcctctgccagtattaagtgatctacgtgttatacattttttat

SEQ ID NO: 8665 - DNA, 584 bp, Zea mays
  unsure (1)..(584): unsure at all n locations; Clone ID: LIB3279-190-Q1-N6-A7
acaggaaggtcatatagatgtcgattattaactgcagattccattaccatttgaagttcatcacaagatcgtcagtgatcgtcgccatccagggaactgaactttgcaagaccaacagaaaggtaaacgctgcctcagatcaggcagagacggagcaccaccagaaagctactagtactacgactgctctgcaacagaaacgactactgcactccagtaattgaaactactaatacgactagctcatggcaactacgatatggatatggactgcaactacggtatggatatggactgcaactaggagacctgggaggacccatccgatgcacacaccctactcgatcttgatctcgaagacgtccttgcgctcctcgtccttgatcttcgggacggtgaccctgagcacgccgttcttcatgtcagccttgatctggtccatcttgaaagcctgggaggagaggccgatgcggtagctgtaccgcgccgggcccttgtcgtcgtcgccctcgaggtccttgccgggctccccctntgacaccagggcgtgcttctccacccgcatcttcacgtgctccttcccc

SEQ ID NO: 8666 - DNA, 560 bp, Zea mays
  Clone ID: LIB3279-190-Q1-N6-A8
gttgtgggggggtgattcgtcttgtatcatacttaatcgtaggaataaataacctcatttacaactcagtttcgcaaatttgcgctaagaaaattaagcctgcgtgcgccgtgagattcatgcggagtgcagagcaaaaaccacgctactagtgcgcgtggccagccggccgtgagccgcagttcctgcagccgtgccggcgtcggccaactccaagaacagatctacggtaaactctagtactaatcttttttgtacgtacgtatagtgggcacaaattgtgtccgtatgtacgccgtatctatagatacttcacgaggaagaaagaatcggtgtcgtgtcgtgtcgtgtctgcgcgcgcgcgcgccctgccctcagctcgcttctcttcccagcaaattattcacatcctgtgtgcgtgcggcatgccctcccctctccattcctgggcacgccgtcctggtcaccagcttcacgccggacaggtcgccgccgaactcctcgagcatcaccagcaggttgccgctggggttgagcctagagcgcgggacgtggtagta

SEQ ID NO: 8667 - DNA, 346 bp, Zea mays
  Clone ID: LIB3279-190-Q1-N6-A9
gggttgtggttttttttttttttttttttttttttttttttttttttttttttttttttttttttttttttttttttttttttttttttttttttttttttttttttgccccccctttttttttttttttactaaacttttgaaagggggggggggatcctaaaacccctgaacgggacccccctatttacaaggaaaaaacttccaacacccttttcaattaaaaaaattttaaaactttttttttttgccccaaacctttcaaggaacccttttggaaaccttaaatttttaatctttttttttccccccaggtggtttttggggccccacttttttttggccc

SEQ ID NO: 8668 - DNA, 414 bp, Zea mays
  Clone ID: LIB3279-190-Q1-N6-B1
ttatactgtgtgtgagaagcttgacagtcaattcagtggtcaaaagttcagccctttacaacaggtatagattttcaactaattttacaaccttaagcctccggatcatgtaaagaccgaaatccccacgagacgattcagactccagggtagaagcattgtctactcaaacttgtatgttttctggtggttcaaccatccacgaggaaagtcacaactattcagatgttactaggaagcttgcccccgttaatcaatggcaattatgaggaaaccaactgagatatacatgaggaagacaggatatagggccagagcttttctccttgggttaacagcagcactcatgaatggataggcagcccaggagctccatgccaatgtgattgtcaccacgacaatcttaagtatcac

SEQ ID NO: 8669 - DNA, 446 bp, Zea mays
  Clone ID: LIB3279-190-Q1-N6-B4
atgtttccaaacatgcccttaacgttctaccgcaaagaaaaacgtctggagcaacgtcaagacaccccgggttccggccattacgcttctacttacagtgatcagcatactgctcaagggcatggtggtggcactacaaaaccaactgtgtacagcacccaaaggttccttcatgccgttagatcatcagatgaaaaaagattatcatttcctagaacgctgcttgacgtcaaactggtagtcatcatcgaggtcatcaacatcatcttcgatttcgtcaagaatcgattggttaatcttctttctagacaccctcctgtgcttcttgagttcaagacgaggctctgcttgcttcacccccatgacacctgttttgtacctgacatcaccttctctttttgttccaaatgtccgtagctggatttcttctctaattttgatctcat

SEQ ID NO: 8670 - DNA, 225 bp, Zea mays
  Clone ID: LIB3279-190-Q1-N6-B7
aattaaaaaaaaaaaggggggggggggggggaaaagaggaaaggagggggggggaggggaagggaggggggggaggaggagagagaagggggggggggaggggtgagaaaaaaaaaagaaaaggggggggagaggaaaaaaattgaaaagataaatggggtggttagggggtattatacacagtttcatagacacttcaagaaaaaaagggcctccgccacattt

SEQ ID NO: 8671 - DNA, 523 bp, Zea mays
  Clone ID: LIB3279-190-Q1-N6-C1
agtcacaacgaccattatcgatacgatgccgcagtgatatttcacagccagacatcccaacaacgatacatataacagtccagttcgttcaaatctgttcctatggtacaaatgccatagctcatcttcacaccccccatcacaagcgaccatttcgcctgggcacaggcccccatggcaagatcaagaaattcacgtcgctcaggacgaacatacccaccccagcttttatgctaccttcagttattcgcacgctggcttggtgtcgaagctggtcaggcagatcgcgaaggcctggaacgccgagagcgggtaccggtagtccatggtgaatatatccttcccgatcttcccgaactggaggatcaccttctcctgctccgctgcggggacgtttagggaagggtcaaccgacgcgacgagctggaagttcttcaccgacgcgacggtgacgcgcccccggaagttgaggcaccagcactgcagctgctcgtgccagcgcggggctttgttcttcagaact

SEQ ID NO: 8672 - DNA, 484 bp, Zea mays
  Clone ID: LIB3279-190-Q1-N6-C2
ccacacagaaccaatggtttttagcacagcaggctgacagccaagggttacagtacataatcagacggggcaacacgaacgaagcagccgcatcagcagcagcctagaacccattaattgacacacagcgtatatatatatatatgtagtacttgtcttttagctgagcagagcatatgcttctgctgcttactagttcttgaggtgggggaagcactggtagaggtcgttcttgggatgcctcgcctccgcatgttctttgcacttggcctcggaggtggtgcaaatgaaggtctgcatgcagatcttgcactggatgttcatggccttcttgttggcctccagctggctgcctttgccgcccttgttcttctcggcgttcctctcgcgcgccatcttggacttctgggcgttgccgccgcccatggccgctgaatcctgcgatggaagaggcgaagatagagacgaaaggagcgggggcgtg

SEQ ID NO: 8673 - DNA, 591 bp, Zea mays
  Clone ID: LIB3279-190-Q1-N6-C3
cgagaaacgcggcaccaaccaaccttatagtagtcaaaagattccaataaacacttttgagttacataaatacatatcagggatacggctgtcacaacattacacacaagggaaatactatcaatgaagaatggtgtggtctctcaagttaagcatgtacgtaccatttattgaaacctcagtttgggtcactagtgcctctattcctacctcttctaatctctcctttcttttccccaacacaacccattctaaagcctacatagttcacgtctaaatacgcaatgcatgcatgatcgcatagaaaggtcctcaggaagatggcacgagaagtcgagaactatgtttcctactacattgtgtacactgtcagtgatctcagcagaccggcataatcctgtcgggcccaatgcatgcagtatcgcgtattatgattaatcctcgagcacgggaactattgcagatgacagctcaatatgcgacatacgaactgccccaatcagcctttctgggagctcgtcgtatgtattagcctggacaaggaaagccatatcgacaactagtgtcgttatgacaccgcacacaagcccc

SEQ ID NO: 8674 - DNA, 564 bp, Zea mays
  Clone ID: LIB3279-190-Q1-N6-C4
ataagatcacgcatcacttttccaagttcagcatatctatcattagtccattattttatatatgtataataagggtaagaaacttagcagctatagcaccactatacacaattgcagcttcaaccttgcattataaagcatccattgcactgagaatctgggagcaccggcaactggattccgcgttcttaaaacgggcaccagtgggtggagcaactaactgaactggacagacgaaactgtcactactgcaagctcctcctgcgcttctctctgggagaaactgaggcggtggactccgccacgtcctccacacctgccacagacactgactgcatctgcactgagatcagctgaggccgaagggcaccaggtccaggcggggaagcagagacgccaggcgtgttggacctcctgtgcagatgcaggcagtgggcagcagggtcttgacagccctggtgctcattgctaccgcccctgctgttgccttgagcactgcctgtaagggctgcagacagcgtcttcccgaagttctctgagctgctggttgcaccacgtctgctc

SEQ ID NO: 8675 - DNA, 619 bp, Zea mays
  unsure (1)..(619): unsure at all n locations; Clone ID: LIB3279-190-Q1-N6-C5
gaaacccaatgctggaaaactgcacagcaatgtctaagcaaatgcagttgggttcagaaagaaactgccggaaaatgagtatctacaatgtcaaaccaaaaagaaaaagaaaaaaccctcactgcatggatgaaacaggccagattgcataacccggtgcatgaaagggaaataacaccatataatgtcgtacaaggcaacggagtaccagtggtccttcactaccgtccattctcaggaggtaaggttgtcttgctcactatgcccttgctaaaatagtctgcaatgacagagaaaccgtccttggaacccctcaactgcctgaaaaagagatcatggtccctggcgttttgctctagcttctgctttgcctccatgacggatctgtattcaggcgcgcattctgggcattctttttcgttgtcaccaaggcagcgaaggtggaacgagtgcatgcacaggaaatggacagcaggtagatcaagggtngaaagtgcacgcgctacacttgctcagttggaaaacttcgcgttcgtcttgagatcttgtatctcccttttcatcaactctgtctctgcctgatacttatcaatggattntctatcatcttcaatagctt

SEQ ID NO: 8676 - DNA, 478 bp, Zea mays
  Clone ID: LIB3279-190-Q1-N6-C6
ataaaattacccaataaacgaacgcggtgaatggaagaatttatttgcacatgtcaccctactagctatagacactgggccatcaaggccacactgactgacgcgctgaatgcacgaactaatcacggcagacaaggcgttcagtagggctagacatgactaatgaatagactgatccctcctaaagcatcttgggtggccccaatacatgactctcgtgcacaaaagtctatgccttgatgctgtgaccctgattgattggaaggttcacgcctgccctcaccttgaccatatggtaatagcatttggctgcctaacatgagcacgcattacatatgccacacaacacataagccgccataatagagcgctaatgcaatctcgctctaatgattgagctataaaacaaaacaaatattggatttacaaacgcgctatagctagttctctacgcttcgtacgcgttggctgacacaat

SEQ ID NO: 8677 - DNA, 405 bp, Zea mays
  Clone ID: LIB3279-190-Q1-N6-C7
ggggagggatttaaaaaaaaaaaaagggggggaaaaaaaaaggaaaaaaagagaagggggggaaaacaaaaaaaacccctgactggggaggggcaaaatttttgggggaaaatttaaaaagggggggggggttttttttttaataaaaaaaatggggggggaaaaggtttttgggggggggaaaaattaaccgggggggggaaaaaaaaagggttttttcctccggaagttttggggggggggaatcaattttttttttggaaaacaaaaaaagggggggggctggaacaattttcaattaaccaccacgggaggtaacggggaacctgggggggaaaaacgggggtcttttgggactaatttattttttcccgaaaaaattaacaacactggccggacgcgggg

SEQ ID NO: 8678 - DNA, 572 bp, Zea mays
  Clone ID: LIB3279-190-Q1-N6-C8
cttgtggttggggttttttttttttttttttttttttttttttttttttttttttttttttttttttttttttttttttttttttttttttttttttttttttttttttttccaaaaaaaaaaaacttacccccccattaggagaaaaaaggaaaaaggcaaaaaattaaccccatgggaaaaggaacccccaccaaaaaaacagaacaaaaaaaaatcggccccggccccacaaagaaaaaacaaaacccaaaacacccaaaaccccccggcaacaaaatgaaaaaaaagggaaaaaatttaaaaaacaaaacaggccccaccggaaaaacaccggaaaaaaggagaaaacaaaaaaaacacccaaggccaacgggggaaccccccagcccgaagggcgggggttaaaaaaaaaaaaaaccgggccggggggggggaaaaaaaccaaagggaatgggcccccaggcagggggggaagccaaccaacccaaaaggcaaacttttaaagggggccgcagaccccggccttggcccggaaagggggggcctaaaaacggcgggggggggggggg

SEQ ID NO: 8679 - DNA, 579 bp, Zea mays
  Clone ID: LIB3279-190-Q1-N6-C9
aatgtgaatcacagcaaagaaattgcataaaagcatttccatgtccaaaattacaacatgaacaaatcgacagattccgcagggccctcttacgattaacatgccacttaacgtaacacttaacattcttaaaatgtttcttttcgccatttcagtttccttccctggaggtaaactagaacatcactgacaatggacacgttcagtaaggtcggtatcgccaatccgatcttgatcggctgcttccgctgctggggccatagccataattgtaatctagaccgccacagaacctgccgaaagatctcattgaaccataagctccgtaaagatccattggatcaatgtacccaccagcagctgaatcattctcaagtggtgccgctgtgtctattgcaacctcatggcctagaatttcatggcttctacgagctactcgttctgccacaccatcatcagcgaaggtgacaaacccaaaacctcggtggccgcttcttttggggtcctttggaatatatgcatctacgattcgaccaaatctgccaaagtactgccttagatcatctgtgtttgcttctt

SEQ ID NO: 8680 - DNA, 371 bp, Zea mays
  Clone ID: LIB3279-190-Q1-N6-D1
tttacactaaccactgcaatctgcaaatcacataaaccaccacaggaattggtcacagtgacgaatatttacaaaactgagtcttttcagtccataaaaattaaacagtactgctcagtgaaaaccccaaacacgatgctgccaagcatgaagcacaagcatgtctccattgcttgattgatggaactaaaaacatgatcggaaggaaactgaaacaagcaatggagaacctttgctgtttcaagcattgctgggtgataaacataaggttagacagctgtggctgaagcaacgggtgtccctaggctttcgccaatagctggacgaaggccctagtctgagacaggatcagcagaggcaggagtttcccc

SEQ ID NO: 8681 - DNA, 389 bp, Zea mays
  Clone ID: LIB3279-190-Q1-N6-D4
ggggggggcctttttaaccccttttattttttccaagggggaaaaacatcccgggttttgggcagaggccccgaagtttaaaaccccaaatttaaaaaaggggggggcgaaaaaaaaggatttggggtttttaaaaaaaaaaagcggggccaaaaaaaaagcttttggggacaaaacggtggggtttacccgggggggcccgtaaaaaaaaaacgaatcccaaagggggcacccctttttaggggggggagataaaaccctttccttggggggggggggggggctttttttaaaacttttacgggggggtgggggaacttttcaggggagcttaaaatttttttggctcggccccccacattttccttatttttcgccccttgggaaaa

SEQ ID NO: 8682 - DNA, 543 bp, Zea mays
  Clone ID: LIB3279-190-Q1-N6-D7
gagcacgttcaaccaaaaattataaggcaaagttaacacatcacagccttgtttcgctacaaatcacatagccacaagtctctaaacaaaataaggacagcctactaacatcgacaatctttccagactcgcttggatctcccatgcttcaccttcatggactcgaatggacctgcgactcacttggccaccatgcttctccttcatggactcagatggacctgcaactcatttggccccatgcttcgccttggagtgagcctgcatagccatctcactattgaatgtcttgctgcatgatttgcaagggactgacccaccagattttggagacttctccgatgatttgtcattgtttgcaggggtcttgccttttgctgggtgtggagttgccacatgggtggcacccttcttgccacctgttttctgggctggcggtgtggcaacctttgctttcttatcaaaaagaggcgttttcagagcattttcagcacctctcttcttgcctgcctctggctttttaggagttggggtttcttcctc

SEQ ID NO: 8683 - DNA, 561 bp, Zea mays
  unsure (1)..(561): unsure at all n locations; Clone ID: LIB3279-190-Q1-N6-E1
gcagcaccaagaagcaccatttttttccttaggatttaacttagaataaagcctgacgggggtaacagcacccatcgatccgcagtccatgctggttgatgcatgggtctgctggagccgaggatgaacacagcactaacaactgacacagagcgaccttcaatcaaaaacacagatgggcaacaacaaacacgagacgaacgaagataaacactctggactagggtaaacaacacggtagcgaacaggataacttggccgcgcgggccccaccgctcagttcctccagttcccgtcggagttgccgtagccgccgccacggttgccaccgccgtagccgccgccaccaccaccgtagccgccgccgtcaccaccgtagccgccgccaccgccgtagccgccgccgccatcacggcgcccgccaccgccgtagccgccgcctccacgggcaccaccgtacccggcgtcggcggcgncttcacggncggcgcgggactgggccttgttgacggtgatgttgcgggcgtccagctccttgccgttcatgccctcgatggcgtt

SEQ ID NO: 8684 - DNA, 380 bp, Zea mays
  Clone ID: LIB3279-190-Q1-N6-E2
caagcaactgggcaaccaaaatgaacgttatgactttgctaaaagccttagcggtctttaaagaccactccagtgggacgagtgaaaaaaaggctggtattacgcagggtctgcaccaagggcaaacggggccggctaacgacgttcatcataaactcctttacctatctcatcaaaaaaaacgcacagacctttgtctccatcttcgttaccaggttcaatcaacctgctctttatccagcccaccgttcatggcgcttgaatcttaaaacttgtcataaaatgttttttccattaggcccaaaaggtttggactttacggcatgaataagatcctgaacactgttaaagtcaaagtgtgggcttaatactaacttttc

SEQ ID NO: 8685 - DNA, 596 bp, Zea mays
  unsure (1)..(596): unsure at all n locations; Clone ID: LIB3279-190-Q1-N6-E3
gacaagaacaaagattattattntcgaacttccatagaggtcattgcaccaagaagcatgcgatacaaaatagcacccaaaacactcgaaattctaccttcttattttagggcctattttaccatgaaaactcaaatcatgtagttgtattactcaaagtgcatatttaaaagcattctttgatacgataagctatatgtgatttatttagtagtggttgttctcccagaattgagcctggagccaatcaattgtccccttctccacctggaaagcctttgccaagacatcatccgaaatcggtggctttgatccgaagaccgcattggcgatggtaataaccccagggttctggctgctgagcgccgcgatagcaacggccggcttgttatagaccgggttgaattggaaatggatgagaccttgggggaatacgaacacatcacccttgttgagcaccttggcaaatagcttgtttgggttggaggtgacaaacccgacgtagagtgtcccctcaagaaccgtgaggatctccgtggcacgtgggtgggtgtgcggcgggttctcgcccaatggcgcgtagtcgatacgtgcca

SEQ ID NO: 8686 - DNA, 267 bp, Zea mays
  Clone ID: LIB3279-190-Q1-N6-E4
ggtctaatgagagtctgtattaaaaaacagttccggcatttgatattactgttgaaagaagtggtactggtcttccattccatcacaaagaattgtgacaatttaaactatgtaggaacaaaggaggagaaaatagagcagcagaaacaggttagacgccttgccattttccagagcaggcccttatgccattacagctttaacgtcttcctcaatctgttttagctctatcaaccttgctgcccatgcccgctctcttgccacagc

SEQ ID NO: 8687 - DNA, 572 bp, Zea mays
  Clone ID: LIB3279-190-Q1-N6-E5
gatatctgaagcacatacatttaggtttttcgataagaaaagcacatacattagtttggcagtacctgtagcgccttaagcaaaggcaaggtgatacacgatttaactgtcaatcattttaaaacaaaaagatgtggattggtgatcttgacagaagcctggacttctcaagaaacaactgcaaaaatctgacgtgcccttggtgcggttgctttgtgtacaagaattttcccaagttccaagtgtaccttcttgacctcacacagtaccctaatttgatctggttcttccgatagcccaaacatcagattcaggtacacctcttgcataaaatggagttttcttccagatgtatctcttctaaaatttattttgtttgccaaaatgacatcatcaaaatcacacagttccgtatagtggcatataggaatgtccacagcttattcgagaattttctctccagttgaaaagacattccaaaccaccgttcctactatgtacaacacaacagacaccttaaacacactatcccaagaacctttctgaagaatgtagccagtggcagcagtacc

SEQ ID NO: 8688 - DNA, 458 bp, Zea mays
  unsure (1)..(458): unsure at all n locations; Clone ID: LIB3279-190-Q1-N6-E6
gtaaaaaaagcaaacaaaaaagacatactgtttatagatagctcctgactaatgtcgtcgtcatcaggacacacaatgttacgacttaaacaagagaatcagatcaactagcaaaacacagcatgcaccaagcattcaacagggcaagtgccaaatgacaaaaaaacatcgactaagcggccacagccaatgcgagaatacaagtccaagattatggtatcccaacatgttcctgtaattgattccccctcagctatttctccgtcgaatcgtggttctgtgaagtagcgtccacatctgacagcgccatctcagcatatctctgcgccgcagatcgaatggaatgttctattttttcaagaaaatccgattgacaacgtgcaatggtagtgcataggcaggatccaaaggcttcaccccggggtactccattaatgaaagccctgcgnacgcgtggg

SEQ ID NO: 8689 - DNA, 382 bp, Zea mays
  Clone ID: LIB3279-190-Q1-N6-E7
atggtgaggtgccatatacgatatatatactgtctcagctgaagggtggccagccaattacagatctgtaggactgtaatgctattggtactaccagtattaggataaggataatgaaagacagctcgacttgcgaagctatgtggatgtgtgatccaccatgtaccagacgggcgaggcgccgtcatgcatggggtacagccgtacaggtgagacccgcaatccatcactggaaggagatggccatctgggccatgaagaggttgatgacgtccaggtagagggagatggctgccaccacgtactggttgtaggcgtggcgcttcagcagcttgttggtgtcatagacgatgaagcccgagaacaccacggtggccaggac

SEQ ID NO: 8690 - DNA, 591 bp, Zea mays
  Clone ID: LIB3279-190-Q1-N6-E8
gaatctacaagactacaactagtaaaaccgacccatgtttccaagttgtgcaacttggggaagggcaatcaatctacaatactacaactagtgacccgacccatatttcgaggagtcgggcttactcaggttgaagatgaaacgagacagcatcacatcacatgtgatggtgctcaagacatatattcccatcacactgcatggcgcatgcacagatttgccaggctgccaaaagaacctaacctactaggctactaccggactaacaacaggtagcgttttacaatacacagcactatttcacatatcgttgcctctccgcctgctgccagaggtctgaactccaaagcatcgccccgtgtcagaggcgtgctgcccgcgtcacccaatggtggcgtgtatccggctcccaactagcatatcatcgctttcatggtcagatgcttcatcaaatttggcaattgcatcaagcaatgactgctcttggcctataagcagttcctttgccctttcaattgcatacacatctggccgggataataccctctccacctttttcacaagaatttcagtatcaggtatgtcagtacg

SEQ ID NO: 8691 - DNA, 570 bp, Zea mays
  Clone ID: LIB3279-190-Q1-N6-E9
ctagccaatgtatatctggatgcatagcaaaaaaccatgtacataagaaagccaaaacgtcttaaaattcggaatggagattgtagtttgcaaggaaaccactcatcataaacattcaaatcacaggaggtgatggtataaaaccacaacagtaagtttaaagctcctcaggatggcaccatatgatgatccttgcagctagacatttaccaataccttttatttatttctggccaccaggatttgattgattttgtatctgcttaagcagggttgctgccagttgcagtgttgcttgaaggcgtttttgaggatctccatcaaggtcctgagccagtagttgttggctagattgctggctagaaggatctaaaggctgcactgtgacagcacttgatgtttgctgctgaaagggtggaggaccttcaggaagtggaggaatgaacggtctcattggcatggaagaatgagctgggttgaccaaagcatgactgggcagcataggcgaagtgctgttacaaagtacaggagcactggtcggcacattgaatggatttgcaggtagcgagc

SEQ ID NO: 8692 - DNA, 545 bp, Zea mays
  unsure (1)..(545): unsure at all n locations; Clone ID: LIB3279-190-Q1-N6-F1
gatggataaatgacgggttcttttgaagatggggaacagaatcctgttcttttaaataaaatcttgtgcacttccaaggactgcttgctatctacatcctttcccaaagggagtatacgaaaacgacacctttgctatcccaaaaaaatcttcaggtggcaggtgctctgaaaagaaattcgatctgatgatgacaacttatgttctcattggtccatccacaaagttaagcgcgccggcgacgacacattgctcagtacagtcggtcacaacaggaacaacttcactcactcctttttgacaaatctaattccgatttatataacagaagggaaaaaagtaaagcttcctaaggtgtgcagagattcttcaggtcttcttccttggcgtaggtattcgggatgagccttgaggcgtagggatacagatccttgtacgaatttctgatggtgccttctgcccaccagtagccaagnatatatctttaagtggcttcttgtcctctgagagttgggttatcatgtaaatgacggcggctgcaattg

SEQ ID NO: 8693 - DNA, 598 bp, Zea mays
  Clone ID: LIB3279-190-Q1-N6-F3
gactaataattttttagatagatttaatgtcttaaaaatatttatttgggaacagcagagtacgtagcgtagatagtacattagtacatcaagacacctactagtagctatttaaacgatggccattatcataattcccatgccaaagccgattattttttaacccaaacaaacttactggcttgacttagctgataacaaatcagcaatgcaagccgcacggacgaccagatagttgagcgtgagcatgcatgactttattcggagctgttcaccacccggcagttccggcggacctcgccgctggtgccgacgcccggtgcaagcctccccatccgcagcatggactccgcgaagtcctggaagaatacggaggcgtcgaaggcgtaggtggcgacgaggctggcgacgtccgcctctaccccaggcacggcagccgacgacgccagtgcctggtctgacggcagcagaccgtcgccagagagcaggttgatgtagtactggttgtcgaaggtcgccggggtggcgaggtccaggtgtgccagcatggaccagccgacccgtgcacagctgctgagcgactgaagaagtgaggtct

SEQ ID NO: 8694 - DNA, 61 bp, Zea mays
  Clone ID: LIB3279-190-Q1-N6-F4
attatgttgtttttttttatttaaagataaaaaaggggggaggggaataaaaaaatggggg

SEQ ID NO: 8695 - DNA, 325 bp, Zea mays
  Clone ID: LIB3279-190-Q1-N6-F6
gggaacagaatacattaaatacacacgggcacatcatcattgtcctagtttacctcgtttttattatagattcagcgcaaccaatctactaacacaaccctaagtccatgacaactctgaatagcctgaccatgcaaaagcccaaacacagcagattcgatcccagggcactggaacacgcattattacaaggcaggatgcaattgcagagtttatttcagattcttgttgaaccagtcgagcatgtccgcaaaggcttcctcagcactcttcacggcagctgcgtcgtcgtggttgtatccggacgcgtgggcggacgcgtggg

SEQ ID NO: 8696 - DNA, 429 bp, Zea mays
  unsure (1)..(429): unsure at all n locations; Clone ID: LIB3279-190-Q1-N6-F7
ggtgttgggtggttttttttttttttttttttttttttttttttttttttttttttttttttttttttttttttttttttttttttttttttttgggaaaaacgggggggcaggccaaaaaagggcttttttttaatccccccctaaaggggggggggggggagcttttaaccgggaaaaaacccaagggggaaaactttggggggtttggaaaaaaagaaaccctttaggaaaaagaggggaacgttaaaaggttggtcccaaaaaaaaaaatcagggggggggccttctttaaaaaaaaaaagggaaaaaagggcttgagggaattgagggtaattttaaatttcgggggggtaaggaaaacacagaantggaggggtttgtttaaacccaaatgaattgggagggcgttaatttcacgggggaaaa

SEQ ID NO: 8697 - DNA, 206 bp, Zea mays
  Clone ID: LIB3279-190-Q1-N6-F9
ggaaaaaaacggtcatgtttataagttcccccaaaggaaaaaaaagcaaacataaatctgggaaaaagaggggggggggcaaaatgcaaagctcccttcagtccaaacaggggtcaacgaaggggacgaggcagctcctcgggcatgcaaaccacaagcccatttaaagcatttttcgctctttcacaaacttttttttttttgat

SEQ ID NO: 8698 - DNA, 555 bp, Zea mays
  Clone ID: LIB3279-190-Q1-N6-G1
cgaaaactcccaaatgactaaaattttagtaacacaatggttttaggatctaccaggtttgttacacccgaacacattatttccaaaaccaaattatcacacaagatccaaaaagggctaaggcatgaaaccataagccaaatatatagttttttgagtaaagggcatttccggtcccttaacttgcgccggtgtgtcagcccggtccataaagttttaaaatgtgtcttttaaagtcttaatcgctgttcgggtctttgttaggtccaaaacggttcaaaacaaatccggtagcaggtttttcagtcttcttccttggcctacctgtcatttccttcttcctccgtccggtagtgtgcgctcggggccactcgtatattcattcagcacatattaaggtcgtcctcaattctagtcttggtctgcaggcccatttcctcttggttccttagcttctcttttatcggggccagagacacaacagctcggtggtactggagactaaccgtccggctgcaggcgcaggcatagcggagcatctgttgctccacctgg

SEQ ID NO: 8699 - DNA, 418 bp, Zea mays
  Clone ID: LIB3279-190-Q1-N6-G2
aaaaaaaaaaaaaagggggggggcccctcggcccccaaacaaggggcaaggggggcccaagggggcgggaagaaaaaaccaaaaacgggggggggggacccccccccttttcccccaaaaaaaaccgggagaaccccaaggtcttagggaaaacctttagccaaaacccaaccaaaggggggtggaattgaacccaaaaaggccgggcccaaagaaaaagccccccaaccccccccccaaaaaaaagggaaaaaagaaaacggcccccccgggaaactaaggcgtaccccttgcggttgggggggaggaggccgaaactcccccacttggggaaaaagggggggcccgggggccccaaaaaaaaaaaaaaaaaggcgcggaacccggccccaaaaagaaccgccccgggcccaagggg

SEQ ID NO: 8700 - DNA, 149 bp, Zea mays
  unsure (1)..(149): unsure at all n locations; Clone ID: LIB3279-190-Q1-N6-G3
gattaatctatggaacttaaattcaatttgtcatatgcattgcatcgtangtgatgttgttacttttgttctacttcttaattgggttggtatttacttatacttagtaattgctaataaaattttgaccaactttaaaagcaatgctc

SEQ ID NO: 8701 - DNA, 605 bp, Zea mays
  unsure (1)..(605): unsure at all n locations; Clone ID: LIB3279-190-Q1-N6-G4
gagatagtaactgaacaaatttttgacattattccaacttcttcaactcatttgaagagatagtaactgaacatgtaggagcatgtattagtattaccaccgcccaatgcatagctgagaaccaatagtacaaatcacctggtctattgcatctgcgtgctacatggctcttggatccgtcccaaatggccagatgtagaccatctcgtcccatccggtgctagcgagcaagccatcgacgaggacgctcatgtcgatgccggcaacgaactccgtgtggtggttgtacctggcgagcagagcatcctcggcgcggtagtcccacatgcagacagtcatgtcgtaggagcatgacatgagcatgccctggcggtgcggcgagaaacggacccgcttaacggcgtagccgtgtccggcgagctgcgcgatgggcgcccgcggcgcgcgcacgtcccagacgcggatggacttgtcgacggaggcggtggcgaggatggaggggtcgtacttgtcccagtcgagcgagagcacctcgtggtcgtgcgcgggcaggatgagcgtgggcgcggggtccccgnccntcccaacgcgcgcggttcggtccc

SEQ ID NO: 8702 - DNA, 646 bp, Zea mays
  unsure (1)..(646): unsure at all n locations; Clone ID: LIB3279-190-Q1-N6-G5
gcgtggatgcagaagtggtcgaaggcgagcttgaagtccggcaggtaggcgcgcactctggcgcggaagacgcggttgaggacgacggtggccaggaagcggagctgctcggacatgggcaggacgagcgggcccagcgtggtgatgttggtgcgcagggcctcgccggcgaccaccatgagctccttggccagggagacgccgacgcaccccgcgtcgtcctcctcctgcgtgacgcagccgaagctctggtcgtgcgcgccgcggtgcgtgcgcaccgtgtggatgagctggtacttggcgcggcggcggtcggcgcggcggttggacagcaggatggccgcgccgccgacgcggaagagcgtgttggtgaccagcatggggcggttgttgcccatgtaggcgttgagagtgatgttctccgtgctcaccaccagcgcgtacgtgtccgagtgcacctggagcaggcgcttggcgaggtcgatggcgatgatgccggcgctgcatcccattccgctgaggttgtggctgacgacgtcgcgccgcatcccgtagcggttggcgatgagcgacgtganagacggcgtggggctgagcaggctggagttgaagatagcacgccgcgtcgccgtcggcacgcgcgcct

SEQ ID NO: 8703 - DNA, 555 bp, Zea mays
  unsure (1)..(555): unsure at all n locations; Clone ID: LIB3279-190-Q1-N6-G6
tttgatccaaacaccctgtaaaataatttcctcaagtaacatttatacaggctattccaacagttaatgctgtatgcttaaaatggactgcaaacatgaaatttgcaggcgctggactgctggagtaaggaagggtggctacagaggtccatccggctccaaagtcgaccacacaaatatgacccagaacaacattcccttgcatgatctgccgggatgaaatgatacagccaaagcattgagtaaaactttgtgtaggctaagttatcgaactttggtgtgttctacaaaacatatatatagacgggcttgtaggatgccagaatctcgcctcaccacactttgtaatcccaatgttcataattgatacgagcaatggccaccacgatgaagacgaataccgtgagcatgaacgacaccttaactgcatcgctgtatccatctggattatcatcatcctctggagtgtggatcagcatgttgattatcttctgaacattctctaggaattcaaatatttttgcctgngcgctttccaggatccacttgaacact

SEQ ID NO: 8704 - DNA, 618 bp, Zea mays
  unsure (1)..(618): unsure at all n locations; Clone ID: LIB3279-190-Q1-N6-G7
gatgcataaaagaccatttttgatactagtagtacttacacaggtttnacatagaaaaagtgccatataacagagatgaggggttttacatggaagattaccgagaacttgctagtgccataccataacaagctcatagaagcagaaatagcaatagcatataaatcgagcatgtctgatactgaaaaagtgtttctacggaagaacagaaagggagcaaaagagagcacctcaggctcacaagagcgagggtgcctataccactaccaaaatagcctgttagcgcatcccacaagtgtggcaaaaccgaacgagagtaatcagatctccccttcagatcgtaggactgcttgctttattctataccttagattgcttagtaatactactgtgtattgggagataagtcttgtcaaacgatcttgaagtgttcaaccatgcagccacaggtggtgcaggatttcagtagtgtcactgaggcaaggaagcaaccccggcaagcgatggtgtgcatacatggtgagcatctgactattgcctcagctccacggcagaccaccatcaactggcatctcagatctaaaacagctcggtgagtcccatgtatctgtatgtcgc

SEQ ID NO: 8705 - DNA, 587 bp, Zea mays
  Clone ID: LIB3279-190-Q1-N6-G8
acggcaaataaatatcattgcatgacatgcgtgtttagtatgatcagttttaaacagatgagtgacgggactgatattgagcaacccaactagctgtatagatcgtcgtcatcagccgcagcacccgcagaagcaaacgggtcggctgcagcagcagcaccagctgtcgccggctgatccgagaagcggaactcactgccaaacccccgggactgctgcaaagtctgggcaaacgcctggtacttgcggatatcagcatcactgacactacgccgagcatacttcatcgactcctcgaagtgaggggccctgatctcggcgatctcatccacttcatcttcctccatcgcctcagggttgtcctttctccgcctttccctctcaatatccttctcaatgttctctctgattgcatatttgcacgcacgctggcaaatttctgtgatatctgctccactgaacccttgcgtgtacttagcaagagcattcaagtccacatccttcgccacaggggacttcctaaggcaggccttgaagatctggagcctagactgctcatcaggcagtggaatgtagatcagctggtc

SEQ ID NO: 8706 - DNA, 598 bp, Zea mays
  Clone ID: LIB3279-190-Q1-N6-G9
ttagacataaagggcataggttctcttattattgattataaactcaagcactgcaaatcgctgcgtagagtactgtatgaagtagagaaggcaggccacgggaatttacacaaactgcatggccaacatacctaccacctatcatcgagctggaacacaaggggtgtgatgtgtagttgcatgttgaagccgaaatgatgcttgttgtagttggccaagctctcgatgccaccagcttgttgtgttgacggtggaataccagacattcctaggccggatccggcgcccatggtccaagagggcagtgccttctcatcggacccatcgccaaggccaccgacgatgccaatatcagctaggttcaccttcttcggtgcagttatgttcagatcaatcaatccccggctcagcgagtctgcccatatgccggacttgacctgaaaattgtctttctttgcgttagccttggaggctgccgcgggtgcttggcctgtccttccaaggttgctacccgaagaaagacgagagggtccttggctgcttcctcggtgctagatacaaatgcaccgaaatcagatgcgtcgatcttgggagctgc

SEQ ID NO: 8707 - DNA, 149 bp, Zea mays
  Clone ID: LIB3279-190-Q1-N6-H1
gaataagggaaatttataagggggggggggttagggggtttttgggggttttaaaaagggaaggggggggggtttggggaaatagaatttagtttaatggggggggataacctgggaaaaggggccttaaaaaaaggggagggaggggg

SEQ ID NO: 8708 - DNA, 644 bp, Zea mays
  Clone ID: LIB3279-190-Q1-N6-H2
aaaaggaacaacaatcaaataagctgatataatgccaaaggaaatcattataaataatataggcatgagataaatttacacatgccttctatgtcatgtcgttccctataagcatccaaaaacaaaagaagtcgtatgaagcccgcaaatcctttataagcatccctctctcagaatatctagggatccagtggactcaaatatcataaatggggcaggaacattctcacccctggtagtgacttcatgatgttcatagtatgcatcagatgaagatattcaatgacataaggtaaaattagcttttgtcaccaccaaacaacgcagcaagacgaccgtagtgtgatacaagaggtccaggaggcggcctccttcgacgttcattgtggcctatgagacgtctgtggtagctctcctttagttggtcaaattcaagtagctggtggaatcgaaaaggatgaggtccacactgaaacacatgagttatccattcttctgaggacattgacaattcatagatccttccattctttcaatcattttcccctgatcctaagagagtagacacctcggcagcagtagcagacgtagacacacgtagtcttccagatgcatgctgaattgctgatgggtgaggactgctg

SEQ ID NO: 8709 - DNA, 462 bp, Zea mays
  Clone ID: LIB3279-190-Q1-N6-H3
agtcgtcttcaacttgaacatgcaagcaacacgacgcaacagcatatccagtgctgacgacgtcttacagaatttattcattcacaaagctgaccatcggattcggatacatgccaaacgtgattgccttgcaacagcgccatgccaatcctagctaggtggatgcctcggccttcttgacggagtgggggggcttggccttgacagagtcgggcttatactgatcgagcctgtttttgagcttctcctgccggtccctctccatcttctggatgtagacgctctacttggagcgctccttcttgatgagcacgcgcccattcccgtcgctgaggaggcgccggccgtccgtcgccgaaacgggcgcacgggcgcacatgctcgcggggagggaagtcatctcggtccgcatcgccatcttgtgctctggtaccgaactcaggtcgaatctggctgtgctgc

SEQ ID NO: 8710 - DNA, 545 bp, Zea mays
  Clone ID: LIB3279-190-Q1-N6-H4
tatccatatggtattagttacccattgatatctctaatctttgcagacaataattcaggaaaggaacaacggtctgtgtagtcaacaaagcacgccatattttgtatggggaacgctggactgctaaaacatacatggccaaagaaacaaatgaacatgtccagaatgagaagaaacaaccaacatccatccatcaatccatggatttgcagacattgccatggtgatgaacgcgtgccatatctcatgcacacggtattaaactaaattaaacaacactaacagagcacaacagcagcagcttgtcatcggtactgttttcaagcctgctcttcaccatcttccacttcgcccctctcttctgcagcagcggccatcagctcatcaaatttgtcgctctttcccaagattatctcaatcttggccttttggaatggactccctcttgattcgtcgtttatttcaacagtagaggtcctaattttctttttaacagcaaatccattgtttttcagaaattttggcacggtcacaactgttgttat

SEQ ID NO: 8711 - DNA, 550 bp, Zea mays
  Clone ID: LIB3279-190-Q1-N6-H5
cttgtaaaaccgcacaagccgcaaatatatacaaatccaccctctgcatatatcttattaagctgtttaataaatgaaacaacacagcatcatatacatagaccggatgcatattcgctacccttattgcaacagcagctagccttcatttctcccatagcactgagccaccggctgagatttcaccgcttctgaaagcatcaacctttgcacggcattgtttctgactcacaactgcgttgctgccttggatgctcatttgttcaggctcaggcaggacccttgaaccatcatgcagcttgcgcactcaaagtgccagttggcagcgacagcccagcgccattgttgttacttgcaggttgcctcgtaacaaagaagcatgcaccgatcacaatgtagcacagcagcagaaggatccccttgaggtagtgtgacgaaccatcctggagggtgaatgctgtcactattactgagacgaagagagagccggtctctatgagcttgaagtcaagatccatttgaatacccgcgatccaagctacaatgacac

SEQ ID NO: 8712 - DNA, 601 bp, Zea mays
  unsure (1)..(601): unsure at all n locations; Clone ID: LIB3279-190-Q1-N6-H6
agggtcggtttggttctaaccgactaaattttagtccatcacatcagataattaaatgctagttaaaagtattaaatataatataactataaataaaacacactgataaagactaaacggcatgattagatgctaggtgagggggttaaataatttaattagtacatgatacgttcattcatgtagtttcagaccaagaggctacgcgtgccggcgttcctcggcggcggggagatggccatggcctatgaacgaggcgacggcgtcgtcgaacatctcctcgacgcccttgaattccgccagccccagcgcgcgggccttggacgtgtcgaagccgtacgactgctcgccgtaggcgcggggcaggctcctcgggacggggtacgctgggaaccgccgcgcgagcagggcggcgaggtcgccgcagtccagcaccgccgcgctgcagatgtacctccctcgggcgcccgcggcctcgtacgccagcatgtggcacctcgccacgtcgtcgatgtggacgtaccccatcctnccgtacgtcgtgaacttccccgtctctccttggaacaggccgaggacatcagaagcggtggggccgagc

SEQ ID NO: 8713 - DNA, 166 bp, Zea mays
  Clone ID: LIB3279-190-Q1-N6-H7
ctctaaagcgcccccctttttttgtgggtgtgtttttaaaaaatttttttttttttttttttttttttttttttttttttttttttttttttttttttattttttttttttttttttttatttttttttttttttttattaaagtgtttttatatttacattaaaa

SEQ ID NO: 8714 - DNA, 603 bp, Zea mays
  Clone ID: LIB3279-190-Q1-N6-H8
ctttgtggttttttttttacgatgtggcttatagcctttaatttatacggatacacgcaaacgcatcgtcaagcaagcagctagtcctgtatgtttcattgcgcgttacattcatataacaaaatcacagacatgtttttcgacacattgacacacgggcgtggatcatatatgtgactgaaacacagctgtcactcttagcttgcatagagtatgatgctgccaccgcatctttatttatttcctttgcctcaagatccatcttcagggtagccatgttggcatgaagttattcatatgctcaggagcgaacccgatctgcagggttggctctgctgcagcttccaggggatgaaagaacaaaccattgccaacatgtgatggggcctgctgttgaggagagtgcctctcgtagccgagtaagttggcaccgtgctcccacacttggccatgcacctggttgctggtctcctccagcttacttctaaggcacttatttgcttcacacagcatttgctccctcctctgaaaatcagtgagctgatcaagcatatgttgtgtccttgtggatcttatgtgccttaaggatgaatcaagttgctc

SEQ ID NO: 8715 - DNA, 376 bp, Zea mays
  unsure (1)..(376): unsure at all n locations; Clone ID: LIB3279-190-Q1-N6-H9
aaaaaaaggggggggggggggggaaaaactancaaaaccgcggaataaaaaattactaaaaaaaaaggggcgacacaacaacccctgttttttaaaaaaaaaaaaaaaaacaccaaaaaaacaacccataacaaaagagagaaaaaaaaaaaaaaaaaaaaacccccacccccccccgcggggaggtttaaaaaacctccacaacctaaccaccctcacccccctccaaaaaaaaaacaaccaacttctagtccctcttctcccccgcccccaccccccaaagagcctaaaaaaacaaaccctccttaccccccccacccgccaaaaaaaaaaaaaaacccctcttggttttcattttggcccccctgttatatct

SEQ ID NO: 8716 - DNA, 621 bp, Zea mays
  Clone ID: LIB3279-191-Q1-N6-A10
gttggcctcctcgaccgcctgctccagcgcgcggcgcaggccggcgttgtccctccgcgcggcggcggcgtcctcctcggcggcgcgcgcgcgcgccacaagtgccttctccctggcgcgccacccggccgcggcgtccttccagttggacgtgagcgcgccgacctgctcggtggcagaccacagctccgcctcggcgccctggagcaggccccggagccggtcggcctcggcgttgctggcctccacctcggcctgcgcgccggagagccacgccttgacctgcttcgcctccacggtgaccgcggacagcgccgcggcgagctcgtcggccgccttccggctccgctcctcggcctgctgcgccgcgcggagcttggccctcagcccgttgatctcctcgtcgacgccgccgaacatgaggtccatgacgctccactgctgcgcctgcgcggccggctcagcagcggcgccgcccttgccctgctgctgctgctgctgctgctgacgcagcgtggcgacctcgagcgaggcctcctcgagcgcgatcttggtctgctccagctccttggtctgctggaccagcgactccagcatcttcatctccgtctgcttcgccga

SEQ ID NO: 8717 - DNA, 459 bp, Zea mays
  Clone ID: LIB3279-191-Q1-N6-A11
gggggcaattatttttagtttacatgaaacagcatgttgggaaagggcatttgggggggaaaaacagagcctgaactgcaacggaacaatgagacaaaaaaaaaagcagaaaggctcacgggagggagcctgaacaaaaaggggcgcccggaataataacaaatgcataaggccgtttgacttaaaaatatagtcatgcgagaagagggtggcacacaaaaccatggaattgacatttattgaaagggattgcaccatttacaggacgccgcagaaaacatggaatacaccggcaaacaagacaggattaaaccaagttgtgaaaagacatggtggggcccggaagggcgaaaagaaacagcactggggcctgggaaaaacacaagagggccaacggagctttaaaggagagggggagtgcgttaagggtgacagcataagggggaaaaaccaccggaa

SEQ ID NO: 8718 - DNA, 364 bp, Zea mays
  Clone ID: LIB3279-191-Q1-N6-A12
cagcaaccaatccataccatcacggggtgcaaccgaaacaagacgaagggatacgacaacaacttaagatgaaggttcaggcacacgacttgccgtgaaatttagagacagcttacaaccccatgcaggacgggaagtttgccacagagaaatcaaccatgcgcacaaagcattgtacggggttcacacatgaaatgacaacggttgtttacgatttatacatatttcgcattatgtttgtgaggataactttggtgagttcaccatatcgtgttttaggttataccttacaggttttttattttagagcctctttttgtagcacattctaccttattttgaaggtctttttttttggtatttt

SEQ ID NO: 8719 - DNA, 604 bp, Zea mays
  unsure (1)..(604): unsure at all n locations; Clone ID: LIB3279-191-Q1-N6-A2
agcaaactgaagtttgtttcgtcgtgttgcaagttttaatcaaatacggcgcggctggaaattacaaccagcaccagctaacctgtcctggtcatctcacttttctcaagtgctatcagtattacttagaataggacaataacatttgagaaatttatatcatccactcagctgctcaactttgttggaatgtaaacaaaacacaactaatgtgaataaaacataacttcatcgccacagatgacttcagtttccgctgatttccttctccttagccttgcacatatcatctgacgactttatgaactttttggtcaattcttcaatctccttctcaatcctctttacgtcatccttgggcatactagatgcagacttctttattgtatcaagtgccttttggcgtgctcttctaatactttgtttaaaatcctccgctgatttagtaacaaccttgcacagtngcctgtatgttctcctttgtcaacggagggatagctgcaataatcctattcccatcaggtgttggattaatgcccaatggtgatgagataatagcatgctcgatcgacttattgaagtaggatcaaaggcatcactgata

SEQ ID NO: 8720 - DNA, 413 bp, Zea mays
  Clone ID: LIB3279-191-Q1-N6-A3
agggggaaaaaaatttttttggaaaggggtttttaaaaaacaaaaaagtgcttttttttttttgaaaaggccccctttctttttgggggaccccagagggaaaaactccccttaaaaatttttatttaataaggccccaaaaaaaaagggattacattttttttggggagaaaaaaaagccattttggggggggggaaaatttatttttgggtttttgggagcagccttttttttataaagaaaaaaaaaaatcttaacaaaaaaaaccacaggggggcggggggggaaaaaaaaaacttgggtggtttacaccagaaaaaaaatttttttttcggggccaattctttattttttgaaaagtgggctggtaataataaaaaatctcccccaaaaaaaaaaaaaaacttttttt

SEQ ID NO: 8721 - DNA, 59 bp, Zea mays
  Clone ID: LIB3279-191-Q1-N6-A5
ccaaaaccactgatcagttaaaaaacgattcacaacagcgggtggttcccacgcgtccg

SEQ ID NO: 8722 - DNA, 472 bp, Zea mays
  Clone ID: LIB3279-191-Q1-N6-A6
atgaaccgcaagtacttgtataacgctgataacgacaccggtacatcacaggcacacacatctcctgcttgttcttattacaggcacgagcatgacgttgccaggactctccctcccggccgccgcccttgtatcagcagtgtgggctggcagcgtcgcgtcgcgtgggcgtggcgcggttcaagcgacggggggcggcttctcgacgtcctcgagcgggcggaaccacaccttctggtccagcaccgtgcctcctgctgcagccgcattcgcggcggcagcgtcagcggcgacgcccagctggttggtgtccaccgccgccgggccgaacacgccggtcttggggtgggggctccagtacttgtcggggctccccgcgccgccgatcacatcgtccggcacgaacgccgggcgcacctgctcctccgggttcttgtcgtacgacgaggcgtgcacggccctcctcggggag

SEQ ID NO: 8723 - DNA, 580 bp, Zea mays
  Clone ID: LIB3279-191-Q1-N6-A7
aacgttgatgggctagtatcttagaaaccggcaccagatctcataaactcctttcacccaaaccaaccactaacgccaatcaacactgccaagtgccaaccaggcaaccacgacagcggcgcaaacaaacgtcagcagcagtcacacatacgcacgcagcttccttatttgcctaacgtaaaatgagagcacaagagctacaaatagatcccgaatcaggacagttcagtcgagaccaacatcattcctgaggtgaactgcacaatgattctacagccgcgagcggccgatccggtcgctgtcggtgatgacgtgtgcgcgggttatctccctcagcgacgtgcagccgctgagcgccatggtgagctccagctcgtccctcagcatctgcagcacctttcgcacgccggcctcgccgtccaccgccagcgagaacagcacgggccggccgatgaacactcctgaagctcccaacgccagggccttgaagacgtccgtgccacggcggacgccgccgtcgaggaacaccggtagccggcctttcgctttcctgacgacctcttccaggcagctgatagtc

SEQ ID NO: 8724 - DNA, 543 bp, Zea mays
  Clone ID: LIB3279-191-Q1-N6-A8
tcgaaattcgaaatcgttgaaggaatgcaaattctacaactccttgtgggggaaaaagagcagtaccaattcaaaatggtggcattcaccgtcctgaactcacgaattcgaattcaccgtcctgcagttgagcctgacctcccccgcggaacccgtgagcgggccgatgttgccgagcctgaccatggacgcggcgaagtccgacgagaaggcgtcggcgttggtgccgtagaggcgcacgagcgagtcgagtgcgccgttgctgaagagctcctggtccgagtgcagcaggccggcgccggccatgaggctccggtagtagccgttgtcgaactggtcgggggtgagcgagtcgagcggcgcgagcgcgtcgtcggcgtcggcccccgaggacgacgggcaggcctggcgctgctgcgcggcgaacgccgggctcacgttgtcgtcgcagtagacgcgggtgcggaagctggcgcagcgcgccatccccaccgtgtgcgcgcccgacagcgccgcgaggtcgcgcgggcccaggcccttggc

SEQ ID NO: 8725 - DNA, 574 bp, Zea mays
  Clone ID: LIB3279-191-Q1-N6-A9
ggcgaccagccaccagtacctgatggcccgttgataacagtagtatacaaatcttgcttcgcaaaacctctgatgccgcaaacctagctgcttcaatggcgatcaaaaccgctagtacctgaaagtctgcactagcatacaaattttgcctcccaatatctttgatgccaccccctaactgcttgaaggtcacaagacttagcagactattccgcctatgctttagctgagttactcgaagctctactgataacaaactttgagctataacataaactgggtcacaaactattatcttctgtatccagatgaaggcctccggttgttacttctgtctaaagcaccataacggttctgtggttgctgtgaccctgaatcagcccttgtgggtggtggcctgcctccgtaggggcctcgcacggcatacgaactatatgattgttgctgccactgctggcctccgccatatggagggggttggtagcctccaccatgaaccccaggatatgctgatggaggttgcccatacaatccaggacccgatggatacatgttgctctgctggtacccatat

SEQ ID NO: 8726 - DNA, 286 bp, Zea mays
  Clone ID: LIB3279-191-Q1-N6-B1
cagaaaggggatttgaattagacaggaagaattacagtgcaccccaattgaaaataaattgagagatcaaattagaggcaacgctacgttggagaaaagtctaacatgccaacattcctacttcaccgtccaatccaatcccatcgaaccagcggttcttacagacccaaagaagcacgactaccggacgacaaagcaaccagctaccacaactgctacaatacgaacacaggaaggcagccaaactagtaccacagatccgagacacctggacaggcaattaccc

SEQ ID NO: 8727 - DNA, 560 bp, Zea mays
  Clone ID: LIB3279-191-Q1-N6-B10
cattagaagaattgcattggctcaaactgtcaaaacctgacatacaatcgtgtcgtaacggtccctgagaaattacaacccttgcggacgacggtacaaggatcgtcctgctgtggcaaaactcgttccttattcgcaagttacgtgttgctgcagcgtttacacaccgcaggaatcaaatccgccagaaataactacacctccagcctactccacaatgctgttgtgatccagaattctacatctacatttggtcccagtcaatagaattgttgttctcaaaattataagaaggttgctgcaaacggttgcggcccaatctgctcattgtggcgaggccttcgatcactttgtaaagtgaagaccaccatcgatcagctgggacctgatactgagttagagattcatcgatttcagtattgtgcttcccttccagtacgctttgcagagtgattacagcatcctttgttctcctcagaatattatttccctcggcagcttctaatgcaaggaggtcactatgtgatgatgtgaggcttctagcaagcgcaaactgggca

SEQ ID NO: 8728 - DNA, 597 bp, Zea mays
  Clone ID: LIB3279-191-Q1-N6-B11
gacaaaatatccacttataacattaggaatttacatgtatgcctgagcaatcctggaaatcatgattttacttgcaacgggaacacatgcaatgtagttacacatcacgctcattctaaataacctggagtcttgaaatccataaacatgagcagagcaaatgaactcgcagtccagtgcattacagttgcttgtacaacaataacaagatagagggaaggggggcaggcatgaagaacttcattttgtagcctgagcaataatgttacttatggagctggcttcctctttagcagcttcgaccaatgaatcctgtgcagcaataagtcttgcaacattcttcttgctagattcttgaagttcaccagcgatgagaatctcatccagtatgtagtaggccttatgaaaattgaatatcaaatccaactcacatacactgccaaaatagcggtccagtatctcgacgaaatgatggatgatctcaaggacttcaagctcattgtcctcggcatcaatgcacatgcagaaatacaggctagcatacctccggtatacgaccttgtaacctctccactcaacaaaattgcagagtttggg

SEQ ID NO: 8729 - DNA, 279 bp, Zea mays
  Clone ID: LIB3279-191-Q1-N6-B12
gcggaaaacagcattgagaaaaatttgaaaagatcgattacgaacactctgaacagattatacggacacgtgcaggtgtgggccgcatcaggtctcgtctcagcctctcatcaggcgcgctctctcagctcgcatccctcttcgatccagcacgcgctgacgccccgtacggcacgtgctcgtggtagggccgtgcgaattccagcgcgcggtacggaaaaagacatgcagtctctcagtatcccagccggcagccggtcagtgtgcctgtggtaggtc

SEQ ID NO: 8730 - DNA, 568 bp, Zea mays
  Clone ID: LIB3279-191-Q1-N6-B2
gaagcattaacacccagcatttttcatatcagaggcctcatgaaggcgaacttttggaacgaaaggaaacggtatgggtaactttaatccactagccgctaatcattatccctccaactaacaccacagcagaaatcaaactaccatgatgctacaccctacctgtttcagtttgatacccaacgatattagccaacgaaaacctgcagtttagagaacctaaaatgagagctctgaaaaatcaggtgatagcttgagcgacatcctcagtccctttcatgcagagactgctgctcttcaggagcttgctcctgctgttcctgaggatcctgccacagatacgtcaccgggtggccttgctgggcgccataaaccatcccaggaccaggcacctgctgctgtggcatgtagtagtatggatatgcgtcagctggggctcccatgggtggcagcccgggcctaggaagcccgattcccgtcgtccttcatctcatccctgggaacaatgtcgaccaagaagtcgtaaatgtcggtcctggtgatggctgcggcaatgtcgttcttctgc

SEQ ID NO: 8731 - DNA, 427 bp, Zea mays
  Clone ID: LIB3279-191-Q1-N6-B3
tttttcagctccggtacacccgatattatacacaaaagagtatattaggctacgacagacgatggtttggaattaagagtaaatacactaggacgatgttcacatccatctttacagccaaagcgcactaggactatactcgatacagcagttgcaatcacaccaagcgagcgggatatctagctcgagggctcagcattttgaagttatttcgtgagggtagggcgaggctctggccggcctctgcgcgattctcagaagtctgggccttgctggaagaactcgaggtctgggtgggtgctcccgcctggaggccgccttggacgcctaacaaagctagatggctcaaaccctgggacgtcaggtgggccaattggatcatagcgaccacctggtggaacactcccaagcccaccaaatggggcag

SEQ ID NO: 8732 - DNA, 227 bp, Zea mays
  Clone ID: LIB3279-191-Q1-N6-B5
gcagagaaccaaatgaaataagtaagcgtcgcatggtttggcgatgatacagccccagaagtatggcgcgaacaagttaccaagcaaaggcacttccttgctagaccacaattggggaattcaatgggtttgccagaaaactcaatgcatgctatggtatggccacaggcagtgcaatatccagcacaaacagccagtactttacacacaccacaacttcaccattc

SEQ ID NO: 8733 - DNA, 578 bp, Zea mays
  Clone ID: LIB3279-191-Q1-N6-B6
agcatgaaacgggaatttcagttctcatagcattatcatgaatctcagaacataacaggtgaaacacgaatcaagcagaggcgccatggggttcacagatccacacctaaaccgctaaattaaactgcgagcgatacatgataaactaagaccaccactcagatcaccaccatcttattcagatccaaaggaacggacgcagggggagtcgacgatgacggagggagggcggccgaacagaccagatcagagagatctaggagagctgtccgcagtcagcgaccttgaccaccttggaggtggagccgttgcgggtgcccaccttctcgatggccttgacgacgtccatgccctcgacgacctggccgaagacgacgtgcttgccgtcgagccaaggggtcgcgacggtgcagatgaagaactgggagccgttggtgttgggcccggcgttggccatggagagcacaccgggggcggtgtgcttgcgcacgaacttctcgtcggggaacttctcgccgtagatggactcgccgccggtgccgttgccgcgggtgaagtcgccgccctggcacatgaac

SEQ ID NO: 8734 - DNA, 609 bp, Zea mays
  unsure (1)..(609): unsure at all n locations; Clone ID: LIB3279-191-Q1-N6-B7
agcacaacccaacaactgagcatcgatatcacaaatttgttccctaacaatttgtttgcggaacaaatgatcatcaatatattaccaaacaaactgcagatcaggtgatgcgagattaaccacaggtccacagccagtgacagcataattcttcctacagagggttcacaaaacactacttcattcccttgcccttccttttaccctttgcagcaccccgcttcttgtcaccccttttcgctctagccttgctcttgaacgttctcttcggtggcttcctcttcacacctaaactgctgttcttcttggcaaaagagctaggattcttgctggtgaggctcgtcgccacggggccgacagttttcgggacaatgtcatcttcttcaggagtaatttcactggtggtgactacagttctggtcccatcatcttcgtaggttttgatttcagacaaaggtttgtcattttccatatcctcaccatcatcgccgatatcttcgttttctaatccagcaccatcatttttatccgatgtcagtactctaccatacagagcaatctccttctcttctttcctcctcttgcggncttgtattttcttcttcctct

SEQ ID NO: 8735 - DNA, 337 bp, Zea mays
  Clone ID: LIB3279-191-Q1-N6-B8
cttcgcctctcgtcatcactcttctgttcctcttcctctccttccacttcttcttcttcctcgtcgtccactatgaagtcatccttctcaaattcatcctgaccgtcctcatcgtcgtcgtcgtcgtcatcgcgctcgtccatatcgtccctgttcctccgcgagggccgcggatcctcctcgtcagcctcgaactcatcttcttcttcatctgaaagaaccgtgcgccccattgttctcgagggatttcaacccggagggtgcgcgtcgccggcggaagtcccgaaggcctcagcaccgagcgtaggacggaggcggcggcggcccagtcgtcggc

SEQ ID NO: 8736 - DNA, 417 bp, Zea mays
  Clone ID: LIB3279-191-Q1-N6-B9
tggcagaaaacaataattccagaacaatgcgtttgcaattacaggattccccgtgaacagtaaaggaatactgctcactatttataggcacaggacacaacctgtaaggaattacaatcataccccttattaaagtttacaacaatgactcagacccttatgtactaaaaagtcattccatctttaagtcggttcgatccttcatcttcgaatacgctataacaccgaagcttcatgagtggtagcttcggcatcacgtataagcagcttttgccaaagctgtttcttcgtgcaggaccttcggcgacgaagcatggtcccaacaccactcaattaaggatagacttggttttcgataggaaaccaagaacttaacaagcaatggacttccggtctcaacaaggagaaagggaaggc

SEQ ID NO: 8737 - DNA, 476 bp, Zea mays
  Clone ID: LIB3279-191-Q1-N6-C1
actcaacagaatcataccctgttgtttctattccagtctagtcacttctatgtccccttatgtacaagagcatctgttcatcgtggccactcatcttcatcgaggacactcagaacggaggccagcattgtctgccacatcttaatggacggtgagttcatgtactgcaagtagccatagccttgcaagtagccatggccttgccctgccaccaggtttgcggtttgggtcgggttccgattcaccgtatgggccatgttggaggatgcctgcaaatcatccagattcatgtcggcgaaccagacgttgtcctccttcaccgtcacgacgccaatgtcagtcctgggggtcatggcctgcccttgcaccatgttgttaccgaagcaattttgtagctcgaagacgttgtcaatgtccgagtcgagcgtctggaaactgttagacatggaattctacgcgctctgccagtgatgctg

SEQ ID NO: 8738 - DNA, 576 bp, Zea mays
  Clone ID: LIB3279-191-Q1-N6-C10
gacaaaaaacattcgtgttttatttattctttccaatgactttacagtatataaggcaacaaatcgaaacataaaatgaatcaaaatccaaggaaaaaaaattgatagtggactggagataattccaaccaaataacgcacacctgtctactgcggggaaaagaaattctgtcactccagttgcaggttattcttctatgttttctgaccatcacacaaagcaaccaggaaggttgttgccaaaaaagaaaaagcaaccaggaaggccacgtgcatctcaagcggagaggatttgatcacaaagcaaggcctgcattccgatatgagaacctgatagacctgtgcactgtggtgcccattacagcagcggttttctcaggcttctcagcgtcgactgtcaccgcaattggtttggagtcagctactttctgttccatggtgctttccgaaaaaaattcaagccccttcactggcttgttttcaggttgagctgaatgtgagagcttcagcttctcactggtttcctggaaaaacctggtgtttattccatcttttaaaccgcctgctacttggcag

SEQ ID NO: 8739 - DNA, 263 bp, Zea mays
  Clone ID: LIB3279-191-Q1-N6-C11
agctatttaaacgatggccattatcataattcccatgccaaagccgattattttttaacccaaacaaacttactggcttgacttagctgataacaaatcagcaatgcaagccgcacggacgaccagatagttgagcgtgagcatgcatgactttattcggagctgttcaccacccggcagatccggtggacctcatcgctggtgccgactcccggtgcaagccttcccatacgtagtatggacttcgttaagtcctgtaataa

SEQ ID NO: 8740 - DNA, 570 bp, Zea mays
  Clone ID: LIB3279-191-Q1-N6-C2
aagaaacacggcatttcctattccattaggaatgacataaagcaacttgagcgaagcagatacacagccaatcacattgcccgcttacaacctacacatgacaacatcggatccgcctccaaaccctatgccttcttgggggacttggcggccttcttgggcgacttggcctccttgctcccgccgctggacgccttctccgccgtcttcttgggcagcaggaccgggttgatgttgggcaacacgccgccgtgggcgatggtcacgccggtcagcagcttcccgagctcctcgtcgttgcggatcgccagcagcacgtggcgcgggacgatgcgcgtcttcttgttgtccttggcagcgttgccggcgagctccaggacctcagcggcgaggtactccaggacggccgcgaggtagacgggggcaccgctgccgacgcgctgcgcgtagcggcccttcttgaggtagcgcccgatgcggccgacggggaactggagcccggccttcacggacctcgtcaccgacttcttcctcggcccgccggccttgcgaccggccgctcccttcttc

SEQ ID NO: 8741 - DNA, 525 bp, Zea mays
  unsure (1)..(525): unsure at all n locations; Clone ID: LIB3279-191-Q1-N6-C3
aaaataatgtttcttgatcaaccatccatcacattttctaatttgtcacatacatgtgtcaaatttaagagttgagttgcaacaaaatatagtgttgtccctcgaaattacacagtttactaatataacaatcagtctctctgtatcatctgtcttatggcacatacctggcagacagaagaatctcaatttgtcaagtctcatggccaatgttgattattgagatgtatttaacagttataggcagtggcggagcttgacaaagatgtgtgttttaaaactggggaggagacatggcctcctttttaagatctgccactggttattacaagcattgaaatgtccaaactttggaatcctgcgttcgatatactgaacagcgatgcattctgttcactccctgtatgaacaagaacaagtaagatgcaacagtttgatccgactacagcagccagccgaattcagagaaggtttttcactcaaaaacttctcatgtgaaacacanaacttttcgtgtagccaaag

SEQ ID NO: 8742 - DNA, 544 bp, Zea mays
  Clone ID: LIB3279-191-Q1-N6-C4
atatattgcaccgctcagatcaactttcagatgacaaacattccatacagtcaaaaggggccacggcgcttaaggacctactcgaaaggggcttaggacgaggtgaacttggtgacggccttggtgccctccgagacggcgtgcttggcgagctcgccgggtagaacgaggcggacggaggtctggatctcccgggaggtgatggtgggctttttgttgtagcgggcgagcttggccgccttgccggcgagctttttaaaaatgtcgttgatgaaggagttcatgatggacatggccttggaggagatgcccatgtccgggtgcacctgcttcagcaccttgaagatgtagatcttgtacgtctccacgctctttttggccttcttccgcccctttttgtcaacaccgcctttcttgccggcggattttcccgccgggagccgcttctccgccttcggcttcttcccagcgggggccttcttcgccggggccgcgggcttcttctctgcgggcttcttcgccgccggcttcttctccgccttgg

SEQ ID NO: 8743 - DNA, 466 bp, Zea mays
  Clone ID: LIB3279-191-Q1-N6-C5
attcaagaatcaagatcacatatatatatatacatataaatgttaggggaagcatagctctaccaatatatattacaaaccgacaattgctcatggtacatctgacaacactgctatgcctgtgatggggcaatgtaccgataatgataacacatttaaggaatagcacgtacaggcagagcagtgaagttaaaagctgcctgatagtctagagtcactagcagcacacgtcgcttccattgaagcaattgaaattagcaggagggatactgttggtagtcaagtcattagaccagattatcttggtttcttgagtgccagataaccttcgccccacaccaaggatcttaagtactgctgcttccagagctccagtccaagaaatctgagatttgataccaccgtcccgcagaagccacacgtttgccaccccattgtcagctttgaagagtgtattattagcaaa

SEQ ID NO: 8744 - DNA, 570 bp, Zea mays
  Clone ID: LIB3279-191-Q1-N6-C6
ctcgaagacttcaacatttcacatttgagtatgaatagaactgctctttagcaggcgctatcgtcagaaattgatgtgctacatagaaatactaatgttcagcccatgctatcgtgcttgatcaacatacaagtctgggtacgctattgcacatccatctgggatcagctcccaaaaaaattgggtggatccatcaaataagattcagataagacctctcctggccgtggaacgtgaaaaataaatctccaaccatggtccagtgttattgcccaaataaactagaaatggccgtcagatatccagctagctgcagaaatggatgagcacgccatcacatattagtagcgcaaaactgtaattaacattctggtttctaagtaaacaattgtgtaacatcagacattactgctgtccattttaacatttccaagctatgtttattggttatggtaaaagtttgtatatattaaaaactgaatttctactacatttggtttatgtacctgccctaagatgccctttcctgtctgagcctccactagcaatccagccgtcagtcctatcact

SEQ ID NO: 8745 - DNA, 582 bp, Zea mays
  Clone ID: LIB3279-191-Q1-N6-C7
agcgtcaagcgagggttatccattggtgtgctgttgtgaactagtataagctgtgaccaaaaaaaaaaaaactactaccatttcttgccctctgaatttgaaacaggtctatacttgagaagagtgatagaacgtggtcgaatgccagattctaggccaaattcatgaactagattctaactccaaccaaatgaaagaatccgaacagaccgacagagattaatcttttatttgacctagtgtttctcgctacttccacactgaatcgctgaggaatcggagtgcagggacgcctttcacctccatatcaaggagcggagcctggatcagcttcaggccgccgagttctcggtcctccagtatcgcacggaaggcacgtgcttcttccctccgttttgcagcacagaatctgcagtccgacgcagacggtggcaacacctgatttatgacgagccttcttgtgtgtgcaccatccttctttaatgactcgtgaaaccttgatgactcagtaactgccatcatcgttggaattgtcacgacgatgaattctgttgattgtggatcaaacaaaatctcacgcac

SEQ ID NO: 8746 - DNA, 305 bp, Zea mays
  unsure (1)..(305): unsure at all n locations; Clone ID: LIB3279-191-Q1-N6-C8
agacaggggaacaacatatcaatatcattggacaaaaatagctgcgaacaaaaaccttgctcattcttctctcgtctcgtttcatagcgggagcaaccaaagggaacaacaggggtaccaacacctaatccaaaggtagaacggacactaacacggtgacagaagcgaacggtaacacgatactatagatagataagataactcggccgaagccaggatgggcccacacatcagtccctccagccgccgccgccgccgccgtagccgncaccaccaccctcgcgccgaccgccgtagccgccacc

SEQ ID NO: 8747 - DNA, 584 bp, Zea mays
  Clone ID: LIB3279-191-Q1-N6-C9
gaataaacccttccaatgcaactagaataaactaaggttcaataaataacaagagtagcaacattagacaaattaaggttcactaaataacaggacgggcatgatagtgtgaacactgttatacttatctagactccaacagcctcagacaacaaaccagagcaagagcactactacacttccaccgatgatgcttaacaacgaacaggcgaacccatttaaagccgtggatctaccatcgaccaagtaaccttcacacaaatcgtagcgtcacctaaagtgagtacaaattcgtgtccaccattccatctaggagtaacttcaatgcctgtagagacaccagcagcggtcgttacgaaaattttcagcttgtccatcacagagaccgatacaacaggtcgcatcaattgaatcataccatgacatttatcacctcctacttggctatcaaacagcacaatcctcctcttgcttctagtggtgtgggcagtcattgctccaaagaattccccctgtgtaacttcagctgcaacagttgcctccaccgcacattccacaacgtcatatgtcacatccacagtact

SEQ ID NO: 8748 - DNA, 577 bp, Zea mays
  Clone ID: LIB3279-191-Q1-N6-D1
agtataaatacgttagtcatgttgccaatcgtgttgtcatgtatgaaacaaccttattctgaaaatcaatattctgaaaataaacaatgttgaaaaaccaagctactgttctcaaacaattgccttcttccttgatgctttcgtggagtcccgtcctaattgttgtatcagatgatcgaacctttggttctattttatccaaccttgaatttttttagcatgtatgaaggcagattatggcgctgcaatgcttcatgaaattgtgatcccatgtgcttgtacatttcctccatgagcgtgatgaggagctggcgcgcggcgttgcggacgggctgcttgctgtcgccgaggcgctcgacggcggcggggacgagggagttgaggtggatcttgaagtggtcgccggcgacgacagcgacgacggagagcgcctggaggccgccctgggcgatgcggaagttggcatcccgcgtcagatccatgcagtggtccaccagcgcggtgacctcggccgccgtcagcccgcgacgcgccgcgacgtcaagcaccttgtgcagccgctcgaccccggccagac

SEQ ID NO: 8749 - DNA, 473 bp, Zea mays
  Clone ID: LIB3279-191-Q1-N6-D10
agtagtgactaaacaatttttttcatagcatgttctgtccatgtcaccttacaatgtcaagcacaaaaaaaagatagttcaacaacctgagctctgaaaatatgcagtgggttgactcatctaagagtagtacaaatgctcccgtagtggtgtgtgccaaacaaaaactcattcgttatcctgctctgagatccatttccatgcgtccatctcgccgggcacgggccacatcaggcgacggcgactgggctcggggacggcttgtgggtcggctccttggcgtcagcaaagtcctcggcgttgtaaacgacggtgaggaagagagaacacgacgggcagcgcgcaatctcctccccgatgcggaggtcgtcgagcgtgatctggaagaggtcgccgcaggggcacgggtacgtgtacgccttcagctccgcgttccactccatgtcctcgatctccacctcgacgtacgccga

SEQ ID NO: 8750 - DNA, 515 bp, Zea mays
  Clone ID: LIB3279-191-Q1-N6-D11
aaccgaacaaaggccggagcaacccaaagcaaaagattcacaaaccatggatgcattggaataggagcaagatcccataaactggttcgatacataaaccctggatgcattggaaggagcaaaatcccatgagctggttcgatacataatactttgacatgtctattaggttctacatgtatggaaaatcagacactggaacataatctctggcaggctccatgaacttgaaatgctctctatttcttcttggcagtgtgcgtaccagccgacctcatcttcctgaggacgcccgccatctcctctctcttcttctttgccctcttgtgagttccaagctttctcttagcaagcttcagggcacgcttgtccttgccaaccttcaaaagctcagtgatacgcttctcataaggagcaaacccagcaacctctctgatcaggcccctgaccatagacaccctcttcgttgatttccccttgcggtggcacgggcggggaggcagctcgcgcttggt

SEQ ID NO: 8751 - DNA, 115 bp, Zea mays
  Clone ID: LIB3279-191-Q1-N6-D12
ggggataaccaattcagggttttagatagaaaaactctggttcacgagtaaatcccaaccattatagcaatctacaggtgaattaccaaattcagagacaattagcagtttttgc

SEQ ID NO: 8752 - DNA, 441 bp, Zea mays
  Clone ID: LIB3279-191-Q1-N6-D2
aaaaaaatgaatatatacacaagtgactcgaaagcacatcaccctggtacattcgtactactacttgttacagttcttcccacttcagagctgacacggtatgggcgtgcatgcaggatacgaatgctagttcccgctgattctgctttgctcgcgccccgcgggcaacagcccaactgcaactgccagcagccgctgcaccacagcagaaaccaactacgagagtggcaaacgacaaacaaacatcacttcgtcaccaaacaataatgcacgagcacgaccccccctacacggacaccaacagcaattgatgggcaaggacaataatggtggcaggagcgacagcgacgacatcaagcggcgcccggtgtgtcctggctggaggcccagacgatgtccttgagcgccggccggagctcctcgctacagaacgaccggtac

SEQ ID NO: 8753 - DNA, 526 bp, Zea mays
  Clone ID: LIB3279-191-Q1-N6-D3
aagaaacacggcatttcctattccattaggaatgacataaagcaacttgagcgaagcagatacacagccaatcacattgcccgcttacaacctacacatgacaaccatcggatccgcctccaaaccctatgccttcttgggggacttggcggccttcttgggcgacttggcctccttgctcccgccgctggacgccttctccgccgtcttcttgggcagcaggaccgggttgatgttgggcaacacgccgccgtgggcgatggtcacgccggtcagcagcttcccgagctcctcgtcgttgcggatcgccagcagcacgtggcgcgggacgatgcgcgtcttcttgttgtccttggcagcgttgccggcgagctccaggacctcagcggcgaggtactccaggacggccgcgaggtagacgggggcaccgctgccgacgcgctgcgcgtagcggcccttcttgaggtagcgcccgatgcggccgacggggaactggagcccggccttcacggacctcgtcaccgac

SEQ ID NO: 8754 - DNA, 605 bp, Zea mays
  Clone ID: LIB3279-191-Q1-N6-D4
gacaaatattttaatttcaaaggcgaaatttacactaaagagtagcctccaccctcttccaagtatactcaaccacaatgtcacaccatcaccctcgtgggttgtgtgttctctttgccattcaaaatttctctatacaagatataaaataggccatacttcccacagttgcatagctgcaatcacttgtagctaagcagaaccgagttaattacatgcatgatcacacggatactggtgccatctgatgcggtcgtggggagtgtccgttggtgggccaattggctgtagacttgctcaaagattggtcgcacatgcaccgcgatgatctggtctgctgggttgattgccatggcaacatctgtcatccattgaaccttccatgatgtctcattgtgaatgtcaattgctagctgctgcaataaggccagaaggaccccctggttaagaggtactggaaccattgcacatagtgcccgcaaatcaacctgggagcacagccacgatactatggaaacatcactcctttgaagagccattgtaaatgcttcgtcaaacttgcgttcagatatcagtctgctcagctctctcatcggttctaacag

SEQ ID NO: 8755 - DNA, 566 bp, Zea mays
  Clone ID: LIB3279-191-Q1-N6-D5
cagggaagggggctgaaaccgcatccaccaaggatcattaatgacgattactctgtatgcaaggtaaacgccagcgtcaaatgcatgttgcataatgcttgacacaggcgcgagagctatatagctcattgcagtaccatcttggcattctactaattccacgttgacttcctcataatcagcctagtactgctagtaagtattaaccacccacggtggttgcgggggcataacaagctacctagtttgctcatcagcatcattttctatatgatgtgtcacgtttatcctacatgtcaacagctttaaacagattgtttaaagcatgaccagtcataccactggagggcaaaacatgtttcaccggagattctttgaccttgacagtgttggctgaggagacaaaattgcctatcttatccttttcatcttaccacagttgcttcttcaaatataaagattttgttggctcggctcccttgcttaggttttaaaatgctgcaatagtaccttcaaacctatatttatctggcctagttgtgtcagagtcccgctctcttcttttt

SEQ ID NO: 8756 - DNA, 535 bp, Zea mays
  Clone ID: LIB3279-191-Q1-N6-D6
ataaatgattagtaaaaaaaaaaaaaaaagataaaaggaaaaaaggaggggggaagagaaaggaaaaaaaaaaaaaagaaaaacaaaggaggaaaaaaaaaataaaaaaaaaaaaaaaaaaaagaaaagaaaaaaaaaagaaaaaaaaaaaaaaaaaaaaaaaaagaaaaaaaaaaaaaaaaaaaaaaaaaaaaaaaaggccaaacaaaaacctggcaaaccaaacccaaaagagaacaaagttaatgaggtgggcgttctaacccccggtttgggtagggaaggaacgggcaaatcaggggatggaaaaggcggggggggggcgggcccggagcctcctcttgatcaggaaggttttgatcaaaaacatagagaaccacgacaccgtgggggaaaggggaggcgtgggaaaacaaacgaagggaggaccgggaaaggaaagagggccaggtgaccggacagtaaataaaattagaaaaaagcgaaaaaaaagaaaggggtaaaaagggggaaaaaaaaatgggccctgaaagat

SEQ ID NO: 8757 - DNA, 433 bp, Zea mays
  Clone ID: LIB3279-191-Q1-N6-D7
tttgacaaagtatttggctttgttcaattaaacagatgtcagatacagattattctccgaactgttgatatttcaaagcaaaacaaacaagtcttggttccaattgtacaggaaacaaaagagcagtacttctgtgcttttgaacgaggttcgtcaacatccagaaaagtttgaggttgatcaataccctagttgccggaggattgttccacgagcttcttgtcgcggcgctccatggcgacgtcccacatatcgttcccgatgtgcttcggcctgccgtgcgcggccttgtggatgaaatactgggcgttgcccatgatgcagagcatgccgccgatgatccccagcggcaggacagcctcaagccagtgcagccgtgccatcgggtaagcccggacgcgggataggggggcgacggaagtcgacggcggag

SEQ ID NO: 8758 - DNA, 552 bp, Zea mays
  unsure (1)..(552): unsure at all n locations; Clone ID: LIB3279-191-Q1-N6-D8
cagggaaaagacattgcaacctcagagaaacaaggcatttcttcttccattctaaatagcaaaggacaacttgcagcaggacacatacacatacaagcacattcgtcccatctgcagcctacgcatcaccgcatactggtaacaaggtactgctaaacatcagatcactccggacagtcagtctatgccttcttaggggacttggcggccttcttgggcgactttgcctccttgctcccgccactggacgccttctccgccgtcttcttgggcagcagaacagggttgatattggggagcacaccgccgtgagcgatggtcacgccgcccaacagcttcccaagctcctcgtcgttccggatcgccagaagcacgtggcgcggaataatgcgagtcttcttgttgtccctggcagcattaccggcgagctccagaacctcagcggcgaggtattcgaggacagcggcgaggtagacggnggcgccggtgccgacacgctgcgcgtagcggcccttcttcaagtagcgcccgatgcggccgacggggaactgg

SEQ ID NO: 8759 - DNA, 604 bp, Zea mays
  Clone ID: LIB3279-191-Q1-N6-D9
atcccaatgtgaacttatcattacagcaaaacagcaagcatatcccaatgtgaacttatcattacatgctagagaatcgaagcaacgaccacggctaacaccgactcttacaaagcttcattttcaccgtacgacgaaagaagcgaccaggccacagatacatccatttggcagaagccaacgtcaagagtgccataactccaacctgcctctttaggtttgaaacccctctctctgtgcgtaaagacttcaccaccttgccatgccttgacagaaacgttcagctccccactcacttcaacagatgcaactcgacgaccaagtgtgatagtgccatcatcagaaacaggcagtttatcgtccccagaatcaagcaagacaacttcctcacgacctatactcaccgtgtgggcagcaaactgggcacggagaccatcaggccatgacccaccacgaactcgcacactaattgtagcctccactgagagaacaacaattgcgagagcaaacctcagcgtgctaagcttgctggtgaaatctcttgtacgcaggcatgactcgagcgggatcgtgatcaagaatggcactgctagaaagctcaagt

SEQ ID NO: 8760 - DNA, 591 bp, Zea mays
  Clone ID: LIB3279-191-Q1-N6-E10
gcagtaaaatgcactcgttcccataaaagcatcagagtccacaagtaccattaccagggaaatgtacattactcagcgaaacagcagctgagtttcgatacgacgcgatgccaagcataaaccccaatccaaatccgtccccaacactgcccccaacaaacaaacccaagctaaattattcactgcatgcaatacgccaagtacatgcacgagctcacggattacagaaccaaatgaggcgcaaactttggtgcccaaatgaccaaaacagaacatgacgaacttttagaagccctgctcgatcaggtaatcgccgagcctctccaccaccatgttgcattgccctggagtcattggctcgtcgtagacaccaataatcaaggacatgccggttttcttgatagtaatgcccccagtgcccttctttcctcggatgacaactccaggttcaccttggatcaccatgtactttgtacctccaacgaaaagaccagttggtgcaagagtaccaggttcatcaaagtcctttatgataccagcaacctcctcaggctttaactcggggaagctctcggactgcgcccaaacgct

SEQ ID NO: 8761 - DNA, 588 bp, Zea mays
  Clone ID: LIB3279-191-Q1-N6-E12
caaggatcaaacgcaattatttcattattgatagggacaaccattacagaacagataccagttttcagaatggaacgactaacaactcaggcctcccaacaattattgcacgacagaatacagtccaatggtccacagaaacagaaagaatgcaactagtaagaagaacacgcacatgtcgaacaaaatcaatctgaagtgaaagatctaacaattttatggaacaaaaccgagagatccaaagctactacttttgttgctggtcatctccatgccaggcccagactatgtccttcagtgctggccggatgtcctcttccaacagtttcttgtactcaagtgaatcaccgcccgtttgtttcatctcgatgaggtggtaggatgccgtgatctcaaatatttccgtgtcgaactccaggacacccttcctccccaccttcctcccctgaatcttgacaacaccattgtccttcttccttaccctgagattcagtgcttttgcaacatcttcaagcttcgagatgatggacacggcacccttatcagaagtgaaccgcgtctccttcttacactcctttctgataaata

SEQ ID NO: 8762 - DNA, 555 bp, Zea mays
  Clone ID: LIB3279-191-Q1-N6-E3
cagtcgaactcttctcctttaatacatattagacatatatttgttttttaatgtttattcatttccaaacttcaacacttacaagttacaccccacaaaagctcttttgaacaatcatagaaatggtatttgtcatttgatggatcagatatgataacccctttgtctcttatgcgtccttaattttctgtgttattcagctttctaaaggcctgtacctggaggcgttatcaattgaacttgtattattaactatctggaaagaggcacttgatgcatgtagcttgctcatggatacatcagatggtgaaaatttctctaaatcttctcaagaacatttccttgctaagagtggccactcacctatgaatgtagtacaaagattggatttcactccgacggcttctattttttcctggcttgaaagtgggtttatgaaggcatatgatcgtgcagagaagatatcacatgtattacggaaaagtgatggttaggaaccctgatcttattaacaccttttggattgattcttgggtctaactaacttattttctt

SEQ ID NO: 8763 - DNA, 597 bp, Zea mays
  Clone ID: LIB3279-191-Q1-N6-E4
tttttaagaagcatgaaacgggaatttcagttctcatagcattatcatgaatctcagaacataacaggtgaaacacgaatcaagcagaggcgccatggggttcacagatccacacctaaaccgctaaattaaactgcgagcgatacatgataaactaagaccaccactcagatcaccaccatcttattcagatccaaaggaacggacgcagggggagtcgacgatgacggagggagggcggccgaacagaccagatcagagagatctaggagagctgtccgcagtcagcgaccttgaccaccttggaggtggagccgttgcgggtgcccaccttctcgatggccttgacgacgtccatgccctcgacgacctggccgaagacgacgtgcttgccgtcgagccaaggggtcgcgacggtgcagatgaagaactgggagccgttggtgttgggcccggcgttggccatggagagcacaccgggggcggtgtgcttgcgcacgaacttctcgtcggggaacttctcgccgtagatggactcgccgccggtgccgttgccgcgggtgaagtcgccgccctggcacatgaactcggggatga

SEQ ID NO: 8764 - DNA, 564 bp, Zea mays
  unsure (1)..(564): unsure at all n locations; Clone ID: LIB3279-191-Q1-N6-E5
aacaggatgataggttccttacagaatgagctgttaagggttacattggagttgagggaccagatcatatcagggtgctgtaactcagcatcagttctgtactgtgacacgcgacaattaaggctacaagctaacgctaagtttttacaacaaaaaccaagcttaaaagacggtattgcccttttgcacgaccctgncgcggtggaaggaaccgaaggtaatttcaatgctgttgttttaatgtcctttgaatttataagtttactttaacccattaaaacttgcctgggaaagggcagtattttacagaatcaaagttgtccttgcaaataaaagcctgttgttggcgtcgttgttaacaagcaaagtactcgttaatttccgtggacctgggaatggcgtgcacaggaggagctttaaccttgcgggggaaaaagtggttgaatcttgttgtggatccggaagtgctgatcatctaaaagttaataaagctgaagggcgtcgtctccctggttttcctccccatggcctccgactcaagcatgtcttccccgaacaatgctt

SEQ ID NO: 8765 - DNA, 582 bp, Zea mays
  Clone ID: LIB3279-191-Q1-N6-E6
ctattcagcgatcagtagtcatatattgagatctgagatttaaaacagcacctattgagatttaaaacaggcagcgttgatgcttgggggtaagtataagtgccgaagaagcgaacacactaccaactaaacagcatcacttcagggacaacactttcaattactaactcagagcaggcactactagtctacagcatctcaaaagacagacagcttccagacgctacggagcagcaaagcccggttaggcccaacgacgatgagatttccctgctgactgcaagcacttgggcagcccagagtttcacccgtcatccatcactcatcaccctcctcgtccccgtcgttgacctcggacttggacttgtcagaatcaccagacaatgtgggtcctcctccagactgcttgttgttataggcgtccatcttctttgtgtactcaaccttcagcttctcggccttagatacgtagggagccttctcctgcgattcagaaactgcacaacgtcaaagggcgggcaagggaacaaacgtatactgcatcggagcgttgaagtgaatatgcaagttgaacaaaaccct

SEQ ID NO: 8766 - DNA, 608 bp, Zea mays
  Clone ID: LIB3279-191-Q1-N6-E7
aatttgtttgcggttgttactgaaaagaaggaatgatgtttactgtcatggaaaatttacaaccgacacatgatccgtactggcatgagtttctttgctacacataacactctacattacagtacaactgaaactcgcacacagagttcagtaagaatcggggggaaaacgttaagcctagggcatagtagttacacaaaaattacttcaagctttgcacagggatggtctttgatatattgctcgagttcagaatcatccctaaatctaaaaccgtacaaagcctgacgttgcgttagaccgactgggtaaattctgtataatttcaggtcatccccacctctaatgctcggtggcctttcatccttccatacaggaacgtggttgagggacctaaatttaccgagcactgcggattccaaggctcccagagttaactggcctcatgtaaatgctctctgacttaaaccgccctctctctcggataaataagtggtaaattgttccctttttggtggaacagctacaaggacgatttgtaaattttggagtcctttcctcctttaaatggatcttggtagcaatatgtatacaaagacgacaagatg

SEQ ID NO: 8767 - DNA, 584 bp, Zea mays
  unsure (1)..(584): unsure at all n locations; Clone ID: LIB3279-191-Q1-N6-E8
ataccgntccaagttttattccgcacaaatatgcgagcatctgcagatagcagagggcaaaagtgttctactgctcattggccatattattaaaaagagttgcagcgaaggagagggtagcgtacagaattgaacttgcatcttttatactcgtatatgacgatgtgcatgcatagggcgtgagtggtggtggtggtttgctgatgcagtggctttctagaacaggaagtaattccgagacagtggcagtgtgggtgctggttggcatgtcaaaacctctccatcagcggtcactgtgtaggtctccgggtcgacctctattttcgggagggcgtcgttgagcttcatgtcaagctttgtcaggcctcgaacacggcctacagcttccaccctcttttctagtctgtactccgttgcgacaccagcttctttagcagccttgctcacaaatgcaattgaattggaacttccagcctttccaaatgcaccaaacataggtcgcatcacaacaggttcaggtgttggaatgctagcattgggatcacccatgttagcccatgcaattgcacctccctttacaacca

SEQ ID NO: 8768 - DNA, 591 bp, Zea mays
  Clone ID: LIB3279-191-Q1-N6-E9
agattcaaatcggctggcatgattgatgaaacaaatacacaccccaggattacactacacgactcccaacaggaaatggaaagcggaagcctgtaccagttcggtgactgcatacaactcatatatataacatacgtctctttgggcgaataatctgtatattattctctatggaaagaaccctcgcgcccgtgctgtacgtttcgtcgtggaaagaaccctggcctcatgcttcgtacaccttgcactcgtcggtctcggggttgtccttgcagaagtcctccagagggtcgccgctgccggccgccgcggcgccgggccacttggccgccaccaggtgcgccagatcaaccacgcgttggctgtacccccactcgttgtcgtaccaggcgacgaccttgaccatgtcgtcgcccatgaccatgctgagcgacgcgtcgatggtgcaggacacgtcggagcacctgaagtcgacggacacgagcggcacgtcgcagacatccaggatgccctgcagcgggccggcggcggccttgcggaacgccgcgttcacgtcgtcggccgtgatgccagtcttcacggtgttgatca

SEQ ID NO: 8769 - DNA, 284 bp, Zea mays
  Clone ID: LIB3279-191-Q1-N6-F1
gaatcgaatgacaagcatgataagttgacattataaatggtatagttgcaaacacgagcacttgcgagattagacacggatataagaagccaacgacggcatcacacgattacaggcgaacacaccaatcagcacaaacatcaccaaatcctttattctagtcactcagtgcagatgcagcctactgctagcagggcactgaacatcaccatcccgtcgtatggattctggtaagggaacagtatcccttcattcgatcttgtcgcagtcgatgtcgggggtga

SEQ ID NO: 8770 - DNA, 467 bp, Zea mays
  Clone ID: LIB3279-191-Q1-N6-F10
ggggaaaacgaccattcattcaaatttgcagatttgggtagatacatagctaatgttttacgcacagacgacaggaacaggtgttgccaaaccaaatacattggtcgcacactacattgacatattacttgaaagaaagcagcatttgaatcacgaagcagggcatccgaaaggcatgcgcttagttgggtatacttttcccccctcatgcaaaaagtatgtgatactccatagagacactcaacttaacaacgcaaattttaacagcttgacacgctatgaaaggcgcggcaaatagctagctcaaaagcattttcggtggacgatagcagggccagactcatcgtactcatccttggatatccacatttgctggaacgtactgagcgacgcaaggatcgagccaccaatccaaacactgttttttctttcaagaggcgccacgaccttgatcttcatgctgctcg

SEQ ID NO: 8771 - DNA, 594 bp, Zea mays
  Clone ID: LIB3279-191-Q1-N6-F11
tttttatgcctgagcaatcctggaaatcatgattttacttgcaacgggaacacatgcaatgtagttacacatcacgctcattctaaataacctggagtcttgaaatccataaacatgagcagagcaaatgaactcgcagtccagtgcattacagttgcttgtacaacaataacaagatagagggaaggggggcaggcatgaagaacttcattttgtagcctgagcaataatgttacttatggagctggcttcctctttagcagcttcgaccaatgaatcctgtgcagcaataagtcttgcaacattcttcttgctagattcttgaagttcaccagcgatgagaatctcatccagtatgtagtaggccttatgaaaattgaatatcaaatccaactcacatacactgccaaaatagcggtccagtatctcgacgaaatgatggatgatctcaaggacttcaagctcattgtcctcggcatcaatgcacatgcagaaatacaggctagcatacctccggtatacgaccttgtaacctctccactcaacaaaattgcagagtttgggccctcgtgtaagaatgagtccactgagttc

SEQ ID NO: 8772 - DNA, 395 bp, Zea mays
  Clone ID: LIB3279-191-Q1-N6-F12
aaaaaaaattgcacaagctaaaactgtaccatctttacatataacgagccacatcaaattatttgccaaagtaaaaaccttccaacaaaagatggaacggtaagggtcatgactcattgtaagaaaaataacataggctgaccacccaagtaagccacgtcagtcgaacctgcctatcattattggcagatttgtggattctgagcaagaaaagaaataaaacaaattctgaagaagaaaaaaacctgtgtcgcagcaagcgatgtgcagtgctgaggccttgatatacagacgccgaaagaggcaaatttgatcttgggtgcttgcacaccgaaaacatggttcaccgttagattgatcttagttacggagcatgtatgtacggtgtttgaacc

SEQ ID NO: 8773 - DNA, 205 bp, Zea mays
  Clone ID: LIB3279-191-Q1-N6-F2
gggggaaaagagggcgtttttttttaaaagaagggtaggtcccagttggtggaaagggaaaagaaagaaaccctcatttaaaagggggcgtgccaaaaaaccaaaatttcatcctaacaccaaaaaaagggggggggcccggaaccatccaaaaaggaaaggggtttacggccaaaaaaataaacccccccctcccggggcccgg

SEQ ID NO: 8774 - DNA, 596 bp, Zea mays
  Clone ID: LIB3279-191-Q1-N6-F3
gaacacaataattacttaatctaacattacccaaactgacattatgacaatgttagccgatgacgacgacaatggaaacagtaatctaggtacaagcaggcgcctctgctagctggcaagtgtgaccacacacaaacacaccagaccagaggcagaaccacccgccagtggcgccaacgaggagcgctatccgttatagcacgacaaaagtaaaaataaaacatcacgatgtggagtgaaactgaataattctagtacatggatataggctccttttttttgatcgccacggggccttgtgtagccgctccattgttggatgaagcaccgtccattgtctcgagcgagctctccatcactcgtcatcatcttcatcctcctcgctaccctcttcgtcatcctcgtcattgacctccgacttggacttgtcagactcctcttcgtcttcctcctcttcctccttggcaggagccttcttagctgcagtgctctcgcccttgttgtaggctgcgatggccttgttgtactctagcttgagcttgttagccttggctacatagggagccttgtccgactcgctcagggatttccacctg

SEQ ID NO: 8775 - DNA, 393 bp, Zea mays
  Clone ID: LIB3279-191-Q1-N6-F4
attgtgtatattttcacttttagagttttctttattttttttcaagtttactcaaccacaatgtcaaaccatcacccttgtagagaggagagagatctatgccattcaaaatatctatatacaagagtaaaaatgggccatacaacctacagttgcatagctgcaatcactagtagctaagcaggaccgagttaattacatgcatgatcacacggatactggtgccatctgatgcggacgtgcggagcgggcgttggtgggccaattgcttgcatacttgctcaaagattggtagtaaagctcagcaaaagaatgggcttgctgggttgattgccttggcaacatatgaaatccattgaaccttccatgatggcttcatagaaaatgacaatt

SEQ ID NO: 8776 - DNA, 224 bp, Zea mays
  Clone ID: LIB3279-191-Q1-N6-F5
aaacgggaatttcagttctcatagcattatcatgaatctcagaacataacaggtgaaacacgaatcaagcagaggcgccatggggttcacagatccacacctaaaccgctaaattaaactgcgagcgatacatgataaactaagaccaccactcagatcaccaccatcttattcagatccaaaggaacggacgcagggggagtcgacgatgacgggaggagggc

SEQ ID NO: 8777 - DNA, 590 bp, Zea mays
  Clone ID: LIB3279-191-Q1-N6-F6
caaaacccaaagcatcactcgtcagaatggcgataacaaagtgaaggcacacacgaacataaaaatccaacaccgccacttgtcagacctcaaaaaaaaaaatcatcgcttacaatagtctccaactggcatgccgaacgtgatggtatgcggctaagtaactccgtgtgtccatcaactcaaagccggatacacatacaccaagctaacatttgagaattgaaatccccagacttctttcactacatcacgcatagtaaattcatgacttgctggggaaacatcagtgccttctcctgggtggggtccttgaacgagcccttggtggtgatcttttccgagtaaatctgcgcttagcagggccactgctaaaggcccaatcaacactcattttttgttcataaagctcagctccatccagttcttttattgcagcctgagcttcttcaaacttctcatattcaatcaaagcgtaccccttgacaaatccggtacgacggtccaaattcaaatgcaggtttttgacctgcccaaattcttggaaagcattttggaggtcatcttcttgagcttcttcatgaactccagtg

SEQ ID NO: 8778 - DNA, 500 bp, Zea mays
  Clone ID: LIB3279-191-Q1-N6-F7
aataaaggtaccattgtgattatgtaacgcttttgcttagtatacaaatacgtaccagtgccaacagatcgtacataaataaaccatatgccaacgtgcctggagatcatagggcatttcattcggtggacaaaataagggatggtcactgtgtgtgatgccgtaaataaagtacatcaaacattgtacgcacgaccagcgctgcaactgaaactatcctgtcatacaatcaataaggtgttcgtctagtctaccatccaacgatacagcactagcaaactctccgaacgaactatgcgggtctgaccaactcttccccgcatatgctcacaagtttgggaacttagtactgtattcctgatcggacataaatgtcgctgtaatcatctttccggcgaaccattttccatgaagtgcttggtgggccttccctgctgcagttacactatcgaactgcagatacaccaagcctggagtatttttgtcaacaaaaatatgct

SEQ ID NO: 8779 - DNA, 553 bp, Zea mays
  unsure (1)..(553): unsure at all n locations; Clone ID: LIB3279-191-Q1-N6-F8
ccaaacgtggagagaagacatgagcaactaaatttcgctacagcacatcgcacagcacagcacaccacgatcacattccgaagggtccagaattcgaccacactttcacaacccaccacaccaaatcacgaggagcacagctacagacgacgagcagagcagaccgtcactcggcgctctcacgatgcatttcactacgccttgacaggcacaaccttgacctggtccagcacggggccgcagagcgagacgccgtcggtgaccttggtgtggtagtaggagctgtagaaggtgaggcgggtgcggacgccgccggccacgaacctgaacgccgccgtcttgaacccacctttcccggcggaatcgaacggcaccttctgcgtgacgttgcccgcgaacgcctccacaagcatagagccgtggcagccgttccgggcgtcgccgacggcgaacgacaggttgtaggcgcggttgggcacggtgcggatgacctgcgcgatggcgctctcccgcccggccaccagctccaccgngtactgccccgcggggacag

SEQ ID NO: 8780 - DNA, 489 bp, Zea mays
  Clone ID: LIB3279-191-Q1-N6-F9
cccaaccggccccgggcccgggggggggcccgggaaatccgggccggggcccggagggggaccaacttttcctaaagggaggcggaaaaaagcccggggaaaacaagggcaaaaggggttcccgggggaaaatgggatcccctaaaaaatccccacaaaaaacgagccgggaggataaaaggggaaagccgggggggccaaagagggggccaacccacattaaatggggggggcccaccggccggtttccaggggggaaaaccggggggcccggggggttaaagaaacgggcaaaccgcggggggaggggggttggggattgggcgcccaggggggtttttttttcacccaggggacggggcacaagtgaatggccctcaacgactgggccttggagaggggcaacaagggggccaacccgggttggcccaaccggggaaaaatccggttgaggggggggaaaggggggaaaaaaaaagggctgggttt

SEQ ID NO: 8781 - DNA, 579 bp, Zea mays
  Clone ID: LIB3279-191-Q1-N6-G1
acgaaaccgaaccagaataccgtattacttaaaacgcgtgccacgataatattgttcaccaacaaaaggttctaacgcggatacaccgcgacgacgacgataaatcgagcagcgactgggccagccagccactgcagcagacacacgagactgacacaatccgcttagtccacctcctcgatcttggggccagggccaccgcttccagccggagcgtcctcgtccatgccgccggcgccacccatgtcggcacccgcgccctggtacatcttggcgatgatggggttgcaaaggctctccagctccttcatcttgtcatcgaactcgtccgcctcggcgagctggttggcgtccagccagctgatggccgcgtcgatggcgtcctcgatcttcttcttgtcgtcggcagccagcttggacgcgatcttctcgtccttgatcgtgttgcgcatgttgtaggcgtagttctccagcgagttcttggactccaccttcttcttgtgctcctcgtcctccgacttgtacttctccgcgtcctgcaccatcttctcgatctcctccttggacagacggcccttg

SEQ ID NO: 8782 - DNA, 517 bp, Zea mays
  Clone ID: LIB3279-191-Q1-N6-G10
acttcgacaataactttcatcaaccaataaaaagaaagagggagagggcatttagacagacttcggtcccttttatgtcacagaacaattcttcaaaaaaaaaagtggagaggcatgcagcaggaagccttgcctagcagcgacgcccgcaatctttacatcttccttggtccgcttgtcttctgaatgtaatcatgcttgaggaggttggcacgcagaagcatggacttgacatctctctcaaagtcattgccggtttgaaggacacgctggaaagttgcatttctctggtcagcatgccttgcgtaaaggatcttgttgtgggagtctatccgggcctgtattttgtcctcagtaatcagtgcggccagctccttctgcagcatggagaccgaagtcttaaaggcggctgccatcgtgttgaggtcaacagatataaaaggaagtgtgtactgtatgatcgctttgtggcgaatctccatatacagagtctttacatgctgatgcaaatggatat

SEQ ID NO: 8783 - DNA, 587 bp, Zea mays
  Clone ID: LIB3279-191-Q1-N6-G11
tttcatggtaataacaagaaacacaatctccatgcaccagaatcaaaacgtcaacatcccggtctttattgtataataaactcggttcaggacaggaaactgcaagttcagaaagattacaagttgacggtacataccaaaaccaagaccaaatacagacacctggcgttccgttttttacttcaatgaaacatactcaggtcggcttgcccaattgatgtagcagtgacccaagtagcagcaggtgatcaaaggaaacggttcaaatgcgtcagcgtgatagaaaacaaatcacagtgaacgcggttttgcagagctcatcataacaacattagaaagatctaaaaatataggccaatgatacggattcactatagtattatggtactagggcaaagaaggtaaattccatgtcaggtcaaggcgcaggggaccggatcaaatgctgtgccacacgctatccattgctttttgcggctgtatggtagcacgcaatcaggaaccttttgccactcccttttcagaaggttgtatgtaacaaggcggttcatacgcttcgccttcaaggagagcatgagcaaaccact

SEQ ID NO: 8784 - DNA, 517 bp, Zea mays
  Clone ID: LIB3279-191-Q1-N6-G12
gagagatgggcagcgttattaattaatatcaggagcatgtaaaaactatagggaaaacatgtccatatactgtggcaggtatgcaaagtaagtatatgacccggtgtcgattctctggcaggtgtgccgtcgaacgcaacgcaacggtgtgctacctacctaacgcactgcgaacgcccgagaggtccccgtaaaatgtttgatggacccaatcagtggtttggaggcaccaaaatgcctcaacctataaacgcccgacggggcgttttcaggaacggtccattccagcgtcgcgaagcttctcgggctcagcttcgacggtctcgaccacttgaagcgtagtgaccagtcgtcgtcgtcgtaggcaggaacccagctgttgctgccgtccagcttctcaacgagcgcgaacgtgccgtccgtgagaaggtcattcctcgggcacgccgagtagaatgtagcgttcacgacactgcccttcctgaaagttgagcttgcggggacgtctgagctgaca

SEQ ID NO: 8785 - DNA, 561 bp, Zea mays
  Clone ID: LIB3279-191-Q1-N6-G2
gtacattgataatttttttcatataaaacacattcactgtaaaaaagatagtaacacaagcgtctccacggcaaataaagtctactctctagtaaaaagatttacagttccaaatggtaatgctcgtaactgcgctacaagcatattgccaaatgaacacctcttaacgaccctctgcttcatataaagctcacaacacaatagctgttctagtcttttaacataatccacaactctgctgcaaaacaatcagtgctgacaacaggatgaacataagagcacagcaacgctgtgcagcacgctcagcgaaaaaaaatcaccggtgaaaatcagtgctgccaacaggagagcagaaagagcacaataacgttgtgcagcaggctcagcaaaaaacaccacaagtttccgtggttactttaaagtaaacctgcatccttgagagcagcctcaaaatcttcttcacgttgccaattccgaacctcaggcacactgtgctggaaataggcctcgatcttcttcatcacaacattatctggtttgaccacacagcaaggtgaacac

SEQ ID NO: 8786 - DNA, 504 bp, Zea mays
  Clone ID: LIB3279-191-Q1-N6-G3
acaccccttcaccttatatatattccaatcacaaatcgatgcaaaggtccttcttccatttcaggtctcactttacattctagttcaaacagttagatccaccttagcgatccgatgcaccttaacgatcagagtaatagcttaaacatgattggctcttaacatataccaccagccgagtagggacgttattagcctcaactcatttttgtgtacgtggatcctgagtgcaacagttactactgcccgcgttgggtttagccttggttgcaaaatcagttgcggcaaaatgcaggaccggaagcattgcaacgaaaggcatctgtgtcagctgggcagcaacagttgtccagatctacgacactaacacagcatgcacatacatgctccatttaggattaataactaacctatgtcatcattgcataaattacgctagtcaggtattcgactcacgtgcaagaggaactaagcactactgcgcggcagggtcttattattgta

SEQ ID NO: 8787 - DNA, 507 bp, Zea mays
  Clone ID: LIB3279-191-Q1-N6-G4
gatgacatatagggaatttttccgacaaactacgccacaagactagaggtgagatctctcaatcacgtgtaaaatgaaccttatgtcgtcaggtgacgaaattaaacaaggtggcaaagaacagcactcaatcgggatgcacaacagcaaagggggctacgacgctcgtttcagagcacagagatttgtaaaaacgcgagctccgcaaaactccaacctactgccggggggcttagcgggcaccatgacaaaaacgtagcaaagcttctcaaagacggcgagtctagacggccgcgaagtactctttgcttcccttggggtcgggcttcatggacctctcccctggcttccaaccggccgggcagacctcgtctgggttctcctggacgtactgcaatgcctgaagggtcctcatggtctcgtccacactgcgaccaatggcaaggttgttaatggtagagtgctgaatcactccctccttgtcaatgatgaacagtcctctcagag

SEQ ID NO: 8788 - DNA, 337 bp, Zea mays
  Clone ID: LIB3279-191-Q1-N6-G5
gggagaataatcatctcatctccttactcagtctgatggaacacaccacaaaaaagaaaagaaaagcatattggacttcccctcggcaacacaggaccaaatcatctcttaaaaccttaacgacgacgacgaacgacggacgacgaccaagcacacaccatgataacttaacttaacttgagagttcttctacgaaccgaacgaaatctgaaaacaggtgacgggatcctcttacgaaagaggcagcggccactcgtgccctgatcggcaaaactaaagcggtactccgacacacagcgagagggggattcttttttaaactagatctaaaaggggg

SEQ ID NO: 8789 - DNA, 564 bp, Zea mays
  Clone ID: LIB3279-191-Q1-N6-G6
gacagataaaagtaccaacctgcatgtccttaggtcgggttcaattgtcactcgcggttcacccatcagcttattcgactccaggagaaacattacctttcccacgagctcacccagcaaagcctacgccctacagaaaccaaaatttgcagttttgcactttgcacaaagctaaacatcagggcagttgcactaagctgtagccttagaagcttggtttttttaccccgcaactccctaaactaagatgaccagccatggcgcatgactgctaatgcttgaagtgcctgactccggtgaggacaagcgacacaccatacttgttgtaatacgcgacggcgtcctcatccttgttactgccttctgactgggcaatgataccaataccgttctggcacgcctcactcacggcatcattccaggcaaaaagaaagaaggcgtccttggccaatgcggtttccttggtctactcttctgccttcctgaaggcgattcgaacgctctctcgcctgttcaggtgaccactggccattaacagcatgcagatgttcttggctatcacaa

SEQ ID NO: 8790 - DNA, 565 bp, Zea mays
  Clone ID: LIB3279-191-Q1-N6-G7
gggtaaacgaataagaccttaatgatgaacactaacatgaaattatctagtgctatcattctctgctcaaaatatcacgtcctcttacagatagagcaccagattcggcctgtaacctgttacaacggccatacagacgttagttcaatgcccagacaaccagtgtccgaaatcatcttcagatgcaactgacgtgtcattgcttggactcatcatcgtcatccgaaccgtgatcgtcatcagaagactccactctgttaggttcatcaccaccgttattacccgttttagctctcttctctttcttacgctgcttcttcttttgccgtttcaggcgcttcttggctgtccgctcctcagctgctttcatcctctcctccctccgcagttcgaactcagccatcttctttctcttctggtagtcagcatccattcgagctagccggtcctgctctctcctcctcatttgccgatactggtggaaatcaccagagccagagccagcagaggaccctgatgtgttactgacacgcacagggacattctccatgatgcgcctgagctt

SEQ ID NO: 8791 - DNA, 585 bp, Zea mays
  Clone ID: LIB3279-191-Q1-N6-G8
aataaaaaattcacattgaagacaagtaattcagataggacaatacagctcacttctagcgaatggaagaccatccatccacctatatatatatcatatggtggctgccaaaccactgccttgctccatccagatcagtaattacctctactacaactagcaagcaagaaaaagcacaataaggttatgagttatgacttatgagattatcggagcaataaattaagcacgcgatcacaactgtcaactcagaagtcctcgtcgatgctgaaggtatggtttgcagcagcgccgccgttgaggctggacattacggacgccttctggtactccccgacgcgcttctcaaagaagttagtcttgccctgcagggaaatgagctccatccagtcgaaggggttggcgacgttgtacatcttcctgtgccccagcgccatgagcaggcggtcggcgacgaactcgatgtactggctcatgagcccgccgttcattccgaccagcgcgacggggagcgcgtcgcaaacgaactcacgctcgatgtcgacggcgtcggcaacgatctcgcggacgcgggactcatcgagc

SEQ ID NO: 8792 - DNA, 290 bp, Zea mays
  Clone ID: LIB3279-191-Q1-N6-G9
agatcaaagctctagaatccctccagatcgagaaggctttgcattggatcccagtccaagattcaaattcaaccaaagattgattgggagccccaaacaagagagagagagagagagagagagagagaagccttttcgggtggccaatctcaattttcaaccctgctctttgcatttgtcgttcattgatcccaactaaaatttgtgatggctgacgggggaaagttggcagctagcaatctttatttgcacggggggaacaactgccctgggcttttatagtttcataa

SEQ ID NO: 8793 - DNA, 611 bp, Zea mays
  Clone ID: LIB3279-191-Q1-N6-H1
agaagaagaattggctttatgaggtattaggatgatcctgagtacatctttagttctaaaagcagcgacccaattatcacatgcattatcaaaagtatagctggaacgaacaacagagggaaagtgactcaaagctcgattctgtaggcagccgatcacatcaaaacttgagttagggtagattctgtagaccattgtaggcagccgatcacatcaaaacttgagttagggtagtaaaagcagtgtagcagagatcctaatcacttggagatttgagggtggtgactgaaaagctccatgtggtgtggacacgtaggtaacgatgtctaagcagtgaaagcgaagaccatgtcatcgatgtccgacttgacattgctgtagatgttgtcgatcagctcgaagatcaccagtgataagttgctctcgacgccgtggccgcggagcgccgcctgaacgtcgacaccggtgagggcctccttcctgtcgaacaccgtctctctgtcaagaggggtgccgccgcaagcgctggacaccatcttgcgcatgatctcaagctcctccgtgatctgcagcgccatccaccactgggcacaccccccctccgcatacca

SEQ ID NO: 8794 - DNA, 549 bp, Zea mays
  Clone ID: LIB3279-191-Q1-N6-H11
tttttgtttttgggagagagattatcatgcatgccgttatttacataggagtggtgtggaatatgaacagacgattaaaaaaaaagaggtactctagaaagaaagaagctcaagagctacgaacgaactgtatatacatttcctctactggcaacactttattcaagatagtgtgtatacagcgagaagctggacgtatcaagaatcgtatgaatctgttaatcctgtctccgtcagaagaaattcacctgccggataggtgctaacgaacggttctccaacaggttcgactgcaagaacggagagccagaaaatgcgccttggctgtcaaccatgtacgcctgctgccaggatggtatggccggaacatcaccaacgggacgatcagatggcaccagaggccaaaaaccggacttcacaggggtattctcaaatcccgggtacaggagaatttcctcttctgtacgtcgtggaacatgcttaccaaggtctgttccagaaaaacttggcttcagactgagagttaaatcaaggacacaatcatcaggt

SEQ ID NO: 8795 - DNA, 604 bp, Zea mays
  Clone ID: LIB3279-191-Q1-N6-H2
accaaaaattccataacgcacatatacatgaattgcgaatcacacgtgttcatattacaacaaacaaaatatacaactcatgaattgcatcaaaaagtattttataaaatacacaaaataattgggtcgtcttcaaccttgggtccgtgcgtgtgacggggatggatcgacgggtttcgaccggatggagaagagcaggggcttgactacggacggcggatggcgtagctccggcgaactccacgggctccggcgacgagcggcaaactccggcgacgaacggcactagcgatgagcgaggagagctagagagcgaggcggggaatgggagagagctcgggtagggaggatgggagagagctctgctgtcccttttatagagagagggaggggagaggggaaaggacgccagggaggtcatggggcgccgacggccttcactggccattgatggcgtcggttttctgctcataatggggagaaatgggagaaggagtaacggaggatttaaacaccattaatcgcgcacgtaatcgaacagacgcgcgcggtcttgggcttgcatcgcgccggtcggagtcgcgtccttgggacggggtcgggc

SEQ ID NO: 8796 - DNA, 594 bp, Zea mays
  Clone ID: LIB3279-191-Q1-N6-H3
gatgccaagtcagcgtgaacagtacgggaatactgttcacctatttataggcacgggtcgcagcccatgcaaaattacatccaggccctttgcctatgacaacaactctatagtaatttatctgggtctagatagtcttttcctctttaagtcggtttcctcttttctgccatcatgccgaagctcccttctgcgcagcttcggctctgctccatctttcgtattatttccgtgcttcttcataccgtgggctcttgttcgaagatccctgtccacacattatactccagaggcattgttaaatcatgtttttgaggaccttcggaagccgaaggcgcccaacatttccgacaccacctaaaccagtctgctcgctgccccgtttccgttgttgacccattcccgatgcgacgccacccgactccatcccttgctgacgcctttgtcccctgtcctgtttttatcgtgatgtcaatccactcgacaagatagatctccctcgttgcaacgatatgacttcccctggggtcggcaggcttgacgaactagaaaaccatagctctcatgtggtctttttggccccccatgaatttt

SEQ ID NO: 8797 - DNA, 92 bp, Zea mays
  Clone ID: LIB3279-191-Q1-N6-H4
cacaaaaaaacttaagtagttcaattgacatagctcaaagctgcttaagtttttataagatgactatatcacctccataccatactacgttg

SEQ ID NO: 8798 - DNA, 557 bp, Zea mays
  Clone ID: LIB3279-191-Q1-N6-H5
gaccaaagaagcgcctgctatttcatgacctgatcgcacaagcgcaggtaaggtttcaaagccgaaggtacacccagctaatgctattacaaaaccgacaaggtaataacagatccatcgctccaacgcaaaacgacagccggaggaggcaaggtctgcgcttctagttcagcttctcgattagttcgttgatcttgtcgccacggtcgcccgagtcgccgccatccttgtagggtttcctcttcatctgcagcctcctctccggacacttgagcctgaagggcatgaggaacctcgatgcttctcggaagtgcggcccaaccgtggcgatctcgtgcacaacgtcttccaagcatatgatgccgtgatctccaagagccttctcaattagatcgttactggtaagagggaaaggctccttgtcgaaaaacccacggcccttcttgtaaataagctctttcacgttcttcaagtttggaaacccgtaggtgacaaagggttcgaccacaagaagcctcttcagcgtcagctcggtggccctgaggaatacgccggtg

SEQ ID NO: 8799 - DNA, 167 bp, Zea mays
  Clone ID: LIB3279-191-Q1-N6-H6
gcaattaacagggaaaatgcatagatgtgctagatcaaccgttccagctggcagcagggacaagtacattgcggctcttcactgaacatgatctagtctaactgcacggccgctaatggtaatatgtgcttaagacaggagatcactgtacgtcattttcggggact

SEQ ID NO: 8800 - DNA, 385 bp, Zea mays
  Clone ID: LIB3279-191-Q1-N6-H7
gaccaatatattcacattattattggggaaaccaacaggaaaaattacaaggatccctggtaataagtggttaccgccagcaccagtacaccaaggaatacacggggcgcacgcaactacaaacctttttattaccacgcttctcattcatgtaaaaaatgaaacggatgacatacgggaatcaccgctagctctgcttttttgggtgaaacgctggccaggactcgatcgaatcaaatggaaatgctgttggggatgcccttggcggtgacgccggtgttatcgcccttgtcggaggtgttggggaaaagcagggtgtaggggaactgggccgcgctgtagcggttcttgaagcgcgggtccttgttcatggcctccacgcgtt

SEQ ID NO: 8801 - DNA, 507 bp, Zea mays
  Clone ID: LIB3279-191-Q1-N6-H8
tgaagagcaaatcatcacatagtagatcaaaagcaaaatcaggagttcaggacagggcagcatcctcagctgaggagcagcagaacaatattgctatcgtgatgtttgcagactattccagtccataaaacaaaatgctttttccaatgttcgtcatcaaggttaaacatgggatccgaatgaccagaggcaacctccatcgatccacaaagcaacatcaagaaccacaccaaggcttaacagcgactgaccgtcactgcgaggccgatgtggatgacggtgatgcgccggcgctgctgctgctgctttcagtggacggggagtagaggaacttcttcgcgttgcccacgtgcacgcaggtcagcttcacgacatttctccctgtcatccatttcagcaggatcttcatgtgcgtcttgctgttcaggccagcgatgccagcattcttggcgtggatccaggtgtaggcgaccgtgaggggcccatggtcgagaggatctggaggag

SEQ ID NO: 8802 - DNA, 538 bp, Zea mays
  Clone ID: LIB3279-191-Q1-N6-H9
gaaaacgagggttttccattgataatggcaagttggtattgcaggaaatgggatacaagacaccacagaacacagcgacgatatagagaacggactacactagattaggcacacaacacgaccaccgccgacacacatgcagttcgccaccagatgacgaagcgacctagccgccgaagccgtagagggtgcggccctgtcgcttgagcgcgtagacgacatccatggcggtgacggtcttgcgccgggcgtgctcggtgtaggtgacggcgtcacgaatgacgttctccagaaagatcttgagcacaccgcgggtctcctcgtagatgagcccggagatgcgcttgacgccgcccctcctagccagcctccggatcgccggcttggtgatgccctggatattgtcgcgcaggaccttgcggtggcgcttggcgccgcccttgcccagacccttgccgcccttgccgcgccccgacatattgtcgaaaccgagcgctgcgctgctagaacttggatcacggaagaagatgcgagcgga

SEQ ID NO: 8803 - DNA, 597 bp, Zea mays
  Clone ID: LIB3279-192-Q1-N6-A1
aatgcgattacagccattaatataaaatatattagtaacatttgtatcttcgaataattttactataaaaatagatgtttgactccttaaaaagcaagaacgacaaacattaggacggagggagtatcatacttgctctatctctactatcaacatcacatcatgatactgcagtgaaaataatggggccaaaatttgatgcgctactttgaacgcataggtatctgcctatctgcgtacatcacatacatagaccatcagcctagtgccctagactcaaccttttctgcacactgtgcggccccgcaaagtttttatttaacctaaaggaccagcactgactctcttaaccatgcctaaactagcagctttagttcctttgtggcgtatggtgagctccatggttctcagatgttgactctcaacttcatccttcacaacagtcccgatattgctgctgtgtaatacttgcacccgcttccacagcaaacaaaagcaatcttcacgagcaaaccgaccacaggcatgaaatgatgaaactttccatgcagcggcatatcattgggtcctgtgaaaaaaaattaggaccaaacccac

SEQ ID NO: 8804 - DNA, 615 bp, Zea mays
  Clone ID: LIB3279-192-Q1-N6-A10
ttggccctggccgcggcgacgctgctggcccagtcctggtcccgcaggaagaggcagacggcggagcagtcgtcgacgcgggacgtcgggtacctggtccgccagcgctgcgccgcggcttcggcgacggccttggacgcgtgctgcttccgcggcgtggcgcagacgatggacacgacctcctcgttgctgagcacgtcccacacgccgtccgtggccaggatgatgaacaggtcccccggcgcgacgcggcggtgcgtcacctccggctccgacaccacgccgtggcgcttgaggcggtagtcgcccagcgagcgcgccatggcgaggcccgggcagtcctcgtcgggaagccacacgcgcagcaccgacggctcgtccttgagcgcgaacacgcggccgttgcagcgcttgatacgctcagcctcctggggcacgttgggcttgtggtcggtggtgagctgcacggccttgaggtagcccgtgtccgacatggtcgccagcacggccctggagtcgccgaggttggcgacgatgaggtccttcccctgcttgatggcgcacacggcggtggtgccgctgaagttggagtccacgttggcctggagcttgagc

SEQ ID NO: 8805 - DNA, 562 bp, Zea mays
  Clone ID: LIB3279-192-Q1-N6-A11
aactagacgacttggtaaaaatccatttaacattgcccaaatgtctaacatatgtcatatatagcattcttgtattgcaataggtgaaataacaagatgctacataaacagataaacgggcacccaatagtagagctcaacagttcacaaggtaacagcaagtcagcaaccacagcatacaaaacttatgccaaaatggaacatctcagctacgtattggaaaagcagacgctgcatcaacgacaggtcgcatcatttcttcttggcagcagccttggtcaccttggcaccggtcgggtccttcttctccacactcttgatgactccaacagcaaccgtctgtctcatgtcacggacagcaaacctacccaggggaggatactgcgagaatgtctccaccaccatgggcttggtgggaatcatcttcaccataccagcatcaccgttcttcaagaacttgggctctttctcaagctccttgccagaacgcctgtcgatcttggtaatcagctcagcaaacttgacagcaatatgggaggtatggcagtccagcactggggca

SEQ ID NO: 8806 - DNA, 597 bp, Zea mays
  Clone ID: LIB3279-192-Q1-N6-A12
gatgataccagttcctggtatttactaccagacctctatttataattaatgtatctgcacaagatatttactaccatagcataggaacagttcgctgtcctgatccatactggaagcaacatctaaaaaactggaggacatttgcgtcatgtgaaaagatgagctcacactaagagagattgtctgctggatactgttgtcaggactagttacattgtaaaatgtccattccacatactatgacagatctcatcgttaaaccctggcaagtgcatctccatctcagactaacagccaccaattgttgaactcaattcaaattgcctccaatgccctgagctttccatgtcaaaatcacaaacaagaagttcagtttacaactctatcaagagggcctccagcaattaagagtgtgcatatcagacctggctggtagcatctgagaaatatggcctggtagtggtgctccagatggcaaatgattcagaacagtatgttgatgattcataggattcattgaagatctgtcaatgtttgatcttgaatatccatcatgcacaaatggcccttctgagcaggtaatgatctggcacttga

SEQ ID NO: 8807 - DNA, 343 bp, Zea mays
  Clone ID: LIB3279-192-Q1-N6-A2
aacccaaccctaaaggggggggggatttttttaaaatttttggggtttaaaaaactggggtaaaatttggttcccggggaaagattacaaaattttacatttccccttaaatttttggcggaaaccccccaggggtcctaccaaaattgggggggtgggggatttgggaaaaaaaaccgaaagggggtttaaaaaaaaaatggggggaattccatttttccaggaaaaaatttttttgtttttttaaaaattttgaccaggaattctggttaaaaattccaaacgggaagccaaacccaaaagggggggggaagaccaacagggaattttaaaccgggcgggg

SEQ ID NO: 8808 - DNA, 595 bp, Zea mays
  Clone ID: LIB3279-192-Q1-N6-A3
cttcctctccatgctgctgtctggccggttcttagatagataaggcatcgccttgctcgccttggcgtcgcctaggcatctaggaggtggttcaacgccttgtctcgccctaccgctttaagaaccatggttatttgaacttgtagatgatgttaatatatttttcttaagaaactttgtaaaagttagagaaaattgacttaggacaaagccaaagaaaagcataatttgaaacgggtggagtgggaataaaaagctacagataactaaaaccgcccatgaatatcaagggggtcaaatgctttcatagttcaccattagctagaaacacttcattccagcatgacccacatctgatctgactgaacaccattcagctcgtccaagtaccttgacttcatactcttaatctgttgataggcaattttccagccagtgagaccacaagcacattcgccctaaaatgttctaacacctgtattactcaagctaaaacagataaatccatctaacagatacaacaatagctagcaattcaagaatcctcattctcctcactctccacctagcaagcgtgggaaaatcataatcccac

SEQ ID NO: 8809 - DNA, 596 bp, Zea mays
  Clone ID: LIB3279-192-Q1-N6-A4
aattagtattgcacaatgatagatccacatgaagtcttctacaatagtcttgcagccataagatgcccttttgaaaatctaaacggtaatttcgttttgaaatgataggtggagggaaccaaagttcctatgaaaactttgaccacagccataattgagtagccagaaacagcttaaaacagcaagtttataagtgccaagcaggaacatgtagaatcatctggcattctggccacagtaaaatagttataatcatcctaatgacccatgtaatgtcttccagggcctcctgaagaagcacccccatacccaccagaaccaccgtagccacccatataaccaccttgcatcccctgcacgctgctaccacccaatgcaccagttggcccctgcggaggcaaccccgatccattagcaccgacccccagaatgctattaaaactcagcccacccccctgctgggtggcaagcaaagctgtcaaggcctgccccagagcaggatccacacctggggcagcagaaataccaccaggcaatgaagccaatccaggtgccagaggtgacattggctggacaataccaacagttccgggcag

SEQ ID NO: 8810 - DNA, 543 bp, Zea mays
  Clone ID: LIB3279-192-Q1-N6-A5
gcaccgtgacctacaccgacttcccgcccctggtcttcctcgtgggcgccgcctccatcgcggcgttcctcgaggccatcgccatcttcctctgcgtgtggaagaagggcaaggacaagaaggccaaggtgctcatgccgctgctgggcgccgccgtgccggcgctgctctacgcggccaccggcgcggcgttcgcggccagctccaacatgtcctactgctcagcctacggcaggcgcctcaacgtctgcaccgccgacgggggcggcagcggcagcaacttctgcagacaggtgcatatctccgtctatctcgcgctcgccgcggccatcgccgtgtccgtcgccgaggtggtcaggggcattggaggaacggcgtccggcggaggctcggactcggactcagactccagctccgacggctgtgaccatagctgccgccacaagcattagctaggttgtgcgttttggagtttgtaccagcaacattgtgtggcttcatttcaacttctggaatccattttcattggtgggcctgtattgt

SEQ ID NO: 8811 - DNA, 568 bp, Zea mays
  Clone ID: LIB3279-192-Q1-N6-A6
ggtattaagttgatttaaatccataacaagtcaaaatccattttaatacacttcaatccacatagaattggaataaccgagaaggccctagcaggaacaaaagagagataaagctgatcttcaggtcttcacacctactgcttgaagaaatccttcagctttctcagccagagcaggtactcacggctgtccttgttgatcatgtacaggtgcaagaaatttgtggtcctgggtgaaatgccacgcagatccaggtacctgtggaattccctctgcaggttctcatcaaggtcattgaaatcaggaccctcatatgcaatcatgtcacgttcatcatcccctgattgttgtgtcacagacatggagtcgatgatgacctcgtcaggataggcagtgcaggtgaattcaagaacaggaccgtcacccttggatatagtgactgtgagaggaatgcttgactgttcaggcttctggccttcatcttcgtcattgtcatctcccgccgtgtcctcatcctcaccatcacggtcatgatcaggctcatctccagtgacaaggctgggcatgt

SEQ ID NO: 8812 - DNA, 495 bp, Zea mays
  Clone ID: LIB3279-192-Q1-N6-A7
atctcactcattctgaagtacttactggaaaagaaaactagttcaacatgggcgtccacaaaaaacatccatttattctagtgtactaaaaagaacacggcgactattgcagatgccatccttctccagatgtcagtcagagactcagagcacactcaagtctttcactatagaacaattcatcgtccgttcagcaggcaaaggactagcagtagaacatggaccccttcagctcattctttatctctggaatttgcttccgaccaccattagcagcagctgcattattgtccgagcctttggcgaggtagacgcgggccccatgtgcgagcttttgggcgtagtatgcgggaggagcgaccgacaacgaacgattgccgcctgaataagtgtagcacaggttatttgtgagagcctgcagttcatctgccgtgaagttgttatcatctcgcagtacaaggtacctcacaggacgccttgggcctttgataacac

SEQ ID NO: 8813 - DNA, 519 bp, Zea mays
  Clone ID: LIB3279-192-Q1-N6-A8
tagaaaccatgatagcaatctgagatacatgattaaaggaatggtttaatagtacatgcacaattaaatgtttctttttcgtttccaaactaggctatgaattgtccacgaccaagctaaaaaactctacccactaaacagtaaactgctgcgcagggacgaacaggcagcattcctgcgtataagcaaccactcgtcgcagccgttgatcatttcctctttttagtaggtggttgggggacttcatcatcatcatcatcatcctcttcagattcttactgctattactcattgccatcgtccccatcattgtagtggtcgtcatcatcctcttcatcctctccaccatcatcttcgtcgtcatcgtttcccccttcgacattggctgcaggatcatcatcatctccatcgtcatcttcctcattctcattgtcatctgatccctcatcaccaccatcatcttccttctccttttcagcatcatcatcggcttcttcatcatcattatcatcatcggac

SEQ ID NO: 8814 - DNA, 576 bp, Zea mays
  Clone ID: LIB3279-192-Q1-N6-A9
gagtgagaagatgatagactagctcattcctcaaaccaaacaccacagtagttcatagccgcttctgtttcttacctgagctcggccgtaaagtttttggcttatcatcaggaacaacagatttcgtctccagccaaaccatcgttttgttacgaggttatagtagcttataagcttgcatcaaacgtcagttgacggcacaacttgtacctacaatatttatgtgataggctaacaatacggcaggtttgcagcgaagaccaagccagatccttctcagtccctccacctgtgcccgcagcttgggttgcagcagatgaagtacagcgtcatggcttgttctcccttagtcggggcctgaaaaaaggcagcttctggatggttgcagttgtaacatctgacgcttctggtgcgaggcaggctaggatcagttgctgcatccttcaggacatccttgggctcaccaccaggcttgcggataacccttttgtacacacaagtatcagtggcaatctcctcatgctcgcacgtttggcacgcgtacaggagggtgcgcgtctccttgtcctcccgcgg

SEQ ID NO: 8815 - DNA, 432 bp, Zea mays
  Clone ID: LIB3279-192-Q1-N6-B1
aaccacataatgagatcttcaaagctcaggtcacagacacacaggttcacattatgttccaaaactctcatccaggcacagagcagttttcaaataacataagacctctatcacataacaattggtagcaaaaactaaagagatgaggaaaaggcggtacgacaaccatcagatgaccgtgaagagtctagtcgatctcctggagagaggcgccggtggcggcgccaccagcggcggcggcagcgacgtcatcggcagtaaacttgcccttagccttgtcggcggcgcggccccgggccttgcggtcgaggagcgccttacggtccttgtcgagcttcagcttggtgacgatcaccttggaggggtggatgcccacgttcaccgtggagccggtcaccttttcgcgggggatcccgtcgacgtggatgaccc

SEQ ID NO: 8816 - DNA, 529 bp, Zea mays
  Clone ID: LIB3279-192-Q1-N6-B11
ttttttttttttttttttttttttttttttttttttttttttttttttttttttttttttttttttttttttttttttttttttttttttttttttgggggggaggaaaaagagaattggggggggaggggggggggggttttaaaaaggaaaagggaaaaataccccaaaaaaagggggggggggggggtaaattggggaaaaattggaaaaaaaggggggaaaaagggggtaaaagggaaaaaaaaaagggaagggggagggaaaaataaggaaaaaaaaggaggggggatacttgggggaggggaagggaaaaaggctaggggaatttaaaaaaaaaaaaaaaaaaattggggaaaaaaaaagagggggaaaaagcgaagggacggggggggaaaaaaaaagggaaagggggaagaaggagggagcaaaaggaaaggaggggggaaaaaaacttagggaatgggagttaagggaaaaaggagaaacggggaaaaaggaagagggagaagggggaagaacctggggg

SEQ ID NO: 8817 - DNA, 366 bp, Zea mays
  Clone ID: LIB3279-192-Q1-N6-B12
atactgaaaggggcatccttgaacgaggtaaattggtatttctccaaaaatgcaagatccacacatccaacactgacaggtctaatagcttaggttccaaaagtacatagagtagcatactctgctactgataaaaaagctttggtagttcaacccgacgttgccatgtatccaatcagacctcctcgacggtcaaaccttgaacttgacaacatccttgctcctcttgatcttcactgagcgggcatccttcctccttgcggtgaggaggaagtccttaatctcatggatctgcttcggcatcttctcgcgggacctgggaatcgccgagctctttttttaacggcggtggctgggaccgacccc

SEQ ID NO: 8818 - DNA, 583 bp, Zea mays
  Clone ID: LIB3279-192-Q1-N6-B2
agtataaatggccagccttgacctgaatttatttcctttctttttggccgatatacaaatatacagttgctgagttggataaagaagacatctccagaacaaattaaatggactatgcgtgcattgggcgcgtgtcgcccgcaatcttcagtcagttctactttactgtcagcgcggagccagttttggctgctggatgtcatcaaaaaccacttcgaccgttttggctggccgtgtagtaagtcagagacaaatttctgcttctaaagcttgcctgatggaacatgccgactttagttgcttctccgagggcttgtaatcgatctgctatcctagcagcaagaagtcctcagtctccgcgctttcttcatcaactttacggcaatgctcatgctctcaggataagctgagagtgatcgatacaatggcaacgaggctgatgaagacgaagaaacggaccccctctctggtgccttgtgaatagtccatgggtggaaggtatccccgcaggccgacatcgtacacgggcgtgccgtcggggtagagcaagccgtagttccgttcggaggccgggccgggcttg

SEQ ID NO: 8819 - DNA, 424 bp, Zea mays
  Clone ID: LIB3279-192-Q1-N6-B3
gcaactgaaaacacaaatcttgtagccgaacaagaacaaccgggatggacatacagtattttttcctgggcgggttgtctttttaggaaacaagcgcccattggaaaagcaactaagtttctttaagccataattttaactgcctgacgaatgccgcccaatttttcaaaaagctaggactgacacaaatgccacgaaaccaagagtgacagagaagccgtcagctattattttggacccccggctgtattgcggcggcgtctgactgctcaccgatggtgacggtatcatacgtggtgtcgtcggcgttggcgtcccttgcgtggtgagggtcccttgagcactggagttggcgcttgcgtgtggagtgaccccccgtggcggcggcggcggtggcaacggcggtgattgtccatggggaaaa

SEQ ID NO: 8820 - DNA, 604 bp, Zea mays
  Clone ID: LIB3279-192-Q1-N6-B7
agtaggaaggcagcaatgtaaaaaacaaatgtgtcttgacaaatgcacataaaagtaagcagacgcttgtaactgcgctaggtatcatgaaatttcctcagcatattttgcaaacatacaaaaaaaactgcattggcaacagaatgaatgttttccacagcatattttctttattgaacaaatgactgcagtgttggataccctctttactgtttggcctctggctctttcttctccaggtacccctgagacctagcccagcgagataactgatagagctggacgctttcattggaagcatggcatgctagaagcaaataatttcggggctgtaccatccatgcaaacctcataaagagtccagaatacacacacatggctgctgtcatattgccagatatcatttcaggaggcttgttcatgtcaaccaaacccgcgatgacgaagccccagttggcgacagggccccagaagtgggtggtcttggggccgacggggctgttcaggaacgatttgagcgccgtcgccatgggggacgaggaagcagtcgagatcacctagcgcagctctcgtcgacgccgacggaagagactcacaagtcgac

SEQ ID NO: 8821 - DNA, 625 bp, Zea mays
  unsure (1)..(625): unsure at all n locations; Clone ID: LIB3279-192-Q1-N6-B8
aaaaacatatanctcgtatcataaaaacatanttaccgaaatcgtgttagagntggttgcaagatagttntgcgtnnggttggatgttagagcnnatcttttcaacttccaaaaatantttcttccaataaaccgaaaantgatgacttctataaaattttaaantcttaaaaaaatgctaccaatctaataacttctaatgttttttcagaaatctaatgagcttgtttttctagacctgcaattccaatgtcacgacacacttcggcagcaccaaagatttgcacatggccttcatgtgttgaaaagcactgctcatgtccttttctagttcatcgtccactttctcctcggcccacatgaaaccttgaatgttctgaacccactcaattaaagtagctaacgaccacaccacctgaattagcatagatatcaggtaatactactactcccttctcggcgagaatctacaacatatgcaagaggcagaagctcggaaaaataataaaaaaaaggttgcactcagaagtgataaaatacacttctcgcattaactgctccgacccaaagccaacaattttggactcacgcgtgttaacaatattatctattgcatcgggtagat

SEQ ID NO: 8822 - DNA, 580 bp, Zea mays
  Clone ID: LIB3279-192-Q1-N6-C1
gatatgaaacataattttaaaaacagcgtcacaaacaggaaatttctggcaaggctcaagctgttactaccatcgtttcgtagcaaacagaaacgccgtggtaattccacaaaagcacaaaacctcttggacttgatatgatctttcccccgttcaagaggatatatttaaatatgtttggcacgtccaacttcactcacaaatgtaagataaacaaggactaacaccaacaaggcactgcaacgctatttgaaccatcagaaacacttcggctgcaggggctagcgcagaaaacttaagcccatcaactgattataccagctcaacgtaatccgctcatcgaatcagtcgtcttcccagacctggcatcagaccaagctttggctattgtgcgcttcatatcctcgtcgccctcctcgtacatgttcttcattaagtccataattcctgacatcggatctttttccttgtccatgtttggcttgaacttgtcttccttgaagtgcaagtctaaccagttgcctttagaacccttgaaaagagtaacaacaaccctggttggtttcaccacaaccttaca

SEQ ID NO: 8823 - DNA, 606 bp, Zea mays
  Clone ID: LIB3279-192-Q1-N6-C10
gaagaacacaaatttactgaacagttatgatacatcacacagccatgatggccaccgtttagtgttttgaccgactagtaaataacagaaccaccaccatccatcaaattggatcaacattgtgcacagttctgtcagcaacaagtgcccaatagacatcacgattcacgaggtacagtagaagtcggcatggtataatctggaaccgactaaactcatactagccactcattgaagtttggtcatgtgctgtccccaatgatgtgatctttgataaacattatgactgaaatcagtattcttcagcagcactagctgcactcaaatccacactaagatccacagtctttccagtgatcattgtatacatgttcaggacatctgttacagttgtctcaaaatgtgtggtggcgtcatagctcgttgtgacaaagcaattatcaagagatggttcattcactggttcatatctgtcataaatttcatataatatctcatccacagaaccaagtagatcaattccaggctttagctcagattgcgggttatcagtctctgcttctgcagacacaaatgcaatgaacttccctcttggcgcaacattgt

SEQ ID NO: 8824 - DNA, 478 bp, Zea mays
  Clone ID: LIB3279-192-Q1-N6-C11
agaaaatgtaaacttcatatgaataagggataaaaggaccatagcaccctccacagggaaaaaataaccaagctatcccattctatctactgactcacttccatttacaaaatttagtcctaatatttatttgatcttgtcacagtaatacaagattagaccatccttgcaaatctgcctggtaaacatagttccattgctgccaagattgagaatatgtcctgcacaaacttagcttccattccagctttgggcatttgccttgtaattgtacgaaactatgaatcaatactccgagcatcaatactattactcaggacatcaagaatgatgctaggatatggtgtctggctggggctgcatgactgcgaagaatgtggccttagtccttctgaaaaggggtgacaggttccttttgatgattggccgttattattattttttaatcatggatggtttcgtttatgcttgttggtag

SEQ ID NO: 8825 - DNA, 434 bp, Zea mays
  Clone ID: LIB3279-192-Q1-N6-C3
gtcgcagcaactcatccgatacttaaacgaaggcattgtatgcaagaaaaattgcccgactgacaaacgaagggcagactctatgaccataaatgtttttggggaccgatgtcaccacctagtaggatagttacgagtgtttggagatctaagtctccatccaaaacaaattgttggaagaatcctccctctacatgaattattaatttcttcgatatgaaaggcaaaaacttcaccagatcctgattggaaaggaccgggaacacacactgctcttgttcgtcatcatatttctccatttaagcaccgccggagccgtacttctttccgaagaagaggatctggagctggtcatagccagaaagcacaccagcaccagcaatggcacgaagaatgttagcaccagcacccttgaacagggacttgggcccttc

SEQ ID NO: 8826 - DNA, 550 bp, Zea mays
  Clone ID: LIB3279-192-Q1-N6-C5
ctcgaggttccacaacttagacacaaaaaaagggttcattcgtcgaaagcacagtaacttatttatcaccactggtccactgctatgcatgctgcagcgacagtaccaggaccgaagaaacagcctcacgtacagctaggcaatcaggtttattacgatcacgaacaaacaccacggcgccggtcagaaaggcaccagcgcaccagtacggctcatcactcctgccccaggagcgcgaggagcatgctctcgtagtcgccggaggtgtcccccgcgacggcccgctccagcggcacgctgttcctcttctggtacgcctccttaatcagtttgaggtccacctcagcgcgggtggtgatgaccctggtcagggagttctcatctgtgcctagccccgctatggcctgcctagccaccttctcaaagtacctgtcagggcaactgaagcaccggatgatcgcccgcagcgttctgaggtactcgtcctgggggtcagccttcagatccttgttgattcggtggccaaatgcatcattgtaatgattgaatg

SEQ ID NO: 8827 - DNA, 545 bp, Zea mays
  Clone ID: LIB3279-192-Q1-N6-C6
aaaaattaaccatctgccgctagttatgaagataattgttcgtatttctttctgtcggtaaactttaggagtcttggccgagctctctgcaaaactgtattggctcatcgaatacctctagtgttaaatgggaaagaacacgacagctttggttttggaaaatagacgtagaaggtttacactctcgccggattttttcccaatagtagagtgccaaatccaggctatgtagaaggatccactaatcgtttcattgggtcagtgatgtttggcgaacgcctcttccaaagtcttcagccaattcacatactggttgcgctccttccgaaggaggtgttgaagaatcgaacttgccagcttggagttgaagcctctcgctaccagatactctcgtaaagcagcctgtagccgaggatccagatctctgcgcaaagaaagaaaggcaaacactgtcactgaatgcagatgcgccagttctacaaacaaacactctagtaggcaggcagttgtgttgatgttctgttctggagaacttgcatcggtta

SEQ ID NO: 8828 - DNA, 607 bp, Zea mays
  unsure (1)..(607): unsure at all n locations; Clone ID: LIB3279-192-Q1-N6-C7
tttgcgaacaaaaaccttgctcattcttctctcgtctcgtttcatagcgggagcaaccaaagggaacaacaggggtaccaacacctaatccaaaggtagaacggacactaacacggtgacagaagcgaacggtaacacgatactatagatagataagataactcggccgaagccaggatgggcccacacatcagtccctccagccgccgccgccgccgccgtagccgccaccaccaccctcgcgccgaccgccgtagccgccaccgcctccgtagccgccgccaccaccctcgcgccgaccgccgtagccgccaccgccgccataaccgccgtcacggcgcccgccaccatagccgccgccgccgcgaccgccgccgtagccaccgncgncaccgccaccgncacgggactgggcctggttaacggtgatgttacggccgtcgagctccttgccgttcatgttctcgatagcgtcgagcatggagttctcggaggagaaggtaacgaagccgaagccgcgagacctccccgtctcccggtcggtgatgaccttggagtcgaggatctcgccgtaggaggcgaaggcattctccagcgactcgttgct

SEQ ID NO: 8829 - DNA, 309 bp, Zea mays
  Clone ID: LIB3279-192-Q1-N6-C8
gagtggtaacattgatactgtattgtctgattcatagcggttcgacatgctcagctagcatagcagggaagcatcaagattcaagagtaccatctagaatacaccaacttcgtccacacaaagccaaacaattcattacatggttttatcataagaataagagtacaggctatcttttaggtccccatccatgcttccattattgccatgctttggagctccccaagtttcagcggtacttgatgaagccaatgtccttggcgttgctgcggaagcactgtctgcagcacatgagcccgtactttcgga

SEQ ID NO: 8830 - DNA, 595 bp, Zea mays
  Clone ID: LIB3279-192-Q1-N6-C9
gttcaatatggtagaaatttgtgagtgaaaatgatgaaatttggcggtccgagttctggctcagattcatttcgagtttctcaccaccgcattttcgcaactatatatgtgtctcaaaacaaacaagacagaaacacatctagcagataatcattttactgattctcgaaagacagacattgctgtgcctcatgttgaacagcatctactcttctgctgctcttgctggatcggccgccctttcatctgaactacattggagggcttcctctccagggctgcctgactccctgctttacttttcttaattgcagcagacattgccaagaacgcctcctcgacgttgatcgactccttagcgctcgtttcgaggaacgggatgcctacctcttcagcgtaagcctgtgctactgaagtgtcgacagccctgttctcggccagatcacatttgttaccaacgagaagcttgcatacgctgtcgttggcgtatcggtcgatctcatcaagccactgcttcacgttgttgaagctctccatgtccgtgatgtcataaacaataattatcccgtgagctcctcggtagtagcttctcgtg

SEQ ID NO: 8831 - DNA, 433 bp, Zea mays
  unsure (1)..(433): unsure at all n locations; Clone ID: LIB3279-192-Q1-N6-D1
gactcaatttcattcaaggagtacatattttttgttttaagtacaagacgtgacgcagatcttgtcccatgtgagctacacgtccattcatccctgggaattgaggagattccaagatttgtgtctcagcccaaagactgacaaaatccagggataaaaagagcaaggtcaaccggcagcacatcgtgaactccatatatccagctctaaactcaaacaaaaaaaaatgcctgttacaggagtaaagggaacaacaaatgccattgcgcaagttctgatcgccaaataggatagcactactgtgccgcgactagcacttcattcgtcatcctcatcatcatcgacaccaccccaagaattgagggcattgagcctttccacgagtctggcctttctctgcccaagcctnccgcgaaccctgggccggaccctt

SEQ ID NO: 8832 - DNA, 490 bp, Zea mays
  Clone ID: LIB3279-192-Q1-N6-D10
cgtttcaaaagcattacataagcagcaaaaccagaaataatcctctaggtgaataagcagacacaatacgaccccgcacacgtaccacttattaggacagtgacagtacagtacaaatgataagcaaggggcagatcaagaatcacaacacgtaggagccataaaaaagcatgatagagcgcaggcagaccagaccaaaagcttcttccgaaacagaggaggcgcctcatgcagaagacggcttctccgccttgaggggcttcaccacctcccaggtgaagtcggggtcgtccctcccaaagtgcccgtaggccgccgtcttgaggtagcgcccgttgccgcctttcttgaggtcgaggttgatgatgatcatgccgggcctgaagtcgaagttctccttcacgatcttcaggatctccttgtcggggatcgcgccggtgccgtacgtgtccacgaacaccgataggggctcgggcacgccgatggcgta

SEQ ID NO: 8833 - DNA, 428 bp, Zea mays
  Clone ID: LIB3279-192-Q1-N6-D11
acatagccctttatcatatcaaacaaagggggatagtttggtctgtccctccagccattttattggctgggcattaatggattggcactggcggcgagggggcggcaaggaaggctcaagcgtcatccttgtcagcgaaaatgtcgaggagggcgagggtcttggcgacggagagctcgagcccaaacttgggcccctcgtaatggtgaaagatggggcggaaggcgtcctcctccaggggatcggagatcttccgggttgccactcgcacctgtgcagggaagcgcgacttgccggggcactttttgtcctcccaccccctcgggtcgatgttggtcccccccaaacttgcggccttgaaaattccccgccacttgggggtggagtaattgttaaggaaaaagggcaacccccggcgggtgggcccc

SEQ ID NO: 8834 - DNA, 460 bp, Zea mays
  Clone ID: LIB3279-192-Q1-N6-D12
gatattccacaaaaactggattttttatatttggtttctcgagttctgaacataacaatctgttcattatatacaaaacacatgctaactctacaagtttccaaacataaccatcacataagacgaggcgctgcatccaaggcaccaaaacagtaggcctattactacctaatcttcttcgaaatacttctcctctgcgtcatagttggcttctctggaccagtggtcatccagcatctcatcgttatcgatccgtgagtagtccatatgttcggtgtcttcaccggacaggaacttctgttgcatcacatacgtgaactgctccagctggtcctgcatctcttcagaagacaacgtttggttcaaagcccttgcagcagagcctcccccattaccgggctccacttgtgcagatgcatcattttcgaccacctcagtcgcaatctgcttctcgacctct

SEQ ID NO: 8835 - DNA, 501 bp, Zea mays
  Clone ID: LIB3279-192-Q1-N6-D5
gcagcctaggccgaggtgaacttggtgacggccttggtgccctcggagacggcgtgcttggcgagctccccgggaaggacgaggcgcacggaggtctggatctcacgggaggtgatggtaggcttcttgttatagcgcgcgagcttggcggcctcagcagcgagcttctcgaagatatcgttaatgaaggagttcatgatggacatggccttggaggagatgccaatgtccgggtgcacctgcttcagcaccttgaagatgtagatcttgtaggtctccacgctcttcttgcccttcttcttgcccctcttgccctcgccgccttccttggcagcggacttgccagcggggacccgcttctccgccttcggcttcttcccggcgggcgccttctcggccgcgggctcctcctccgccggcttcttcgccgcgggtttcttctcggccttgggcgccatcgatgcggggcgagttggggttttggttgcgaagggggatcgg

SEQ ID NO: 8836 - DNA, 538 bp, Zea mays
  Clone ID: LIB3279-192-Q1-N6-D6
cagggcaaaggtttaatttaaatgctcaaaacttaacattgttcacgtccactgccacttcaccgtaccaaattcctaggcaactttagcatcaaaactatgttttttgaagtacatagggagacccaacataacattcagaatcaacgaaatagagtggagatatccagagggcatcatatttatgcattttcggtcatagggtactcaaagaccacatctttcccacacagcctgcggtagaccgcagtgcaggtctccagcttgtattcagtgttgttcctctcctttgggtccaagaaaatcttgataatcttggaaccatccagacggtatctgacacgcttccccacaatctcagctgggtagacaacatcctccaagatgccatcgtgaacagcagtcagagtcctggtgcgagggcgcagaacagctgaacccttcttgggtggcctcacaatcctccgtgtagcaacaattaccacatccttgccgctgaatttcttctccagctccctgacgagtctgacatggatct

SEQ ID NO: 8837 - DNA, 458 bp, Zea mays
  Clone ID: LIB3279-192-Q1-N6-D7
gctggaaatccaattggtgaaactgcagtttatttacatggcactcagactgcacgcggacgttcatggggtgtttaattgcagttgctgcaataaacatcgagtgcagattacaggtatagtaggtgccaacttgactatgggtctggtttgcccattatctcctcatcacccgagtcgtcttcatcttcactcagctcttcgtcactggactgctcttctggggtgacaccagcatcccctggtttggcgtatttttcacagtactctttcactttttgttcataagcagggcgatcacgcatcatcaacgcagctgcatctccatttaatggatcagaaggattaggatataacagaagttgtggaaggaagacctcgaacacattgacaagatcaaacattgggctccaagtctggttgatgacatccaaacagactgaaccagacatttcatc

SEQ ID NO: 8838 - DNA, 484 bp, Zea mays
  unsure (1)..(484): unsure at all n locations; Clone ID: LIB3279-192-Q1-N6-D8
aaatctgcaatacagaatcactgtaaacaaatccaatacagaatctgcaatcactgtaaatctgaagcaccatgaattcgaaacctctgtacatcacaactatccggattctagctattcatagttgcaggttagttatcagagtcaagaaaacacaccggtgttttctctgctttccttttggtctttgccttaggttgaccttcatcttcgttattattcaaatcgttttgattagcctgtggttcatagagtttgtcaccctcctcatctgaatcaaatgtgaatccatcaagggtaccttccaccatagtctctgcttcaaataaattggattgtggttccagttgaatgaagtcattcattatagcctctatctttgcttctgattgtcccacactcacaacacaaaatgtcctggatggaactatagntggtttgtatattggtcctttcagggccaacaacaaatcctgttttgcag

SEQ ID NO: 8839 - DNA, 447 bp, Zea mays
  Clone ID: LIB3279-192-Q1-N6-D9
ggcccacaacgtttttgttttcatcgttttccgggggcagagaacacaagttaaaacccttgatttttttttttgggaaaagaattccaatcaaatgaatttcggtaagtgcgtgttcctgttgtacaataaagttagcgtactttaaatagctccacaccattgtttccaacaacagaaccagggacttgtgccagtggaatttccatcccgaggatttttcatgtgattcgacagtttaggttgtgcctgtcttgtcgcccttaattttaatgctcgacgaacagtttttgtcagtccaccccatgacttgattttccaagtcatagacaaccaacttgtttgaaagcacaagatcttccataagcacaatgtccttcccattttttgattgtaatgcaccattttggaatcccacacagtttttgtcattcccatttgggaaaa

SEQ ID NO: 8840 - DNA, 534 bp, Zea mays
  Clone ID: LIB3279-192-Q1-N6-E10
gcctgtctccagaaaggtctcgattatactcatataatacccaagataagtcgcaattcagctaagcaatcatgcatggatgctgtagcaaagtataaccgctcaggcgacacctataaggctataaccctttcttcacattaacggaggtaaaagaaaaaggaaaactcaaccacaagttgcagttcaccccgacctggtgcctcagttggagctcgctccgaaaaccctgattctctcttcgacttcagcgctgcagcaggggcagcgagtgatgcctttatcttcatgcagcttattgcagccaacacagaggacctggtgggcacactggagtaggatcacacacgccgccgcctttttgcaggcaacacagtcccggcggcggcttggcttctgggctggtggtggcagcgaccggttagatgcaagttgtggccccaggatggcctgctgcttggctgcctgcgccgcgcttcggttagctgtgccaggaaagttggctgatgggacaactgtttgagttgcacctgc

SEQ ID NO: 8841 - DNA, 582 bp, Zea mays
  Clone ID: LIB3279-192-Q1-N6-E11
tttaaggagaataatgcattgcatgaggagctcatacgtttcaatgactttcaaaaactttccatggcatgcatccttcatgttcttagtgcatgcttctttttaagaaaagaagaaatgaacataaattgttcagcaggcatctgtggcccacgagacaataaaaacagtgcccttcacttgttagaggaaacattttattcaaaaggacagattaaaattgcagacacaggaaaaccttcaacaggacagcctctgcattccgatgatgcttttatccaaaaggctgttagaagtcaagtggttgcctcaagaacgcctccatttgcttcgccctgttcctgattgagatatcaagcaccttctgcccgaattcaatcactaatcctcccatgatgctgtagtcaatcttctgttcaaccaaaatagttttgttttccccaaggatatcctgcaaggtttccttgagttctttctcctcctccttggtgagtgaaataactgtcctgaccacaaccttcatctcccccttatgttccatagtcaaatcaacaaatctctccgcaatgcgttcaatatatt

SEQ ID NO: 8842 - DNA, 605 bp, Zea mays
  Clone ID: LIB3279-192-Q1-N6-E12
caccaaagattattttccatcaggcttgccacggtaatttcgattcagcagctcgagcagaagaacagctgcagagtccttggcctttttcacactcggcattggctctccaatgcactcgtcagtccatccactgtcagatgtatttacccttaccgcataaacaaatcttttggcatgggcagggccaccctcgtttatacacctgtactgtggcatcggccattgccttctcaagcagatgtcgttcagagtctgcctagtgaactgagaaccgtttttcttctcgccatccttttcagtgtctttctttgctgcggtttccttctctttcaagacaacaagtgcatttctagccgccaacttttgtgccatcttcttctgtgggttctgagctacaccaatctgtatgccatcaaccaagacttcaactgtagctacattgcctgtacgggatgctttgtattctaatccttcggcttgctgctggcagcgctcttggagctcccttacagggtgcatcggaagggtgtccggcgtcaccattggatcaagcagaggctgaaaaaccttccagactacggaggtagcacacccactatcaa

SEQ ID NO: 8843 - DNA, 451 bp, Zea mays
  Clone ID: LIB3279-192-Q1-N6-E2
aaaaaaaaaaaagggaaaaaaaaaaaccctttttaggggaacccaaaaaaaaaggggttaaaaaaaaaaaggaaaagggaaaaatttttttaacccacacaaggcggggggggaaaaatttttgggggggggtaaaaaaaaagggcacccggcccttaaaaacaaaaaaaaaaaaatgttgccaaaaaaaaaaaaaaaaaagggggggggggaaaaaaaaatatttccaaaaaaaaaattcccggttaaaaaaattttttaaaaaaaaacgggggaaaacccccttaaaatttttggaggtttttttttttaacaaccagattaaattgggaaaagggctccttggaaaaagacgcggaaaaaaaaatgcaaaccctttttttaaaaaaaggggggagcccccaaaaaaaatttcaaaaaccgggagaaaaatccggaggcaaaaactttt

SEQ ID NO: 8844 - DNA, 492 bp, Zea mays
  Clone ID: LIB3279-192-Q1-N6-E4
aaaaaaaaaaaaaacccggaaaaattgaacggggggaattgcaacggggttcccaaataaaaaatcctttacccccccaattaaaaaaaaaaaaaattaccccaggggggggttttcccaaaaaaatatttttttttaaaaaaacccaaaaaaaaaaggggttgggggagggcccaaaattttaccccccccggggaaaaaaagaagggtcaaaaggttaaaaggcccccctttccttttttggggggggggcatttggggaggtcccccggtttagggtgggggaaaagaaaaaccattccttgtagtttcgggggggggaaaacctggaaacccaggggcccgggttttttaagctccgggttcctggacccccccggaaaaacctaccccttctttaaggaagggggggggagtttttaaaaccacccccgggggagggggaccccccactggggggagcacccttttattttcttggggggggggggg

SEQ ID NO: 8845 - DNA, 513 bp, Zea mays
  Clone ID: LIB3279-192-Q1-N6-E6
caacggggaacatatataagtttttggtctccgaaaaacttagtttaaacaaaggggccacagaagcaccccatagcttttgcccataaagattagggtaaccaactgccttagcattgtccttatcgaaagataaaaacttttttaggacccgatcaaactgccatttaagggacacagtggggaccttacacctaaggaggggccaaaaccggggggcgcggttcgtcctcgtccttggggggggggatggccaccaggcccggaaaaggagtgatcgggccaaccttgcctttggggtccaaataaagcatgatcttaaccttgatgccaaaaacaccctgtttgaaaaaaacgtgtttaacagccgaggaaatggactggttaactggctgaccaaaagaaatcatgtagccatccttgaacttcatggacttggttttttgggccctgggttttccactaaaaataacctaaaaaccctgggcaccattttccataacataacgaaaa

SEQ ID NO: 8846 - DNA, 345 bp, Zea mays
  Clone ID: LIB3279-192-Q1-N6-E7
gcccactaacgatacttaccgaaatatggcacatatcaggtgaacagtgaccaaaactacaataacagagttgctattgtcatatagtattgtgtcatcgacaacaaggtaaaacataacagaaggcccaaatgttgggtaaacaaacacggttcaacaaccacacagcaatacagcccaacattgtccatgaaactgactaggagcagcacctcagttcttgatcttcttcttggccctcagctggttgctgtgaccacacttcttcttgcggcagttgacagccctagggtgcagtcgtgcatagcatttgcggcagatcatcttgtcctggttgtacttgcg

SEQ ID NO: 8847 - DNA, 608 bp, Zea mays
  Clone ID: LIB3279-192-Q1-N6-E8
gttgggagaccagatggcagcatcatacacagcacaaacccagtaaatcagtaatccatggattcatggagcagtcacagaaaactagctgaagcagtctagcctaagagatacacatcacatcccttcttcgcttgcaaagagtagctaagcaaacaacggctggaaggaagagcaggcaacacgagcattatgtcgtcacaggccatcagggcttcatctcctcgtcatcgtcgatcttgggggccaggtaaaatctaatgtaacccatctcagcgatcttgtactcgaccaccactggaagctcggacgacaggctgatagtgacttgctcagacagtgaagacgccttggtgaaggagttcatgtaccgcagggcaaaggtcagggaaaccggctcctgcatctctataatggtagcctcttctggcttgtcaatagtttggttctgcctgcagacaatgtttgcactcccaatttctccagatgtggagaatttcacgccctccttagtcaccgagatgacgactgtgtctccgatgctgctaagatctttgcagatcctcataaactcagcagaaggcatgcggacgatggcctggtactcg

SEQ ID NO: 8848 - DNA, 496 bp, Zea mays
  Clone ID: LIB3279-192-Q1-N6-E9
aaaaaaaaacaggggttttttttttcctttttaaatagcaaaggacaattgggggggggacacatccccttccaagccctttggtccaatttggagcctacgcataaccgttttcgggaaaaagggtcctgttaaaaataaaatcactccggacaggaagtttttgcctttttaggggacttgggggcttttttgggcaattttgcctttttgttcccgccattggaccctttttccgccgtttttttgggaaaaaaaaaagggttttttttggggagcacacccccgggagcgatggtaacccccccaaaaagtttccaaagttttttgtttttccggatcgccaaaagcacgtggggcggaataatgcgagtttttttgttgtccctggaagatttaccggggagctccaaaacctaaggggggaggttttcaaggacagcggcaaggtaaacgggggccccggtcccaacacccttggcgtaggggccctttt

SEQ ID NO: 8849 - DNA, 286 bp, Zea mays
  unsure (1)..(286): unsure at all n locations; Clone ID: LIB3279-192-Q1-N6-F1
ctcggggngnnnnnnnnnnnnnnnnnnnnnnnnnccgcggaaaacagacgancaacacccagaacggaggcagggcanngannnagnacacagacagcnaaggcncncagcnaccnnacnccacncaccacagaanncagcnaaacggcnaccaaggggggcgnacaaaangaaccagcaaaagaacagcacagaccggaacagagnnagccnngcncaaaaacaannnncnagagggggccaagcaaagngggnncaaacnncaaacagagcgccaggncaccca

SEQ ID NO: 8850 - DNA, 436 bp, Zea mays
  Clone ID: LIB3279-192-Q1-N6-F11
ttttgacaacacactgagctctcatgacagctcacagaatcataatacacagaaaagccatcatacacaacattctcatcacaagtcatacacaattccagcacactagttcttccacaacagaggttcaaacatacaaaggttccaccacaaaggtttgaagcattcaaacagattgcacgtagttctgacaaagttctaaccacagatatgttctagcaaggtagaaaaaccttaagcaaaggcatcatccccagacttggtatgcatccctacctcaatctttctgaagtttcaggacagctcgtaacagagcattggactgttcaaacttggtatgcatgcccttcacttactcttgggcctggcgcaacaaacttgggttaactttaagtgcggactgtagagcttagaaatgaacttgcaactatagctg

SEQ ID NO: 8851 - DNA, 569 bp, Zea mays
  unsure (1)..(569): unsure at all n locations; Clone ID: LIB3279-192-Q1-N6-F12
aacttgagacatttcaaaacctttgctactgcctactggccggtctaacaaagaacaggagattaaatccaagatgcaccagaattatgccgctgtgacaattctccgtcgtacacaaagatcttacatataagcaggttcctagctaagtacaaggtaataaacatacttatccaaagaagcaccgtggggctctaaaccctcgtacaaacattttgttaagttgctgcccccagagtgtcggattttgggtcagccagcttctgtgttgtaatactacaaataaggcttgtgtgacctcgcaaaacagagaaactggctccaaagggaaatgagaaacaagcagagggccaataaaaccatgatagggggcagttggcatcacgatgctgctaacttttacttatcaggtagacgtctccccgttctaagcatcctccagctttggttcaagttcatcagagagatggtttggctctaccgacaaagagcttactgcttttctcttacgggctagcatgacttctgatgtaggtgcctcatcggtgagagaaggtngttcactggca

SEQ ID NO: 8852 - DNA, 443 bp, Zea mays
  unsure (1)..(443): unsure at all n locations; Clone ID: LIB3279-192-Q1-N6-F2
gctagaaccatcaccatcagtntgggttgctgctatgtgccttcttgacgatgctagggccaccttgtccaatcacacttttcactggagtagacttgattgagccaccatctgataaggaagcacgtggcaccttgctatccactggtgcattgtctttctctgtcttaaatcctggtctgtcaaggtctgttctctttgtctcccttttgttttcattttgataactatcatcatcacttgaattacagtaggtctgtgccaatctgtcaatcttttgccgtagcagacgaacatcgggattagcagcacatatttccaaaatttgggccaacattgagttattgtaggtaacagttttcttaatgtcggccacgttggcaaggagcaccgtattcaggttcagcaatatgtcaatgcaaaccccgcgtagctcgtcggcg

SEQ ID NO: 8853 - DNA, 534 bp, Zea mays
  Clone ID: LIB3279-192-Q1-N6-F6
ttaaatatgcatcacaagttgccttgtttttcagtgagaatatcttcagtgtaccatggtaaataggggttttacattgtagatgacattatttgcactttgcagtgtttgtagagtgaagattaaaatacgggatgtgatagaggataaagatagaggaactattggggatagccttagatattttactactagttgtccaattcattatgaagacaggaacatgattcatccagcatttggactagtatatcctcaaagcgtccatgtggctccttcgcccatcgagcttggccgcgaagaagcccttcatgaaatccatgtagtccatggatctgtaccgtgccccgccactgtctctttccacgagctcctgcagagggccgaccgtcgtgttggggcatgtctgatggaacatcgccgccgagatgcgttctttgtccgggtgtacaatggctctgtgctcaatgcttctgtacctcccattgcttagaatctccagtatgtcgccgatgctgacgactaaagcaccgt

SEQ ID NO: 8854 - DNA, 603 bp, Zea mays
  Clone ID: LIB3279-192-Q1-N6-F8
ggcgcataacagttttccaatatcgagaagcaataatgtagtgtagacaaccatccataacgacgttcttaataacccagtggcaaagcggggcggacataaccagaaagtcttacaacatcaggtgttgcaaaccacaacggggacaagagcagcacacaagcctgacgatgaccgcatcaggatacttctagtactcatcaccatcatcaccttcctcaccctcatcaaactcagcaccaacctcctcgtagtccttctcgagcgctgccagatcctcacgggcctcagagaactcgccctcctccataccctcaccgacataccagtgcacgaaggcacgcttggcgtacatgaggtcgaacttgtggtcgatgcgggagaacacctccacaacactggtggagttggagatcatgcacacagcgcgctgcaccttggccaggtcaccaccaggcaccacacttggaggctggtagttaatgccgcacttaaagccagttgggcaccagtccacaaactggatggtgcgcttggtcttgatggtggccacagcagcattcacatccttggggaccacatcaccacggtacatgaggcagc

SEQ ID NO: 8855 - DNA, 494 bp, Zea mays
  Clone ID: LIB3279-192-Q1-N6-F9
ggagttcatacattgaccccaaccttgcgttcgaatggtgcatttttcttgataccaaaaaaaaaaaaagacagcaacaagcaaaaagtacatgtcgatcttatgtctctacatctgaaaaaaacgagtggacggactcctttgccccagtgccctatgttattctaacagcttggaaaagagcaggcgcaagaggggaagaatgtcggtgtcacgagtcgggcaggaactgggctttatcctcccgctgtacctcgtcctgcaactgctgcgactccttggctttggcgagcatatgcgccttgtacctccgcagcctttcctccatcctcgccttgtacgaggtctcgatgcggtgcatgacgtagaatccaagtacgccaccgaggatggtgccggccatcacgcgcacgtaagcccaccgccgcgaccccggcggcgccatcgctcacaaatcaccaagctgataccgcgccgccttcagccgccgctgg

SEQ ID NO: 8856 - DNA, 488 bp, Zea mays
  Clone ID: LIB3279-192-Q1-N6-G1
gggacaaacacacacagcttgataaattggcatgcgacatcagtctcgtcgcgcctttcgcaactacgggacgacaaagaaaaaaaaagagaaaaaaacaaaattacagagaaatcaacagcacgttcagacattactagggactgcagagaccgtggagggagagggaagaattccattcctcaacctcctcctcatcttctggcaccgcctctcgcaaaagccaggatgcatgcaacgccgccttccgaaggccgaagcacaccctcgatcacgctcccagctagctgtaatttaagggtaataattcaccaaggagcggtacgtcccttcggccttccagctggccgggatgacattgctggcgacgaggaccttgcctgagtcggaggtgagcctgagcgagaagggcgctctcaacgccttgccggagttggagttgtagcgccacagcgcgccccagttctgcaccatcggggtccatgtgc

SEQ ID NO: 8857 - DNA, 534 bp, Zea mays
  unsure (1)..(534): unsure at all n locations; Clone ID: LIB3279-192-Q1-N6-G10
tagaaaccatgatagcaatctgagatacatgattaaaggaatggtttaatagtacatgcacaattaaatgtttctttttcgtttccaaactaggctatgaattgtccacgaccaagctaaaaaactctacccactaaacagtaaactgctgcgcagggacgaacaggcagcattcctgcgtataagcaaccactcgtcgcagccgttgatcatttcctctttttagtaggtggttgggggacttcatcatcatcatcatcatcctcttcagattcttcctcctcttcctcattgccatcgtccccatcatcgtcgtcgtcgtcatcatcctcttcatcctctccaccatcatcttcgtcgtcatcgcttcccccttcgccattggctgcaggatcatcatcatctccatcgncatcttcctcattctcattgtcatctgatccctcatcaccaccatcatcttcctcctcgttttcagcatcatcatcgnctccttcatcatcattatcatcatcggactctccatcatctttg

SEQ ID NO: 8858 - DNA, 513 bp, Zea mays
  unsure (1)..(513): unsure at all n locations; Clone ID: LIB3279-192-Q1-N6-G11
aacaaaaaccttgctcattcttctctcgtctcgtttcatagcgggagcaaccaaagggaacaacaggggtaccaacacctaatccaaaggtagaacggacactaacacggtgacagaagcgaacggtaacacgatactatagatagataagataactcggccgaagccaggatgggcccacacatcagtccctccagccgccgccgccgccgccgtagccgccaccaccaccctcgcgccgaccgccgtagccgccaccgcctccgtagccgccgccaccaccctcgcgccgaccgccgtagccgccaccgccgccataaccgccgtcacggcgcccgccaccatagccgccgccgccgcgaccgccgccgtagccaccgncgncaccgncaccgncacgggactgggcctggttaacggtgatgttacggccgtcgagctccttgccgttcatgttctcgatagcgtcgagcatggagttctcggaggagaaggtaacgaagccgaagccgc

SEQ ID NO: 8859 - DNA, 456 bp, Zea mays
  Clone ID: LIB3279-192-Q1-N6-G12
gttcactctaatacgatggttgacgattcttcatcacatttgtcatataacacagtctgaaaaactcaaaacttgagtactgaggataacaaaagcctacagacataacgtcagataagtcttggacagtataagcgaatttgctaatggctgggtagcgagggtctaagactctcagtcaaacaggctgaagcccatgtcgatatcagactcctgcttgggctcttccttcttttactctgcagcaggggcagcagcagctgcagtacccccagctggggcggaagcatcaactggagcatcgccaccaccagatccaacggagaggattagatcctcaacgctgcgcttatccaggagcttagctaaaagcgccagccagtaagactccagcttgatgttggccgcctttacgatggcagcgatcttcttgtttgtaatagcgataccggcaac

SEQ ID NO: 8860 - DNA, 618 bp, Zea mays
  Clone ID: LIB3279-192-Q1-N6-G2
gtctcaggatcacattgtgaccaaaatctcaaatttgttatgttcaaatttgacttcccagaagctttgcactctgcatacctctcctgtcttgtctgtgtggtgtaatgctatctgacgctaatctaaccacccccgtgctggtgtggtgctacagagctgagcttaatcacatcacggtgcaggcggcgttggggttctcgtcgctcagcatgaactcggcgttgctcagcgactgctggtcgtagaaggccgccttccacgcctccagctcagccgacagggccttggtgatcgccgcgtccttcccgtccttcccatccttctccttctccttctccttctccttgccgccgccaccgcctccgtccttgtccttgccgtccttgttgcccgaccccggcgccaccacgtccacgggccgccgcagcttcttgcgcagcttctccggcagggccttggcgtccatggtccccgtcaccgtcacctggttcttgcccatgtccatgcgcacctgctccactcctttgatcttgtacagcttcctgcggatgcggttcatgcagccgtcgcagtggagccccgtggagcctatcctcagcaccaccgtcgcgacca

SEQ ID NO: 8861 - DNA, 457 bp, Zea mays
  Clone ID: LIB3279-192-Q1-N6-G4
acgaaaaataactaatcattctcttaaacaaatggggaaaaaaaagcaagcgtatcatgtcaggtcgtcatacacacaccaacgttttacaaattttagtcctcgtcgctgtcatcaaacacgacagcctttctacgatgcgaaacagccggctgcttccttggcggagaatcgtcgtggtcctcgtcctcctcctcagacaccagctcctcgcgcctttgcccaccaccccctgattctctcttacgtttcggtgcctccatttcttcatccgacagaggcgcttcttcttcttcaacatcttcctcgtattcttcctcctcatccagctcgtcctcccttcttccacgaggcggtgaatgttcgatatcctcaccatccgtttcgtactctgactcctccctctcactccccgagtattcatccgcttgacgtctcggtggacgggcaggagggt

SEQ ID NO: 8862 - DNA, 437 bp, Zea mays
  Clone ID: LIB3279-192-Q1-N6-G7
ggattgaaaagtgttaagagcacaactcagagatcatgctagcgcttatcaaaaacacgatgacctctaagtcaatctcagtggcttgagtcctccaaaggcgtgagtaagaaaatcttcgctactggctttggagactgtatccatggaggcgtgcttagagggcatctgaaactaattaaggtcataatccacattgaattgtgtcaataacaaagccggaacagggagtcccctaggggtctgattttttggcataggatatagccatggcgctctccggcgagatcttagaagccttggagagcctgcatagcgaccatggactggccgtcgttctacgaactccacaaaagcgataactgtgttagctcccatcatacttactttgcagaagatacggttctggtggatcaggatctggagcatcatgctcg

SEQ ID NO: 8863 - DNA, 468 bp, Zea mays
  Clone ID: LIB3279-192-Q1-N6-G8
tcgctagaaggatcacaaggttctgaaggttcggtcatttctgtacagcttgctgagagttccaagtgtgagtgactatggggccgaggattatggcactatggactgtggtgggtacaaagacggaatcagcacattagattgcagccatgttttagataatggatcgaggtcgattttccatatagatcaagcatcacctttcttggagttggccagctgtggttcatcaacttcaactgataaccaggatgtgatgaacggggagcttgtttttattgaagctcagtacaagcacttggttgatgagttgacaaggatgcgagaagaggctagggaaggagctcgaaaaaactggttgccagatacatgatgtttttgttcaaatttggcatttcctctaaacatcataaactatgttcgatttcatgttcgaagtgtgagaaatgttaataatctgttttagtt

SEQ ID NO: 8864 - DNA, 590 bp, Zea mays
  Clone ID: LIB3279-192-Q1-N6-G9
agaggaacactctgtatattattctagcaaatccgagtacagcactacaacagaagatactagaaatagaagaaccagtaacatgagaaggaaggagaggaagcagatgagaaatgaagacttcagtttataaattgattctttgatgatccttcatagcttgaaccgctctccttttatagccgaacatgcccatttgccacctatctaaggccccacatgacagtgtgctaacattccccactgcttaaaatacggcttgcccccaagccgttgataatgtagactccagggcaaggaacctatagaagaccatgaccatcaggttctcggaggccatgctcaattcctgctcttgcagcttcctcagaagtcttggaaacattaaaaacaacaccaccatcaatggatctgaaaagctgaacattccatgtatctctctgctcagagttgcaaagaatatcagtgttgctaggacacagaatacagatgacatccgtgcatgggcatttgaggagtattcatcagtaaggcgcagagacaagcaatggattcctttggaaatagcagttgcagcataatgtttatac

SEQ ID NO: 8865 - DNA, 562 bp, Zea mays
  unsure (1)..(562): unsure at all n locations; Clone ID: LIB3279-192-Q1-N6-H1
ggccgcaatcgcgcaaattattggattttaaagtacaataagacagcaaagtttccatcgagtcacacaaaccccacatggcaatgccaacacacgccttcaagcatataacagtagtatttacgaatctaccaaacatgagtagcagtccacaggacaatgggtcattgcggctcaacagcataagcctgaatcgcatctgataaagcctgaaacaacctttcagccgcgggccttaagctcggcgaggcggcgagaaaggtcatcctcgtcgactttctccttatccttggcggcagggatggcgtgggcggctgcctgcggcagaccgacggagacctcgagcccgtagtcgtccgcgacctgctgcatgaggctgttgacctcggtctccggcgtggagagggaggtggagcctgccatggcgccctccatgaactcggcctggacctccatgttgacgaactggcgctcgaaattgtccatggtctcggacatcttctggaggttcccggtggccagcgaggagtcnagcgacttgacgatggactgcatggacttg

SEQ ID NO: 8866 - DNA, 192 bp, Zea mays
  Clone ID: LIB3279-192-Q1-N6-H10
tttggtttttttttgtttgtttgttttcgagctaaaacaactcattgcaagttagacatggtgatcatgtctatccatccactaaatcataaagctttggctctgcggaactttcctccttgccccggggaggggggggtcgggggattttgttgccttaaggagatttttctttttaatcttatttttttt

SEQ ID NO: 8867 - DNA, 604 bp, Zea mays
  Clone ID: LIB3279-192-Q1-N6-H11
ggcgcataacagttttccaatatcgagaagcaataatgtagtgtagacaaccatccataacgacgttcttaataacccagtggcaaagcggggcggacataaccagaaagtcttacaacatcaggtgttgcaaaccacaacggggacaagagcagcacacaagcctgacgatgaccgcatcaggatacttctagtactcatcaccatcatcaccttcctcaccctcatcaaactcagcaccaacctcctcgtagtccttctcgagcgctgccagatcctcacgggcctcagagaactcgccctcctccataccctcaccgacataccagtgcacgaaggcacgcttggcgtacatgaggtcgaacttgtggtcgatgcgggagaacacctccacaacactggtggagttggagatcatgcacacagcgcgctgcaccttggccaggtcaccaccaggcaccacacttggaggctggtagttaatgccgcacttaaagccagttgggcaccagtccacaaactggatggtgcgcttggtcttgatggtggccacagcagcattcacatccttggggaccacatcaccatggtacatgaggcagca

SEQ ID NO: 8868 - DNA, 595 bp, Zea mays
  Clone ID: LIB3279-192-Q1-N6-H12
aagagcaaaatataagcttgtttgatgcatatcatagccataaatttacatgggagatgtgagttgtgacataaccagaaaatagccatgccaagcatgtgtccaagcaacaacagggcaacagaacatgcattattgcattcaaacaaggcatgagttggtaaggtttgttaaactgaatgctaaactttcctccaagagtactcttgtgttttcctttggtgattgcagagctagcatttataggaaaacatgtatgcgcctatctacaatagcagatgtcgtccacagcaccaagttcgtccattgaaaagggacctcaactctggtggctaccctaataaaattgtgccccttcctagaacaccaactccaggccatgacaagggttgcggagaagaggccgctgcctcacatgccatcatgtcatgcagcacgtcatctctccttctgcagaagcaagacaaaagcctgaacaagggagttctccaacctgacttttgtaatatactgcatttaaaccttagcaagctggttagccttagcctctgttaatttcccatcaacaagaatgacttcagcgaagatcagggca

SEQ ID NO: 8869 - DNA, 411 bp, Zea mays
  Clone ID: LIB3279-192-Q1-N6-H2
gaaccactgaagaaaacacttcattcagacaccaaacagcaggtagtacagaaacaagcccaagcattttaacagccatatacatggacagcactgagactaacaacttaaagctaggaataacattaagtttgcaaataagagaggtttatggctggccggacatacaagtataaaccagttccaggttccagccgtcttgcagctactgcaaaacctatataacgaagacctataagacttgacaacttgggagagccatggaggaatccgaagcttataacgaggagccctacaagttttattcttcagtagaaccaattggccccgtcgttcttctgcgccgcgcctgggtaatcagcggcggcggtgctagacatgttgaaaccagagccgaacctgaactccgcc

SEQ ID NO: 8870 - DNA, 355 bp, Zea mays
  Clone ID: LIB3279-192-Q1-N6-H3
aggaaaatcgtgatttccccttagcttgcatagtctgtctggaaacaccagtcttattattcggatgtataataattacaaaaaacaccatcactgagttttgcaacaacggcaaaactgacacaggttggtatagttacaaaaacaccatcactgaatttcgcaacagcggaaaaactgacacaagtttgcgtgcccaattttctagtgtacaacaagggccatgcatagcaatcccattattacttttcggcgaagtgcacagaggggaagtcctgtcactctcctcgatcctacattcctgctttgattcctctgctgaccagcaaagatcaaagatttacggacgcgtggg

SEQ ID NO: 8871 - DNA, 597 bp, Zea mays
  unsure (1)..(597): unsure at all n locations; Clone ID: LIB3279-192-Q1-N6-H4
agagtgaaaatgcatacataaacatgacgagccaattcctcagccaaaaaacattatccatgcaacatcatataggttcgagtaacggtaaacggtcatccacatagagcaaaattaaagctcgtcttgacaaacacagaanacagcaacaccacccagagagggctaacttcataatggccacccgccaagagccggcaaatggcacgcagagcctacagcctccttccctcctaccgccctttttgcgagtgctgccaggggggaccggggtaacgtcctcaatgcgtccgattttaattccggaccgagcaagcgccctgagggcaaactgggcaccaggtccaggggtcttggtcttgttgcctccgggggcgcaaagctaaatgtgcagtgcagtaatgccaagctccttgcagcgctgtgcgacgttttgagcagcaagcatagcagcgtaaggtgacaactcgtaacggtcagccttaaccttcatgccaccggtgatccgaaccagagtttccttcccagacaaatcagtgatatgaatgaaggtgtcattgaaggatgcaaagatgtgagcaacaccaaagacatact

SEQ ID NO: 8872 - DNA, 435 bp, Zea mays
  Clone ID: LIB3279-192-Q1-N6-H5
ggaacggttaaggcgttcaaagatagcaaaaaaaatacgacagtcagcaattcaaacaaaataggatcttaagacaacattgacctacacaaagaaccaaaagcagataacgccatgctgaaccaccaataccgataaaactttcttagatcttctcataatatttgacagacttcaagcagaatgaaacaaggtaggccttcagctctgggagaccatctcgtggggcttgtcacaagagagcacagccaaaacgacttcctccgaactccaaaactcggtttagaagaccatctcgtggggcttgtcaccatccctaagggagaaccgagcgccaagataggccttcagctctgggacagcctcaatagccttgatcagagcagcatccacggccttctggtcatcctttttgaaatcaggcagagacttgga

SEQ ID NO: 8873 - DNA, 168 bp, Zea mays
  unsure (1)..(168): unsure at all n locations; Clone ID: LIB3279-192-Q1-N6-H6
acagcaacttaatgacagtattcattcaggagtgcgaatctccacttcaatattcagaatacaattatttgggccaacatttttctaaagctcatttcacttactcgggcaaggagatgagaccgtcactattagtgtctaacagcatanagaactccgatggagcac

SEQ ID NO: 8874 - DNA, 468 bp, Zea mays
  Clone ID: LIB3279-192-Q1-N6-H7
gccatgggagctgatcagacacttcagttaccctacgtggcattctatcaccaggaaaaaaaacctaccttgtaatcttcagagatcaggttaccagagaccacaagtacctaacacacaaggatacatgtcatcggcgtggcaagattgtcgccgtccacataagttgcgatccattagcatctcaagccgccttgcaatatgtagccatgttaaggtttcagtttcttctagctaccgggccagaagcctgtatgatggcatgtcctcaatcctctgaatatcttcaattaacagctccctttctagctgacgccgtgtagacttcatgaccgtgttgaagtccatgtaagtagcatgcatgtcaagccattgctgatccatcagcttgaaggttatgcagtagagaatgtcaaaagcttgatcgttttctgaaagaagttttaggaaaactgctccaacaatgac

SEQ ID NO: 8875 - DNA, 304 bp, Zea mays
  Clone ID: LIB3279-192-Q1-N6-H8
agctatttaaacgatggccattatcataattcccatgccaaagccgattattttttaacccaaacaaacttactggcttgacttagctgataacaaatcagcaatgcaagccgcacggacgaccagatagttgagcgtgagcatgcatgactttattcggagctgaacaccacccgggagtaacggcggacctcaacgatggtgccatcgcccggagcaagcctacccatacgtagtatggactttcgtaaagatctggaagaatacagtggtattttaggctctattggtaacaaggctgtag

SEQ ID NO: 8876 - DNA, 567 bp, Zea mays
  Clone ID: LIB3279-192-Q1-N6-H9
acacgtcgtccctatttctccatttgcggctccagctttccatacaggtataaagccaaaaaaccacagaagaaaagcaatccagtaaaccaaactccagcacatgattgtcgaccaaaggaagcatcacagaaacaatatcaataatgtgatgagcataacactaggatgcccatgtaaagacagaacgtaaattttagggcaagtcactgggatcggccagtgccacaacgtagaagtttgtccaccgattcagcagaattaacttgacgatacaactagtttagatcatgtcggaagcatcttcagctgctctgagccgactcagtcttggcttccgccgactcagtcttctcggcctcagcagcatgtccggcagcttgaggtttcgacacttcttcttcatcactatcatcctcaaaatcatccattcccataccacccataccgcccattccacccatgccaccaagaccacccaagccagccatatcacccatgccacccataccacccataccgccaaaattcgagaaggccatcccatccaagttgacatcagcacca

SEQ ID NO: 8877 - DNA, 339 bp, Zea mays
  Clone ID: LIB3279-193-Q1-N6-A10
gatataaagcatcaaacaatccatactactcaatactcatgacaagacgcaagaaaatcatccgccgactcgattttactgatgacaaaagatgaacaaggtggtaaatgtaaagcatctccgagatgaagcaacaacgtaaacagccataattattctcaataacccggtagcaatgcaggggaattaacaactcttacaacatcaggtgttgtaaaccacacaatacttcagaacagacacacataacacgatagcaggagcaactctcggcagatcacgggataagggcagcacactggcctgatgctgcgtcatcagcaaacttttctagtactc

SEQ ID NO: 8878 - DNA, 606 bp, Zea mays
  Clone ID: LIB3279-193-Q1-N6-A3
cgaagtaactgaaattgataacaaaatatccggttgccaaattgcagactctctttggacagatgcacatacccccacgctaacctgaaacacacgcacattctgctacatgattgtggccgcaagaaggcaacctaaacagaactctttaagttacaactggctaagcactacagggacttacaagaaaattcagctatagccaagttaaggttccacagctactaatcaaaaaccaaagaaaccaagctcagtcgccctttccttctcaaaggtttcgaagtattggtatatgattgtcacagcgagcaatataccagttcctgaaccaatcgcacccatgaaatcagccaggacggtcaatgcgccaatgcatacaccaccaaatgcagcggcagtggggatgtatcggttaagttccttctgcaagtttgactcacgatggcctggcatcaccatttgttgttccttgagctgcttagcaacatcctttgctgatgaaccagaaacttcaatccatgtctttgagaacagagcacaggctgacagcatgaagaccacataaaacagtgcatggaatggatttgcaaggacatcagccaaact

SEQ ID NO: 8879 - DNA, 357 bp, Zea mays
  unsure (1)..(357): unsure at all n locations; Clone ID: LIB3279-193-Q1-N6-A4
agtctataaccggctttaattcgaaccgactgcacggaggttctttaatggtggatgaatgaatactgactgcatcatgggatgaaaccatgaaactgcaccgcgttcgcatccagaaacaagtcaagcagggacgccggacgacaccgctagctcgtccctgaacagggcgacggtgtcgcggacgatgtcgtcggggcgcgccgtcgcgtcggcctcggcgaccccctccgcggggtcgacccgcagcaggtcgagctggctccgcagcaggctcgccggcatgaagtgctccccttccaccgacctccgcagcaccctctccgcgagcacctncgccggcgccctcaggcacac

SEQ ID NO: 8880 - DNA, 221 bp, Zea mays
  unsure (1)..(221): unsure at all n locations; Clone ID: LIB3279-193-Q1-N6-A5
aaaacgaagtgtatctttcacatttcattaacctttatgattacaacataacatcgaatcctttgacgcatcgtcctttaaacttttaggcatgaaacgaggggaataaaaagcaaaaggggggatggggttcaatagcttctaaagcatgtttnnatgcanntncagcancttgatcagcacaaggaaaattcttcggaagaatcgtaactcttttgatt

SEQ ID NO: 8881 - DNA, 513 bp, Zea mays
  Clone ID: LIB3279-193-Q1-N6-A6
aagcatagtttttccaattttagagttactatgtcctacataaaatcaattcaaacaacaataaattaggagcaaagtgactccatcctaccatattccgaaaccaaacactacctaaatacatctgataagtaataacctatttggtaatatggcgctaatacacaattctaaagtggggacaacaagctgccttcaaagaaatcatgcgtccattgggggcgcagtacccagagcagcaacttcatagtggcatcacaactgatgaatcattgcctctgagaatcctcgccaggaacttcagcaaagcaaacagggcataccttgtttatgctaagccatcttgtcacgcagctggcatggtatacatgcttgcatggaagcgtaatctgcaaatttcctctcctgtactccatttggcaaatcacacacctttcacggcgtgttttcttccttgaaaagaatccacacttatacttagtgatgggaagcaacgaaatgcattcttgggag

SEQ ID NO: 8882 - DNA, 246 bp, Zea mays
  Clone ID: LIB3279-193-Q1-N6-A7
gggcagagatgaaaagaaaactagccatgcaattctgttgcagaaatagacaactttgtgaatacaaaaacttccttggatacaaaaggttttgctgttgcaaatacaaactaggaactttttaaagatgtggagaacgcgacagcttaatcggtttcgtcaacgaccttggtccccagccctttcaagcccttggcagggatctccgcgacggtgacaagggagtagagttcctccttggcatcc

SEQ ID NO: 8883 - DNA, 569 bp, Zea mays
  Clone ID: LIB3279-193-Q1-N6-B1
gcattggaataggagcaagatcccataaactggttcgatacataaaccctggatgcattggaaggagcaaaatcccatgagctggttcgatacataatactttgacatgtctattaggttctacatgtatggaaaatcagacactggaacataatctctggcaggctccatgaacttgaaatgctctctatttcttcttgtcagtgtgcgtaccagccgacctcatcttcctgaggacgcccgccatctcctctctcttcttctttgccctcttgtgagttccaagctttctcttagcaagcttcagggcacgcttgtccttgccaaccttcagaagctcagtgatacgcttctcataaggagcaaacccagcaacctctctgatcaggcccctgaccatagacaccctcttcgttgatttccccttgcggtggcacgggcggggaggcagctcgcgcttggtgacgacatgacccttgttgatgccaacgaagaggcccgactttggctgcggcggcgccatgagtacgaaccctttcctggagcggacgcgtgggcgaacgcgtggg

SEQ ID NO: 8884 - DNA, 468 bp, Zea mays
  Clone ID: LIB3279-193-Q1-N6-B10
ggcataacacgcatgcattagattcgccacttaggatccatcaacatattgctgcagtgtctcagttctcaaatcagtccccagttcaagcgttacaaattatacagctcaggttcaaaggaggcacacgacatacaaacgttaagtctgacattttcatttcccccagaagactgtttacataggtaatgtggcgagtaatagatcaaccatcttcagtgttttcccttgtcttcactcttcagcgcgcttcatattggacaatccggcgggtccgcttcttgtagaggatgcggtagccacattcacggcactggatgacatctccgggcttcagggtgttctcagctccgcaatctccgcagaggtaactgacaggctccggctgctgcggatccatggtcgagcgctctagggttttccggcggcaggtagttcgtagagaggtaggtgtttggaggtttcttc

SEQ ID NO: 8885 - DNA, 598 bp, Zea mays
  Clone ID: LIB3279-193-Q1-N6-B11
aaaaacaagcgtgcagctattcggttatttaagagtgacgttggaaccgaacacacaatacaatgcagatttgtacatactgccctcgcttgacacccaggtcgaccagacacttgagaaatttactttacttatttggtcactagtgcttggcatacaactcagatggacttataagcaacacaggttacgcacatatacagcggtaacatctaatgacttccagggacaacgggagggagggagggatacgatcatgtcacctggaacagcaacaatttacgccggcgaattatttcaatggagcaatccccggctgtcggctgcctaaagagcaacgccacccaggttatttacaggggatcaacgacaggcttgagcttgttggatcgtgttttatatgtcatcggcgtcgcttccgcccaagtgagcatcttgtggaacccagtattggcttccgtcagggcccgacaccttgtacctgctcaggacaaatcttgttgcagtgagtctgattccaccagattaacaatataatcgatgcaccaatctgcaaaccgagttacagatctgtttgaacagaggacatttctttggg

SEQ ID NO: 8886 - DNA, 461 bp, Zea mays
  Clone ID: LIB3279-193-Q1-N6-B12
ggggggggttttttttttttttttaaaaaaaacaaagggggggcgggggggggaaagggggaaaaaagggggggggggggggttttttaaagggggttttttttttttttaggggccccaggggggggggaaaaaaaagggggggcccccgggggaaaaaattttggggggcaggggggggaaattttttgggataaaggggggggggggggagaaaaaatttttttctttggggggggggggggggaaaatttttttttttttggggggggggggggttaaatgggggttaaaaaaagagaaggaaaaatttttgtgcgggggggaaaaaaaaaagggggggggggtggggagaggttttttttgaaaaggggtgtgggggggagaggatttttttatggtgtggggggggggaagagaggcgggtggtgggggggggagctctttgggggggggggaaa

SEQ ID NO: 8887 - DNA, 548 bp, Zea mays
  Clone ID: LIB3279-193-Q1-N6-B2
tttttagtcgcagcaactcatccgatacttaaacgaaggcattgtatgcaagaaaaattgcccgactgacaaacgaagggcagactctatgaccataaatgtttttggggaccgatgtcaccacctagtaggatagttacgagtgtttggagatctaagtctccatccaaaacaaattgttggaagaatcctccctctacatgaattattaatttcttcgatatgaaaggcaaaaacttcaccagatcctgattggaaaggaccgggaacacacactgctcttgttcgtcatcatatttctccatttaagcaccgccggagccgtacttctttccgaagaagaggatctggagctggtcatagccagaaagcacaccagcaccagcaatggcacgaagaatgttagcaccagcacccttgaacagggacttgggcccttccttcttaagaatctgctggaacgcgtccaaggagctcttgtacttgacagcctcaccagatgtcatcatcatccttctgcggacggtatcgatggggtaagatgcaag

SEQ ID NO: 8888 - DNA, 332 bp, Zea mays
  Clone ID: LIB3279-193-Q1-N6-B4
aactgcaaaccactaattaattagactgaatcactgaactaaagcttgtagagtaggtacaaagacaggcaaaaatcccgtatcacgttgcatgggaaaaaaatgggcgtctctcaagaaccatcacgtgacttgaaccaggcagtcaccgatatcatcacattcctagtaaagcgggagctagctagacttgaaaacaaatccgaaagcctaaagctcgtccttgtcgtaggacgacggctcccgttccggctccttctcctccacctccggctgctcctctgcctcgtcgtcctcctccacggtcgcgtcggggctcaggtccaggccct

SEQ ID NO: 8889 - DNA, 596 bp, Zea mays
  Clone ID: LIB3279-193-Q1-N6-B5
gagcaaatcgcttacaaatgataatcagataagtagagtcaacaagacaaaactgtatctggcaacgcacatcgcctcaccccagccgactacaccattattcttcagcaaaagcaaacagctccttccctcccccctcagctcaagcgataaccataagaaaacctgctacgcgactgcgtatatgataatgcatatgcatgcaaaagataactgacaggccagtgtagcgaacttcatagcacacaacggcccgagtgagctgcaagccgtgtgcctagtaccggtagtgggcaggcttgtagggaccctcgatcggcacgctgatgtagtcggcctgagacttggtgagcttggtcagcttggcaccaagcttgcccaagtggagagcagcaaccttctcatcaaggtgcttggggagcacatacaccttcttctcatacttgccagagctcttctccttccacagttcaagttgggcaatgacctggttagtgaatgagcaggacatgacaaagctaggatggccagtagcacacccaaggttcatcaggcgaccctcagcaaggacaatgatgccagtgttggtctcgggg

SEQ ID NO: 8890 - DNA, 527 bp, Zea mays
  Clone ID: LIB3279-193-Q1-N6-B6
ataaactcatgttgacgcgttggtatttttattaaggtatcgaaaagcgcccaagcttttccctaattctcgtttaagacccaagcaagggaatgtttacacgagacccaagattgtgattaggtaactccgtagatagctctagctcttctccacaagtaagtggtgctccggttgtggcctcttccggatgcttccatcgtctccttatcgagttttggtcaaaacatcgcgaaccccattcccaccaatactcgatagcggccacaccacaaacacaaccaatatgatatcattgcatcccttcccaatacacctattacaatgacgcgcacaagcatcaaggggtaagaggtgcgcctgacctcacttctaatcactaggcctaaatctagagcaagagccaaagatagtggtataactaatataagtacttcacaaattactcacactaatcatcaagtgatattggaccactttggtgtctagggctactagagatgagattcaattatcttggtatgttc

SEQ ID NO: 8891 - DNA, 590 bp, Zea mays
  Clone ID: LIB3279-193-Q1-N6-B7
agcaagaaacatgaactcgtctaccataaatccatggcgatatagaaaacagtacttacaacagtatataacaagcttcacccacggatggaaattaaataagtgacgagcaaggcaaacacctaagtggtcagcaaccacagttttacaccttgcggatgagcagaaagagcctctgatcaagctcaaagctagcggcagtggaagggtcacccctgagcagcataagaagcccgccgaacgatgcatacatttccactttagcgttttggctggatgatgtgtcttctgagattttgtaaagcttcccttgcatgacgtactcataattgtctgccagagtttttctgccagcctgagtatagtagccagtatctggggtgccatccaaattcagagtaggcgctataaccatgttaaatttctcaccagcatgcataggataaacatctgtggcaacatctagctgcatatacatatctaactgctcactgcgagcttcaacacgagaaactctatcaaactttttgccatcagggtcgagtctagtgacgacgaaggtgtcctcaaagagatgctcagacatttct

SEQ ID NO: 8892 - DNA, 479 bp, Zea mays
  Clone ID: LIB3279-193-Q1-N6-B8
cgaatcccactcattcacgggggcccaggggggggctttagttcccacaaatccccggggaatcagttccgggccccgggatccatgcaaaacggggtcctgggcctttacatggcgcgggaaaatttaaaaccctgggaaaaaaggaccggggctccatacgggtagatctccatgattgggaggggagcagtccggggggggggaaccctaatctaaataaataaagcggtttccaaaagaatcagatcccataccatacccccacaggccgtaacggtttccatggaccccgcggcggcggaggcaaagggaacatgggcggtcctgcaaagaacatggggtttttggcccccccgccggggccggaacccgacaaagctcccaatgggggaactagaccagcgttgcccgccagcgttgcttcaggggaattggagttcccgggggcatctttgaacccgttatggggggggggg

SEQ ID NO: 8893 - DNA, 592 bp, Zea mays
  Clone ID: LIB3279-193-Q1-N6-B9
tttttttttttttttttttttttttttttttttttttttttttttttttttttttttttttttttttttttttttttttttttttaaaacaacaaactttttcaggtttggccatagttggggggggtccgcacacacaaaaaaacgggtccttttttaaaccaaccttgccccgatttatgacacgaacgggggtttttttgccaccctcctttgggggggggccccaaacgacgcgggcccttggggggtttaaacgacccttgattttttgccccccacgggaacggggcaaaggggggggggggctttcttttgggatgttgaagtctgttaaggggcggccttcctccagttgtttgccgggaaaaataaaacccttttggtccggggggatgccctccttggccgggattttcgccttaaaattggggaggggggccgagctttaaacctccagggttttggtttttccagggagggttttaaaaaaaattttgttaccccccctggggggggaaaaaaggggggggggtcttttcttttggatgttgtagcccgggggggggggacctttttccaattgtttgcc

SEQ ID NO: 8894 - DNA, 599 bp, Zea mays
  Clone ID: LIB3279-193-Q1-N6-C10
cagtccacagcagcaggcagcatttgatcactaaccattcattgtctgataatacaaccgaattgcaaatagttcatgacatatgctccataattgacttctaacattaaaagtgctaagaacacaaatagcaaaactttgaaaatgcaaccagagacaggcacgcttgttgtcttgattgggaatgatcggacagtggcagtatccaagcacccgacgagctgctcagcggtagcggcggagggagagggtctggttgcgcttccaggtggctctccttgagggcctgttcttgtggtgggtgtggcccttgccacgcaggccacggtacttcttgcctgctgaggtgaggccacggagctcacggtgcttgtgcacagggttgcatagccagttgatcctcgggtcggttttgatggctttgtgggcaacgtccacaaggatgatctcaaagtacttgtaggtactatcctcattcacccagtaggagttaagaaccctcagtccaccaagcttacgtccagctctctcctcagcgacagacctcttgttcctctggaacttgagctgggtgataccctggtgcttgggcttgccat

SEQ ID NO: 8895 - DNA, 187 bp, Zea mays
  Clone ID: LIB3279-193-Q1-N6-C11
caagcaaatccttcatgggggagccctgttttcactcaaggggaatagatgcgttttgcatttgcccttttcgaaggaaccaaaaccaatccgtaagattctgcatttaggagttccaacaattcagcataacccgaatagcaaaacctgacaacccttaacataaaacgtcataccaagtcctaaa

SEQ ID NO: 8896 - DNA, 599 bp, Zea mays
  Clone ID: LIB3279-193-Q1-N6-C4
gaatcaccggttcattatttgagtccatcaggcatttctcatgtaacatgattgagacgacaaaagaaaagagagtcaaaagatactacacgaagcattccagagatgcttctaacacttagccagcattgtcgctaagcacacgttttcacaaaaagaaggcaaaagaaaagcaaggtgcccgcacttcatgctagtttggaaggtccttcagtattccttcttaccaaagtttttgcaccacagttgagatgggattggccggactgggtgatgcgggcgttgctgcataaaagtatcatattacattcgttagaactgtgatttccacaacctccatctcctggttcttgcttttgtacagggtgtcggcatttagttgtttttcctttgaacagtccttggtatttttgatttatcttgttcctctgcagcaggttgtccttattaactagttccttatcacaaggattcttgtcatcagatccatcaagtatcaatttagtagcagtgtagccccctgtagactcttccacaggagaacattcctcacatattctgaacatagctgcaatggtccatttcctgataaagacact

SEQ ID NO: 8897 - DNA, 89 bp, Zea mays
  Clone ID: LIB3279-193-Q1-N6-C5
ggtactgaaaaaacaacttccctcattgaaaacagattattcagacagttaccgagcttgtcaaagctatgataaaatggtgtaatcgc

SEQ ID NO: 8898 - DNA, 494 bp, Zea mays
  Clone ID: LIB3279-193-Q1-N6-C6
aaaacagggaaaaaaaaacccagtttgccccttggcccttttccaaggcccctttccaaaataaataactgggcgcccctcccccgggataactccttttccccaaaatttggatgacaaaaagttttggaacttacaaaattcccccctggcctccaaaggaggaagttttaagggggaaaaaaccctttttccaccctttggatccctcacccctttcccaggggggacccccccccccggttgctgcttttttaccttcccaaagaggtaaaaaaaagccccaaaggtcaggccgcttttaatcaaattttgggggccccctggaaagctcaaaacagggccagggcaacaccctgggactcctgccttgattccaccattttttccccggggttttttcaaaaagcaggtttctaaactttgaccccccccaagaaccccaaatttttttccaaatgccccccctttcccaaaggggcctttaatcccct

SEQ ID NO: 8899 - DNA, 382 bp, Zea mays
  Clone ID: LIB3279-193-Q1-N6-C7
gtttagatcggagcggcccttttttttttttttttcagggataatcacagccaatatatcgactgtcctcaacgggggtacaccaacaagacatcggatcatatacaaccaagttttgatggctgtttgcagtcgcatcagatcattgtctttaagcaaacaagttcggtacagcttataatcaatcaatcaccagcccatcatcatgcactcagaggcaaagcttgcaggtcgcgtctaatcgtcgtcgtcaaggacacttcgacgcctctgaatcgtaactttggtttgcttgcttgtgtgggtgttaatttgctctagaagggagataagtctttcttcggacaccttttcagatattccaccagtttgagcagctctc

SEQ ID NO: 8900 - DNA, 457 bp, Zea mays
  Clone ID: LIB3279-193-Q1-N6-C8
agggccaaaccaatgcgaattagattattgtacaacattacaccctaaccattccagaaagccttccaatctaattctcacgatcatcgttttaccaaaaaaatcagtagcacaaagtgctccattcagtgtgcaaaacttaaacgaccaagacaaattctagtaacaattgcttgtggtggtaggaagcccaaagaggtataatgattggtcacaagttgaatatctgaacaggccagctgcgcttccggccatctgaactgattgctgtggtttcaaccgatatgtctatgctgcggtgctcagatgccctcacgatgctgatccgagacctgagcgccgtagctgggcactcatctgtgccagccaatgcagatgaacccagggttgattcctccttcgccattgcaatgggctcttcaaaggtgaagattgtctgcgaccagtgagttggtgt

SEQ ID NO: 8901 - DNA, 302 bp, Zea mays
  Clone ID: LIB3279-193-Q1-N6-C9
aacttctcaaacttcgaaatgcacattcagagtattcacatgcacacaaacatcacgagataaaggtggccaacaacaaagagagaggatccacaaataagcaactagctggattcaataagcattgttactgttccatcagataacagttgctaccggaggagaccagacacagcagcacctaactacagcaagacacgcgaacatacgagggaagcctgcaagcggaggccacgcagcctaggacgaggtgaacttggtgacggccttggtgcccctcgagacggcgtgcttggcgagct

SEQ ID NO: 8902 - DNA, 602 bp, Zea mays
  Clone ID: LIB3279-193-Q1-N6-D1
agaaagaacacagaacacaataattacttaatctaacattacccaaactgacattatgacaatgttagccgatgacgacgacaatggaaacagtaatctaggtacaagcaggcgcctctgctagctggcaagtgtgaccacacacaaacacaccagaccagaggcagaaccacccgccagtggcgccaacgaggagcgctatccgttatagcacgacaaaagtaaaaataaaacatcacgatgtggagtgaaactgaataattctagtacatggatataggctccttttttttgatcgccacggggccttgtgtagccgctccattgttggatgaagcaccgtccattgtctcgagcgagctctccatcactcgtcatcatcttcatcctcctcgctaccctcttcgtcatcctcgtcattgacctccgacttggacttgtcagactcctcttcgtcttcctcctcttcctccttggcaggagccttcttagctgcagtgctctcgcccttgttgtaggctgcgatggccttgttgtactctagcttgagcttgttagccttggctacatagggagccttgtccgactcgctcagggatttc

SEQ ID NO: 8903 - DNA, 603 bp, Zea mays
  Clone ID: LIB3279-193-Q1-N6-D11
gttccggagaaattatcatatgaccaaacttgtaggtaccttacaaaaaaactgaacaagagctcaagtccacgacgttatgtgtcagactctctatacaactacagcatagtttgacatggtttactctctactctctctacaactaatgcatagtggtcgtggtgttgcttggctatggccctccaccaattgcctcccccctcataaccgttaccaacgcacctttgcgttccatctcctggataaatcgcttcacttctggttcaagatttggagcttgtcggacaacaataccaaagacactgctactgctttgagggggagcttccatgcttggacggtccagtccatggtttgaaggaaatgaagcattatcagactgtaccttgtctggctggtttgaaacgcaatttcccttctcaacctcctcctctacaattgcatcacctttatcctcctttgctttgaaggccgcccataggtagtgtttggtttggaatgtctgatatctttcaggtagtagaacagacgggaatatcagcatctcagcttcaccaataatagctcgcaagatcaaatctttatccatgacttcattaa

SEQ ID NO: 8904 - DNA, 570 bp, Zea mays
  Clone ID: LIB3279-193-Q1-N6-D12
ttgaaagccaaccaaccacacatacatttagcatcacgcattgtctgtaaacacagttagaactgtctcaaaatcaacccggacagatcatacgatgacacgaacaaagcaacctaactcagataatacatcacggtgttaaaagagcacgaaacctaacaatcacataaggcctggtcactggtcaggcagcaggggcatccttgagcgtcgcaggatcgaccttcggagggtcggaatggcgcctcactctttccctgggcttctctgtcggcacaacgcttggcttctcgacgacggggaacgacaggcgcttcttgacaacggagtgggccagaggcgctctctcaggaacctcaagcttctcagtcagtagtagactgcggtaccgagacttggcccgtgcagactcggtcgactgcatgtagctggggagaggtggtgtgctggtcaggctggtatcgtcccggaccgagcctccacccgtgctctgcctccttgggcgctcggagcggatgctcgtgatgctcctcaggtcatcctccttgtacagccaactgttccttggac

SEQ ID NO: 8905 - DNA, 525 bp, Zea mays
  Clone ID: LIB3279-193-Q1-N6-D2
cctaaaatcaaattaacaatgccaaaaggttaacatatagctcttacagcattcttgtattgcagaaggtgaaatagcaagaaggtaccaaataaatagataaaagtgcacaggctaacagagctcaacagttcacacaataacagcaacgaccacaaacaaaacttgtaatgatgaaaactaggtattgctaaagcaggcgcaggatcgcatcatttcttcttggcagcagccttggtcaccttggcgccggttgggtccttcttctccacactcttgataactccaacagcaaccgtctgcctcatgtcacggacagcaaacctaccaaggggaggatacgctgagaatgtctccaccaccatgggcttggtgggtatcatcttcaccataccagcatcaccgttcttcaggaactttggctccttctcaagctccttgccagaccgcctgtcgatcttggtaatgagctcagcaaacttgacagcgatgtgggaggtgtggcagtccagcactggggcatag

SEQ ID NO: 8906 - DNA, 391 bp, Zea mays
  Clone ID: LIB3279-193-Q1-N6-D3
gcaaaaccaaatattcacattgtcactagaaacataaacattcgctgtcatttacagctaaccacgacagtctgtggttcatcaaatcatcaggtggtggtagatatacctccatactgtttttacgttggacggctacatgatgaaaccacaaaactcatcacgcttcagggcaccttggacaaacccagtggcatgcttcttcatggtctcctgccagactccattgactccaagatagggctggtgtccctcaggacaatgtcaccatggtcatctggttcatcttcaaactctgtaggtcttatgttgattgagtttgcattaccattactgtgtgtctcagctagctgttggaagtatgcgtgtggccatagggctacaaataaat

SEQ ID NO: 8907 - DNA, 342 bp, Zea mays
  Clone ID: LIB3279-193-Q1-N6-D4
aacttagagcatcatataattatcctcaaattacaatataaacccagtctcagaacatgctagaatgaatcaaaaaggacggtttacatcgcctacgtctacagcaaaggacgtctgcaaagggagaccatcatcccaacgagcctcagccatgatgcaggagaagctcgccatcctcgtcacaagatgcgcctacttagatctctgcctcattttccggcgcttcctcttgagcctccgcatcctcttcttcttccacttggcccgcatcgcgtcggaacaggtggagcgcgcgctcgagctacctgtccctgattgcggcggctgagtactagtgagttg

SEQ ID NO: 8908 - DNA, 470 bp, Zea mays
  Clone ID: LIB3279-193-Q1-N6-D5
ggccccatccccggtggaattttttaaggcttttccaaggcctcgcccggtgggaccggatttaatcctaaggcctggttgggtggcaaaggaattaatccctcctattattaggccagccggccaaaaaccgcccttgggttaaccttgggtttggggtaacccacaaggctttttttacgtggttgggaaaattaattgtgggggttgccaagttaccccatttttggcttaggttacccaaaaacctggcggttttttttgtttaaaacttaaaattggccccgttggttttaacttggaataaccaactgttggggaaaacccttttttttccccaaaaggaaggggtcttcaaatgaaaacacccttcccattggttccagttgggccctgccttgaactttaaaaaccattcctttggtttttggaacatccccagccaagggttgggaccccttttttaaacc

SEQ ID NO: 8909 - DNA, 608 bp, Zea mays
  Clone ID: LIB3279-193-Q1-N6-D6
gcgggagaattccaagcctttctgtaaaggctgtcatcatatcgtacttacattttgtagttttccagatggacaggcgtcatgagcttccaggaagcacaccaaaccatcatcagatctatacatcatgtatcttcctttgaacatctattgctaccaattcttttagtttttctgtgtatgcatattctaaacctaaaagaatatcacaacctatttcattgatcttggaaatgaagatctgtatctcctatgttgtcatcatcgtcatcgtcaaggtaatccacaggcacatttgcaggccgccgtttcaacctttggaatatgtcatcaagagattctggtgaagagacattcaaatttggaacaaatcctggatcttggcgcaaaggaagaaacttcttagaacccatatttgctttgaaattttgaaaaccaatcttcatcgaggcccatgttgcagacacaccagttggtggtacaccagcattggacccctgctctgaatttctttcttcgagcaaagatatagagttcggtgaaatttcctttctcactaccttccctgactgccggttctgttctctaatagaagtgtatttgctggc

SEQ ID NO: 8910 - DNA, 604 bp, Zea mays
  Clone ID: LIB3279-193-Q1-N6-D7
ggatgcaaccctcccacaacatcacacataacggacagccacgccataacttggattgtttgtactaactgggtaccaaacccaacacagctaaccctgacatgcaaaatcaggatgaccaccaagtactactcagtcttgaagagcgaactagatgtaaaaactcatgacaaccaccaccagaaatacctaactactcggcccaaaaggagctgaacaggggatttcaaagtcaggataaccaccagaaacagttaactggtccggcaaacggaaatgggacagttgcttccgctgctttgaccttccaagccacacttctacttctgggtgcaactagtatgtacaccataacccactaactcgggtcaaacggagcgccttgatatgaaagatcaatttgcaatagaagtccccgctgacttatcatcatcaggcaggcccaggtcattgtgaagcaaattgatctgtgagaactttggcagcacagatttcacatcagaagttgttgctgactcctcgttctgcaggtcttgattcatgttgctgctactctcgggcaccacagtcttgtggtaatcagcaccaggtacgcccttgccat

SEQ ID NO: 8911 - DNA, 468 bp, Zea mays
  Clone ID: LIB3279-193-Q1-N6-D8
acctatacaaagattggtttaatattttctgaatgtctcgagaacgatcacagcgcacaaatggcagctgtggagcgtccggccacgacctagccaaagggtagtacgtcggtaacaactccatgcctgatatccttcacgttgagtttctttggcgctagacggtcactgtctgatcatggaacctgaccagcggtggcacgaacccgtgtggccgattcactagcctcggtctaagcctaccataacgaactcttgcttgaacatgttgaacacagccggcatgacggcaccaggagttacattggagtccatggacaccttgtggcatgtgaccgatagccaaactatactatatacattgcatgtgggccagcatcctcttgatagatgcaatacatctctcacatgatattccagcctttagcacaacagtatgggccatatggcgagatgagatgatggccc

SEQ ID NO: 8912 - DNA, 546 bp, Zea mays
  unsure (1)..(546): unsure at all n locations; Clone ID: LIB3279-193-Q1-N6-D9
aatgtcttaaaaatatttantttgggaacagcagagtacgtagcgtagatagtacattagtacatcaagacacctactagtagctatttaaacgatggccattatcataattcccatgccaaagccgattattttttaacccaaacaaacttactggcttgacttagctgataacaaatcagcaatgcaagccgcacggacgaccagatagttgagcgtgagcatgcatgactttattcggagctgttcaccacccggcagttccggcggacctcgccgctggtgccgacgcccggtgcaagcctccccatccgcagcatggactccgcgaagtcctggaagaatacggaggcgtcgaaggcgtaggtggcgacgaggctggcgacgtccgcctctaccccaggcacggcagccgacgacgccagtgcctggtctgacggcagcagaccgtcgccagagagcaggttgatgtagtactggttgtcgaaggtcgccggggtggcgaggtccaagtgtgccagcgcggacccagccgaccccgtgcac

SEQ ID NO: 8913 - DNA, 420 bp, Zea mays
  Clone ID: LIB3279-193-Q1-N6-E1
tgacgctgaggcttcatcacatggcccaagatcatcaaatgaatcatcgtactcatcttcatactcatattgcgagtcaaggataacagatctagctgcatttttagcatttttcgagtccaggattgcagtgtccggcaaatcatcattggccttccttgtaaatctaccttttgggacagatgatatggatgaggatgggcccagagatgctgatgaaatagcagaagatggtccctggaatgctgaggaaattgcagaagatggcccaagggatgctggtgaaattgcagaagatggaccttgtgatgctgatgaagttgctgaagataggccatcttgaacaaagtaatgtgtctcagcaactttatggggtttctttgtaatttgaggcacagtttccaccaatatacccttccc

SEQ ID NO: 8914 - DNA, 521 bp, Zea mays
  Clone ID: LIB3279-193-Q1-N6-E10
cgattattaactgcagattccattaccatttgaagttcatcacaagatcgtcagtgatcgtcgccatccagggaactgaactttgcaagaccaacagaaaggtaaacgctgcctcagatcaggcagagacggagcaccaccagaaagctactagtactacgactgctctgcaacagaaacgactactgcactccagtaattgaaactactaatacgactagctcatggcaactacgatatggatatggactgcaactacggtatggatatggactgcaactaggagacctgggaggacccatccgatgcacacaccctactcgatcttgatctcgaagacgtccttgcgctcctcgtccttgatcttcgggacggtgaccctgagcacgccgttcttcatgtcagccttgatctggtccatcttgaaagcctgggaggagaggccgatgcggtagctgtaccgcgccgggcccttgtcgtcgtcgccctcgaggtccttgccggcctcccccttgatcacc

SEQ ID NO: 8915 - DNA, 534 bp, Zea mays
  Clone ID: LIB3279-193-Q1-N6-E12
aaaaaaaaaggcccgaaaaagggaaaaacggggatttctaaaaaaagaataacccccacccggaggtaaacaggaaaacaaaaaaattaagagggggaacaagggtacaggggaacaggggcttttgggaaaagcccttttttaaaaaaaaggaaaatttggctgaaggaaaaaacccgccaaaagaatgggccgggaaaaaaaagggcctatggggggaaaagggcaaataacaaaaacagggggggggaaaaaaaaataccccgccgaaaacaacaactgggaaagggaaacccccccaaaggggaaaccccccccccggattaaaaaaaaaatttaaacggatcaaaaaaaaaacccaccctccaaacaaggataaagacactcccttaaaaaaaggggggaaatggaaaaacccccgaaaaggggggtccccgggaccaaaagggtgggacacccaaaagggggggcctgcgggttgaaaaaaaaaatccctccaaattaacttccagttggaattttggtggtaccaaa

SEQ ID NO: 8916 - DNA, 482 bp, Zea mays
  Clone ID: LIB3279-193-Q1-N6-E2
attaaaaatcttcaaattaatgatttaggtttaagagaggctaaaaaaaaaaaataaagtataagccccgacaaaacgaggccaaaaaaaaaacaaggaaaaggacaacaaaaaacaaacaacaaaaaaagaagagaaggggaaaggcaacaccaaaaaaaaacaaccggaggccggatactggccactccaccggccctggaagatgctacaaggaagaaaaaacagggaaaaacaacagcaggaacaaaaatcaggcaaaaaacaagcaaaagctacagaaacaatagtttaaatcaagtcttgagcagccggagcagcaagcccctggggagcatctggttgaacaatcagtggcaagtctccggccgaacccccccggcaagcgcccgcgaaaacgacccgccactgaacaccccgaacttggaacactcctcccggacccggaggtcaaaccgggaacccccgaccggaacctggag

SEQ ID NO: 8917 - DNA, 477 bp, Zea mays
  Clone ID: LIB3279-193-Q1-N6-E3
aaataaccggaaatttgattcgcattctcgaaaaccttttacatgttcgaaggtggttaccgggcgttttgcagctgtttgacaagaatcccttgctttttaacgcccataaataaattgggaataaaaagcctttttagctaaaaatacaggcttttgctccttggattttctctgttcaacaaatgggcaggggcttccccttccacttcttgagggacttgagcaacgggtcgatgtgcttgccctggttgatggcaaccagcaccttgttcaacttcttgccgggagagggcgtttttttgccggggagggacacgggttcgagcttcttgcgcacaaaacggtaaaacgggtaggaacggcaatcggcgatttttttcggtattcctgccgggccgtttttgacaggcgcccgtgcagccttcaccgccttgggcaacgccccacccaagttgtccttaaactgggcgacct

SEQ ID NO: 8918 - DNA, 580 bp, Zea mays
  Clone ID: LIB3279-193-Q1-N6-E4
cccaagtcaaagccggttcacacaatatggaacacgttatcgcattccatcagagtttacagttacagatgagctcagcccaaacgtttcacaatcatataaaacctagaaacgttcctaaatctattatctatgtagtagtaaaaatggaagattctctcgagactaggtgaaactccagcatttaaattttaattaaggcgagagggtacaaagtacaatccagcatatcgctagctagttgacaaaggcgcacctcttcctgatctccccctgggcgccggtgagcacgcccaccctgcccatgttgagcatggacgccccgaagtccgcgaggaacgccgcctcggacggcgcgtccctatagcggtagacgagcgccctggtctccccgttcctgagcagcgcctcgtcggagtggaagagcgccctccgctccgcgaccaggccgtagtaggccgtgccgaacgcggtggagctccccggcaccatctccagctccgtcgtgttgtccctgcgcctccggcactgccgcctcagctccgccgcgtacgcgccgtccagggtcgggtcgctgtcc

SEQ ID NO: 8919 - DNA, 554 bp, Zea mays
  Clone ID: LIB3279-193-Q1-N6-E6
cacagaagtctcatccataatcataaataagacacatctcatccagtcctaataagagacaatttctcatacatagtcataataaaagtctcaagtttcagaacacaataccatttaacagtgggacacttgtgcggatgcttgcatgaaatagctgacaaacctgtggacgtatagagcatagttggaggcggtaataattactaacaaacaacattttgattaattcaaacaacataggcttgtgtgggcactcctccatgcatgtagctttaatcgaccgggaattcattagcccttttaataacgggggacattttacgacaaccctggggcgcgctcgatccacttagttttaagcactttatggatttttccccgttccaattcagtaaccttttttcactttgagcgctctgaaggatatatcccatatttttatttttcaacagaagaagttcatcttcagtatacttattatcttcaggcttaggtctatgaattccaccaacagtcctacgtgttgatcattttaaaatagaactcatccgggt

SEQ ID NO: 8920 - DNA, 316 bp, Zea mays
  Clone ID: LIB3279-193-Q1-N6-E7
gaaccaaacacttcagaatttataccataacaggcaagttcaaaacttaaccgccacagatgcaaccaaagatctaaaagaagtttagcatagtaggacaacaactacgaatagcagtgcgatcaagaggcaaccaccgcgaagtctaaacgcggtcacggcggggaccaccgtactgcgggcggccgtaggcgggggcgttggagacctcagcctggcgctcaacgccgggcaggtcggccatgccgagggcagcgagcatctccatggtctccttgtcgacgcggatctcttcgacctcgagcgcggacttctc

SEQ ID NO: 8921 - DNA, 503 bp, Zea mays
  Clone ID: LIB3279-193-Q1-N6-E8
gtctcctgatatattgcaaaactctctggtggttgtgctgcaattggcatcaccgctaatggtgctacctgtccaatacctctcttggccatattaaccctgttagcagcctcttgaagagcttgcattgccacaatataaacctctaatgatgatgccccctcctcagcataccttagtgcttcacgacacaaactgttgtaacgccatgtcggggactgctcatcatcttcagcgctacttctttgctcctccttgggctccgcaactctgctaacttcgtcaacattcttgcctgagcttctatccagtgcattctttgtccatctttttacaaagtaatgagaagggagtgcagagacacctcttatgccaaacacggtaagtatgtgcctgcagacaataccaaaatattcaaacatatgacagctacatgtcaccgaacttccagaagaactgaactgaacagttacagacttctcacttccttcagatctggtcac

SEQ ID NO: 8922 - DNA, 464 bp, Zea mays
  Clone ID: LIB3279-193-Q1-N6-E9
aaacaaatatgataggattctaatagataagcagagttacattattataggactaggttaccatattagatctatcatataaccgcacaccttccagcctatataaatacatgccaccataacacctcaagccatcaaccatggacttatctcctctatagcctcgcagcagtgccgctgccatccaagctacaacagtctgcagccaactaagctcgctgccataagccaccatgaccatctcgtcaaagttcgactccctccccaactctagcgacaactccgatgagttaatttgtcaccgtccattcatcttctgagacaacgtagaacatcattatgaccggctcgacgagagctttgtcatcgcgcttctggttcatcgatcggatctccgattcatgttaatttgcgaaaaaaccgagatgtctagcagcagcgcgagatcgaagggcttggttgga

SEQ ID NO: 8923 - DNA, 591 bp, Zea mays
  Clone ID: LIB3279-193-Q1-N6-F1
ttttttttttttttttttttttttttttttttttttttttttttttttttttttttttttttttttttttttttttttttttttttttttttttttttttttttttttttggggggccccccccacctggaaaaaaagaaaacgggggcggaaaaaaagaaaaaagaaaacggggccgtccccccgggggggaaaaaaaaaaaacccttttttaacaaaaacatccctgaaggggattttgggaattttaccctaaacggggaaaaaaacccttgggaggggttaaaaaaaactggaaaaaaaaaggggctgggttaaaaaatggcttaaaggagggaaaaaaaaagccccaacttgggactgccccaaattaaagggttttaaaaaattttttttacccttggaaagggaaaattttgtttttaaaattgggctgggttttaaaaaaaaccccccccaccggagggggggttttgctcccctttaaaaaaaaaagtttttaaaaaaatttaaaaaccctttaggggggtaaatttccggagaaaacaaaccgcggggctaaaaaaaaactttgcctttttttttttgggc

SEQ ID NO: 8924 - DNA, 332 bp, Zea mays
  Clone ID: LIB3279-193-Q1-N6-F12
aaacaaggcccgtcgcaacaatagctacaataaggggaccatacacggaatgcagcatagttccctttacttttatgctcaaatagccacaaggggcttgaatcatacaatgatgttttagcatattcaggtggggaggctgcagttgaggagcaaatgccaagaggcttcgaggccaaaccctgaaggcacaacaaaggcttgatcactaaaaacgacaggcttttcgggtatattcattggaggttccaggttctccacaaaaatccccaggtttaagtccttatcctggaacttctgaaaaaaagggttatttacggacacatgggcgg

SEQ ID NO: 8925 - DNA, 538 bp, Zea mays
  Clone ID: LIB3279-193-Q1-N6-F2
aagaagaaaggtcaagcgcaacaattggcctggaaattaaaggccggttaccaccccatggcaggacggaaggttggcaccaaggaattaaaccttgccgcacaaggcttggcggggggcacaccatgaaagggcaccgggggggacgaatcaaacacaaaacgcccaacggccggggagggtaactttggggggccccccaacccgggcttaaattgcccccgaacagggagcccagggaaaaaccccccccaggagcaacgtggaccttggttgaaggacgggccctaaggaaattgccagggttttgaccattaaccctgggggagttattggtttggctggtaaccccaaaaaaaacctggttggccggattaatttttggagcaaatggttttttaacagggggagcacttgcaactggggccactgctggtttggggggcttaccgtttccaaagaaataacccaaaaaactttgaccaccaccgggactaccaccaagggttattttggtttttgaaaaaaaaaaccaaag

SEQ ID NO: 8926 - DNA, 596 bp, Zea mays
  Clone ID: LIB3279-193-Q1-N6-F3
agaaaccggcaccagatctcataaactcctttcacccaaaccaaccactaacgccaatcaacactgccaagtgccaaccaggcaaccacgacagcggcgcaaacaaacgtcagcagcagtcacacatacgcacgcagcttccttatttgcctaacgtaaaatgagagcacaagagctacaaatagatcccgaatcaggacagttcagtcgagaccaacatcattcctgaggtgaactgcacaatgattctacagccgcgagcggccgatccggtcgctgtcggtgatgacgtgtgcgcgggttatctccctcagcgacgtgcagccgctgagcgccatggtgagctccagctcgtccctcagcatctgcagcaccttccgcacgccggcctcgccgtccaccgccagcgagaacagcacgggccggccgatgaacactcctgaagctcccaacgccagggccttgaagacgtccgtgccacggcggacgccgccgtcgaggaacaccggtagccggcctttcgcttccctgacgacctcttccaggcagctgatagtcgcaggaacataatctagctggcgcgcgccgtggttgga

SEQ ID NO: 8927 - DNA, 324 bp, Zea mays
  Clone ID: LIB3279-193-Q1-N6-F5
aaacgacgaatggaaaccccatgcggcgaaggcagcaagttcatcttatccagatgacactatgtttcaacactccatcctgctgagacagatgcatgcacctcatcttacaacacctacgttggggcctactcctcctagcacaggcctaaatttgacaaagccacctgatcttaaccgcgccctgcctgatcataacacgatggccctcggtgaccccccctgaacaaatgggatacggggaaaaaactctagccactcatgccggactatgctcacccaacaccggatctacctagaagagatccctatcttccacaaaca

SEQ ID NO: 8928 - DNA, 485 bp, Zea mays
  Clone ID: LIB3279-193-Q1-N6-F6
gacaaaggaaagaaggcttgcattatataaagtacaaactcctagacaggggcataaagtttcaatggagagtcttgtggatagctgagctatatcaaagaatacaatccctaaccttttttttttgccctccatcactaggaaggatgtgtcatcttgttaattgggcactggtgggtctctcttctgtcctgtgatggaatagcttcgctattgatcgtctctcacaatccttaaacatattgagacggaatggtctgtcaggatttgtccttctcagttttaagtatgtatatgcaaagctgagctggtcacgaggtgtgaatcgatcaacttcattgtaccacaggcaggaaaataagttggacatcggtgtgtgctctcttgcgataaaagagccttcagggacataacttggtaaaagcctgctgggatccgatgggttgaaccttgtcagtccatccgcttgataaaactcaaattgc

SEQ ID NO: 8929 - DNA, 590 bp, Zea mays
  Clone ID: LIB3279-193-Q1-N6-F7
gacttggttaatatttcataaatgatactctcatacggagtaagactcaaaagcaacagcttgcttatagtacaaatagtaagttagcctgcccagacaatggcagtgtcacaaacaactgaatgatcaccaagtacggggcgttccccccttacgcgtagtaattcaagctggacttcttctttgcctgcacttggatgatcccctcgttgaaatcctcgtgggtaacctctgtagcatctcggcgtagagcgagcatgccagcctctacgcaaacagcctttagctgagcgccattgaaatcatcggttgaacgcgccaactcttcaaagttgacatctggattcacattcattttcctcgagtggatctgcaggattctagctcttgcttcctctgatggatgagggaactcaatcttacggtccagacgaccagatctcatcagagcaggatcaagaatatcagcacgatttgttgcagctatcacctttatcctctcatcgctgctaaatccatcaagctggttcagcaattccaacattgtcctttgcacttctctatcaccactaacttcactgtcaaaacgc

SEQ ID NO: 8930 - DNA, 589 bp, Zea mays
  unsure (1)..(589): unsure at all n locations; Clone ID: LIB3279-193-Q1-N6-F9
ttttatcatcaacatcctcaaccttaccctcctcatccttcttatcctcctcatcttcatcatcagagatctccttctcagtggtcttctcaatccagagagagattgggtagctgatgaactcggagtgcttcttgatcagatccttgaggcggcgctcctcaaggtactccaactgatcatccttgaggtagagggtcatctttgtacccctgccaagttgctccccagaggtatcacgtgcgacagtgaaggagccaccagcctgagactcccacacgtactgctcatcatcattgtgcttagtggtcacgacaaccctctctgcaacaaggtaggcagagtagaaaccgacaccaaactggccaatcatggacacatcagcaccagcagcaagtgcctccatgaattccttcgtgcctgaccgcgcaatggtaccaaggttgttcacaaggtctgacttggtcataccaatgccgctgtcgatgattgtcagcgtgttgttggccttgtcggggacaatgtggatgaacagctctggctgtgcatncagcttggtcttgtccgtcaaactctcaaacctgatctt

SEQ ID NO: 8931 - DNA, 334 bp, Zea mays
  Clone ID: LIB3279-193-Q1-N6-G11
ccgatatttttttcaaattcatgtgtcgagatttacaatgtttagtcgttgagttccctattattcatgctggcaagcctcccaatgcccgtgttatcagtttatagtgcactgatgctcagaagtttatcaacctgtattagttagtgcactaatgcctgtgtatcagtttagggcatcggtctgctgtcagcgcactagcaggattcaatgggttttatcagttgcaaatcgtatatccaacattgtatatagatctgcagtccgcgctctcgcttccacgtgatctgtagcgacgtacgttgtgcttgcattgcgtctacatgccgtgctt

SEQ ID NO: 8932 - DNA, 526 bp, Zea mays
  Clone ID: LIB3279-193-Q1-N6-G12
ccttaggatttaacttagaataaagcctgacgggggtaacagcacccatcgatccgcagtccatgctggttgatgcatgggtctgctggagccgaggatgaacacagcactaacaactgacacagagcgaccttcaatcaaaaacacagatgggcaacaacaaacacgagacgaacgaagataaacactctggactagggtaaacaacacggtagcgaacaggataacttggccgcgcgggccccaccgctcagttcctccagttcccgtcggagttgccgtagccgccgccacggttgccaccggcgtagccgccgccaccaccaccgtagccgtcggcggcaccaccgtagccggcgtcaccggcgtagccggcggcggcatcacggggcccgccaccggcgtagccgccggcttcaccggcaccaacgtacccggcggcggcggcggcttcacgggcggcgggggaatgggccttcttgaccgggatggtgcgggccgtcagcttctttggcggtcatgcccc

SEQ ID NO: 8933 - DNA, 515 bp, Zea mays
  Clone ID: LIB3279-193-Q1-N6-G2
tttttttttttttttttttttttttttttttttttttttttttttttttttttttttttttttttttttttttttttttttttttttttttttttttttttttttttttttggggaaaaggggttaaaaaaaaaggaaaataaaaaggttttaaaccccccgaaaaaaaaggggcttggggcttaaaaagggggatgggggattttcctttaaaagttaaaaaacaatggactttgtttttaaacaaaaaaaaaaaaggttaaccttaaatttaaaaatttagaaaaggttgtttcccccccaaaatttaaaaacccaaaaggggaaaatttcgggttaaaacttaataaaaaagggggcaaattatttaaaaaaaaaaattcccggacccggggggtcccccggaaattttggaccgggtctgggggggaacacaattttttttaaaaagaagtgtataaaaggttggggaaaaaaaggaaaaaattttttcttggagaaaaatggttccctct

SEQ ID NO: 8934 - DNA, 359 bp, Zea mays
  unsure (1)..(359): unsure at all n locations; Clone ID: LIB3279-193-Q1-N6-G4
gcgacaggtagaagaaatacaataatcccagggttgaacttgaatcccaccagaaacacggagcatccacagaatacacaccagccctagtctaatccaatcgacatcgacagagtaccagtngtctcataacagagagagagagagagagaaaaaaaaagaaaagagggcgataacgcaggacaaagctagaatagcacggcccagttccagctcttccgtaagctggttgcttcacttgcagccgtgttggacccggcacggatggttccgtcagaagcaggcgtccaggaggcagcagcagcagagggcagccaagcatccttccatgaaggaaggcccgctgctctgctgctgct

SEQ ID NO: 8935 - DNA, 403 bp, Zea mays
  Clone ID: LIB3279-193-Q1-N6-G6
ggcaagccaaacgaagggggggtatgttatcagggctcaaatatacaggacggcccccccccacatataactcgctttcaaaaaaccacaagggattcgtttggaaaaaaaaacccacgcccgcacgcagaatgttaaaaccctcttaactggtgtatgcctgggacccttttaagcgcttaagggacaagctcaattaaaatccgagcagcttactttggattgagtaagggcccaagccccccaaacttggcttgggaccgggaaagaaacaaaccctaacaagggagaacaatgctcaaaaggggtgcttatcctcccacctcggataaaaccgctgaaaccgggcgacctggaaaccatttaggctgcccttaaaaagggtttggggggggggcccaac

SEQ ID NO: 8936 - DNA, 464 bp, Zea mays
  Clone ID: LIB3279-193-Q1-N6-G7
aaacccataactggctaggcactaaattaggcaatgaaacagggcccggggggggggacccaagggattagcaaaaaaaaagcaacgtaatagcttgcagcattcgggtttttttttggtaatgcactaaactaacaacctcacgaaactaataaatccccttaataaacacctgttccaaacaacttaacattaaagatagcaaacccgggggctaattggggacctaacaatcgatttgctacctcacgacaggggaaatactatttactcgggggcggggttttccttgtaactaccgccatccttataattgaccttggactttgagccattggcggaataagtcttagccttttttgagcttgggctctccttctaaatatttgccttagtcttttaataagcctgctttttttgcccaggttgggccaaataggggtgctttttttgctttgacataa

SEQ ID NO: 8937 - DNA, 596 bp, Zea mays
  unsure (1)..(596): unsure at all n locations; Clone ID: LIB3279-193-Q1-N6-G8
gatataacancttggcaccacatccactagaagcaaacaagagagaatgtcatatgggcataagttatcactaaaatccgattttatgtaaaataaacgtaggccttgtcatacaaaacttccacaacatagacactgccacacaggtaaacaaaatctgcgcttgctgacaggagttgcgggtgcttcacgacattgacagggtcgatcaaagcctactcccctttccagagctcagcaaactcatcaggctccagcgtgttctccatctcgtgcatcttcctcctcaccttggccttcaccttcttggcatatttgcctgccttctgcctcttctctagtgcacggatcatgtaggaccaccaaaactaccaccaaatattttgattggattcaaacagaacctggggccaacctcaataagtgtcattttatccataccacctttatcaactttatcaatctcattgtggggaacagaaatctggtagtttcggaaccaaacatggccatccacaatggagaagacaaatacatggtcatggaaaggttttgctttacggtgatctttangagtagcaaatatatgagttata

SEQ ID NO: 8938 - DNA, 576 bp, Zea mays
  Clone ID: LIB3279-193-Q1-N6-G9
gaaccggcaatcacctcatccagacccatggatttctctctttggagcaaaagtgatgcatcgcacactggagctgcgaaaaataactgactttacaccctatatcactgatcgtaaaaactataagatgtgaaataggaaaagcttgttgcttcccttaattgcaccaacctaactgctggtgatggaatagagttcagaaaaaatggatttaaacatgcatccagttattatctgatcaaagaacgaagtataactacagttaatctgacgctacttgtgggcatgcgactctacatcatgttggatcttccgtggtgttttccttttctgcttatacttcgcataagagtaccatacgccgccaaatgtgttgatcaccagtccagtaacattcagagcatgtacttcgacacctcccaacagaacgaaaccgagggtcgttgatccgacacccttgagaactcctactattgttgtagtcagagcagagttcacaattgtgcaccaaaacatagtgaaattgagaacgattcccatcaccagtgagataacgagaatgacaccgaacgtcag

SEQ ID NO: 8939 - DNA, 524 bp, Zea mays
  Clone ID: LIB3279-193-Q1-N6-H1
aaaataatgtttcttgatcaaccatccatcacattttctaatttgtcacatacatgtgtcaaatttaagagttgagttgcaacaaaatatagtgttgtccctcgaaattacacagtttactaatataacaatcagtctctctgtatcatctgtcttatggcacatacctggcagacagaagaatctcaatttgtcaagtctcatggccaatgttgattattgagatgtatttaacagttataggcagtggcggagcttgacaaagatgtgtgttttaaaactggggaggagacatggcctcctttttaagatctgccactggttattacaagcattgaaatgtccaaactttggaatcctgcgttcgatatactgaacagcgatgcattctgttcactccctgtatgaacaagaacaagtaagatgcaacagtttgatccgactacagcagccagccgaattcagagaaggtttttcactcaaaaacttctcatgtgaaacacaaacttttcgtgtagccaaag

SEQ ID NO: 8940 - DNA, 450 bp, Zea mays
  unsure (1)..(450): unsure at all n locations; Clone ID: LIB3279-193-Q1-N6-H10
ggatgtgttaactcatgcatttcattgaagtgacagtgatgccgccaccacataaaaagtcgagtgatagccagttcggttgtagattacattataccaaacatattcgcttccccttaaacatagtattattcgtactctagaatttctaccatactcgtatcctcgggactctttccttccgagttcatcagcaaaaagactggtgggatgttggtaagtggtaagcgaagcgaaggattaggtacaggttgtggcacaaccgattacacacacaacttgacccataaacttnttactcgcacgtacaattaatatgattagtacagctcagcgaccagataaactttgacatgaggtcccaaatttatagcataaatagccagcagtggggcaccagaatttaaaagagttgacttatagcaaagtcaacaacctactgatattgac

SEQ ID NO: 8941 - DNA, 603 bp, Zea mays
  Clone ID: LIB3279-193-Q1-N6-H11
gactgaaacaatttgcgtgttgcaagtaccacaggtttgaaacgaatatatgtccatgaaaaaaatccaacatttcactaacttaaaaagggttcaaacatgtcttctacatcatgtacaggtagaacacaggtgatgttttcggatcaattgcttgcattgagcttaaacactagtgcaagggggtgaactcgatcgctgcagacgatgatctattgacagatccggggcaaccacgtgtaggcaccaggcaggcttggtgcataccctcagttccttcacagcagattcatatcgatggatcttccagcgcggcagtggtgaagtcgttgattcgaggataagccgccttttcgtccagttgattttgggtccatttcaacatctttaacaagcttggaagcttcggatctttctcatgactttggcttgtaagaatagcagcattaacttcacttgcagtcttcaaacgttgagaaacatccaatagttccccataagggcaattttttacatcttcaaaaaccagtagtgctacagttttttctatttcctcgagaaatgtttgattttcttcgcctctcggtgcaagttcttcttgag

SEQ ID NO: 8942 - DNA, 595 bp, Zea mays
  Clone ID: LIB3279-193-Q1-N6-H12
ggctgtgaaccgcaaaatgtggagcataaatagtcaagccgttccgacagtgggactgacagctttgagcctgcattacctgggtgcacatcaacacagtcatgcttgctggggaataactgcactgactttcttattacgcaggtacagagcacacgacgcataatacaaaactcttggtacttatggcctttgggaccctttgtttgctaaacctctgaagaggggattggatacttgtcagcctatccatgggtcatatcatttctttcacagctatgaagctggttcctatgctcgtttttctgacttagtatgtgatgttgcatacgtgacctgtgccaatgacacaaccatattgacaccgactgcggcttacatacacccaccgagcttcatgtatgacgctaccccaccaactagggcgggacgcaaagctaccatgggcctgacctacatgagctattacgatgctggacagctttgtgcccctgaaggctccgagacctgaacacctggcgatcagcacctgggacctcataagaccagtcatcttccatataaacacaactagccaactgggtctattggacag

SEQ ID NO: 8943 - DNA, 526 bp, Zea mays
  Clone ID: LIB3279-193-Q1-N6-H2
aaagctaacccaagggaattcgatcgattcatcattgaacaacaaggcaattaagataagacgctgctggcgtcgatcctcctctctgcttgccgcactcaggcgtccacgacctcgtcgtccttgtacgcaatcatcaactcctcgcgcaacggcggcgacatggtcccgtccacggcgttgggcctgcccagggccttgagcgccaggtgcgccgccttctggccggagatcatcatggcgccaaacgtcgggcccatcctgggggcgccgtcaatctcggcgacctccattccggtgacgatcatgccgggaacgacctcgcgcgtgaggcgcacgatctcgtcctcggcggtgttcatgtcgagcgccttcatccccggcacggcgctgatcatgccgatgtcctggagcctcttgacgccggtggcgccgaagggcccgtcgtggccgcaggagctgaccacgaccttggcctccatgacgttggggtccatgcaggactgcgtgtcgtggttcatggaca

SEQ ID NO: 8944 - DNA, 492 bp, Zea mays
  Clone ID: LIB3279-193-Q1-N6-H3
acgccagcaattgttctggttacattttacaacagggcaggataatcaacttgcgtccttcaaacaagatacatggtaggtcagtagcaagcagttcatacccagcagcatatcacaagttcgttaacgcaaaccgtctcccttcaacgatgggggaggagccttggctagctgatacatgtgacatgtatgacctgaaattgcagcatcttagctcctgataaccacacgcaagcatcaacctagagcaatcatatttctcctcggtaacccccgccgccaaagtagtcttttctcgagccagcaattgccatggacttttggtgctccaacttcggacagtcactgacacgatggccaagcccaccacaatacgcacaacctttgacaccactctccttggcaattatttcctcatcatccaatggatcgttgagctccgccaacaccggtggaatcctctgctttgcctccttcagccggacgcgtggg

SEQ ID NO: 8945 - DNA, 516 bp, Zea mays
  Clone ID: LIB3279-193-Q1-N6-H4
cccggataaaggttttttaatgttaccagcagacggtagctttgctggtacaagtcatactcaatcctaaatatgcagggccgacaaaaccaagctacatgtgttatccagatacataatttttgccttattacagtccttttttttaaaacagggagcacctaagactagatactttggtacaaggtacgcgcttttcaaatataacattttgcttcatgcatgaacaatatccaaagggagcagacttttatttacactgttttcaaaattcccccatttacccaagttccaaaacaccccccccccctttaaactaaaacacatttatttgattttcagtcctaaaagtaaaatgggaatgcttatgtgctgcccatgggggttccttatgctttgatccattgccactgaaactggaatctttcattttgtttacaactaatgcggcatcatccgttggggaattgtcatcctaagtatccctggaggccaaattctggttcataacaaacc

SEQ ID NO: 8946 - DNA, 452 bp, Zea mays
  Clone ID: LIB3279-193-Q1-N6-H5
aaaaaaatcataacatcattatgatatttaggtgtgctatccttttttttacctccaattacccaagatttttatctgtggtatcgcatcttaaatctgaaaacgagaagacaaacaaaatcaattttcaagagtctgaacctaaaactgtcttactatcaagtaccaatgtcaattgacaccctagactccacgtatcgagtagccgaatgggtagtagcgcatccaaactagatagatactcatccatttgatacctgcctaagttaacatgcatttcgttgtgcagtactgcagttctaccaatacatgtcaacatcccatagtgaggtgacaaagcaacaggtcacaaggcgtgatcctctttggaaaatcttggcttcagtaccttgcagatttagcaacaagatctgaatactgttcaggcacgaaagatttcactttcaatgatc

SEQ ID NO: 8947 - DNA, 602 bp, Zea mays
  unsure (1)..(602): unsure at all n locations; Clone ID: LIB3279-193-Q1-N6-H6
tttttaacgggataacatacattttgtatataagttatcatagtatactcatattatatattttcattacaacacacgtgcattcagctagtaactactatagatctaatgggagcagagaattatgaaaaaacattatagaagcattacaagccggtatgaatgaaagtcaaacgaacaagttcgtcacatatagcaaatccatgattaccgactagaactggtgtccatgggtcgtattggaatcccttgcacagatcatgttttcgcaaccaccgcttcctctaaaattggcaaagatggtctccaagtggttccgtcggggccatccatgaggggcaattctatggcagccagntcttttccgatctcgtcggattttcatactgctttgccttccttgctgcagtcctctcttcaatcttctgcaccacaagctcctcggtgatggaagctcgtctcagtgccttatcccgcagctgttgcaaagcctcatgataacttgaaggtagcaatcctagaacagagagaactactcttattttctcttctaaggcagaaagagattccagccttttgtcctgcttctttcccttacgagt

SEQ ID NO: 8948 - DNA, 326 bp, Zea mays
  Clone ID: LIB3279-193-Q1-N6-H7
acgattcaagattcttaatttttaaaccaaaactgtttgcaatcatctcagatgcagaaagagaaaagcaaaggtgttaatcctctggttgagccgtttgacttgaccttcttcgcacccatcagtctaccgattaaccaactccctgcaaagtcgactgcgtctcctcccacgcactgctgctcgaggagacgcggggaaaaaaaaaacaactcaggaaactgtaccctttcggttctagcgcctatccccctcttattctcaccccctgagctctcttcactgatgagtgagtcatcccctttggatggctccggacgcgtggg

SEQ ID NO: 8949 - DNA, 462 bp, Zea mays
  Clone ID: LIB3279-193-Q1-N6-H8
gttattaatttatttttattttcgttactgtattaacaataacaaattacaaatataccttcggctcgaaggaaagcaagggtacaagcgtgacgcgaaagcagatgccaagtcagcgtgaacagtacgggaatactgttcacctatttataggcacgggtcgcagcccatgcaaaattacatccaggccctttgcctatgacaacaactctatagtaatttatctgggtctagatagtcttttcctctttaagtcggtttcctcttttctgccatcatgccgaagctcccttctgcgcagcttcggctctgctccatctttcgtattatttccgtgcttcttcataccgggggctcttgttcgaagatccctgtccacacattatactccagaggcattgttaaatcatgtttttgaggaccttcggaagcccaaagcgcccaacatttccgacaccacct

SEQ ID NO: 8950 - DNA, 510 bp, Zea mays
  Clone ID: LIB3279-193-Q1-N6-H9
gcagccaattcatattattccgagacattaaaccaaacaaacagctttgcaaagccaccgtaacagaataccagtcaaatataggtcattctaaacaacaacgctgcaacaagggcaggtctttttttccctggaagaagcagcaggcttggagcacgaaaaccagcatccagccatcatttatcaacttgagaatcgaaacatagcatgcgggcataacatctagagtgtgtgcttaattaaaaacagcggcaaaggcaatggcaatggcaggcagcttcagcgcacgcgcaccggcgccgtgacgaagagaacaacacgaggtgtactagaagataagctatcagaaatcaagaacggcacagtcctggtaaactccccgacatcagcagacacgcatcaggtcgggagatcggatccgtcttactggccctcgggggcggattctttgggggcagcagctgcttccttgatctcatccccgccgtcctcgttggtgtcggaagccca

SEQ ID NO: 8951 - DNA, 390 bp, Zea mays
  Clone ID: LIB3279-194-Q1-N6-A1
gcagaatcagaacgagaaacagaacatggggaacattagtacacaacgagctctgattgctgaagatcttctcgatgaagacgaacatacaataagacacaagggcgaaactagagcaggacacatcccatccacaaatctagacacgagcatgctacagcacacagtgcaaatgaagtccctactttctaagccttcttgggggacttggcgcccttcttgggggacttgggctccttgctgccggcgctggccgccttttccgccgccttcttgggcaggagcacggagtggatgttggggaggacgcctccttgcgcgatggtgacgcctgccagcagcttccctagctccttgtcgttgcggatcgccaggagcacgtggcgcggg

SEQ ID NO: 8952 - DNA, 531 bp, Zea mays
  Clone ID: LIB3279-194-Q1-N6-A10
atgacccgctattacatttctttcggctgcatttggtcaatgtttacatttacatacaactgggatcgcaccaataaacgcactagcacaaagctggccatcgatacaatgcccctgtcaagtcctaaacgatgagggtcagtatgacgcaaaacagtatataacataaatgacctacgtacaaattaaatcgctgcacctccagaacccctgagaaaggccatcttcgttgctttaacacactgactctgcctttccctcttttcgcgctggcattcaccacaccagctcggaaaatccttctggtatttcttcatctctctccggcaccacaaaagcagatttattctgagaccagatgaagtagctcgagcaccatgcctgtgtcgaccatggtggagtacagcccaaccaggaatatgtgtgtagtcatacatttcctcatgttgtgtctctgaattcacatgattctcacaccgaatacctcgaaagtataattcaccaccagagaattgcggacccgtgggcgga

SEQ ID NO: 8953 - DNA, 300 bp, Zea mays
  unsure (1)..(300): unsure at all n locations; Clone ID: LIB3279-194-Q1-N6-A11
ttccaacaaacattgnaatttttggtcaaaacagcatacaacggcagcacagaatctcatccaagaacaccacgacacttctaaggaaacattttaatcaaaattccaatccactancgaagagggttggcgnaactaacatttatagagaaaaaaaaaacgccgnccgtccccggtagcgtccacaagcggcagatntatcaagcaggagatattgcatacgtggagggagcatcaagggcaaagaaaaccacaaaggcaaccccggaccaactgaaggaaaaaggcctgagtacacca

SEQ ID NO: 8954 - DNA, 68 bp, Zea mays
  Clone ID: LIB3279-194-Q1-N6-A2
atggaagattatagatattttataatttatatgtttttgatatttttacagtttaacaaagacaaaaa

SEQ ID NO: 8955 - DNA, 572 bp, Zea mays
  Clone ID: LIB3279-194-Q1-N6-A3
atggaacactatatatatattacaatatacaacgtcatgatagccttacagtctaacaacgaccaacattgtacactgtggtacgcctacataaaagcacatcttgtttctgcgcactcaccaccgacgcaacctgtttgagggctcacaatgctatacgtactctctctctctctctatatatatatatagacacacggactcacttgtctttctttgcacgaaggccacgatggtactcaccgagagcccagatggggaacaagttgcggtagcttgggtaattgaagtagaggctgcagttgaagcatcctacatgctcttgctgaggaaactctcctgtctccagttgcatgttgatcaattcctttgcagcacgatgtaatggcgttggatctcgttcaaactgtccagcataaattaaagcgagcattgcccaggcggtattcacagcgtgagcacggtcacctttgagatttacatacacctgagtttcaatagcgatatggctttctccccatccaccagtactgagctgcttcgacaatatgaagtggcatgctttccgtatg

SEQ ID NO: 8956 - DNA, 500 bp, Zea mays
  Clone ID: LIB3279-194-Q1-N6-A4
agaaaacgacaaccaaattcgacgtcaatgatggcacaggatcaaatatcatttgtcagattcagaacggtaaccgagggcaaatctcaacaacacaactttgagatcctagagcataaaccaaatataaggagcattgtgggggcgaaacagccagtacagtgattccacatttccactagataaggcccccacaacatgcctgacaagagcaactacaggaaaccccaataatataaagagctatatcatgcttcagtctgctccctcaggcggcggatcgtgctcctgacggtgaccgcactagcagtgttcatggtgtaagcaccaccagccttcaccttcccacagtccttgcacccccaaattccaactgctttcctcttcacagcaaacttcccacagaactcgcaaaagtacttggaatgctgagatacctccatcttcttgatttgcttacgcaagctagcaccatacctggttccatatttgccacaatt

SEQ ID NO: 8957 - DNA, 347 bp, Zea mays
  unsure (1)..(347): unsure at all n locations; Clone ID: LIB3279-194-Q1-N6-A5
cttggtttgggttttttttttatttttttttttttttttttttttttttttttttttttttttttttttttttttttttttttttttttttttttttttttttttttttttttttttttttttgggcccaaaaaaaaaaaaaaatttcaggggggtttgttggaaaaanncattttgggggggaaaaaaaaaanntcnncnnnaaaccccaaccgggggngggccctagggctaaaaaaacccaaagaaaaagcttnaaaagcctnnccaaaaaaaaaaaaaagaaaaggcgaaaaacagcaaaaangaggaagacgaggggggggggagagaaaaaaaaaaagaaa

SEQ ID NO: 8958 - DNA, 409 bp, Zea mays
  Clone ID: LIB3279-194-Q1-N6-A7
ggtttgggttttttaaaaaatttttttttttttttttttttttttttttttttttttttttttttttttttttttttttttttttggggataatgggggggtttattttttagaaggttggaatagggcttaattttttcacaactgggggtttgttggacctttaggtggaggggggaaaaaaaaaaaaaggtggggggcgtaattccaaaaatcaggattttttttgggttggagcaccgtttggcgcctcctccatgggatctggttttggtggatttccttttttggctttcttttttttcccaacaccctttttttttgatttggcccccaaaggaaggcatgcctttatttttgaattgggttaaaggggtttggggggctttaaattggacgggtgggggga

SEQ ID NO: 8959 - DNA, 524 bp, Zea mays
  Clone ID: LIB3279-194-Q1-N6-A8
accgaaaagaagaattaccgtatcacttaaggtttgccagtagccgcgataacatggaaccgaccgactatcacgaggtccaaaaaaaataaccaccacaaaagtaccagcccaccacaaataaagtttaagcggacacaggggaccgaccgacgacgataactcgcggcagcgactgggccagccagcaactgcagcacgctcaagactgacaacaaaccgcttagtccacctcctcgatcttggggccagggccgccgctgccagcgggggcgtcctcgtccatgccgccagcgccgcccatgtcttcacccgcgccctggtacatcttggcgatgatggggttgcagaggctctccagctccttcatcttgtcctcgaactcgtccgcctcggcgagctggttggcgtccagccagctgatggccgcgtcgatggcgtcctcgatcttcttcttgtcatcggccggcagcttggacgcaatcttctcgtccttgatcgtgttgcgcatgttgtaggagtag

SEQ ID NO: 8960 - DNA, 519 bp, Zea mays
  unsure (1)..(519): unsure at all n locations; Clone ID: LIB3279-194-Q1-N6-B10
cacgcgtacgnaagcnnggatcctcnagagcggccgcgggcgacggcgggcgcggcggaaggcggcgcgcgcacgcgcgccagcccgcgccaggcccgcgccgccgggncgaaccacncggcgncgcgcccgaacccgccccgccgcgccgngcggnacccgcngacggccaggaaccggncgccggccacgggggccaggccgncgcacccggcgcgcgccaccaacaagnccggcagcgggncccaggcgncggcccccgcgncgnaggccccggccgncnngagcgcgnncnngngccngncgnggccccccgccacgnagancccgccgccggccccggcgcacgcgaagaaggagcgcgccgaccgcangggcgcgccgngccgncacccgcccgncgccgcgnccagcacgngcacgnccgccacgggcccgaagcccagcgggncccagccgcccagcacggccagccggggccccaccgccgggcaacgggcgaacaccggcaccacgggc

SEQ ID NO: 8961 - DNA, 596 bp, Zea mays
  Clone ID: LIB3279-194-Q1-N6-B11
ctgggttgggggtttttttttttttttaagataagagggccagacatgaataagcctccaactctggtggtctggcattacttgttacaggctacatacacgacgattattcttactaactgatcacggcaaattcaaagaggcggcttgcgggggggggcggcgcctttgccatggaacgtcagcagcatgcattgatcagaggtggtcgaagatgatgccaccgtgcgcggcgaagaagggcgcgaagacgagcgactccacggccataagcttgatgaggatgttgagggacggtccggaggtgtccttgagcgggtcgccgatggtgtccccgatcaccgccgctttgtgcgcctccgatcccttgggccccagcgacctcgccttctccgacaagccggcctcgatgtacttcttggcgttgtcccatgcacccccgctgttggaggcagagatggcgacctggacgccggagacgagtgcgccggcgaggagccccccgagcgtttcgaccccgaagagcgtaccggcgacgagcgggctgaacatgacgagcgcgcccggcgccatcatttttttgagcgagggctcgg

SEQ ID NO: 8962 - DNA, 584 bp, Zea mays
  Clone ID: LIB3279-194-Q1-N6-B12
ccagttttaagattaaccaaaaatttcaacgtcagcaatattggacaacgggttcagctagaaagccctaaaacacaagtgttcaaagcaaagcaaagcatagctatagaagatgccaccggaatttggacattcagaccacagaaaaatactgaacttcagccgcagaagacaggtctcagagtggacaacgcctactcccagccttgggcagtcggtggcggggctgcttggtcccaaccagtaggagcaaccagaggaggtacagtgccgtccaccacaggtgcaggggccccagcttgatcccagccatcaccggtaggaaccggagctggagcagcaccccaatcagcaccagtaggagcaacaggcggcgcagtcacatcagaggtccactggtcaccaccccactgatcagctccttggtaatcagtgattgcggcaaactcaggggcaacagcagcttcctcctcctgctcctttgcttcctctgggtccctgtagaagaacaaatccaccatgacctcccacttgtgcccagggaggatagtgcccctcatctgcagaaccatcctggccaaaag

SEQ ID NO: 8963 - DNA, 500 bp, Zea mays
  Clone ID: LIB3279-194-Q1-N6-B2
tttttagacttgaaccaggtgtgcgggagcttgcctgtgaaaccgtagtctccaaagagtacatactgcgacaccctcgactcttcggttccctggaagccaagctgcaacaagcgcttccactaatggaacatacgggtcaatcacaatgggacgaccagaaatgatgactactgcacatttaactgcagcacacacagttctgatcgtgtctggaccagggtctagcatagtgaggtcggtgctatcgccaactgtttcagcgtatggtggctcgccaacaacgacgatagcgaatgagaagtcattgtgcttcatgaaactgtcatcggggttctcagagtagacaacagacgtcgagtcagcaacggtagactttatcgcatcaagaattgttgtccctgcacaggatactgaatcacagttgtgatattaccactgtcccccatccattggattgaccatccaccacactggtaccccaaattgctagcatgact

SEQ ID NO: 8964 - DNA, 579 bp, Zea mays
  Clone ID: LIB3279-194-Q1-N6-B3
caagaacacaggatgaaaagacatgtcatcaggaaaaaaaacatcaccaacagtcaacagatggggcataggtatcgtgtcgtgaccataattaaacaacatctggaatccaaaacacaaactatataggacattgtccaaaccctcattcagaggatgcacaacattgaaaagctaatatgcagattattgaactgctaacataacccttgagtcgcaacaacaccataaagcttgagtctcccggaatccgttcatgccatcagtattcagtgggcgcgagatgaaggtgaagaagagaactgacagctcacgaacaggcacgtatcacatttcacgtgtagaggttgcagacactaaaagtaccactaagtcgtaagtccctcttatcagcagcagggccctgaaacaagctaaggtgcaacgttacatcttattctttcaacaactatcagcaaggaagtgcattatttaatactcttactcctagtacagcatcaaaagccaggttcgggtgaactttgacatgtaccgagtatgtcataccggtagtttctttttttctgaatggtaaaatct

SEQ ID NO: 8965 - DNA, 354 bp, Zea mays
  Clone ID: LIB3279-194-Q1-N6-B4
ggagcaggaacaaaattgcacatacataacatatctcacctattcatcggcactgtactgactacttatgattattactaccgatctgacgagaagtcaggcgggccatgttactcatgggggggtcacaaataaattatttattaggtagaagctgatcgatgctactgtggacgccaaaccgaaagagagttctctcttgcgcatgaatccttcgcagtttcgctgcagcagcccatcactcacacaggtcacagtctcacagaacacatggccacctgcccacccatgctcaccgatgccgcggcaatctgatgttgcctatctcctggaacggcgaccgcttcgggagca

SEQ ID NO: 8966 - DNA, 526 bp, Zea mays
  unsure (1)..(526): unsure at all n locations; Clone ID: LIB3279-194-Q1-N6-B5
catttgaaattattttaatgaatcgcagatcggtacatgaccaccacacactggacaaaatcccaatagccacatgcaaaactaaccttaacaatacagaggacaaacgaatcacagttcatcgtanatgggagcaggagcatttgctggggcaggtccacgttgggcattcgctacgatgtcatcggctgataatgaaccggatctgatggcatcggccagtttcctttgcagcgtcaatagaccaatacgtcttgagacaacataaagaaccgccaaggagaaaatgataaagccgatggtcaggatgatcctatcaagaacatcttgctgttgcatcgtggagagcaaaccacgggtacgcattagcaaagagcggtgtccttgatattcaccttcagccttccggagaacacttggtgattcatcaaatgttgccaaggtacttgcactcctttccacttcctgaaccatcatctggcgagaccgtcggaggctctcggtgatactttcagcagcagatgtc

SEQ ID NO: 8967 - DNA, 580 bp, Zea mays
  Clone ID: LIB3279-194-Q1-N6-B6
cttgttttggggttttttttttagagccaaactcaaaaacattgtatacatcatatattattctatatgacccacattaattaacaatgcacaacactgttatcagaaaggtaaaaggagcctttttcgttgacgaactattccaaaggctcaagggggcatgcgcagctcaatttgaaatgaaaaactcctgatacaatctactaggaaaaaacatactcatacgacacagaaagaagaaacatcagccgccatacaaagactgacacaagaggcttcatagttgctgcttcccacagggttgtcaaagtcagctgcttcctcccttctgcattcctcgcccaccgaccgaccgacacccgcctcacggtttcgccaccatcttggcagctgatgcacccggtccctcacgcctttccacaggaggcaacttatcttggagacgcattatcgtcgatattagcactctatcaccaactacgtgcctcaactcctttattagttcgcatcggcttattttcttactcttaaactcttcatagcaaccaataaccatgtccataatttgaggagacacttt

SEQ ID NO: 8968 - DNA, 441 bp, Zea mays
  Clone ID: LIB3279-194-Q1-N6-B7
cgaactcggtaacgtatcagtattcatcaacattagctcatgattttattccaaaaagaactgagcaactaacagaaaccaaagaagaaacagatagaaagttcacgcagaaaatgccggcctatgggggggtctttttgggactggggcaaggaaggattccccagttccttctcacttcctccaggtcttcgtgaaagtgcttctcgtaatatacagacatcagatcagtacacctgagaccagcttttgttgcccatgggaagtagtgctggaaaaacagcgccctttgtttgtcgctgaacctcgcagagcccccgacgactgacatcatgcacattgggaggaacatctgttcaaactctatcaccttgagggcggtctccccaatcaggttcgtcggaagaccaaacagcacgtgccaaaagtcgtgcacctcgc

SEQ ID NO: 8969 - DNA, 418 bp, Zea mays
  Clone ID: LIB3279-194-Q1-N6-B8
ctgggttgggggtttttaaaaaattttttttttttttttttttttttgggtcagactcgagctattatttgtaaaaacacattaaccgtaaacactacacactgccatgatgaggacggcatgggtttttcacagccaaaccaaacatgcacacggcgaggggtaataaacatcatcaagactaaaacggggctcttcactgccgcaccttgatcaggaacaagacaccaaactgacgatccaacagcctgctgcctggtactggtggaaatcctcctctaggggtcgacactgagtcccggattatgctaaatcagggcgatagtgctttcaccgccaggaggcttgcggtttccgcccacacgctcgcggattggttccttcccatttgcaaaaatgttgcttccagtgatctcct

SEQ ID NO: 8970 - DNA, 461 bp, Zea mays
  unsure (1)..(461): unsure at all n locations; Clone ID: LIB3279-194-Q1-N6-B9
ctggtttgggggttttggcataaaatgagactatgagagcatggactccctttttttatctagcagatgcagagattctaatgctagcttagctagtagacgacaattcccctgcctgcgtgcctgcctcaggtacatgcgagctctgtctgatgagagggtcgccggcggctacgagcacgacctgatgagccctaagttgtagaggaacttctcggagcgggaccggatcatgttcccgagcgagcgccgcccgccggccacggtcgacctggtcccgttggcggcggcggcggcggcgtcctggtgctcccggacgaacaggagctgctcgccgatctcggcgcgcacggcggccaccgcctgcgcctgcacgggctcccccgacgacgcgtncaccacgtagaacacgttggccgcccgcgccccgggcgtgcccaccttcgcgtgcgtcaccgaca

SEQ ID NO: 8971 - DNA, 596 bp, Zea mays
  Clone ID: LIB3279-194-Q1-N6-C10
agtcttcaaaatctctcatatttcaatgccaaaggcgtccgacacaaggcttaaaaagtccaaatatgaaggtacaacagcacaagttgaaggtaaaacagcatctagttatagaaccacataagtagctccgatgatagaaaattaagccacgggtacaggcatcgatctggcaagttgggacaacacaggcaactgtccggcaagagcgggcagccgagcgctcaacggtaggacttctggaacctggcgcgggcgccacgaccaccgaacttcttcggctcgcagcgcctggggtcggcgacgagaagggtgcggtcgtaccgggtgaagatgtccttgacctccttcttggcggcctcgtcgacgtacttctggtagtaggcgacgagccccttggcgacggcctggcggatggcgtagatctgcgacgtcttcccgccgcctcggacgcggatcctcatgtcgatgtccttgaacctggagcgccccgccagcaggatgggctcgaaggccttgaggcggagcatctccggcctgatgagctcaatcgggacgccgttcaccttgatcagcccgcgccccggcttggtgta

SEQ ID NO: 8972 - DNA, 563 bp, Zea mays
  Clone ID: LIB3279-194-Q1-N6-C11
acacaagctatttgatcaaggcacgctaataacagccatctcaggaatacagcgaggaatcaaggtcacagaggggtttgcaatgttccactgtccacacctatatataataacaacatccacggctattacaaaaaggtcaagaacacagaaggtgccaacgtctaatattaagacaacacgctaggatcgtcatttctccttcaaaacataggatcatgatggattaattaaagggtcctctgcagcctcgaaatcggtcctcaatccagtggaactcttcagcagcttcaacacggactatcgttaatcagacgaacattgccaactctgggcgactaaatatgttatccccattgtcttccagggcaggataagaagcaacaagtgaatcctgtgcaccaatgtacagagagttgtatatcttccaataaacttcacgtactttccttgctggatggaagagaccttgcaggcaataattcaaaatcacagctgcacctagcgcaacccttataccctcaattgcctccatgacagcatttataacgtggggagatgtc

SEQ ID NO: 8973 - DNA, 186 bp, Zea mays
  Clone ID: LIB3279-194-Q1-N6-C2
gagctgaatacaagttttcttttctagagctgaaatttttcaccctacctcatcagagacggggattcatacacgacacgtgtcatcacgaacattcaggaaaaagcgctcttgaatgtttgttatgtacgcatgtggcggaactttgttaagatttctacttctgtttaaaggcggacgcgtggg

SEQ ID NO: 8974 - DNA, 299 bp, Zea mays
  Clone ID: LIB3279-194-Q1-N6-C3
acacgaacaaccgggggggaccattttaatgcagaaaacaacatacaaaatattttttgcatacaaaagatcaactgggggcgggtttaatgcagaaaacaacatacaaaatattttctgcatacaaaagtgcaaatatggtaacaaactagctagtagcacgcacaggatcacttttttgtcgaactaagcctaaacatttagttgaggaagaccgcccaaaaaccgccggcgggagtggccacagccgtcgcccaaacaagcgcccccacaacgggcgggataaggggggccaccct

SEQ ID NO: 8975 - DNA, 563 bp, Zea mays
  Clone ID: LIB3279-194-Q1-N6-C4
ttttgaccaaacaatgaatgtaaatatattgttcttaccttataacatcatgaatttttatgtacaaaagagtgtgaatcaaattacaaacgataatgctagtgaaacgtagcaccctgccatatctctgccatatctcgagcgataacatctgtgtcttcaccccggtagctttaacagtggcatcaccccggcaacttgactgcaaaacaaagccacctgttttcatggtgtccctgttcttttcaggagcaatctcgacctctacattttcttgtacacaagtccatatctcgctttgcaagttgcaactacaccatttcacatcatcctcttccaagtccgccaaaagacatgttttcctcgtcacccatgtggatagttgggtggccagcaagattgttctcctcgtctatgccatcatcatcttgcaaaacatttgaggtctcaacatgacccttaggtggctcctctttgatgactgatttgaccacaacttcaacttcagttggataggatgcttgtcaatctcaatttctgttatggacataacagaagctact

SEQ ID NO: 8976 - DNA, 295 bp, Zea mays
  unsure (1)..(295): unsure at all n locations; Clone ID: LIB3279-194-Q1-N6-C9
acgtaagctnggatcctttagagcggccgcaccgggcgcgcggggcgcggacacagccgccggggaggggngcgcgcgggcgcgggagcacgggacgcgggcgccaccgncggccaccgncgncgncgccggggagggagaaaggggcgccgncgaggaggggaaaccgangggggaggggcgggggggcggnnaangnnaggggagagagggagaaaaaanccacngacgggaaaacgaagaaacgaagaaaccanaggngcaacaanggaggnnncccaccggggaagaagac

SEQ ID NO: 8977 - DNA, 470 bp, Zea mays
  Clone ID: LIB3279-194-Q1-N6-D1
aacaatcagatgaatgggactataaggagctcctgggttcaaaggaggtccaaggagtgtgacgttgatgtccgcatagtcgatgatgaaataaatctcaaattcacagagaagaagagagccaactctttgctttgtgctgcggggttctagaggagcttcatcttgagctcatccatgttgatgggggaatcattggagatcaccatatattcatgttcaatacaaagatacctaagggctcttctgtgtacgcatgcgcggtggcccagaagctcctcgaagctgcggagataaagaagcaggctcataatatcttcaactagacataccaatcataatgtttatccagacaacttagcatgctggtctgctctttagcatctaataaggggcttgcttattacttatcaaagactgaccacattgataagacttctttcatgaaagctgcaaactttcttgatagc

SEQ ID NO: 8978 - DNA, 415 bp, Zea mays
  Clone ID: LIB3279-194-Q1-N6-D10
ttttataaatttttttttttccactatatgctgttgatcctgtcatgagccgacatcagccagccggccataaagttgtacagtattcagttagtgcgacgggttgccttcaaataacaccgatgcgaggcaatctataaccgggtgccaaaatttcaaaaaaaaaaaaaactttttggtactatatatcgagaggatcagaaaaccctgcttctagtctggagctgctagagcattatatcgacttggggtaactgcggttggacctaaagctgcaagtggtgaaatggggattcagattattctaccagagaaatgcctagagcgaccagcatccccattgccagggagatcagctgagctactgagctcttgagggttgttttctggtcgttcatctgtggtaggactcccg

SEQ ID NO: 8979 - DNA, 446 bp, Zea mays
  Clone ID: LIB3279-194-Q1-N6-D11
ggagaaaagtctaacatgccaacattcctactttaccgtccaatccaatcccatcgaaccagcggtttttacagacccaaagaagcacgggttccggacgacaaagcaaccagcttccacaactgcttcaatacgaacacaggaaggcagccaaacttgtaccacagatcccagacacctggacaggcaattacccacacctaacctagccgccgaagccataaagagtgcggccctggcgtttgagggcgtacaccacgtccatagcggtgaccgttttgcgacgggcgtgctccgtgtaggtcacagcgtcgcggatgacattctcgagaaagatcttgagcaccccgcgggtctccttgtagatcagcctggagatgcgctttacgccaccccttcttgccagccttcggatcgccggcttcgtgatcccctggatgttgtcg

SEQ ID NO: 8980 - DNA, 593 bp, Zea mays
  unsure (1)..(593): unsure at all n locations; Clone ID: LIB3279-194-Q1-N6-D12
ctccaggtactgctgatggtactcttctgctctatagaacctcttcgctggaacgatctcggtgacgatcttccggttcagaagcttctgctgcttctccagggactctcttgccgccttctcctgctctgggttatagtagtatatccctgacctatactgtgttccaacatcattgccctgtcggttgggagtagtggggtcgtggcgcgcccagaaggtgtcgaggaggtcgtcgtacttgcaggcggccgggtcgtactgcacgcggacgacctcgttgtggtttgtggtgccggtgcagacgtcctcgtaggtcggatcgtggatgttgccctggctgtagccgacctccgtgcgcgtgactcccggcacgcgctggaacgcgagctccacgccccagaagcagccggcgccgaattgcgcgaactcgttccccggcgcgggctggtcctcgtcgggcccctgcgccagcgctgccgacgcctncgacgcgcgcgggctgcctccaagcccgctcaggcccagcttcccaagccagctcatcgcggggggcggtcgggtcttcctgcgcggcgcgaggaagtggaccg

SEQ ID NO: 8981 - DNA, 467 bp, Zea mays
  Clone ID: LIB3279-194-Q1-N6-D3
gaaacagcggcaggcctgccgtggcgaaacatttgctcaataacttatacaaacaataaagtgtgatgctaaggggaaggcaatagcgcagacatcaaattagctagagtaaaaaaaatatcttttatgacaacaaatggggaaccacacacagcccctatatcttttatgacaacaaatacaagcattgagtaaagcaagttcaagcaaccatctgaatatcacaggatattagtatcttttattcgatgcatacatagggccttctatggcttccttgctctatggcaccttagcgacgcaacagccagcgcagcagctctttggtggcagaagcagaatgggtggtggtggcgcaacagcggcggcagcagcagcagcagcagcacagcaatagcggcggcggtgggcagagcactcaagtttagctaacaaaaaacttcaacttgtatatggatgcaaaaagc

SEQ ID NO: 8982 - DNA, 430 bp, Zea mays
  unsure (1)..(430): unsure at all n locations; Clone ID: LIB3279-194-Q1-N6-D4
aaaaccattatctttttttcccacaacaatacaacactatcttcagacccaaacatcgtccgcgaccacactacagtatatatatagtatagggtacacgcatttcccagttcaacccatcataatacagtgttgctaccttacgtagttacggttgtacaaaaaacatcnggaaatcaatcgacgcatgtacattagagcacaccactgcgtaaaaaaattttactgctacgctttaagcgtatcccctgctaccttgcccatgcaagaagngcacgacgacccaaggtatggtggcactgttttnccttttgtacgcctcttgcaagagcatctttgcagcctcttttggggccttaatggatctaggcatcgcaacagcgttcttcttagagaccacatnccacaancccatactttgaagggttaa

SEQ ID NO: 8983 - DNA, 502 bp, Zea mays
  Clone ID: LIB3279-194-Q1-N6-D5
aattcctcacggaactaatactcaggttaaattttactgtgaagttaaatgtagtggtcgcagagttgtgatgatagagaactgctatacagaagttaacaagcaccaactctgcagataaaatggcattgctgtcatatcacattacacgtcgcataagaatttatggttcctgttctttgctctcagttgaacccactatattttccccatgttgcttttctttcttgcgctttggaagaagcccttccgcggacatcagttcatacaacttgcgcatgattgtctcttcttctacctgcagtttatgcaactcatgggacattgctcgatatgtttccattagtgcttgattttgcttgtctaaatgcttggacacttcagccgaatgctttggatccattatcaccaaacaacttgatatgtctcctcttcggataaacccgagatatgtgatattgtaggttgtagcacgtactgcaatttccgcgtatggaaacac

SEQ ID NO: 8984 - DNA, 488 bp, Zea mays
  Clone ID: LIB3279-194-Q1-N6-D6
gggaagagcaacacacactagaattaaatccacactgcaaacacgcacacaagtgagaagatgagcacacaaaacatgcgcggagagtttacaactcgaaaagtgctccaatctcaagaacgatgaacgattgtgtgaaagtgaggactagaagtcttggaatgcttagagtgtgcttgggtgactcctccatgtgcctaggggtcccttttatagccccaaggcagctaggagccgttggaggccaacaaggaaggccaaagttgccttctgtcgggtggcgcaccggacagttcggtgcaccaccggacaaccactgttcatgtccggtgcgcgatctccttcctatttgggcgcagacgaccgttgcagattcgcgacagttggagcaccggacactgtccggtacacaccggacactgtccggtgcacaccggacagtccggtgctccctgccgaccgttggcgcggcccacgcgtcgtacgtg

SEQ ID NO: 8985 - DNA, 571 bp, Zea mays
  unsure (1)..(571): unsure at all n locations; Clone ID: LIB3279-194-Q1-N6-D7
ttttggcagccatatatagtctctagattattgcattgttagttgttacacattagcaaggcagcattaccacttctctctcgctcattgccaacgattaaccagtgacattaattgcatatccttgtttgaagatcgccggcgtccggcgagatgggcttcaaccctcccgtgccgcagcaggacagcaactgggagatccgagtggcggtgcaggtgagcctcctcctccaggtgttcctcatcttcgtgggccccatgcgcaagcgttcctcctccccgttcccccgcttcgtcgtctggtcctgctacctcctcgccgactgggtcgccgacctcgccctcggcctcctcctcaacaacatgggcaacatcggcggaggaggcagctcctcgtccagctccagcttcggcctcaagcgcggcggcacgggcgccactgccggcaacaacgacgcaagcagcagcagcagccccatcatcttcgccttctggacgccgttcctgctgctccacctgggcggnccggacaccatcaccgnctactcgctggaggacaacgagctgtggc

SEQ ID NO: 8986 - DNA, 548 bp, Zea mays
  Clone ID: LIB3279-194-Q1-N6-D8
aaaccgaatagcagtagtcacataactaaataagcatccaggtttgcacccctgaagttaacaactcaacacaaacacaataaccaaataactgatgaagcagtaccaggcaagcgttacacagaggagctccaaggggagggctcaactaaaacctacaggatgacaaggactcgccgaggagcgcacagaagtctagtttaaactaaagatgcacatcccctagtcttcactccttggaggacttgttgatcagggacttgtgaatgtgcgggatgacacctccgcctgcgatggtgcccttgatgagggtgtccagctcctcgtctccacgaatggctagctgcaaatggcgaggggtgatacgcttcaccttcagatccttgctagcattcccagccagctccagaacctcggcagtcaagtactccaggatggcagcggagtagacggctgcggtggcaccaacgcgaccatttgcctgagtcctttgcttcagctgacggtggatacgcccaacagggaactggagggccggccgggaggag

SEQ ID NO: 8987 - DNA, 568 bp, Zea mays
  Clone ID: LIB3279-194-Q1-N6-D9
gtggaagggataaaaccaaatctgatagcactgtgtcagttctcccaatggatctgaaaattatgtagtgccactgtgtcggttcttttttatttgcaagctcggttcagaaatctagctaaattagaagactccatatagcatcatgaaaagggggaccagtccatcttgtacgatgatatgagaagaacaatgaattgtatgctccctcttgatccttttcaaggacagggttttcctgtttcacggactgtggttctggtgccgcactaatcatccaaagagaatccctgcggtggttggaactttgcacccaattcgctcagtttagcatgagcctcagcgtagtctctgaagaatgcgtcttggtcctctgcatatttctccgcatagacctggttgtgttgtggattctcatagagtaaagtaagctcaacaattaaattcatagaataccaacatcatacagttgatcatcagagatcaccttgaactttgggtcctcaaataaagcagcatctgtaggtaggaccagaagatcctgatctcggttccgacgcgtgggtcg

SEQ ID NO: 8988 - DNA, 407 bp, Zea mays
  unsure (1)..(407): unsure at all n locations; Clone ID: LIB3279-194-Q1-N6-E1
aataatacggtgatgcatctcatttacaacgaccctggtccaatgcaggcaggatgcatggtccgattcaatgcggttcctgctaggatccaagaaaacttacgtccgttcacggggacggggggggggggggggggncacctntcntnccnccgtgtgattccacccaaggacaaccaaaccaaccactgcaaatgcgtcgtcccagcagcagcggcagagtaaccaacgcctctccttccatttggaccactcctgaaccaacggacatcgtctccattctacggcggacctcacaacataaccctacgtctatttcctgcgctgtgctcctatgctttcacttcgatctctacttgggagaaaactttctgggggggagttagggagacggacggacggactat

SEQ ID NO: 8989 - DNA, 495 bp, Zea mays
  unsure (1)..(495): unsure at all n locations; Clone ID: LIB3279-194-Q1-N6-E10
agctgcgaacaaaaaccttgctcattcttctctcgtctcgtttcatagcgggagcaaccaaagggaacaacaggggtaccaacacctaatccaaaggtagaacggacactaacacggtgacagaagcgaacggtaacacgatactatagatagataagataactcggccgaagccaggatgggcccacacatcagtccctccagccgccgccgccgccgccgtagccgccaccaccaccctcgcgccgaccgccgtagccgccaccgccttcgtagccgccgccaccaccctcgcgccgaccgccgtagccgccaccgccgccataaccgccgtcacggcgcccgccaccatagccgccgccgccgngaccgccgccgtagccaccgncgncaccgncaccgncacgggactgggcctggttaacggtgatgttacggccgtcgagctccttgccgttcatgttctcgatagcgtcgagcatggagttctcggag

SEQ ID NO: 8990 - DNA, 501 bp, Zea mays
  Clone ID: LIB3279-194-Q1-N6-E11
atagggcgggcggtaggtggcccgttttataaggttctccagtggttcacaattctattcttggcagacaacagcccacatgttgttttcagctttcagctgatacaacgtggtgggcaggcaaatgaggatcataaagcagatggctctccataatcccatgcaggttcatttgttcgcgatccaactacgtataaagactctgatcgaaccgagccaagccgaataagaccatactagtagaaaggcaacacaggtagctatatacaactctattcttggaactggaattctgggtaccggagcttaaccacgggagcattcaggcaccgactcgtagatagacaggatgagagcagagcgcctagtcggctgccctgaagagggtcatcagggacaggaagaggttgataacgtccaggtacagggagactgcggcccagacgtactggtcgtacgtgtagcgcctgatgatgttgtttgtgtcgtagacgatgtacc

SEQ ID NO: 8991 - DNA, 482 bp, Zea mays
  Clone ID: LIB3279-194-Q1-N6-E12
cagagaaacaaggcatttcttcttccattctaaatagcaaaggacaacttgcagcaggacacatacacatacaagcacattcgtcccatctgcagcctacgcatcaccgcatactggtaacaaggtactgctaaacatcagatcactccggacagtcagtctatgccttcttaggggacttggcggccttcttgggcgactttgcctccttgctcccgccactggacgccttctccgccgacttcttgggcagcagaacagggttgatattggggagcacaccgccgtgagcgatggtcacgccgaccaacagcttcccaagctcctggacgttccggatcgccagaagcacgtggcgcggaataatgcgagtgttcttgttgaccctggcagcattaccggcgagctccagaacctcaacggcgaggtattcgaggacagcggcgaggtaaaacggggcgccggtgccgacacgctgcgcg

SEQ ID NO: 8992 - DNA, 456 bp, Zea mays
  Clone ID: LIB3279-194-Q1-N6-E3
agttctacacatttcgctgcttggctgcaattacaatttaggacgcactcaagataggtaacggcaaatggtaggtgttgcaatatgcatagccgtgtattacaatacatccagcacattattatacgtacaaatcatacaagctataccttctaatcaatctgatattgcaccaaccaaattctcgtatgcatactccacaacggtaagatccaatggaaaagaagcaaacaaatagttgcaggaacgataagatagcttactgaggcctgtaatagttgctctggtgcggagggtaagccccaggggcattgtacggtggctgtggatatggcgcagattgctgcggctgaggggcattgtaatatggcccacgccatccaggatatgccggctgaccgtagtcatggccaggaggtggctggtgcgctggcggctggtactgaccagggtgtg

SEQ ID NO: 8993 - DNA, 291 bp, Zea mays
  Clone ID: LIB3279-194-Q1-N6-E4
gaaaacggaggaaacctagtttatttttgaaaaaaaaaggcttttacagtattcagtaaaagaactgttatctgctaagcacccactgggaacgtgtctgatcaaaagtggtacagctgaaatatgtaagtcacacgtgcaactaaaatttctgttcatcattacgactgctcaactttctccttgataacctcttggatggcctttaagagcaccggcaccaagcgctcgcctgtcttgatgatgcctgtttgccagtacgaaaattttgcaactacttttttgtcgacc

SEQ ID NO: 8994 - DNA, 493 bp, Zea mays
  Clone ID: LIB3279-194-Q1-N6-E5
gggggggggaaaaaaaaattttttccgggggggggttaataaaaaactttttccccttttaaggggccctttttttaggaaaaaggcccccccccccctttcccaaaaaaagttttatttttccccccccctaaggtttttttgggaaaatttttttttgggggaaaaaaaaaaatttttttttaaaaaaaggccaaaattgggggaaaaaatttaattttaaaacccccaaggggggtttttttcccctttttgggttttttccaaattttaaggggggggtttgccccccccctttttggggctaaaaaaaaaattttttccttaattttttcccccaattttttaaagggttttttaaaggaaaacgttggaaaaggaaaaacaagttttttttttccaaacttggaaaaaaaaggaaaaatttttttttgggccccccccccataaaagaaattttcctttttcccccttagggggggaaaaaaaccca

SEQ ID NO: 8995 - DNA, 583 bp, Zea mays
  Clone ID: LIB3279-194-Q1-N6-E6
tttttgaaatcacaaaacaacctcccttgagaccacaggatacaatatctgagtcacgacagaaacaatgaaccggatactgctatggtctagttatacatttgagccatgtttcgacctcgtctcgacacgttctgctcctcatgttgcacaatatagatggaaaccttctcctatgccctcgaaagagaatatccagacgcatactgcataccacattgctccattgcttcgatgcctaaggttgtacagcttctaggagcttctcatacacttgccgtgcagacaaatcctcaacaattagaagcttcgatttgttattccatcctctttgaagggtcatctgagtcaatcttaggccaagaaccttgcccataaattctagcaactcactgttagcttcccctcgagcagcaagggcagctaccgttactcgaacgtcatcagcattcactcttgttactgctgaacgttgtgcccggtcttccacttcaatggctacttggacaactccaccttccagttgtgtgatgcaaggaggtacaggagcatcatgtggatttgtctcagcagcaactgaact

SEQ ID NO: 8996 - DNA, 583 bp, Zea mays
  unsure (1)..(583): unsure at all n locations; Clone ID: LIB3279-194-Q1-N6-E8
gcagcaccaagaagcaccatttttttccttaggatttaacttagaataaagcctgacgggggtaacagcacccatcgatccgcagtccatgctggttgatgcatgggtctgctggagccgaggatgaacacagcactaacaactgacacagagcgaccttcaatcaaaaacacagatgggcaacaacaaacacgagacgaacgaagataaacactctggactagggtaaacaacacggtagcgaacaggataacttggccgcgcgggccccaccgctcagttcctccagttcccgtcggagttgccgtagccgccgccacggttgccaccgccgtagccgccgncaccaccaccgtagccgccgncgncaccaccgtagccgncgncaccgncgtagccgccgccgccatcacggngcccgccaccgncgtagccgncgncttcacggncaccaccgtacccgncgncgncgncgncttcacggncgnncggggactgggcctcgttgacggtgatgttgcggccgtccagctccttgccgttcatgccctcgatggcgttccgcatcgcctcctccgtggag

SEQ ID NO: 8997 - DNA, 432 bp, Zea mays
  Clone ID: LIB3279-194-Q1-N6-E9
aaacaaaaataatcttaaagcacttgttacgaataacctttgggtttagagtttagggcagggacagaagaaaacatgtcgccagacaattttatgaagttcgcgtcataagggacctcctgtccagattcgtctagataaagaagtagcaaataaactactcggcagcagcaacctcctgcatagcctcatcaccctcgacaggcctctcaagcttcacaccaacgtcctctttgtagtcgccatgaacctccatcaacttcccgagatcaaacttgggggccttgagtatcttcaccttgcggatgaagacgttttgaagtgggaagatgctggaggtagacttctcaatctctttgccaataacttccggaatgaacttagaaacaagttctttaaggtcacatgtagaagcctggttgatcataatct

SEQ ID NO: 8998 - DNA, 587 bp, Zea mays
  Clone ID: LIB3279-194-Q1-N6-F1
attgaaatatgcgtgttttctgtttatttttatttcatactacagaactgaagttgctgatctatcgtataatttcctgtgcaggcaaaaacttggtctagctgagaaagtttctgtaattaccctgtgtcatattgttcacttgattggttcggaggatgcaaaattcctcaaaacagacatgagcactcattctgaagttctggatcaatgcctaagatccacaaaaatacaaaatccgcaaggtgggtcagccttttgttaatctatttagccttcttcttttttgctttcttctttttcttttgaccagcttctgattcccgtttgaagatagccagaatttcaatgctattggtgccagggaagaagttaaaagcatgagcattgtgcaactgccaggccttgctggatatcaagcttttgcagtgcctcttaaaactgttccatgcacaggtaatgtatatgagagtttcaggccacgtttgattggccctttaagttgttggattataacatgaactggagcctcccttgccccaaagatccatgggcttttctatgcttaacctttgcaagcaaacttt

SEQ ID NO: 8999 - DNA, 145 bp, Zea mays
  Clone ID: LIB3279-194-Q1-N6-F10
aaacacacacctggtaagttctctcttattaaatcagcatatagccaacctgtagcatgacagataaacacagacgcaaaaatgtcacccgttgaaccagccgattgggggagaccgaacaaacaccgcggcacggacgcgtggg

SEQ ID NO: 9000 - DNA, 588 bp, Zea mays
  unsure (1)..(588): unsure at all n locations; Clone ID: LIB3279-194-Q1-N6-F11
aaacgggaatttcagttctcatagcattatcatgaatctcagaacataacaggtgaaacacgaatcaagcagaggcgccatggggttcacagatccacacctaaaccgctaaattaaactgcgagcgatacatgataaactaagaccaccactcagatcaccaccatcttattcagatccaaaggaacggacgcagggggagtcgacgatgacggagggagggcggccgaacagaccagatcagagagatctaggagagctgtccgcagtcagcgaccttgaccaccttggaggtggagccgttgcgggtgcccaccttctcgatggccttgacgacgtccatgccctcgacgacctggccgaagacgacgtgcttgccgtcgagccaaggggtcgcgacggtgcagatgaagaactgggagccgttggtgttgggcccggcgttggccatggagagcacaccgggggcggtgtgcttgcgcacgaacttctcgtcggggaacttctcgccgtagatggactcgccgccggtgccgttgccgcgggtgaagtccccgccctggcacatgaactcggngatgacgcggt

SEQ ID NO: 9001 - DNA, 446 bp, Zea mays
  Clone ID: LIB3279-194-Q1-N6-F12
agacagccattagataagggtatagctgatgagtttgcaaccacaagtaccaggtatcaaacagttgggcaccaaaactctggtctctattttcagcaccaaaacagaacttagaacacacacttgacagtaaaattcgagtagtggctgcatcggaataaagaaagaaaaaaacagggtatacctgcttcacttcttttcatccttctccgactcagccgccttcttctggcgggcaccaaggtgtttcttgttcatacgctcaagacggagcttgccgtatgccgtaaacgacctgatctgatgaggaaccttgacaacctagactgagcgctgctgaccacgagtaataggcatgttgggaccctggacctgtgtggtcgatataagccttttccgagaatagtgcacgtgatcgacctttgcagcacgccttgtgaagatta

SEQ ID NO: 9002 - DNA, 221 bp, Zea mays
  Clone ID: LIB3279-194-Q1-N6-F2
aaccagcaggaaacaaaaaccaccactattgcacaaacatggttcatcttagtgtacaacgccaactcatcatctcgacttgcctatgcaatgcaacgtgaaacaaaagacacacatgcgtcttgcagcatcaatcaatccacgtacgtacaccctctccgatccgaaagacaatgaaattgcataacataacccttgagcttaattgctggggaccaaat

SEQ ID NO: 9003 - DNA, 183 bp, Zea mays
  Clone ID: LIB3279-194-Q1-N6-F3
aagcatagtttttccaattttagagttactatgtcctacataaaatcaattcaaacaacaataaattaggagcaaagtgactccatcctaccatattccgaaaccaaacactacctaagtacatctgataagtaataacctatttggtaatatggcgctaatacacaattctaaagtggggac

SEQ ID NO: 9004 - DNA, 427 bp, Zea mays
  Clone ID: LIB3279-194-Q1-N6-F4
aaggaatacatcgccggctggatccataattccttatcaatcctaccacggacggagatacacatgttacctgtatttctattatgagtcctgtcaccatgacaatgaatggctccaccccgccgcctgaaaaaaaaaatggtaacaatctgcattctgctagtttgtgtttcatctacgccgaactgggggtggtcgtcgtcacgtaggaactggactctccccaacaaggggccaaaaataacagtgtagtgtcgatagctgagggctgacggacaagcaactttggatcgagcgatcgcgcgcgcacagttacaaaagaacaagaagaatgaacgaatcagcggcagctgcggcagccgcagcagctagctcttcatctcgccgtcctcgaggtcgactgcgggcacgccccccgacgcgtggg

SEQ ID NO: 9005 - DNA, 501 bp, Zea mays
  unsure (1)..(501): unsure at all n locations; Clone ID: LIB3279-194-Q1-N6-F5
gacttctctgtagcaggttcacgatccttttgacaactgccagccacacgcacggcaatgcgaggtcgacggcgttgggcaagctgggcatctggccggggacacgacacgatctaggcacaacaaggcaggacccattcaagcacaaccatctagacacatcaccatcacggcacggtctattaaatcagaaccagctatgggccatactgtgcccagccagttgaccgagccattagtctacgacacaggccacaacaatctatatctatactgactattaagactgcactgccccgcctaacaactgcccgcccgatcccacagcgacccccgccaaccgcctgccgngaccctcgcccgccaccagccgcaaggcgcgaacattacagcatatttacagacatcatcacatatcaattcacttcgaacacgcactggcaattgccaaatggagaagaaaagggaaggaacgcacgaacagaggaggagatccggacg

SEQ ID NO: 9006 - DNA, 447 bp, Zea mays
  Clone ID: LIB3279-194-Q1-N6-F7
aaaccgaatagcagtagtcacataactaaataagcatccaggtttgcacccctgaagttaacaactcaacacaaacacaataaccaaataactgatgaagcagtaccaggcaagcgttacacagaggagctccaacctgacagctcaactaaaacctacaggatgacaaggactcgccgaggagcgcacagaagtctagtttaaactaaagatgcacatcccctagtcttcactccttggaggacttgttgatcagggacttgtgaatgtgcgggatgacacctccgcctgcgatggtgcccttgatgagggtgtccagctcctcgtctccacgaatggctagctgcaaatggcgaggggtgatacgcttcaccttcagatccttgctagcattcccagccagctccagaacctcggcagtcaagtactccaggatggcagcggagt

SEQ ID NO: 9007 - DNA, 444 bp, Zea mays
  Clone ID: LIB3279-194-Q1-N6-F8
agggcaagaggcattgtgcttataccaataaccttcagaagttcattatcggatgtgacttggttaaggaattaatgggtaccgatctcatagctgtgcatttgggatggggggggggcgacaaagataaccttgcatccacaagggcagagatgggtgaggtaagagaagagaacaagaggctaaagacaatgctgtcacgcatcggagaggactaccgggccctccaattacaggtccacgacgtttttcaaaaaggagaacccatggagaagaagcttgctgaccaccggcccttgaccattacgccacccaccgggattgaggaggccgaattcgtctcgctgagccttgggacgggcacaggcacgcacaagaaggaagagaagagcgtcatcattagtgctgccgaaggaaaatggggggaagactacttgatgatgg

SEQ ID NO: 9008 - DNA, 604 bp, Zea mays
  Clone ID: LIB3279-194-Q1-N6-F9
aaacgttcaaatgttggtttccttgttgatctatcagactgacggaattaaatgtacgtgagggcagttcaaccaagctggatcactgaacatcacaggatccacaacaatgctcggtagcgaacacaactacgtactagtcaccaagggcgagccctaccgtgttccttgtctttgttgaaagagttgcggtcctagtattgtacaagtgtggggtctacagtacaacatgctacatcgaatatgacctacatctacgaactccaagatgaggagctgtttgtgttcaagaatcaagagcaccatgtagggaattgcaagaatcggagctgtccaccacttgagcttctgattatgaggaccaaattagcttgtaacaagtagccttaactttctgtcgtgctttatcattgaactcacactctctaccagcaacacagtctgaaggcaagtgtaagccaaaccagtggcgaagtagaaatttgcattaccagtgcccctccagatccacagattatgcatgacagggctaagtagggagactccaatatatccaaaaaacaagaagaatgtgaactgcatttctgctaattcgttgacaaat

SEQ ID NO: 9009 - DNA, 78 bp, Zea mays
  Clone ID: LIB3279-194-Q1-N6-G1
gagaagccatgtatctgcatatagctgttggtgtgaacaaacaatggaaaacaaacagtagcacgagcttcaacgcag

SEQ ID NO: 9010 - DNA, 539 bp, Zea mays
  Clone ID: LIB3279-194-Q1-N6-G10
ggcagtacaaagttctcaacgctaattcataaaaatttaaaaagacaagtgagcccggctgagctgtgaatcaaactaacatcgactgtccttgtggagttaacaacagagtgcgatgacaagccataatcaaggaccatggtgcccacgcttcgtacaagggtcgtctattaccgattgatgacgtggatagcaagagctcggaagcgtttcacagcctcgcgatgacggcttccacctcggcaggggtgtagaggtggtacttgggggcaaccttggcaatatcgacgttgtttggggtcaccttctcttccataacctgcttcaggatagaaagggctatggtctccgcctcctggagggttaattccttgttgtactgttcctgcaaggaactatcagctccctcagaacctgatccaattgcctttgcgttgcattgccaaaatgtaccagatgggtcagtgtagtacaggctaggtccattctcatcatgtccagcaattaggagagagactccaaatggccgtgacattgac

SEQ ID NO: 9011 - DNA, 512 bp, Zea mays
  Clone ID: LIB3279-194-Q1-N6-G11
gcaaacatatatcttagattcgagaattgagtcttgatatcacattaggtactcggggaacatagtgtggcgccatagctagatgcaataaaccttaaagtcctctgaactcgaaaatcctaacccaaaagagcaaatagagcgcagtcttctcaaccatcaaacatgacaccattgaaaccaaagatgacactgctcacgcttcaacagcgacccttccagccacttggtccagatcacgccttccctggttggtgatgaggcgtccacccttgggatcgacatcgatgatgcccataatctgcagctgctgcaggatgttgcgtgcaacagcaccactgctcttgcagaagtgtggtgggcgggagccattcctctggcggccaccgtagatcttctgaaagccacccacaccgatgccttgccttaggtagatcttccttgcaatggatgcagccctgatgtagtaccagtcaggatcataaggaggaagctccttgaacctcgcagtc

SEQ ID NO: 9012 - DNA, 436 bp, Zea mays
  Clone ID: LIB3279-194-Q1-N6-G12
ggacggaaaaccctttaataaataagttgactcccagggggttcatcacaacaaagccggttcattcatttcgccgacgggggggacattatttttttacatcacaaacaaaacaaatccgagcaaactggaagggcgatccatccacccaaacgggcacgctaataaaatgggggatttggatttgattcgccgcctaaacgtttccacttagctttaagggggctttcgcttgcattttttgatgacagaataaccttgagacctttcgcttcatccttggaaccagaattaggtggcctttgtgtacgtggagaatgtgaaaccattttaccgtttttagaggatggaagggagtgaccaccagtgaagccgtttttttttgctgaatcaaagctaagtggttggagggctttttccccgaaagagagctttt

SEQ ID NO: 9013 - DNA, 588 bp, Zea mays
  Clone ID: LIB3279-194-Q1-N6-G2
cagttcgaagtaactgaaattgataacaaaatatccggttgccaaattgcagactctctttggacagatgcacatacccccacgctaacctgaaacacacgcacattctgctacatgattgtggccgcaagaaggcaacctaaacagaactctttaagttacaactggctaagcactacagggacttacaagaaaattcagctatagccaagttaaggttccacagctactaatcaaaaaccaaagaaaccaagctcagtcgccctttccttctcaaaggtttcgaagtattggtatatgattgtcacagcgagcaatataccagttcctgaaccaatcgcacccatgaaatcagccaggacggtcaatgcgccaatgcatacaccaccaaatgcagcggcagtggggatgtatcggttaagttccttctgcaagtttgactcacgatggcctggcatcaccatttgttgttccttgagctgcttagcaacatcctttgctgatgaaccagaaacttcaatccatgtctttgagaacagagcacaggctgacagcatgaagaccacataaaacagtgcatggaatgga

SEQ ID NO: 9014 - DNA, 485 bp, Zea mays
  Clone ID: LIB3279-194-Q1-N6-G3
aatcccttgagagtcacgacatgattacattgcaggggaacgaaaccaaaccaaatctcacgcacgcgcgcaacgcagcagctgctgaaacaaaaaaaggcgacccgaaccaaccaccggcacccaaggcgatcgatgatgtcattctcctcgctcacgacttcccccgcccgtaggtcgcccgccattgctccacagccaagccccgctcatcacgcgttgctcctgaaggagccgagggccttgatggcgccagcccggaggatgtactggtggtagaaggccgcgatggcagcgcccacgagagggcccacccagaagatccagtggtcgtcccagggcttgtccttgttgtagatgacggcggcgcccaggctcctggccgggttgatgccggtgccggtgacggggatggtggccaggtgcaccatgaacacggcgaagccgatggggaggggagccagaaccgggacgtgggagtcgcg

SEQ ID NO: 9015 - DNA, 301 bp, Zea mays
  Clone ID: LIB3279-194-Q1-N6-G4
cattaagaatatggtagagtttattcccattatgtaggaagcaagcacatctccaatattttttattcagattactgatcatggtcatggaattacacaacaaccaaagcacacacgagtacatcatgtcatgtggtagcacagcagtgtatgcaaggactaggagctcgagctattcagcaggcacatcacatacgtccttccattcagattattgggtagcaaagcaactagcaacaagcaagcaagcacaacactgaacaccgcaagaggcaggacagagtaaatttacaccgagact

SEQ ID NO: 9016 - DNA, 504 bp, Zea mays
  Clone ID: LIB3279-194-Q1-N6-G5
gggggcagaaaacgagctaggtggatatatattacctagattcatgcatggttgaactgaatcaatgttaaacaacaactccaatcaagaaatcagagtttaagagaaagccttttgaaacatagggctcgttcatagtgctttacaaattgcaagcttcaaattcaggtgttgtccacaaaagagcttggtagagtttggcaaaaaaaagagcttacaaacgctgcacctggcctgcatgtgctagtgaacgagaggattgttgttcatctaatgaagctccacagcaccttttatatcgttttttaaaaccacatgggcagaaagcattcctacttatctgaccactctttgccagattacttttgccgacatccactggtgtaaaacccattagattttggacctcgttaaatgactttggtaatggcttcccttcttccttgagctttgcaatctttttctgagcctctttagcccatgtgtacttggccagaatgtgct

SEQ ID NO: 9017 - DNA, 574 bp, Zea mays
  unsure (1)..(574): unsure at all n locations; Clone ID: LIB3279-194-Q1-N6-G6
tatatttaggacaagcactgccaagtcatatgattcaggagaataaatagagaccatatagatttgttttgctgaaaacattagaattataccatcagcagttccacaaccatcgcccatcagcaagcataggaagcgctgtcgcttccgctggatcaggcactagtgatcaaactgtgaaatcctacaccacccacacatccaccagaacatagctggagaaaaacatcaggggttcaagacctactagcattctagagcaaagcagcaagcagagctgcgggattcttcaatgcactcccagctgcaggatcgctggctcgtctctcagctcaaatgtaactggattgttctccaaagatgggtactggtcaagctgatcataggcaagacagtcttcatccagctttgctttaccatctactgaactagggagatcccaactgatgtccgggagaatctcaggttccagctccagcacttttggttcatataaaacctncctagctggaaacatcagagaatcaaataccgtatctgaccaaccacgcaaggctgagtttactgaccccac

SEQ ID NO: 9018 - DNA, 547 bp, Zea mays
  Clone ID: LIB3279-194-Q1-N6-G7
gggctaatgctttttattaactttccttattgatactttgggccaaaaaagggtgtcaaaatgttttaagctgagtagaatgggcacacaactgcacatatatgatgcatcatcagatttggatctgttgcagattctgtgccactaccatcatgacaggaatgcataagcaccctagttctttgggcaccaaatatagttaaacaccctagttcttctttgggtattctcttgcaccaaatatggttgacccaactcttacatttgtgcttcccatttcaatcgcttgttcaaaatcagccgacatgcccatagacaattcgcactgctcttcgggtattccaagctccttgcacacctcttcccggcagttagccagcgccttgaaattctcaggggttgaggagtaatcaagcatcccaattgtcatcagaccagagaacacaaggttcgggcagttcagtttgacatgctttgctagttccatgcatcctgagggatctactccaaatttcgattcttctccactagtgttgacttggaccaa

SEQ ID NO: 9019 - DNA, 393 bp, Zea mays
  Clone ID: LIB3279-194-Q1-N6-G8
gggataatacaggagtattatatagacacaggtgaaccaaacaggttctctgttccctgtctccctcggggggattgcctacatctgaataataaaaaaacaaacagggggggacgagggggtctcgtattatttgctgaattatccaagttctcttcagtcaggaaccatcccggataaaagtgaagtaccaaagttgcagacttgcaagccttttatgcctctggttggggtttctcgaagaaagttttcttaatccagtcaaatggcttatgcgttttagtgtgatgccagcttccttttccatgtccgcttaatttgttggttccacttaacacactcaagccagggatggagatgacgcccggaggacagcaagccagggatggtgga

SEQ ID NO: 9020 - DNA, 506 bp, Zea mays
  unsure (1)..(506): unsure at all n locations; Clone ID: LIB3279-194-Q1-N6-G9
ttctcacgattcacgatagcagttcttcaacaatgatcaaaggctaccgcagcaaaacataggctaaggtcacggggggctaggatgaatctatcatcacctgataaagcctgaaacaacctctcagccgcgggccttaagctcggcgaggcggcgagaaaggtcatcctcgtcgactttctccttatccttggcggcagggatggcgtgggcggctgcctgcggcagaccgacggagacctcgagcccgtagtcgtccgcgacctgctgcatgaggctgttgacctcggtctccggcgtggagagggaggtggagccggccatggcgccctccatgaactcggcctggacctccatgttgacgaactggcgctcgaaattgtccatggtctcggacatcttctggaggttcccggtggcgagcgaggagtcnagcgacttgacgatggactgcatggacttgccgatgacctgcatcttggcctgcgtgtcgaggcgggccacga

SEQ ID NO: 9021 - DNA, 609 bp, Zea mays
  unsure (1)..(609): unsure at all n locations; Clone ID: LIB3279-194-Q1-N6-H1
gatacaatgcacacatggttattctattcatccggtcatcccgtcagaggttttaacatttaagcatatacgcacaaaaacaaaatgagataagtatgcaatacaatacgcactctgtaccaaacatcataaactcccaacatcatatatatggatgcttttgcaaagtgcacatggagatcttctgcatcccggcaactcggagatacgtcaacgaacagaggacgcagttgaaaataccagatactggctactcaaaatttccatgaagataacggtggggtctcggagtccttccaagtgttggccaattgatcgccataccggtcacccaagacttcaccagccgcggcatacgactcgagttcagccatctcatccggtgtaagcttcacagacagtgcccccacgttctggttgaagttgtcgatttttgttgtgccaggtatggggcaaacgtcgtttccttggtggtgaacccaggccaacgcgagctgtgatggcgtgcatcctttccgtgctgncatcgcgctcacgcgctcgaatatctgagcgttcttgtcgagattctctggctgaaatctaggcatatgcttgcggaagtcctgc

SEQ ID NO: 9022 - DNA, 512 bp, Zea mays
  Clone ID: LIB3279-194-Q1-N6-H10
ctgggttggggtttttttttttttttttttttttttttttttttttttttttttttttttttttttttttttttttttttttttttttttttttttttttttttttttttttaacccaaaggggggggatttaaaccaaataaccttttggtttggggggaaaaaaccgcaggggggaaaggggaaaaagggctttttttgggggaaatgggaaaaaagggaactgggccatccactagggggtgggaaaaaaaaaaggttatccccttggggttgggaaaaccctggggaaaaaaccttggaggggggcccccatggttggttcaagggtttaaggggggggtggggccttttgggggggtttttgaaaaaaaaaagaattttttttttggggggtaaaaaacgggcaaaggtaagggaatttggggaaattgggggggaaaaaaaaaacggtgggggggggggggaaaaccaaagaggggtgggggggggaaaaagcaaggaaagtgggg

SEQ ID NO: 9023 - DNA, 589 bp, Zea mays
  Clone ID: LIB3279-194-Q1-N6-H11
cttggtttggttttttgtgatatactcagtttattgcattggcacgtcgttgtaacttgcttacatagtcattatagacacacatgtacaagctgaaacctgcagctaattccgtgatacctttcagtgattcctgattgctcattttagagagggggggcttctacaaagtttatggaacccaacaaatgaacccctagggtcttcaatatctcatcacccagcagccacctgatattggtcttatcttgatttggtcagttttgtcagaggatatggtgagggatggttatgaggacgttgtaaacatatacatttcatctgtgctcatcgagcggatgagagagaaacaaaaggagattacacaactaacatgtagcgtttgcagatctaggtaaatacaatcacctcttgtttgtactcacatacaagcacttatgacttatccatgtattttatgaactgaattgtgatcaattatactactgtgcttttaggacatgttatttttggttaaaagtgccagactttcagttagtgcttttggcttgttggaaatggatgaggccgagatgctaactccccatgc

SEQ ID NO: 9024 - DNA, 589 bp, Zea mays
  Clone ID: LIB3279-194-Q1-N6-H12
aattacaaatatacctctcggctcgaaggaaagcaagggtacaagcgtgacgcgaaagcagatgccaagtcagcgtgaacagtacgggaatactgttcacctatttataggcacgggtcgcagcccatgcaaaattacatccaggccctttgcctatgacaacaactctatagtaatttatctgggtctagatagtcttttcctctttaagtcggtttcctcttttctgccatcatgccgaagctcccttctgcgcagcttcggctctgctccatctttcgtattatttccgtgcttcttcataccgtgggctcttgttcgaagatccctgtccacacattatactccagaggcattgttaaatcatgtttttgaggaccttcggaagccgaaggcgcccaacatttccgacaccacctaaaccagtctgctcgctgccccgtttccgttgttgacccattcccgatgcgacgccacccgactccatcccttcctgacgcctctgtcccctgtcctgtttttatcgtgatgtcaatccactcgacaagatagatctccctcgttgcaacgatatgacttcccctggggt

SEQ ID NO: 9025 - DNA, 411 bp, Zea mays
  Clone ID: LIB3279-194-Q1-N6-H2
gaagacgcaggataagacagattgataaaaatactatttcgtctcaatacaagttcagggacacaactactcaaaacttaactaggcctcaaagggcggttcactgcgtcactccgagccacttggtgaagttctcaaactcggtgtagtcactgtccgagaccatggtcttgtaccacgccttgccggcagccttgaccttggcagtctccgaggtaagcttggtccttttggaatcaagcttctccttccgggccttgactcgggcagcctcaacaagggtggccattttccgggcagtgccgaggtaggggttgagcttgagcacaccaaccatgttcgtgagcgggttgttactgttttgcttgggcttaacctgcttggtgagggggttaaccacagactggacct

SEQ ID NO: 9026 - DNA, 515 bp, Zea mays
  Clone ID: LIB3279-194-Q1-N6-H4
caaacaaggtccactagtttattttttatttttgtttttcgttcaagcatggcacctgtctatgatggaacggaattcagtaccatctagagatacattggaggagattagtaacccgcacatcttggcaagcataggaggaagcctctgtgtttgtgccacagacagatcaggggccagccagcagtcttcgttacttcatgccaactgatgccataaaatcctcgtcctcagggtaagcctccgttctttgacccgccgccgaacccgttggtccaaaagggttttagatttgattgccaccgggccacctggtgccgcctgccccaaacatatcttgcttgcggcgggggcgggggcttaacttgaaacggcggaaaaaacaatggatgtaacggtgccggattcggaggtgccttgacggacggccagcttccccggaaccccgttggaaactaaaaaggaaatcctttcttgggaaaggttccttgaaagtttgaagaaggggaaccttc

SEQ ID NO: 9027 - DNA, 457 bp, Zea mays
  Clone ID: LIB3279-194-Q1-N6-H5
aaggaaacctcaggttatttttctcaagtgaagtcaagtatgtgaacaaatgagtagcagcagtacacacgctacgttacctcttttccccttgctgaggttctgctatttttttaattaaaaactaaaaccctattttatccaagccgataacttagagagaaaatacgcagatctactgcttccgccgtactgtaaaaaaaacagtgcacagtactataggcagtattatccacagaaaaacgagcaagatatcatctttttttactttttggcccactgacggaggtcggaaggcatggagtcatggacagatcgcgttttagaacgggtggtagctccggcgcagcccactgacgttggcgaacagcccgacgagctcttgcttgtacggcaggtacgaacgcctccggctgccgccgcctctaccgtaatatctcagctgatgcgccacgct

SEQ ID NO: 9028 - DNA, 375 bp, Zea mays
  Clone ID: LIB3279-194-Q1-N6-H6
ttcttcggaagtaaggggttgcgaaaaaaggagcaggttgccgtatgtttgcaggcaaggcaaaggcaaggcaaccaagtgggccgacgaccgtctcagatctccacacccagcacaactcggaggcgcttctttttccagacaaaacttgtagggctttgttatcaaatcgaaatgccaggatcctctcttaagaaggacccaaaggctgcgtatgaggagtctccggaacaatgtcagaaacgaacttgatcagcgagcagagcccgcccaggaagttgtggtcaatcaccccatcaccctcggccacatgggcaaagtccaccagcttcaccgtcaccccacccccatctccgcctgctgcgactgcagcag

SEQ ID NO: 9029 - DNA, 534 bp, Zea mays
  Clone ID: LIB3279-194-Q1-N6-H7
tgcattaacggctcgatcgatcaatagtagccgctgagcagcatccggccaacctcgaaagagacaaaagcgtcgatggtggcgtactcgatctgctcgtcggagagggatgacgcgtcccaggggcccgtcctcacccactgcggcttctcgacgtgggcgtccatgacggctctcgcgatgccctgcaggcccgcgttgcggaggtccgggcgccccatctccttcgccgcgagttcggccaggtcctccgcgttcgccacctccaggtcgtagtcgttctcgagccgctcgacgtccgcagccacgcccacgccgacgaatgtgtagtcggggtcgctgaggaactcatccagcgtgttggggacgtagtcggcgtggagaagctggaagatgaggcagcggcgcccgacgcagagctggacgatggctgttttgctgtaggcgcggctgaagctggggcgccactcgacgtccagcccgacgacgagcttgtgcaggcggcggcggtggacggagaggatctcgtcgagc

SEQ ID NO: 9030 - DNA, 291 bp, Zea mays
  Clone ID: LIB3279-194-Q1-N6-H8
ggaacaaggcctaaatcataggagtactaacaacacagaaacacagaacaaaactgcaacctcaccacaagcagcaaaaagctaatctgaggtcccatattagcgagcggatctgtcacagatggtagcaggaagggaaacaaaagtgcaaaacatgttcagactcagcatgaacctggcgacccataggcacgcgccatgcacattgatgtgttgggatacacaagcagtaaccatccatgagaagcaggggggaaaaacccctactgggtgtggaacatgtggggtgtc

SEQ ID NO: 9031 - DNA, 201 bp, Zea mays
  Clone ID: LIB3279-195-Q1-K6-A1
tcgacccagcgtcctttttcgcgtccggcgccgtcgcctccgacatcgtcctttcgtccccacgagcaaccgataatccgccggcgttgagatgttggtttatcaggatctcctatctggcgacgagctcctgtcggattcattcacctacaaggagctcgagaacggttttctgtgggaggtcgagggaaagtgggtgag

SEQ ID NO: 9032 - DNA, 524 bp, Zea mays
  unsure (1)..(524): unsure at all n locations; Clone ID: LIB3279-195-Q1-K6-A10
taacgaattcgcctccggctctcctcttctcgagcgttttcggcaccacggcgcagtaggatggcggcggcggccccgacgagagcagaggtgctgtcgctcttccgttccttactccgcacggcgaagaagttctcggactacaacatccgcgagtacacgcgccgacgcgccgcggactccttccgcgaaaaccgcgccctcgccgatgcgtcggccgccgccgcggcgttctcggaggggaagaagcagctagaggttgcgaagcggcaagcggnggtttactctctctacgcccccaaggccaagagcgtgatggagttgaaggtgcagtgatggctgngaccttttcttccccaccgttcccgttccagattcgttgcttttgtgtgatgatgaaactataaactgctccgttgtcgcattttctggatgattggcatgatatagnttcgttctgtggcttagattcctaaattcttccgcttttttttggtgtgtttttatttcggggggttcgtcgg

SEQ ID NO: 9033 - DNA, 78 bp, Zea mays
  unsure (1)..(78): unsure at all n locations; Clone ID: LIB3279-195-Q1-K6-A11
tccgttcgggttcgggttcgtgagttctccggggttcggtttcgtgggtgngcggntcggntggcggcgtcggttgtt

SEQ ID NO: 9034 - DNA, 469 bp, Zea mays
  unsure (1)..(469): unsure at all n locations; Clone ID: LIB3279-195-Q1-K6-A2
aaccagtgcagcaaaggaccccgctcgtgggatgccaggacctggagtgagtgagccggtggccatggttttctatactctgctatgctctccctcgccggcgttcttttcgtgtcccaatctggaaggacgacggacggtacggtggctggtttagctatagacaaaaaaaaaaaggtacggccgcgtggtggcggtgctaatatgcttagccacgcgcggttgatctttgagaagttaagcgtgtacgaaatgacagctttgtacgtgtactgtctgctggagtgtgctgtgtatctggtctggatccgatcggcctaatgtatgaaaaaaagatgtttacgtactaaatggaaaatcattttttcccaaaaaaaaaaaaanaaaaaaaaaaaaaaaaaaaaaaaaaaaaaaagggggggggcgtttttggaggatccaaggttacttgcgcggtgtttgcgacggg

SEQ ID NO: 9035 - DNA, 615 bp, Zea mays
  unsure (1)..(615): unsure at all n locations; Clone ID: LIB3279-195-Q1-K6-A6
ccccgcgtccgtcatggtgtatcggnccatttatccggaagctatcaataacatattctaccagttcatatatgaaacagaaaagcacaatggaattgcagagctcttggagatttttggaagtatcatcaatgggtttgctttgccactcaaggaagagcacaaactgttccttgtaaggaccttaattccacttcacaagccaaggtgcactacaatgtaccatcaacagttgtcttactgcattacacagtttgttgaaaaagattgcaagcttgcggattctgttattaggggcctcataaaatattggcctatcaccaacagcacaaaggaggtactgttcttgggtgagttggaagaggtactagatgcaacacaacctggcgagtttcaaaaatgtatggttcctctttctcaccagatcgctcgctgctcaaacagccctcacttccaggttgctgagagagtattgtttttctggaacaatactcacttcgagaatcttgttaagcaaaacagtaaggtgatcctgcctatcgtcttccctgcattggagaaaaatataaatgggcactggaatcaagtcgtgcgaagcctcagcctgaatgtccg

SEQ ID NO: 9036 - DNA, 639 bp, Zea mays
  unsure (1)..(639): unsure at all n locations; Clone ID: LIB3279-195-Q1-K6-A7
ctcagtcacctgacgccgccgcttcgnttcgtnngtggaggggagaagagnnaggaaatggcggcgaccccgagggcgtgcctcctgnngggatgggcannaccccctcctcgnaccatctccccgccgtcgnntcgatgaccgccccttcctgacccaaagtatgacatcatagctgtaacaatnngctattcnntcgctgaggggagagagcacttgcccctatgtatttgacgagtnntggctagcaagnagccaatnngttgaatattannttgccggnaggnnagcccacccagnnaactctnnatcagggttnngcccaatggatnngcttcaaaccctcctggtgccaacccaagttacccatggganntgcattgnngaaaggaccaagtnnttggtgaggnnnaaatgaagnnaaaaacccgctcaagnnctgcagnngagttaccctgctncnnattactacccgaggnatgagaacctgnnctcctaccctggcaccatgtgccctgtnnatgtgttnngttggtgnngtgaaaggggtcattgatttgcaaattntggtcagcggcaaaactggttaccaaattctgagcattttaaagaggaccaggagaaactggggcacctagt

SEQ ID NO: 9037 - DNA, 630 bp, Zea mays
  Clone ID: LIB3279-195-Q1-K6-A8
cgtccgttcttccactccctccatttccctcacctccccgcagcagcttagccgccagccaaccaaccgaaccaaccaaccaacccacagcgagcgagtaaagcgtccaatggtagcgatggcggccgtgcagcagaagcagcagcagcagcgccgcgacgcggaggcggagctcaacctgcccccgggcttccggttccacccgacggacgaggagctggtggcgcactacctctgcgcgcgcgccgcggggcgccgcccgccggtgtccatcatcgccgaggtcgacctgtaccgcttcgacccctgggacctgccggagcgcgccctctttgggcgccgcgagtggtacttcttcacgccgcgggaccgcaagtaccccaacggctcccgccccaaccgcgccgctgggtcgggctactggaaggccacgggcgcggacaagcccgtggagcacgggggccggacggcggggatcaagaaggcgctcgtgttctaccacggcaagccgccgcgcggggtcaagacggagtggatcatgcacgagtaccggcttgccgaagccggcggggcccgcgccaagaagtccggcgccggcacgctccagctggatgactgggtgctgtgccg

SEQ ID NO: 9038 - DNA, 585 bp, Zea mays
  Clone ID: LIB3279-195-Q1-K6-A9
cctctcctttcctctcctctaggctctagtcctctcgcatccgcagcttccccagccagctagggtttgcagatgacgaccgcggcgcgccccacctgggcgccggccaagggcggcaacgagcaggggggcacccgcatcttcggcccctcccagaagttctcctcccgcgacctcgccgcgcacacctccctcaagccaagaaaagacggtcaacagacccaagaggagttacagaagaggaatctcagggaggaacttgaggaacgtgagcgcaagcactactcttccaaggataagtcctatgccgaagaaagagaccggcggaaaagctctagccatctactcttagaaggttcaaagagagagacagaggataagatagttccacgagaaatcgatgctgatgactccgatgtggagcctaaaagcgatgacgagagcgatgaagatgatgatgacgacgacactgaagctctaatggcagagcttgagaggattaagaaagaaagagccgaggagaagcttagaaaggagcggcaacaagcaggagaggaggccaagatgaaggaggctgaactgatg

SEQ ID NO: 9039 - DNA, 539 bp, Zea mays
  Clone ID: LIB3279-195-Q1-K6-B1
ctcccaccaaggcaccaaaccaatctagccaccaaggcaccaaccaagagccatggcatccccgttctgcgccgctgccgccgcttgccgccttgccgtccccgccccgtcccctcccgccgcacgggcgcctaggccccgacgcggcctggtggcggtgcgcgcggaggcgggcggtgggataaacccggccatccggaaggaggaggacaaggtggtcgacaccgtcctcaccggcgagctcgccaagccgctcaccgcgtactgtcggtgttggagatcaggaacattcccactgtgcgatggatcccatgtgaagcacaacaaagcaaccggtgataatgtgggccccctgctcgttaagaagtagatgcagtttcgttcgacttttgccctagcatcatgttgagcgctgagctgaacactatctgtctgtcatgatatatgtttttttagccaagataaactattacgacgcaacgatccttcattcagaataaagtaagctgctgatgtcaacaagtgtcagtttcatgatt

SEQ ID NO: 9040 - DNA, 294 bp, Zea mays
  Clone ID: LIB3279-195-Q1-K6-B10
cgctgccaaggctcatccaacagttacgccatcaaaaagaaggacgagattgagcgtgttgccaaggccaaccgttgaactgagcttgtatcctggtgcactctgcgctggaaacttttatgtcgctggcagtcgtatcggttcttgttttaccaatgtttagagttttttgagacctatatgcggttttggttttcagtgcacaattaaaattactgagtaatgtagttgattgggaacagaaatgtttggtgcctggtttaccgaactccagttctcttgtcatttttcttt

SEQ ID NO: 9041 - DNA, 710 bp, Zea mays
  unsure (1)..(710): unsure at all n locations; Clone ID: LIB3279-195-Q1-K6-B2
cccgggtcgnaccccacgcccgtccgctcctacgcgnntccgcaatnntcctctggnnaatatagcgnaagnnaatgcagcntnngggcttcccnnatatttgnntgaggcnnagtcaaatnnttcaagttnnacctgctgnnnacccatccacnntccgnattatnncatgnattgnngtcctgggnacccagggctggnnctccttttagnnaggtttcnnttgcaggaaagnngttagcactgaaacaantctggagnncagaactgggcacnnttcaatcctnntttctttggatgcagngaacccgtaatatnggactacanntatatgaagnnatgagctgcaaactttccttgaggagggggncgctttctgagctaattgttgcattctctcgggaagggccaactaaagaatatgtgcagcataagatggtggagaaggccacagaaatttggaacatcatctcacatggtggttacttatatgtatgcggtgatgccaagggaatggctagagacgtacacaggatgcttcatacagtagtccaagagcagggatctttggatagctccaaaaccgagagctacgtaaagagcctgcagatggaaggcaggtacctccgtgatgtatggtgacacatcacccccattcagccatagctctagcgtgtggaagtaaagctggctttgcgtgtacgacatgc

SEQ ID NO: 9042 - DNA, 559 bp, Zea mays
  Clone ID: LIB3279-195-Q1-K6-B3
ttccattccatgcactgttttatgtggtcttcatgctgtcagcttgcgctctgttctcaaaaacgtggattgaagtttctggttcatcagcaaaggatgttgctaagcagctcaaggaacaacaaatggtgatgccaggacatcgtgagtcaaacttgcagaaggaactgaaccgatacatccccactgctgctgcatttggtggagtatgcatcggcgcattgactgtcctggctgatttcatgggtgcaattggttcaggaactggaatactgctggctgtgacaatcatataccaatacttcgaaaccttcgagaaggaaagggcaacggagcttggtttctttggtttttgattagtagctgtggaaccttgaaccgatagctgaattttcttgtaaggccctgtttggaagcaacccggttttttagaaaccagtttttatattttagctaggagaggccagcttcttgggttttaagaaactgagaatctaatttctataaacttagtcattaactagtatgtttggaaccccttaatttctataaaccagtt

SEQ ID NO: 9043 - DNA, 620 bp, Zea mays
  unsure (1)..(620): unsure at all n locations; Clone ID: LIB3279-195-Q1-K6-B4
ccggaaccaaaacccccggtcgacccagcgtccgncgacatggcacctttgcaccacgctactgccctgcctactactagtactgtctctttgaaccactttggtggcctaatcccgggcccctctgatgatggcttatgagccccagctttgcgcttgcaggcactgcacggtctggttcttgttcctgagcagttgagctgcgcacaccgacttcttttgcacaaggtacagcagcgcaggcgcagcggcagcccgccgctggatctctcccgaggctccggcgatggaacggtcctgctacttcccgctgcggtgggagagcacgggcgaccagtggtggtacgcgtcgccgatagactgggcggcggccgacggccactacgacatcgtccgccagctgctgcacctcgaccctaacctgctcatcaagctcacctccctccgccggatccgccgcctcgaggcgctgtgggacgacgacgcccgcttcgccgacgcggcccggaaccgcgcgtccgtcgcccgcagcctgctgctggagtgcgagtgcaggaaccaccgccccggcgccggggaagaacacgctgctccgggccgggtacggcggctgggtgctc

SEQ ID NO: 9044 - DNA, 319 bp, Zea mays
  Clone ID: LIB3279-195-Q1-K6-B5
cggcaatcctacgagccataaaccagagctagtactgaacaatttcactacacgccttggtcatcgtgttggaaggatgatccagtctctcttccctcaagatcccaatttccgcgggcgccgtgttgtgaccttccacaaccagcgagactacatatttttccgccatcacaggtgggcatatcgaaatgcagtcaggagttaactttgtccggcgaggggtgcctgggtatatgggtgtatgtatagtctagttatctggtgtctgcctcctttgtgtgtattccttttttttgtgaaaaatggttgctttttagtg

SEQ ID NO: 9045 - DNA, 610 bp, Zea mays
  Clone ID: LIB3279-195-Q1-K6-B6
gctccgagcgtcattctccgccccgacatttaaaccttgctcccgacaaccgccgccgactcctccccaatgctctcctcttcctcctccacccactcggccacctcgcccttccccggcctcgcctccgcaaaccctaacccccgctctcgcctcctccgcctccgcgccgcctcgcccgtgtcgtccgcggtcttgagcgcgagtgggcccccgccgatgagtacggttagggcctcgttcgccgctggggcggccggccggagagctgcggcagtgggggagttggcgacggagcggctggtggaggtggcgcagcgggcggcggacgctgctggggaggtgctcaggaagtacttccgccagcgggttgagatcatcgacaaagaggaccacagtgtcctgttacaattgcagatagagaagcagaagaagcaatggtgtcagttatactgaagagcttccctactcatgccatttttggtgaggagaatggttggagatgtgcagagaattctgctgattatgtttgggttttggatccaatagatggaacgaaaagtttcataactggtagtggatctctggtcacattacgggtttatgactg

SEQ ID NO: 9046 - DNA, 644 bp, Zea mays
  Clone ID: LIB3279-195-Q1-K6-B7
gtcgacccagcgtccgccacgcctcgaccgagagccagctctcccagcacacgagcacatggcgtccaccaccctcctcgctgtcttcctgctcgtggctgcgtccgcagcgccggcgcggtcttgctcacctcgcgacctgcaggcgctgttgagcgtgaagcaggcgctagggaacccggcaacgctgtcgacgtggaccccagcgtcgcccgactgctgctcgtgggaccacctccggtgtaacgacgccggacgcgtgaacaacgtgttcatcgacggcgcggacgacgtgcgcgggcaaatcccgtcggcggtgggcgggctgacggagctcatgtcgctgaccctgttccggctggcggggctgacgggccccatcccggcctgcctggccgcgctgtccaacctgcagttcctgaccgtctcccacaccaacgtgtccggcgccatcccggagtccctggcgcggctgcgcggcctcgactcggtggacctctccagcaaccagctgacgggcggcatcccggcgtcgttcgccgacctgcccagcctccggtcgctggacctcgggcacaaccagctgacgggcagcatcccggcggggctggtgcaggggcagttccggtcgctggtcctgtcgt

SEQ ID NO: 9047 - DNA, 532 bp, Zea mays
  unsure (1)..(532): unsure at all n locations; Clone ID: LIB3279-195-Q1-K6-B8
tcgtccccgtccaaaccacttggaataggagaagcaaaagagatggatctcgccgacagccagcaacagcggctcatcgccggcgcggctctgctggtcgccaccgtcgccttcctcaggctcctcctgagctcccgctccgggggcaagcgcctgccgcccaccatcccgggggcgccggtggtcggcggcctcgtcaagttcatgcgcgggcctatcccgatgatccgggagcagtacgcccgcctcggcagcgtcttcaccgtccccatcatcagccgcaagatcacgttcctcgtcgggcccgaggtgtccgcgcacttcttcaagggcaacgaggccgagatgagccagcaggaggtgtacaggttcaacgtgcccaccttcggccccggggtcgtctttgacgtngactactccattaggcaggagcagtttaggtttttcaccgaggcgctccgggccaataagctgcgcagntttgtngaacagatggttgttgaggctgaggagtactttttaaaggggggag

SEQ ID NO: 9048 - DNA, 664 bp, Zea mays
  unsure (1)..(664): unsure at all n locations; Clone ID: LIB3279-195-Q1-K6-B9
gttttgcatcccattgctgattctatcaatatcaacaaagagattggaaaatgtttttgatgaacttcttccaagattggtgaaagaaggaagtgatggtaatgctggatccagtgctctttgtgacacaacctgcttgcaggcactctccagaaggatccactatgggaagtttgtggcagaggccaagtttcaagagtcccctgaagcttacacgccagccataatagcccaagaccgtgatcaactcatgaaccttctcacatatgaaacggtggagcgtgctatcgaacacagggtggaggccaaagccaagatcttcgggcaagaggtgaacattggtgctaaggacaacggcagcccaccggtctacaaaatcaggccgagcttggtcgccgagctgtacagctacagaatcatgccgctaaccaaggaggttgaggtcgcgtacttgcttaagaggctggattgagtgtgtttacgtagctgtaaaactgccagatccgaactcctggtattaaaccataacatcggtaagtacccatttctgtgaagaggatgatccgaactcctgtcattaaaccagaacatcagtaagtacccagttttggggagaggatggaaaatatccatgtgtggncagcaacatgcataatatcatctg

SEQ ID NO: 9049 - DNA, 411 bp, Zea mays
  Clone ID: LIB3279-195-Q1-K6-C1
ttctgctgtccgtggcctgaaacaccaacagcgccttcgagccatcctccatgatggccaagtgcgacccccgccatggcaagtacatggcatgctgcctcatgtaccgtggtgatgtggttcccaaggacgtgaacgctgctgtggccacaatcaagaccaagcgcaccatccagttcgtggactggtgcccgactggcttcaagtgcggaatcaactaccagcctcccagcgtcgtccccggcggtgacctggccaaggtgcagcgtgccgtgtgcatgatctccaactccaccagtgttgtggaggtcttctcccgcattgaccacaagttcgacctcatgtacgccaagcgcgccttcgtgcactggtacgtcggtgagggtatggaggagggcgagttttttttgg

SEQ ID NO: 9050 - DNA, 543 bp, Zea mays
  unsure (1)..(543): unsure at all n locations; Clone ID: LIB3279-195-Q1-K6-C10
ggnctatacaattctcgtgtctcgccctcccccgacgcgccgtctagggtttcacagccgcaccccgatccactagagctatggagttcgacgaatacgagtacctggagaaggcggtggagccggctcccccgccggccaatggttccggctccggcgagaaggaccgcggctcgcgtcgccgcgagggcgacgagggccgcatatcgaagcgctcccgctcgggggaggaccgcgagcggggccggcaccgcagcgttcgggagcaccgggatcgggataaggatgacgggaaggagaaggagaggagccgcgatagccgcgggaaggacagagacagggaagggagagaacgggagaaggagaggggggacaggcaccggcccagagagagggaggtggaacgggagcggaggagcctgagccgttcggagcggcgccgtatcgaggaagaggagatggtgagggagctggagatggagcgcgagcgcagcgagcgacaccactatcgcgaccgtgacgtcaggcgtaggaaagatgacg

SEQ ID NO: 9051 - DNA, 386 bp, Zea mays
  unsure (1)..(386): unsure at all n locations; Clone ID: LIB3279-195-Q1-K6-C11
gtaaactagnaaaggctcctcccgaccgcaacgcccctcatctccctcgaccccgacatccccgacccgatggcgcccaaggcggagaagaagccagcggagaagaagccggcggccgaggagaaggcggagaagacgaccgcagggaagaagcccaaggccgagaagcggctgcccgcgtccaagtcctccggcaaggagggcggcgagaagaaggggaagaagaaggccaagaagagcgtggagacctacaagacctacatcttcaaggtgctgaagcaggtgcaccccgacatcggcgtatcctccaaggccatgtccatcatgaactccttcatgaacgacatctttgagaagctggccggggnggccggctagctggcgcg

SEQ ID NO: 9052 - DNA, 630 bp, Zea mays
  unsure (1)..(630): unsure at all n locations; Clone ID: LIB3279-195-Q1-K6-C2
cggtcgacccagcgtccgccccgcgtccggnaaggcggtggtcaacttgtgtcctgaggtgcccgtagaacccaggacaagaaacaggagaagagtagatctacatctactccaccgatgagcgcgtctcggttcatcaagtgcgtcaccgtgggggacggtgccgtcggaaagacctgcatgctcatctcctacacatccaacactttccccactgactatgttccaactgtgttcgacaacttcagtgccaatgttgtggttgacgggagcactgtcaacttgggtctgtgggatacagcaggacaagaagattacaatagactgcgtccgttgagctatcgtggtgctgatgtttttctgctcgccttttctcttatcagcaaagcaagctatgagaatgtctctaagaagtgggttcctgaattaaggcactatgctcctggcgtgcccataatccttgttgggacaaaacttgatctgcgtgatgataagcagttttttgttgatcaccctggtgctgttccaatttccactgcccagggcgaagagctgaggaagctaattggtgctgccgcctacatcgaatgcagttcaaaaatccagcagaacataaaagcagtgtttgac

SEQ ID NO: 9053 - DNA, 414 bp, Zea mays
  unsure (1)..(414): unsure at all n locations; Clone ID: LIB3279-195-Q1-K6-C3
gtcgacccagcgtccggcgagctagnactagagctatagagatcactctccttctccgcgtgaggtagtgacgtgacgcccagccatggcaacaatggcactgcgcgccgtggcgacggcgctgctggtggcggctgcgtccgtgtgcggcgcgtcggcgtcgacgctggtgctgtacaaccggtgcggggagacggtgtggccgggcatccagccgagcgccgggaaggaggtgctggcgcgcggcgggctgcagctggcgccggggcggtcggcgtcggtgcggctccccgcggggtggtcggggcgcgtgtgggggcggcaggggtgctcgttcgacgcggcggggcgcgggcggtgcgccacgggcgactgcggcggcgcgctctactgcggcggngccgggggcgcgcc

SEQ ID NO: 9054 - DNA, 519 bp, Zea mays
  Clone ID: LIB3279-195-Q1-K6-C4
ccccgcgtccggcaaacagtgattcgaagcggtttcgaaggtgatgcaggggtgaagtttgcatagcattgataggccggaaatcggatttgaggacccaatgatatgccgctgcatggaaagtttcatcatttcatgcctgtggtcggtttgctcgtgaagattgcttttgtttgctgtggaagcgggtgcaagtattacacagcagcaatatcgggactgttgtgaaggatgaagttgagagtcaacatctgagaaccatggagctcaccatacgccacaaaggaactaaagctgctagtttaggcatggttaagagagtcagtgctggtcctttaggttaaataaaaactttgcggggccgcacagtgtgcagaaaaggttgagtctagggcactaggctgatggtctatgtatgtgatgtacgcagataggcagatacctatgcgttcaaagtagcgcatcaaattttggccccattattttcaaaatggatgaaagaaccttgaaattggaagg

SEQ ID NO: 9055 - DNA, 646 bp, Zea mays
  Clone ID: LIB3279-195-Q1-K6-C5
tgtctactgcatctgttgcacctcacctgtggcaacctgcaaagggattctgatgacaaatgacacgaatgatggcaacccagaagaagcaaccgcctgcattgcattgtcaaaaaatgactcctatgttatgtctgcatctggtggcaaagtctcgttgttcaatatgatgacattcaaggtcatgactactttcatggcacctccacctgctgcaactttccttgcattccacccacaagataataatatcatcgccattggaatggaggactctaccatccaaatctacaatgtccgcattgatgatgtcaaaagtaagctcaagggacatcagaagaagattacggggctggccttttctcaatcaatgaacgtgctagtatcatcaggtgctgatgctcagctatgtgtgtggagtattgatggctgggaaaaaaagaaatcaagatatatccaacccccagcaaaccgacctggcactttggttggtgacacaagggtgcagtttcacaatgaccaaacacatcttttggtcgtccatgagagccagttgggaatctatgatgggaatcttgactgtttgcgcttgtggtctccaagagagcactcccagctccgatatcgagtgcgatatactcgtgcg

SEQ ID NO: 9056 - DNA, 639 bp, Zea mays
  Clone ID: LIB3279-195-Q1-K6-C6
gtgtaaggcaaaatcatttctggcaatgtgaatgtgaagaaccaaatatcgagggaggatctaaaagaagcattcaaaaaatttggagctgtccggtatgtggacttcagcatcggagataattcaggataccttcgctttgaagattctaaggcagctgaaaaagcccgcatgtctgcagtacttgctgatggtggcttgataattaaggaccacattgttactttggagcctgtgactggtgaagctgagaaggattattgggacacaatccgcagtattcaaggaaagtacaaggatagtagaagctacaagggaagggcttcaaataaccagagaggaggaaagcgtttcaacgcgaagcgagatagaaacccagactcggagaagaattctaacaaggctcggaaggttgaagctatcgcatgaggttaatttaggtaccttagctcgactaaagaagtaacatgttatgccagcatgatcgacttcagtactctccaagtttctagaatcgacttgttttttagctatcgttttcattttggtcgttttgccaccttattcgatgttcgtcccttagctattatccttttgtaatggctttactgtgatgcgagggctcaccccgtggcgtgt

SEQ ID NO: 9057 - DNA, 602 bp, Zea mays
  Clone ID: LIB3279-195-Q1-K6-C7
ccctccgccaagcgcggatctgaacgctgcgctccgtgtcgtcgctcgaatccgccatgaagggggccaaatccaaggcgccgccaaggccgatgccaagctggcggtgaagagcaagggggcggagaagcccgccaagggcaggaaggggaaggccggcaaggaccccaacaagcctaagagggctcccagcgctttcttcgtgttcatggaggaatttcgcaaggagttcaaggagaagaaccctaagaacaagtctgtcgctgcggtgggaaaagctgctggcgacaggtggaaatccctgagcgagtcggacaaggctccctatgtagccaaggctaacaagctcaagctagagtacaacaaggccatcgcagcctacaacaagggcgagagcactgcagctaagaaggctcctgccaaggaggaagaggaggaagacgaagaggagtctgacaagtccaagtcggaggtcaatgacgaggatgacgaagagggtagcgaggaggatgaagatgatgacgagtgatggagagctcgctcgagacatggacggtgcttcatccaacaatggagcggctacacaaggccccgtggcgatc

SEQ ID NO: 9058 - DNA, 632 bp, Zea mays
  unsure (1)..(632): unsure at all n locations; Clone ID: LIB3279-195-Q1-K6-C8
ngattaataaaaattgttatataataattttatttatgtacttgttttttaaaacttatttatataaattgttggacttgctaacatatggacaggtatgcccaagtactaagggacaaatagggctcaggtgcacaacaaaacattaggtggggaactgtagtgtcttattatatgtgtcacatccatgtacataatgaagatatttataggtgatcaaggatggtaggtggacctaaataccattatgcctcgttcacttgctacattcccggaatatttgaaagggaaatgtgcccttgggccatttctaagtattttggtgattaaatggccaacacaaatggtttaagtgataaattgtgccaaagactaaagaagtgcaaatcaaggtgcaaggtatgtttctagacttagtacattgctttgaagactaatgtattgtgtctaagtgctagaaacaggataaaacagtttggacaaagacagcttcggtctgggtgcaccggattgtccggtggtgcaccggacagtgtccggtgcgccaggaccagtctnggtgaacagtccggtctcgggactcgacgacgatgtacgctataaatcatcgggactgtccgggggtgcaccgg

SEQ ID NO: 9059 - DNA, 631 bp, Zea mays
  unsure (1)..(631): unsure at all n locations; Clone ID: LIB3279-195-Q1-K6-C9
ttttcagaggcgttccaaaggaaagatgcgtgttgatgatgtactagtcaggatagcaaacatatcccttatnncgaggagaagatggctgccacaggnnaccaggaaaaattacaaacatttttcctaattacttgctctatgagttccaaggcttatctggtggaagaatatggaaagcggagcatgatctactgttactgagaggcatactgaaacatggatatgcaaggtggcagtatatatcagatgacagagagaatgggctttttgaggctgcacgacgagagctgcatctcccttcggttaatgaaataattggtgctcagttgaacgaggcaaatgggaatttggaaggtgcacaggaaggccaagcgaacacaacaagcatgtcgcattacaaggagatccagagaaagatagttgagttcttgagaaagagatatcatcttatggagagagccttgaatctggaatatgctgtgataaagaaaaaaatcctgttcctgatgatattactgaacaaggtgttccagcaagacatgctccgcttattccagatatcagggaactgttgcgggaattgcccagtcttgagcccatttctaccaatgaattgatttctgagggc

SEQ ID NO: 9060 - DNA, 614 bp, Zea mays
  Clone ID: LIB3279-195-Q1-K6-D1
ggaaaaatatccccaaaccctagctcccgatctcgatggcgaaccctcgcgtcttcttcgacatgaccgtcggcggcgccccggcgggccggatcgtgatggagctgtacgccaacgaggtgcccaagaccgcggagaacttccgcgcgctgtgcacgggcgagaagggcgtgggcaagtccgggaagccgctccactacaagggctccaccttccaccgcgtcatccccgagttcatgtgccagggcggcgacttcacccgcggcaacggcaccggcggcgagtccatctacggcgagaagttccccgacgagaagttcgtgcgcaagcacaccgcccccggtgtgctctccatggccaacgccgggcccaacaccaacggctcccagttcttcatctgcaccgtcgcgaccccttggctcgacggcaagcacgtcgtcttcggccaggtcgtcgagggcatggacgtcgtcaaggccatcgagaaggtgggcacccgcaacggctccacctccaaggtggtcaaggtcgctgactgcggacagctctcctagatctctctgatctggtctgttcggccgccctcccttcgtcatcgtcgactccccctgcgt

SEQ ID NO: 9061 - DNA, 577 bp, Zea mays
  Clone ID: LIB3279-195-Q1-K6-D10
cccacgcgtccggccaattgggttcgcggtgttcctggtccaccttgccaccatccccatcaccggcaccggcatcaacccggctaggagccttggcgccgccatcatctacaaccgggatcatgcgtggagcgaccatgtgagtgggaactgctctcgattcctctcgcaccaactttcggtttccaacagtgtggtaccactcgcactcgcagtgtagtttgtctccatccaaataccagacatgtggccactgtctttccattgtgcagcaatcatagtgatagtggcatgctctacaaagtatattctgattcttgctaggtgctgcattttaaattttttgtttcttgcacctcaccagtcagaagtattttttgtggccaaaacgacgactaaccattcactcaccaactccaaactaaatgatgtagacagaatggcatatgtctccatctagctgtgtgttaggcttatcacgaaggcttgtctccatctatgtagctggcatgcattaatctaggctttgcatggagtgtcctttgttttagtgcgtggttgatcgtctatcggtacc

SEQ ID NO: 9062 - DNA, 320 bp, Zea mays
  Clone ID: LIB3279-195-Q1-K6-D11
cgtccggctcacgcgtcacggcatttccgtcaaagctccgggcctttctactcgaattttaactacgaaatccaccgaggccatgggctgagcccccggggcaaacccgtcgtgctagcggccctgtgagcagccgaagccatggcgcagacgatagacgagaagaaagacgacgatctcgacgaggaagagtactagtggacattcctgggcatagagaagggcgccgtgctgcaggaggatgaagtttagcatgaccctcagctagactcgcggggaagctgccaggttatgaccaagcttatgtacctggtcaacca

SEQ ID NO: 9063 - DNA, 227 bp, Zea mays
  Clone ID: LIB3279-195-Q1-K6-D12
ggtggtaacgaacctcgcctggcgtctcgtctcgttgcggcggcggcctcctcctcctccctctcttcagcgtcccccctcgctcgcctaatctctcgccgcggccttgccggtgccgcagacggccatgggtctgcgaaggtgcccttgtggaaagatccgttgagcccgagcgaggggaaggaagagcactttgttctagcaagcctctcaatgtggggggttat

SEQ ID NO: 9064 - DNA, 662 bp, Zea mays
  unsure (1)..(662): unsure at all n locations; Clone ID: LIB3279-195-Q1-K6-D2
gnttactacccagaaatgttaaagaagctgtcaatcttgccctagataaaggcaccaattttgttgatcctcttgttaggctactggagcatttgtacacaaagaaaattttcaagactcaagacctggaatccggttgcttgttatatggtactctgctggatgacattggcattgaccttcctaaagctccagcacaatttggtgagatcattgctcgcctgactttgttgggtgccttgagatttgaagctctggaggttattttaaagaaaatggaggatacctacaaccgcaaagcagtttctaatgctttcatgaaaaccttggaagcaaacccatcaggtcaggctatcttaggctcacctgctgctgctgcagtaatagacgcttgcaacagccttttggaataatcttcctagcagctttggcctatcaaccttttcagattctgtatcttgcgaaagacggtctcgtgtactctctatagtttaggtgtcaaggaattgaggaacagacaattttgagctgtataattttgcgagatcagatgagtgttgattgttattgtttcggccaagaaggaaagaaagagccatgaattttggtcttgggcgaccagcttaatttgcaggagtcctagatgaacaaggctaaatatg

SEQ ID NO: 9065 - DNA, 448 bp, Zea mays
  unsure (1)..(448): unsure at all n locations; Clone ID: LIB3279-195-Q1-K6-D3
cgtccgcctctacgcgtccgcggnacgcgtggnggcttgaaagnaaaattagnngacctctacnntgttgaaatannaacgacgaatcaagnagggggcgtccattttccaaaagggccaagnnattgagnatnnaatcttgggnaaagnnagcgacaaatttgnnnatgagctgatnnggccgctgcttgcagtaagtaaagnggggcgaagntggaagtatgggtggaagnnagcaggcntnntgaaaacangtaccccgatgaccaagnnctgctgctnnngttgtgcnntctgnnttagtgggttgtttannatttagtnnttaatacccgtnngtgcattgagnatanntggcacgnncgttcttgcttcaacttaccatcnnaccatggcnnaatgtctgccaannatccatggattggatggnnnatggatgttggtttgt

SEQ ID NO: 9066 - DNA, 624 bp, Zea mays
  unsure (1)..(624): unsure at all n locations; Clone ID: LIB3279-195-Q1-K6-D5
ttgtggcatcatcgttccaccttactctccaggctccagctccgaccccggcgagccgctagagcaacgagaacgaatcagctagtagccgcccgcgtatctccatcatggccgtgctggtcgcgaggcagggacgcgagctgcagcggtacagccagagcaccggcgggcgcatcgtggtgggctgcatcccgtaccgcgtgcggtgcgacggcgagctggaggtgctggcgatcacgtcccagaaggggcacggcatgatgttccccaagggcgggtgggaggtggacgagtccatggacgaggccgcccggcgcgaggccctggaggaggccggcgtcctcggcgacaccgagccggtcctcggcctctggcactacaagagccgccgctacgtggaccagacctacgaggggttcatgttcccgctccgcgtcgccgacgagctccaccagtggcccgagatggcgtcccgcaagcgcacctgggcaacggtgcagcaggtgatggacgggtgcccgcacttgtggatgcgcgaggcgctggagcggctcgtcgcgcgccacgccgtgctgcagtctgctctctgaacggntgggcggaagaggagtcccgcgcggcggc

SEQ ID NO: 9067 - DNA, 550 bp, Zea mays
  Clone ID: LIB3279-195-Q1-K6-D6
tttctttctattggttccatgttcttttttgtcttccaaaacttgctgaatttcactaagttacgctgacatcaatttctgtttgatcttatatagactgcaagaagttcaaggagttggttgaggagattgctgagtcacttacagagaacgaggacaaggaaggtcaagatggctcttccacggccggattgctggagaagctcactgtgagcgagggcaaatctgaggaaagtggcaagtcggagtccactgattctggcaaagtgaccgaaaccaaagccgatgcagccccagccgagtagttggtgtggttgcacgcagatcctccccgtgctgaatcagttcctctgccctttagccatgaaatatgtttgctaatttttttggggcgagttggagcagtctcatgtgtttgggtttgttcttaaaaacttgagttaattggggttggaacgttcggtatgcaagtgtagtatttcactgcgtggatcgttatggattgcggtaaattcatataaggtgcatctattttttgatttctttcagt

SEQ ID NO: 9068 - DNA, 486 bp, Zea mays
  unsure (1)..(486): unsure at all n locations; Clone ID: LIB3279-195-Q1-K6-D7
gttctgctaccctgtgaccacacgctcttgaccacgtngaaaacatatgtacgtgtaccacggaggcatatgcattatattgctggaggataatgctcattaacattagtacgtgccaatgcaagccagcctgcaagatagtgcaacttgccccgacacgtacacatgtggctgctgggaggtcactcgaaacttggaaaaccgtgcatgaaaaaatgatattcatgttaattagcataagttacgaccgatttcagaagcgtaccggaaacttcgagcaacatgctcactaaacatgaccgtcaacttggcatgcacatgtttaaaaattgtataaaacacaaacaaagtcagaaaatcatgaaacttgtccacgtgtcatgatatcatacgtagaggctgtgataaaaattttacaatgtttggagaaagttgtgagacactatgtgtagaaacctaagaggactacacatgaaaaccgccccc

SEQ ID NO: 9069 - DNA, 592 bp, Zea mays
  Clone ID: LIB3279-195-Q1-K6-D8
gttctcgtcatcgtcctcgcgctcagtgtcatttgcagttcccggcagcagccatggcgtcggtgcagctgtctgggccgcgggtggtggcggctgcgaaaccggctgcgttgggcgggctcctcctgacgccgtcccttgcggtgccaaaggggcggagaaccagggggctcgtggtgagggccgccacggtcgtgtcacctaagtatacatccataaaaccattgggagacagagtacttgtgaagatcaagacctctgaggctaaatctgatggagggattttacttccagtatcagttcagacaagaccacaaggaggggaaattgttgcggttggagaagggagaagttttggaagtaaccgcattgagatcagtgttccggttggtgcacaagttgtctactcgaaatatgcaggcacagaattgaaattcaatgacgccgaccatctcattttgaaagaagatgacataattggtattcttgacagtgatgatgtgaaggatatgaaaccactgaatgatcgcattctgattaaggttgctgaagctgaagaacgaactgctggtggtttgctattgacgcaggc

SEQ ID NO: 9070 - DNA, 654 bp, Zea mays
  unsure (1)..(654): unsure at all n locations; Clone ID: LIB3279-195-Q1-K6-D9
tccggcggtcagcgatgagtcatcggnanactagnanatgatgacacnntgaccataaggattcatctgcgcccaagaagaggaaatctggtaacacatcggctgaagatgagccgtctcaagctactgttgtgcgatatgctgcggttgagtcaccatatcccgcaaaaggaaggtctgcctcaaagcttccagtgtctgcacctgggcgtgcagcgcttcctagtgccaccccgaatctaaacattgggatggacatttggaatgcttctcctgccttggctgtgcctgcagtgcagggggaagtgagtcctgggttggcacttgtccgacgtgatggcgttactcaactggacgaacgtgaaataaagagggagaggcgaaaacaatctaacagggagtctgcaaggagatctagattacgcaagcagcaagagtgcgaggagttagcccgctggggccatgtagagtcgcccccactgcagccatgtattatttatggctcgtcgcggtgtgctttgtgtttttttgtgtgttgtgtaaaaactattgatgtaacaaaacctanagagcctagaggttttttttatgtctgctaactcctgacgaggggatgtatgtnaccggcccatttgttgcctgatcgttcgttag

SEQ ID NO: 9071 - DNA, 583 bp, Zea mays
  unsure (1)..(583): unsure at all n locations; Clone ID: LIB3279-195-Q1-K6-E1
ccggtgtgaggaatcgcattattcgaggaaccctagatgctgtcgcagtaaagaatcgtcaacaagggcgttctaaatatggggccaaaagccaaaaaataagtgattcgtttttagcccttataaaaagaaaacggattcttgaacctctttcacgctcatgtcacgtcgaggtactgcagaaaaaagaaccgcaaaatccgatccaatttttcgtaatcgattagttaacatggtggttaaccgtattatgaaagacggaaaaaaatcattggcttatcaaattctctatcgagccgtgaaaaanttcaacaaaagacagaaacaaatccactattggttttacgtcaagcaatacgtagagtaactcccaatataggagtaaaaacaagacgtaataaaaaaggatcgacgcggaaagttccgattgaaataggatctaaacaaggaagagcacttgccattcgttggttattagaagcatcccaaaagcgtccgggtcgaaatatggctttcaaattaagttccgaattagtagatgctgccaaagggagtgggggtgccatacgcaaaaggaagcgac

SEQ ID NO: 9072 - DNA, 540 bp, Zea mays
  unsure (1)..(540): unsure at all n locations; Clone ID: LIB3279-195-Q1-K6-E10
gtcaagnagaagaggagaaagacttgttgctcagcagaacatgtatgcgcaattgcttcctcttgctttgcctgctccgccaatgcctggcatgggtggccctccacctccgatgggtgggatgggcatgcctccaatgggtggaatgggtatgccgccgatgggccctggtccgatgccagcattcgggatgccagcaatgggaagctactgagatgtttttgcagagagcttagacgatgatttgaatcgtccctgtgtaagcgaaggtggaaacttcattggagttgtagatggttacagtttggaattaatattctttatggtaccagaatttttttggcaagtgaaaccttagccagagtctgagaattgcaacctgttataccgtaggatcggataggatgagggtgattaggttggttgagcgagctgttgaaagctggtatcatttgtatagtgtgatgaaaactttgtagacattttgcttgtataatactcctacttgttggcacagtgaaggacaaaccaatgtatgct

SEQ ID NO: 9073 - DNA, 329 bp, Zea mays
  Clone ID: LIB3279-195-Q1-K6-E12
cgtccgggcgcctgtttccttccagcttcttttgtgcttgctctttttttttcaagatttgttttttctgctttcgttaagggagagagcgagttcaaattctgagtagtgagcacttcaggtttaccagcttctggtgtcctagctgccaagaaatgagctttgggagctgtccggccgtggccgggggcgcgacggcagaggagctgcttgaacgggcgcgggggctggtgccacccgccctggccgctgcgcgcgcggccactggcttcggtgggcggtggaaggctctcgccgtgtggctggggttgctgccgccgtgcctgtcg

SEQ ID NO: 9074 - DNA, 481 bp, Zea mays
  unsure (1)..(481): unsure at all n locations; Clone ID: LIB3279-195-Q1-K6-E2
cgcgcctcctcctcgtcgtggtgcttctctccgcggcgataccgatcccgtccttcgcgacaagcttcgtcgtcggcgacaagaggcatcgctgggctcccaacgtcaactatacagactgggcggaccgtcaccagttccacgtcggcgactggctcgaattcaggtacgagagggacaggttcgatgtggtgcaggtgaacgagacggcatacgcggcgtgcgacgccagcagccccatcctcagctacagccgcggccacaacttcgtcttccggctcaaccacacgggccggttctacttcatctgcagccgcggctactgctggagtggcatgaaggtctccgtgctcgtccagccgccgccgccgcccccgtcgctgccgncggcgtnccactcccacgcgnnaagcgccagngcgcgggggcggccggcggccggnctttgggggggggcgctgtgtcgcgggtggggtggggg

SEQ ID NO: 9075 - DNA, 294 bp, Zea mays
  unsure (1)..(294): unsure at all n locations; Clone ID: LIB3279-195-Q1-K6-E3
gggtcgnacccacgccgtccgtgtcttatggnagttcctggnacggcgtgcaccaagctggnccgggngatgccaacgtggnaaacagtgtcntcaggnagatcccacgtcgcgccggtagtcaaaggcggncgtcccttgcaaacgcgtcacnncgtgatttcaacggaaaatttggtccagcaagtaggcaagctggtntntgnnnatgtgcgtggttctgaggttggctatttggtgcctctgattttgtgttgctttaacaatctgatcatgcacataaatcttctctta

SEQ ID NO: 9076 - DNA, 635 bp, Zea mays
  unsure (1)..(635): unsure at all n locations; Clone ID: LIB3279-195-Q1-K6-E5
nccgtcgccaggttccggcgccgcacggcgacgtgcagggccagcagcggcggtggcggtggccggggcggcgaaaagatggcctcctttggctgccccggcgggacgtgatgctcaacggcctgtccagtgtcgccgccgggctcgcctggtacccgggcgtcgcgtccggcgcggatgcggtgtgcaccagggccgacaaggtgaacgagaagaccgtgcagtgcacggacccggccgggcagcttccgtgccctctggtgtcgccgacggaccccgtggacttcaagccggaaagcaaggtgacgcgcatccggcagccggtgcatctcctgagccgggagtaccaggagaagtacaaggaggccgtcgcgaagatgaaggcgctaccggaagagaacccgctgagcttcgcggcccaggcggccatccaccaggcctactgcgacgcctactacaagtatgacccgacggccaaggacgcgccgttcgacgtgcacttctcgtggatcttcgcgccgtggcaccgcatgtacatctacttctacgagcgcgccctcgggcagctcatcggcgacgacaccttcgcgctgccgttctggaactgggatacgccggccggcatggtggtgccg

SEQ ID NO: 9077 - DNA, 455 bp, Zea mays
  unsure (1)..(455): unsure at all n locations; Clone ID: LIB3279-195-Q1-K6-E6
cggccgcgtgggcggncgcatgggcggcgccaacgggagcggcacctacatcagccgcgccgccgcgctgcccagcaagtgcggcgtcgccctgccgtacaagatcagcaccaacgttaactgcaacacgattaattaaatgaggcgtcctgtgcgcgtccgggcgaggaatgcatgcatggcggagagtaataaagtaatgctactggtattttaagctagatcgaggtgtgcctgtctctagtcatttatggtgtttagcaatcgtctacacagttcgtaaacggtgtatcgtggatgcatgttgccgcgagcagagtacgtaggcatgaaccgatgtgtgcgcttctgtctgtgtactctctctatgtagtaatgtgtggccagtgggtgctttgatccagatgtattcgctcgtgagtggtgagtcgtggaagttgatcgtttcagtatca

SEQ ID NO: 9078 - DNA, 678 bp, Zea mays
  unsure (1)..(678): unsure at all n locations; Clone ID: LIB3279-195-Q1-K6-E7
tccggtcctccgnatccccaattccctnccttcggnnatctcgcatgtcagnncgcagcgcaggggtgtgaagggaagggggggacgcggnanngaagatggggctcnngcgttcgggaagctcnttcagccccggctctttcgccaagaaaggggagatgcggatcccctcatggtcggcccctcgacgcctgcctggtaaaaccaccatcctgctacagagctcagnagctcggcgagatcgtcanccaccatccccaccatcggtnttcaatgtntgaaactgtntgagtacaagaacattagcttcactgtctgggatgtcgggggtcaggacaagatcagacctctttggaggcattacttccagaacacccagggtcttatttttgttgtggacagcaatgaccgtgaccgtgttgttgaagccagagatgagctccacaggatgctgaacgaggatgagctacgtgatgctgtgctgcttgtttttgccaacaagcaagatcttcccaatgccatgaatgctgctgagattactgacaagcttggattacactccctgcgccagcgacactggtacattcagagcacttgtgccacaactggcgagggtctgtttggagggcctggactggctgtgcagcaacattgcgagcaaggcttggggcctacctt

SEQ ID NO: 9079 - DNA, 592 bp, Zea mays
  Clone ID: LIB3279-195-Q1-K6-E8
ccccgcgtccgccccgcgtccgcggacgcgtggggaatagttattttctttgcactcatctttgttggctttcatgaggctctaaaagtgagagttggagaaatacaaatcggtggacacgcatgaccaaacattcatagtcgtggctataattttttcttcagacatggcgcttaataatgtctacgtgtagtctacctatatgtgagcagatttggcctctaggagcgagcacgtgtgtttgcatatggcatgtatcgtgtgggttattagagtgaactcgaaccacgtccatcggagttgcacatccatgtgagttggcagaggtgtttgatgtgatgtgggcatttgtgttttatgtaatagatagcatcatcctcgctcgttgtgccgccttcgtccacacaagcgacggagctaaggttacgagaactagcccggtggcaccatgttggtctaccaggatctgctatctgacgacgacctccagtaggactccctcccctacaggcaactcaggaacggcgtcacagacgtcgaggacaagtgcactatcaaatacgcgatctttgccgagtgcatataatcttgc

SEQ ID NO: 9080 - DNA, 595 bp, Zea mays
  Clone ID: LIB3279-195-Q1-K6-E9
ccccgcgtcccgatctccagcctctctttctcgctcgctggccacccgccgcaccctccccatcaggccagcagcgaggaagaatggagtacgagaggattcatcagaaagcccagcctggtgctctttctccaacaaagctgaggatgaagatcctgggagcccacaatcgagttagagtcatcaccagcaactcgtcatcgcggacgtcgcctgcgaaaaccatcgaggcttcacaggcgcagaacaggctactagtttgtgatgttcttgaagaagacagcgcagatagcacaaaacacccgtcggcaactaacaaaaccgaagccgtagaaaaggttcaaaaggatccagcagtggacatcagtcaagtgcagaacgcttccaccagttcggctgctaagccagcgacaggcagctcgagtatgatacagatacacccactgagacccgcggaagaagacagcactaccgaatgcgacagtggtctcgacaacgccagcactagcagcttcgagttccacggagtggagaaggcggcggcgacccagaatccagcagccgggtacttgtccaggcagacttccatttcctc

SEQ ID NO: 9081 - DNA, 166 bp, Zea mays
  Clone ID: LIB3279-195-Q1-K6-F1
ctgcggcttcccccgctgctgatttgtttttaatggttagaccaggacccttcacgagcgtagaatttagttcttgttggtcatttatgtgctgtgcctgacggtgttcaatcagatagaggtgatggtttttttggtagatcaaatcaaggaatatttcataaaa

SEQ ID NO: 9082 - DNA, 537 bp, Zea mays
  Clone ID: LIB3279-195-Q1-K6-F10
gcgttcgccccgcgtccgctgtgctatccgctagggtttatctgctcgaggaatggcgtcggtgcaggtctccggcgcgggggtcggtaccgcggccttctctgtgaaggggaaggcctccaccggtgcgctccggcttcgctctacgttgaccttcggcgaggtctgcccggcgcggcgggcgttccgcggcctcgtcgtcagggccgctaccgtcgtcgcccccaagtatacaacacttaagcccttggctgatagagtgcttgtaaagattaactcttccgaggagaagacaactggtggaatcttgctccctacgactgctcagtccagacctcaaggtggcgaggtagttgctgttggagaaggaaggataattggggataagaaagttgatgtcagcattcaggttggagctcaggttgtgtattctaagtacgctggaaccgaggtcgcgttgaacgatcacagccatctggttctcaaagaggatgacgttataggtatcttagaaactgatgacgtgaaagacatgaa

SEQ ID NO: 9083 - DNA, 359 bp, Zea mays
  unsure (1)..(359): unsure at all n locations; Clone ID: LIB3279-195-Q1-K6-F11
ctcccaacaccacctcgcctgcgatctccgtagcctccgtcgcgtcgagcatcgatcatgtcggcctactgcggaaagtacaaggatgagctcatcaagaatgctgcctacattggcacccctggcaagggtatccttgctgctgatgagtccactggcaccattggcaagcgcctttccagcatcaatgtcgagaacgttgaggagaaccgccgtgccctccgtgagctcctattctgctgccctggtgctctccagtacatcagcggtgtgatcctcttcgaggagaccctgtaccagaagaccaaggatggcaagccttttgttgatgtcctnaaggagggaggcgtcctccctgg

SEQ ID NO: 9084 - DNA, 404 bp, Zea mays
  Clone ID: LIB3279-195-Q1-K6-F12
ggtagttgcacactgccatagccatggtgtccttcaccggttggatttctcttgtctaatttatatttctgaactcatcagatgagtataacatcacatttttccacttttatggtccatgctcaaatttatttatagggatttaaagccacaaaacctgctggtggacaaggagaagggtatactgaagattgctgatctgggactcggtagggctttcactgtgcccatgaaaagctacacccatgagattgtgaccctttggtacagagctcctgaagttttgcttggagcaacacattactcaactggcgttgatatgtggtctgttggatgcatctttgctgaactggcccgacggcaggctctttttcctggcgcctcggtgttgcctcagttgcctc

SEQ ID NO: 9085 - DNA, 645 bp, Zea mays
  Clone ID: LIB3279-195-Q1-K6-F2
cggacgcgtgggtccccttccctccctccctctccccgcgggccgccagaggcaatttcgccctcgattcgaccccgattcgtccgcccgcgaccgggattccctccgccaagcgcggatctgaacgctgcgctccgtgtcgtcgctcgaatccgccatgaagggggccaaatccaagggcgccgccaaggccgatgccaagctggcggtgaagagcaagggggcggagaagcccgccaagggcaggaaggggaaggccggcaaggaccccaacaagcctaagagggctcccagcgctttcttcgtgttcatggaggaatttcgcaaggagttcaaggagaagaaccctaagaacaagtctgtcgctgcggtgggaaaagctgctggcgacaggtggaaatccctgagcgagtcggacaaggctccctatgtagccaaggctaacaagctcaagctagagtacaacaaggccatcgcagcctacaacaagggcgagagcactgcagctaagaaggctcctgccaaggaggaagaggaggaagacgaagaggagtctgacaagtccaagtcggaggtcaatgacgaggatgacgaagagggtagcgaggaggatgaagatgatgaccagtgatggagagctcgctc

SEQ ID NO: 9086 - DNA, 534 bp, Zea mays
  Clone ID: LIB3279-195-Q1-K6-F3
ctcgcttcccaccaaacccacacccgacaatggcgtcggcgtccaaggaggaggtgatcgggaagctcaacgtccgcgtggtgcggggcaacaacctggtcatcgccgacccgctcacccacaccagcgacccctacgtcgtcctccagtacggcgctcagaaggtgaagactagtgtccagaagaagaactccaatccagtgtggaacgaagtactgcagctctcagtaacacatcctacgaagccagtgcaccttgaagtttttgatgaagacaagttcacagcagacgacagcatgggtgttgctgagatcaacattactgacatctacgatgctgcgaagctggacctgaagcacgcctctgatgggacaaggatcaagacgatctaccctgtcggagtaaactaccttggcggcgagagccatgttcagtggaaggatggcaaggtggtccaggacttgattctgaagctgaggaaggtcgagagtggcctgattgtggtgcagctggagtgggtttatgtttctggcg

SEQ ID NO: 9087 - DNA, 551 bp, Zea mays
  unsure (1)..(551): unsure at all n locations; Clone ID: LIB3279-195-Q1-K6-F4
ttttccttcggnactctctcgtgctcacctcatccgtccgacagatccacacgaatcctctgattcagagcagggtgttggcattgatcagacgcctgccatggcggatcagttcgaggattcggcgaacaatgtgatcattgaggaggtgaacaagggcctgaacccaggaatggtggttctgcttgtggttgcaagcttcctgctgatcttctttgtggggaactatgcgctgtatgtgtatgcgcagaagacgctcccgccaaagaagaagaagccggtgtcgaagaagaagctgaagaaggaaaagctgaagcagggggtctctgcgccgggagagtaaacggccatgctgccgatcctcccgtccagagctcctattcacatgattattagagaaaaaattatatatatataccagatggagccgtagtgttggagtaactttgttctgtagatgctctgtttttaatggtacatctgtnttggagactttgagaccttgtttcagcaactgatgaatcttagcctgagccgagctagtttgcttg

SEQ ID NO: 9088 - DNA, 529 bp, Zea mays
  unsure (1)..(529): unsure at all n locations; Clone ID: LIB3279-195-Q1-K6-F5
gcgtccgttttttttttttccatgctaaatgaccaacctttatagtcaacatcgttatatgaatattttttattgttggctctaaatgacatgggaaagatttagagcccaatgtaagcactattattaaagacccattattaaacttgctctaaagagataaattcagaaaccacgagttagaagtgctccatgacgagcgcgcacgcgtgtaagagctgccaaccgtaccacaagtagtctacgcctggttccttgtcacggagctgttgaacacgacgatctcgtcgccggcggccacaccgtgccactcgaaggatctcgactcgtccatcacgctctgttcatgtatgaagaagtaggcgccgtcgcgcgggagcgggaaccgtgcccccgccccgcgcgcgcgctccagctccgcccgcagcatcgacaccgcggngcgcgcgcccacggccatctccacgcgtccctcggcgcaccccgacacgacgatcacccgcagcggcggcgccggtcccttgccacg

SEQ ID NO: 9089 - DNA, 592 bp, Zea mays
  unsure (1)..(592): unsure at all n locations; Clone ID: LIB3279-195-Q1-K6-F6
tttcatgnaagtcaaggggnatacagnatcaatggtagnnaaattagaaanagatnnaggatccacctgcataaggtntgttgagagcatgngaggagacagaattgcagcctctgcctctcatgatacaccttgccgctgccgctttcccccgcgccagatcctgcctcaccttgctttgcttccgatttggctcccggttccatgcctcgatgctcgatggggctgggtcgctgccacgcagggacaaaacctgaaaccccacaggttacgcgccgtcgcgccccactccgcgtctccgctgcccggctggccgttttatcggcggcgccgccgttgcagcgatattaggctgtccactcatgaatttttatattatattttattctagtcagcaaatcctctactctacctcacaatcttcaacattaatatttgttggcggccttcggcttccgaaggtcctcaaaaacatgatttaacaatgttttccaagtgaaatgtgtgagcaggtatcttcggaattggattacgagtatataagattaaggccaagacgaagcttgagtgggacggaaggtgattgtgacga

SEQ ID NO: 9090 - DNA, 567 bp, Zea mays
  unsure (1)..(567): unsure at all n locations; Clone ID: LIB3279-195-Q1-K6-F7
gggtaacgaccagnacttcttgctgatnacgcgagagaaggaaacgagtggccaaggactctggaaagaccgaacagcaggtgagccaattggtcgcgcaactcttccaaatgcgtgcaaaatgcagaaaagatgggcgctatgcaagggaaaagagtcaccagacatggacgagctcatggaatcgatgaaagctgaggagcaggctgctgccggtactggacggcgtagaaggaagtatggcaacctgaggcagcgccaactggatgccatgcgtggtttccgcagacggtgagatgttcattgccgactagcactggcggtgcctgcacgaacgatggcatttagggacttgggctcggatatagaagtggaagaagatgaagtgcttttgggtgcaatggcaatcatctgggtacattgagttgagttttcatattcatgtgcagtgtcctattttgacatattagctgtattattatctttcttcggagcaagaactcgcaaaattgcgtcatctgaacctgtccaccgtcgtggaaacgagtgcacttcggccatgctagc

SEQ ID NO: 9091 - DNA, 332 bp, Zea mays
  Clone ID: LIB3279-195-Q1-K6-F8
ggcaataaaataaatatataaaataaagcatctcaatggggtcgcaatatagtacagcaaaaccaaaaaaaggaagagaagagaaagaaagaatccgaggcgacggtgctacgtccgcaccgcacgtaccacccgccaccgaacgtgagtggcactgcactactactacacacgcgaggcccggccaagaatacagcgcggcgccgcgcaccggctgcatccgcgtcaccaattcctgtcgtcgtccgtcccggcagtgcggtgcggccgtgcaggcgccacccgctcgcgcgcgcgcccgtgcctaggcgagcagggccacgaggcccagc

SEQ ID NO: 9092 - DNA, 578 bp, Zea mays
  unsure (1)..(578): unsure at all n locations; Clone ID: LIB3279-195-Q1-K6-F9
ngatgacgatgatctgtaaaanaagcagaagaagatgagatagatgatgaagaggttgttgagcaaacagaaaatcaagttggtgatgacactaaagataaaccagcaaaagaacccaaccatcatcttcaaatgataggggtacagttattgaaggatatggagaggacacctgtttcttcaaagaaattaaagcggatgccagagattgatgatgatgaagactggttccctgaagatccaattgaagcctttaaggttatgcgggaggagaggatgttcgatgtatcagacatgtatactactgcagatgcctggggatggacgtgggaaagagaaataaagaacaagatgccccgtaagtggtcacaagaatgggaggttgagttggctatcaagataatgcacaaggtaatagaactgggtggtactccgacaattggtgattgtgccattatattgcgagctgctatgagagcaccactcccatctgcttttataccaatattgcaaacaacacacagtctaggttataagtttggaagcccactgtttgacgaagtagtcctattgtgcct

SEQ ID NO: 9093 - DNA, 411 bp, Zea mays
  Clone ID: LIB3279-195-Q1-K6-G1
ttcagtcctatgcttgggggaaccaccgaccagtaagttgtggatgagaaccttgagaagctgaagaaggtgctagaggtgtacgaggcacgcctgaccaagtgcaagtaccttgctggagacttcctgagcctcgccgacctgaaccatgtgtctgtcactctctgcctgttcgctacgccctacgcatctgtgctcgacgcctacccgcatgtgaaggcctggtggtctggtctgatggagaggccgtctgtccagaaggtcgatgccctgatgaagccatctgcttgaaacggttgccctgtcaatcggtgaatggaataagccaagtctgttctgggttgtttgcttgttcagtgatgtgtgttctatgacgaacgttgagtgcctatgtgtgagcatgcttgcttg

SEQ ID NO: 9094 - DNA, 653 bp, Zea mays
  unsure (1)..(653): unsure at all n locations; Clone ID: LIB3279-195-Q1-K6-G10
cggccgcgtgggctattgngagagatttatgatggtacaattcgagtctatgacatagnaaagtgtcacaaagataagaattcttgatgcaagtggaccaccaggccttccaagcttacttgcaggatcatcgaatagaacaacaaccatactgatatcagttctgagtttctcaccggatggagagggtctggttgccttctctgagaacggattgatgataagatggtggtccttaggtagtgcctggtgggagaggctgagcagaagccttactcctattcaatgcacaaagcttatctatgttcctccatgggaaggattttcacctaactctgctcgcttgagtataatttctagcattttagatgataaacctggaaggtcagagaaggaactaggcgaggcggataatctgaagttattgcttcataatcttgacctttcataccgtcttcactggattggtggaaagactatcaaacttacgaggcatggccaggatttgggtacatttcagttgtgatgggcttacccatgaatattgagttgctttgtagtgttgaaagaagctaattcgatggctggcaagtctaaccaggatcaccagtacattcatatgtcctggtgaggaccttgatgtttctttgact

SEQ ID NO: 9095 - DNA, 256 bp, Zea mays
  unsure (1)..(256): unsure at all n locations; Clone ID: LIB3279-195-Q1-K6-G11
cggtcgcgtgggtccgccggcgcctgcaagctccagcgccctcgccgtcggctgcccggctgccgtcctcccgctacgagctaggcatctccttcgccgatccaacatgggtaagacacgtggtatgggagctgggcgcangctcaagacccacaggaggaaccagaggtgggctgacagggcctgcaagaagagccatcttggcaacgagtggaagaaccccttcgctggatcatcccacgtctggggaattgtg

SEQ ID NO: 9096 - DNA, 154 bp, Zea mays
  unsure (1)..(154): unsure at all n locations; Clone ID: LIB3279-195-Q1-K6-G12
aaaagcagaagacaanaccaaagagncccaagaggcggaggagaaggcggcggcagngggcggacccggaggagccggggcggcggacgcggcgcagcggggggggggggcagcaggggaggccgcggnggngcgggngcggccggnggggacg

SEQ ID NO: 9097 - DNA, 392 bp, Zea mays
  Clone ID: LIB3279-195-Q1-K6-G2
cgggtcgaccccgcgtccgcaaagttcacagctccaatcctggtgcaagcgcacagtagcggagcaagatgcggggaggagaccggccatcggcgtcgctccagctcctctcgctgggcctcgtgctcctctacttcttcacctcaggtgagctcggctcgactccatctatcattatgagatagatagatagatcattgcgctcaagcagaaccaccacgccgttcgtctagaaaagaatgggccaccatctctctctctctctctcgggtgttttgcaggcagcaccgttggtctcgtggagggacagaagacgtggtgcatcgcgaagccgtcggcgcgtaacgagatcctggtgcagaacctggactacgcgtcctgccaggtgagct

SEQ ID NO: 9098 - DNA, 445 bp, Zea mays
  unsure (1)..(445): unsure at all n locations; Clone ID: LIB3279-195-Q1-K6-G3
gcgattcgggcgcaggttgaggatcctgacatgttangaaaggatacggctaaccatcatcaacaacctgctccagtatcatcctgaatcaagtgagaagttggcaatgggtgaattttttgggataaaacctcctgtgaagaaggttgatatcgatattgcaacacatatagttgttgaagacgacgggccaaaaagaagcatgctttacatagagacagccgatcggcctggcctacttcttgagataatcaagatcatcgcggacacaaatattgatgtggagtcagctgagattgatactgaaggtttggttgcgaaggacaagttccatgtgagttacagaggtgcaaaactaaacagctcctcatgtcaggtgttgatcaattgtgtgcgttattacctggcgaagcctgggacagatggacacaggtgtgggctgggg

SEQ ID NO: 9099 - DNA, 671 bp, Zea mays
  unsure (1)..(671): unsure at all n locations; Clone ID: LIB3279-195-Q1-K6-G4
cgtccgggtaagcacagnncgacatcacccttcaagggactccaagnnacgcttctcttttcggcgagnaaagccggtncnnaccgtctnnttggcattcagggaacccccgnaggnaggannncccgtggnnggtgagggctngnngtgctgnagnntatgtnncgtggnnnagtccacncgngnntgtctnnntcactgtaccaaggtaccaagggggctgctgnncacatctngagaggggtgggtngggccaagnaaggggttgttnnnatctctttgccccnannagcaaagnnatgcacncnncatgttnnntgttgtnnntggtgtncnnaatgagggacccaagtaccanccctccgnatnngttaaccattnngtttccaatggcttagnnctgcaccacnnaaactgcctnntgctccccttgctaaggtcattcatgacaacctttggcattattggaggggcttgatgacaanctgttcatgccatcactgccacccagaagactgttgatggaccctcagccaaggactggagaggtggcagggctgccagctttaacatcattcccagcagctccggtgctgtcaaggctgttggtgaggttctctctgtattggatggcgagcctactggcctgtgctttccggttaccaccgtgg

SEQ ID NO: 9100 - DNA, 627 bp, Zea mays
  Clone ID: LIB3279-195-Q1-K6-G6
gtcctcgtccccggcttgtcgttgagcagaccactcgtgactcgtggcctcgtggtgttgcagaaaccagccctttttttcctgtcagcaactacccactggccactgcagccgagtgttcctttctagccttcacttctcagcacggcagccttcgatcccccgactgcagccgccagccgcgccatggagcaagcagccatgccgcaggttccccgcgtcaagctcggcatccaggggcttgaggtgtcgaagctggggttcgggtgcatggggctcacgggcacctacaacgcgccgctcggcgacgaggccgtggccgccgtcgtcgcgcacgccttccgccgcgggatcaccttcttcgacacctccgatgcctacgggccccgcaccaacgagaccctcctggggaaggcgctcaagcagctgccgagggagcaggtgcaggtggccaccaagttcgggataggtcagggcgccgctggcatgaccgtgtgcggcacgcccgagtacgtacgcgcctgctgcgaggccagcctgcgccgcctcgacgccggctacatcgacctctactaccagcaccgcgtcgacaccaccgtccccatcgaggatacgattggtgagctc

SEQ ID NO: 9101 - DNA, 530 bp, Zea mays
  Clone ID: LIB3279-195-Q1-K6-G7
cttgcaccataattatggccttttgatgctcttgggttatcatgctctttgaactatagttgttgatgacgcgagctattgccgtttctattcataattagtatggtaaaatgataaaatgctaccttttcaaagcatcgagtcatcggcctatcacatgctattccttgatcattttggttgcttgggagatttggaagcaccgtaatgcttgtgtttttgagggggttgtgccctgcacccagcgagttcagagtgctgtgattgaggagggcaacgtctggtgtttggctggtgcatcagctctgcaggacctcctgctgcgccagctccctaggggaccttagcagttttcctgctggtagtcgtttttggtcgggttgttaccttgtgtgtgtgtggtgcgttgtgttattgccggaggggtctcggcctaggggcctttgtaattaggggttgacaagtcttgtctctcctatgttctttttttcttcttaatttaatgacacgcagctctcctgcgtttgttc

SEQ ID NO: 9102 - DNA, 642 bp, Zea mays
  unsure (1)..(642): unsure at all n locations; Clone ID: LIB3279-195-Q1-K6-G8
cgtttgggtgccgggttgccaagnacatggaggattcgagcggctgctcgtcgtctccagccgtcctacggaacaagtactgggtcctccgccacggccgcagcgtccccaacgagcgcggtctcatcgtgtcatctctggagaacggcacgaagccggagttcgggctggccccgcagggagtcgagcaggcgcgcgcggccggcgaaaagttccggaaggagcttgacgagattggtgtgccggtgggttccgtcaagattcgttactcgccgttctcacggaccaccgagacggctagagtggtcgccggtgtgctcggcatcccctttgaagctcctagttgcgaagcggtgctgggacttcgtgagcgctactttgggccatcatatgagttactttcacatgataaggtgggtttccttctttggattcagttatattgtttcagtagaaatgaaaggacattcttgtcatatgagcatctactgaggtatttgatacaggttcaattctataatatgaattggtcggtgaaatctaagtggtgcattttcatctataatctaagaaatcttagtccttctagcaacctccgctttgtcagacataaaaatgtctttatagacatccatcatcctt

SEQ ID NO: 9103 - DNA, 662 bp, Zea mays
  unsure (1)..(662): unsure at all n locations; Clone ID: LIB3279-195-Q1-K6-G9
tccggcttgnttcggttatttcctaatacacatggnattggnatgnnggattggaaaaanattgagaagaagtttnngacttgtttnngggattcaaaccnncatccaatctcactttcaatccacatggnnattgagnannnctaaccgaaccaagcccnnttaaagtgacannataattccctaaactttgtctaaatnngcttcgcttcccgtgcttagttccannactgatcaattcanntttagaaacaanncctcttagtcaaacctaatggaagggcntnncactccatcaaaaacagncccttattacgagagagccataagcaccaagctccaaggataatgacactattgaaacccctcctcttgcacctatgcactcttttagagaccttttcccaccacacagcaaatgactgttcagcagcaataggagtgaggttaccaagcccgatagacgacaaaatgagatgacaaaaatccctagaaaaactgcaggtgcagaggatatgctggattgtttcctgctcctgatcacatagggggcaactcgccgggtaatgtaaccctctcctctgaagtctgtccgcagtccaatatttattccttatagccagccaaagaaaaaacttgcatttaggggggggggcccaagt

SEQ ID NO: 9104 - DNA, 263 bp, Zea mays
  unsure (1)..(263): unsure at all n locations; Clone ID: LIB3279-195-Q1-K6-H10
acaagaagaagcancagncnngngncnnaccacngncaagaacgagganaagcnngagnncagcaagaacnnggaggcnannaaggcaaacggcaacgacaagnnncgagaggncaggaagaagnggggaggnggcancanggganccaagncgcaggccaagaccaaggcccgggaaaagcngcncgccaaggaggcngcgcagcgngagacccaganngncnacngcngngncngcccngnagnnngacggggaagaaccg

SEQ ID NO: 9105 - DNA, 149 bp, Zea mays
  Clone ID: LIB3279-195-Q1-K6-H11
ccctgcgtccggtttgttagcgtgacgtgcgtgaggagtctggagtcggacggaatcgaaaggcgaaactcagtgtctcgagtttcctcggagcggaggcgatggctgggaagggagggaaaggcttgctcgccgcgaagactacggcg

SEQ ID NO: 9106 - DNA, 318 bp, Zea mays
  unsure (1)..(318): unsure at all n locations; Clone ID: LIB3279-195-Q1-K6-H12
cattcaggccagggagccctncaaggaaaaaagacncgggcnccnaaggagcnnnccccaaagaaagggaacncaagaggagnacacgggggngcaagggnancngcangngccnggacngcngnacgnnncgccnacacgccgaccgagccnncgaggggggggggaagcagnnagagagaagccgagacancanaaggaacnnaccgaaggagggggacagncnnaggagcccgcnggagaagcaggcnggccaaccggaancaacacaggcagcccgcagacaggccngccgggggccggagggggcccggaacc

SEQ ID NO: 9107 - DNA, 326 bp, Zea mays
  Clone ID: LIB3279-195-Q1-K6-H2
cccacgcgtcacgcccaagtcgtccgcttgtacatttcatggcaaatttgcgtacgccctcaacatctgtcgtgcgggcgttcaccctcttgtgaagtttgttcagcctggcgttttccacaggagtttgcctgtccaggtggtgcctcaatgattgatctatgagagcagcaaggattgaggaagctaccgggaccaggagcaaagaatgaaagccaagtgaagaggcaggatgggaatgtccgggaggagtcgaaggcgattcgagaggaagcctctgaggaggcaggtttcggtcaatgacacgcattgatcaatcacaggtg

SEQ ID NO: 9108 - DNA, 347 bp, Zea mays
  Clone ID: LIB3279-195-Q1-K6-H3
tttatctctatttcttagactagaaaccgactccccactctcctcatcacacgctctcttgtctgctcccatcttcaaatctttggtagaaaatctttgagtgagattgaaagctgtggttttttgtgcttcatctccaaatccttcttgctcttcttgattcttgctttggtactacatcgtgttttttgtggattcactactcttggagcttctagctcctagaagactaggtgtcgccccccaccctccaaaccttgcagaaaaccataagaaagtgtgtattacccgcacgtgtgacccaagattactatgtgggcttgcccttcgcggtcgctggcgggcgg

SEQ ID NO: 9109 - DNA, 201 bp, Zea mays
  Clone ID: LIB3279-195-Q1-K6-H4
tctttttctaaattttttttttaagaaaccccccgcacatacatgtagtgctctagtcatgcttaagaattccttggcattgtgagaagtatctcatataacaagctgtgctcgacagcgatactgcagtgtatacggattggctgagcgctgcaagtagtcgcttgagagcacaagggtactgtttttttgtccatgaca

SEQ ID NO: 9110 - DNA, 379 bp, Zea mays
  unsure (1)..(379): unsure at all n locations; Clone ID: LIB3279-195-Q1-K6-H6
tccggcgtagtcgcgagcacagnatcgaacaggcaggcggacctctgtcctctgatctgtcgccattgtctcgttgtgttgtcccggaggagcaggagcaggagcgatcaggccaacgctttggactcctggacctaccccgatggcgccagcctccttttttttgagacagtaatccagcgagcgcgagtgagaggcaaccagcaaccatgaggccagacacggcggnctgcgtctctccgactccgaagaagaaacccgacagtaaagccgcgctggacctcgcgttggggagcttcaacgttaccacgttcgtcgggctcatcatggtcaacaaggctctaatggcgacgtacgggttcacgtttcgccaccactt

SEQ ID NO: 9111 - DNA, 582 bp, Zea mays
  Clone ID: LIB3279-195-Q1-K6-H7
ggtcccacactcccaccgtactccccacaaaacattctctcatagtctcatctcatgtgcaccggaaaggcatctattgcctttctcccaacccgccaaaccctacttgccaccgccaaacttccgccttcgtccgcgccggcgccgctctatcgctctaaaataacctttccagttccaccgggactagctgaaaggagagggaacggagggggatggcgtcgccggacgacgagataagccggctcttccgcatccgccgcacggtgtatgagatgctgcgcgaccgcggatacggtgtccgcgacgaacaaatcaagctcgaaaggcacaagttcatcgaacgctacggcaaccccgtccgccgtgacgagctcaccttcaacgccacaaagttgaacggcccatcggaccagatctacgtgttctttcctaatgaggcaaagcccggggtgaagacaatcaggaactacgtcgagaagatgaagaacgagaacgtcttcgccggcatactcgtcgtgcagcaggcgctcagcgccttcgcacgcagcgccgttcaggaggtctcccagaagtaccacc

SEQ ID NO: 9112 - DNA, 514 bp, Zea mays
  unsure (1)..(514): unsure at all n locations; Clone ID: LIB3279-195-Q1-K6-H8
ctttgnacgagcgctttcacctcatgcccttcatggaggtggcgaagccgaggtggtacgagcgcgcgctcgttatcaccgtccagggcgtcttcttcaacgcatacttcctcggctacctcttgtccccgaagttcgcgcaccgcgtcgtcggttacctggaggaggaggccatccactcgtacaccgagtacctcaaggatctggaggccggcaagatcgagaacgtccccgccccggccatcgccatcgactactggcgcctccccgctaacgccacgctcaaggacgtcgtcaccgtcgtgcgcgccgacgaggctcaccaccgcgacgtcaaccactttgcatcggacatacattgccaggggatgcagctgaagcagtctcctgcgccgattgggtaccactgatgcagtgatgctgtttgtgctctgctgagttttgagtcggtaataagcaaatgagtgtcttgccttcaagggaaagaaagaattgagttacgatacggcgatta

SEQ ID NO: 9113 - DNA, 533 bp, Zea mays
  Clone ID: LIB3279-195-Q1-K6-H9
gcttgtaaacttgaatatgtgttaattcttgttgtttttcctcttgttgtatttggtatacattcatctgaacaatttcccgtttctcctactcgctgccctcttccttgtttattcctctaatgtgttgctgccttgctgggtaacaagtcattcgcgaactcagtggactcattcttacacgagggcccaaactctgcaattttgttgagtggagaggttacaaggtcgtataccggaggtatgctagcctgtatttctgcatgtgcattgatgccgaggacaatgagcttgaagtccttgagatcatccatcatttcgtcgagatactggaccgctattttggcagtgtatgtgagttggatttgatattcaattttcataaggcctactacatactggatgagattctcatcgctggtgaacttcaagaatctagcaagaagaatgttgcaagacttattgctgcacaggattcattggtcgaagctgctcaagaggaagccccctccataagtgacattattgctcag

SEQ ID NO: 9114 - DNA, 450 bp, Zea mays
  Clone ID: LIB3279-195-Q1-N6-A10
ggcgggagaatttagtaatttattgcacagaacgaaactttttcatgacaatcatccagaaaatgcgacaacggagcagtttatagtttcatcatcacacaaaagcaacgaatctggaacgggaacgggggggaagaaaagtcgcagccatcactgcaccttcaactccatcacgctcttggccttgggggcgtaaagagagtaaaccaccgcttgccgcttcgcaacctttagctgcttcttcccctccgagaacgccgcggcggcggccgacgcattggcgagggcgcggttttcgcggaaggagtccgcggcgcgtcggcgcgtgtactcgcggatgttgtagtccgagaacttcttcgccgtgcggagtaaggaacggaagagcgacagcacctttgctctcgttggggccgccgccgccatcctactgcgccgtggtgccgaaaa

SEQ ID NO: 9115 - DNA, 550 bp, Zea mays
  unsure (1)..(550): unsure at all n locations; Clone ID: LIB3279-195-Q1-N6-A11
gcagcaccaagaagcaccatttttttccttaggatttaacttaaaataaagcctgacgggggtaacagcacccatcgatccgcagtccatgctggttgatgcatgggtctgctggagccgaggatgaacacagcactaacaactgacacagagcgaccttcaatcaaaaacacagatgggcaacaacaaacacgagacgaacgaagataaacactctggactagggtaaacaacacggtagcgaacaggataacttggccgcgcgggccccaccgctcagttcctccagttcccgtcggagttgccgtagccgccgccacggttgccaccgccgtagccgccgccaccaccaccgtagccgccgccgccaccaccgtagccgccgccaccgccgtagccgccgccgccatcacggggcccgccaccgccgtagccgccgccttcacggccaccaccgtacccgccgccgccgccgcctccacggncgncgcgggactgggcctcgttgacggtgatgttgcggccgtccagctccttgccgttcatgccc

SEQ ID NO: 9116 - DNA, 379 bp, Zea mays
  Clone ID: LIB3279-195-Q1-N6-A2
gggaaaaaagattttccatttagtacgtaaacatcctttttttcatacattaggccgatcggatccagaccagatacacagcacactccagcagacagtacacgtacaaagctgtcatttcgtacacgcttaacttctcaaagatcaaccgcgcgtggctaagcatattagcaccgccaccacgcgggcggaccttttttttttttgtctatagctaaaccagccaccgtaccgtccgtcgtccttccaaattgggacaccaaaagaacgccggcgagggagagcatagcagagtatagaaaaccatggccaccggctcactcactccaggtcctggcatcccacgagcggggtccctttgctgcactggttgtgcgcc

SEQ ID NO: 9117 - DNA, 529 bp, Zea mays
  unsure (1)..(529): unsure at all n locations; Clone ID: LIB3279-195-Q1-N6-A3
cttcttcctggttttcagcacaatgactagccctcgtgtcgtcaccgtggaataagctaccagcagtgaaatagttatggtgacatactgacatagggngaaataattatatgaagcagctgaaaggtttctattatgcatctttgctgttaatattgttttgtttcatgttcaaatactttttgaaccaatcctgtccttcttccagcaatacttgcagctcacatgtaaatgtaaagactagcctgacacccccatcaattgaactattgtttcgttgcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaanggggggggcccttccgaaatttttttaaaacgggggggggccccccnttttttaaatttttttatatttatatttttattttttanttttttatttttttttttttaggtttttatctttttttttt

SEQ ID NO: 9118 - DNA, 491 bp, Zea mays
  unsure (1)..(491): unsure at all n locations; Clone ID: LIB3279-195-Q1-N6-A5
gagatcctagagcataaaccaaatataaggagcattgtctcggcaaaacagccagtacagtgattccacatttccactagataaggcccccacaacatgcctgacaagagcaactacaggaaaccccaataatataaagagctatatcatgcttcagtctgctccctcaggcggcggatcgtgctcctgacggtgaccgcactagcagtgttcatggtgtaagcaccaccagccttcaccttcccacagtccttgcacccccaaattccaactgctttcctcttcacagcaaacttcccacagaactcgcaaaagtacttggaatgctgagatacctccatcttcttgatttgcttacgcaagctagcaccatacctggttccatatttgccaacaattcctgccttcttagtgcgcttcgtcatcttggcgacacgaaatgaagcgaggtgcggggcgtancggcggcggcggcggcggcgcgagcgaag

SEQ ID NO: 9119 - DNA, 611 bp, Zea mays
  Clone ID: LIB3279-195-Q1-N6-A6
gcgaaaggaaaagcttataacttttatcatttaagctgactgcacgccatctcgacattttccattataagaagaaaaaaaaacattcattctcccaaacaacggactacagcagcaaagtgaaccaccatgatgccaaaagaagccatggcacgggatttacagaaatgatgcactactggctcctcatctctctttcctcgatttcgcacacctgccttggtggcttcatatacccgcttttatctacaacccaatcctgtacaatgtctaacgactctgcaaggaccactcatgtagcgcaggttcctacaagactgaaggttgacgatgcaaggttggagacaccaggacagcctcaccacttgtgacttttgctgatgcaatctcatctagacgtttccatgccaactcttgcttcagtctaaattccttctctctgtctttgtcttcctcataaccccgcaagcattcattgaacatttgggggtcacgatcggagaatagctttcggacattcaggctgaggcttcgcacgacttgattccagtgcccatttatatttttctccaatgcagggaagacgataggcaggatcaccttactgtttt

SEQ ID NO: 9120 - DNA, 575 bp, Zea mays
  Clone ID: LIB3279-195-Q1-N6-A7
cgttccaacacattctcattgcattgcaagcatcaccgaagcaacagaatgatggcaaatcatgccttatacagcaacaaaggagacgtccatagttgcagaacacaaatttcacggcaaaaatattggccggatcagaagagaagcctcggaagaatacagggtgtgtagacaccgaaccacgcactggttaacaattaagtgtgcctataacagtccctctcatgacgtgcctcagttttgcactagttgaagtcaggcttctccgggtaagtacagcccgggcgctggatgataacgtttgcggcatagcaacctgccctcacgcagtcttcaatgcccttgcctagaaccaactgtgagaggaagcctccaacgaaagcatcacctgcgccgttggtgtcaacaagcttctccttgggcaataggatcacagggaacgttttcaccttcccatcctcagcaacagccactggatcagcaccttgagtaatcacagcaatcctcttttgcttgcctgaagccaaaggaagttgagagatcttcaaagcaatctcctcaatattctcagtctc

SEQ ID NO: 9121 - DNA, 552 bp, Zea mays
  Clone ID: LIB3279-195-Q1-N6-A8
ggcattacccatctgaaattatattctggacaacgaagaatttgcagccaagaaacgaaagaatgccgtcacttgtcacagatcaagtggcgatgaacatcagtactacaatggaacttcaatcatgcctgctgctacttctgcactacaccactagaacaagatattagcaagaactttttttttgttgttgttggttccatgaagaaaatctgaactatacacagtttgcgttgcgctgcatccggtccccggagtcgccgaaggatctcagaagaaggggaagccgccgtccggctccatcttggcggccatcggcgagacgagcatggagccgtagaaatcggcggcatcccccggcatctgcaggtcgtcgaggttgatgcccgcgagccagtcgtcgccgccgaggtcgccgaagtcctccacctcctccttgggcaggacgacgccggcaggggctggggctgcgcccatgtcgtcgaacgccggcagagagcccagctccgggaacgggtcgtcgtcgatctccgactccggcgtccgcgtgtc

SEQ ID NO: 9122 - DNA, 569 bp, Zea mays
  Clone ID: LIB3279-195-Q1-N6-A9
gtcacattcaactaggatatgcattgctcagcataactttgttaagtagtagacatatgtttacactcttgtttcatacaacaacacaataatgatctttcgctcatacacaaacatgataacgatgaggggctccaggctgaattgtgaacgacggaagcgtcacttcatgtacctctgaagaaatttacggtggaaatcactcctgatggtgtcgttgatgaaccgtttcggtgtcttggtctctcctcgtgcttgattcttgaataccacgtcgtcgtcccaccttctcttaacactgaaggagccagcattgttgatattaatcaacgggtttccccgcatcagttcagcctccttcatcttggcctcctcttctgcttgttgccgctcctttctaagcttctcctcggctctttctttcttaatcctctcaagctctgccattagagcttcagtgtcgtcgtcatcatcatcttcatcgctctcgtcatcgcttttaggctccacatcggagtcatcagcatcgatttctcgtggaactatcttatcctctgtctctctctttg

SEQ ID NO: 9123 - DNA, 592 bp, Zea mays
  unsure (1)..(592): unsure at all n locations; Clone ID: LIB3279-195-Q1-N6-B1
ttttacctgaaggacattagcagatcataagctcatgacttgattgttcatcacagaaaacaacatattttttccgattttcatacatcccactacatgtatcacctgtcactaacgcttcctacaatcatgaaactgagacttgttgacatgagcagcttactttattctgaatgaaggatcgttgcgtcgtgatagtttatcttggctaaaaaaacatatatcatgacagacagatagtgttcagctcagcgctcaacatgatgctagggcaaaagtcgaacgaaactgcatctacttcttaacgagcagggggcccacattatcaccggttgctttgttgtgcttcacatgggatccatcgcacagtgggaatgttcctgatctccaacaccgacagtacgcggtgagcggcttggcgagctcgccggtgaggacggtgtcgaccaccttgtcctcctccttccggatggccgggtttatcccaccgcccgcctccgngcgcaccgncaccaggccgngtcggggcctaggcgcccgtgcggcgggaggggaacgggcggngacggcaagcggcaaagcgcggcagcgg

SEQ ID NO: 9124 - DNA, 294 bp, Zea mays
  Clone ID: LIB3279-195-Q1-N6-B10
aaagaaaatgacaagagaactggagttcggtaaaccaggcaccaaacatttctgttcccaatcaactacattactcagtaattttaattgtgcactgaaaaccaaaaccgcatataggtctcaaaaaactctaaacattggtaaaacaagaaccgatacgactgccagcgacataaaagtttccagcgcagagtgcaccaggatacaagctcagttcaacggttggccttggcaacacgctcaatctcgtccttcttcttgatggcgtaactgttggatgagcccttggcagcg

SEQ ID NO: 9125 - DNA, 604 bp, Zea mays
  Clone ID: LIB3279-195-Q1-N6-B11
gcttatactcaggctacacaatagtctctaactatccatgccaggtccggtttgcgcctgtgtctgcaactgacccagcagtccggcttgcagttgcgcttgtgagtgcccctgtgattgtagttgtacctgaggttggggttgggaggtttgctgggctgatgattgcaactgcgcttcttggggctgcacttggggctgctcgtggacctgcacttgtggggattgctgcagctgctgatggacctgcaattgtgggggcaactgcggctgagggtgcagatgcacttggggttgcagctgcggctgagagtgcagctgcacttgtgggagctgttgtggctgatggtggagctgcagttgaggttggagggagtgttgtgtttgcgaatgcaactgaacttgagattgcatgggttgctgtggttcagtatgcagctgaagttggggttgtgcttgtggtagctgtggcggttcttgttctggctcctttggcttgggggctccgttattcatccttgctcgagcctcagcaaacatcctttgttgctcagcaacagcttcttcctctgtcatctcaatcctagtgaacttgccagctttt

SEQ ID NO: 9126 - DNA, 530 bp, Zea mays
  Clone ID: LIB3279-195-Q1-N6-B12
ttacaacatatcaatatcattggacaaaaatagctgcgaacaaaaaccttgctcattcttctctcgtctcgtttcatagcgggagcaaccaaagggaacaacaggggtaccaacacctaatccaaaggtagaacggacactaacacggtgacagaagcgaacggtaacacgatactatagatagataagataactcggccgaagccaggatgggcccacacatcagtccctccagccgccgccgccgccgccgtagccgccaccaccaccctcgcgccgaccgccgtagccgccaccgcctccgtagccgccgccaccaccctcgcgccgaccgccgtagccgccaccgccgccataaccgccgtcacggcgcccgccaccatagccgccgccgccgcgaccgccgccgtagccaccgccgccaccgccaccggcacgggactgggcctggttaacggtgatgttacggccgtcgagctccttgccgttcatgttctcgattgcgtcgagcatggagttctcgggggaga

SEQ ID NO: 9127 - DNA, 583 bp, Zea mays
  Clone ID: LIB3279-195-Q1-N6-B2
ctacaacagttcctcccattccatataatgataaaatagttagatgtcaaagaattacactgatcgactgaacatttcagtttctaaacaatggcacgcttcatttggcattaggcatgtcgtacacgcaaagccagctttacttccacacgctagagctatggctgaatgggggtgatgtgtcaccatacatcacggaggtacctgccttccatctgcaggctctttacgtagctctcggttttggagctatccaaagatccctgctcttggactactgtatgaagcatcctgtgtacgtctctagccattcccttggcatcaccgcatacatataagtaaccaccatgtgagatgatgttccaaatttctgtggccttctccaccatcttatgctgcacatattctttagttggcccttcccgagagaatgcaacaattagctcagaaagcgccccctcctcaaggaaagtttgcagctcatcttcatatatgtagtccatattacggttcctgcatccaaagaaaagattgaagtgcccagttctgctccagattgtttcagtgctaacctttcctgcaa

SEQ ID NO: 9128 - DNA, 498 bp, Zea mays
  Clone ID: LIB3279-195-Q1-N6-B3
aagttctgggaaactagtaataacagaccttacagttcaaaagtaactgaaattgaacacagaacatccagttgccagggtaacctatgagcaaactgtagagtgcggattactgattgtggatgggatgagcacgctctttggacagattccgctacatgattgtggccacaaggcaacctaacagaactctcttaagttacaactggctaagcactacagtgacttaggccctgtttggaaacacccagtttttaagaaactggtttatagaaattgaggtggttccaaacatactagtttatgactaagtttatagaaattagattctcagtttcttaaaaaccaagaagctggcctctcctagctaaaatataaaaactggtttctaaaaaaccgggttgcttccaaacagggccttacaagaaaattcagctatcggttcaaggttccacagctactaatcaaaaaccaaagaaaccaagctccgttgccctt

SEQ ID NO: 9129 - DNA, 600 bp, Zea mays
  Clone ID: LIB3279-195-Q1-N6-B4
agttaaagagctgtggattcgtcaacgtcacagttaacacaagcacaagttcattggatcaccagttcaccgctggctgtgcaaggagcaaagcaaacaagcacacatagctgcacgcgagacaccaaaccaatcacaccacgctgttgtagtcgagacaccacgccgtcaatcaggacaccctgaggcactgctgcttgaacatcttgctcgtctgctgcccgctcgccgagtcctccacggtgaggccctgcgcgccaaagcagatgttgatgagcctcccgttgccgcacccgtgcttccgggccgcgctctctgccgtcccggcgccacagccgtcgtccatggacgagttgttggagcacgaggggtcctccatggcgtcgtcactatccttcagcctgccggcgggcggcgtcaccatggagatctcgtcgtcgaggcagatgtccttcagcttcgccagcggctgcggcgtggacgataccgaggacctcaggaaagtgtccgtcggggacgcggaccgcgccgtagatggcgccagctgtggcatggcctccatgatgccgtggatgagcttcgtgttgagcttcttcttgg

SEQ ID NO: 9130 - DNA, 328 bp, Zea mays
  Clone ID: LIB3279-195-Q1-N6-B5
aaaaaaaaaggcacccttttttaaaaaaaaaaggggttccccccaggggggggggcccccaaaaaactggcttttccaaccccccatttccccgggcccccctggggggaaaaagtaaaccccggccgggttttgaattgcccccccggggggggggaaaaaattgtacccccgggggggggggaaggaaaaaacccggcccccgggaaaatgggattttgggggaaaaaaaaatgggatattccttccaaaaaaaaaaccaagggggggaggaaaattgtcaaaacctaccttgggttaagggcccaaaaaattcccccgaccccgg

SEQ ID NO: 9131 - DNA, 536 bp, Zea mays
  Clone ID: LIB3279-195-Q1-N6-B6
aaggtaagacctcacacatttagcattcccaagacataatatctgcttgatgcaaacagcaagccactgcttggtagtttacaaccaagctatctattattagtgcaaaggttgaggccaaccaacaagcatacaggtaaagcttattattgttcatacaaatatcacatgtaaatgtctaaatagttggttattagtataatgcttatctaaagagcacgctagcgccaccgcaacgcatcaagggcctctttgtggacacgggcatccccagctgctaccacgttaaaacttgtgggccgtgattctgcagtaacaggccaatggagcttgtcccatctccaatcagttattgaccctccagctccttcaatgacaggtaccagcgagaggaaatcatatggcttcaaaccagattcaacaacaatatccacaaaaccagaagccagaagagcataagcataacaatcacagccataaagtgggactttcaccttattccttacacgaataaatgcatcttcagcatctgcttc

SEQ ID NO: 9132 - DNA, 595 bp, Zea mays
  Clone ID: LIB3279-195-Q1-N6-B7
agtacgtaaacatccttttcatacatcaggccgatcggatccataccaaatacacacagtacttctcacactccatcagacagtacacacgtacacagctgtcgtttcgtacacgcttaactgctcaagatcaaccaggccgcgtagctagaccaggcacgcggccgtacgtgctttcgtctatagctaaactcctaaaccaggcaccgtcgtccttagttccttacacacaccacgatcgtgaagcacgccggcgagggagagcagagcagagaaaccaaggccgccaccggctcactcactccactccaggtcctggcagcccgcgagcggggtccctttgcggcactggttgtgcgcgtacggcttgcacccgtgcttgatgacgccgtgtcccttggggagcggcccgcacaggcggttgtagctcaggtccagcttctgcagcgtggacagccgctccagcgacagcggcacggtgccccggatgaggttgtgggacaggtccaggtacgtcatctccggcgggaacaccagctggctcaggtcgaagtcgaggtagttccacgacaggtccaccttgccgatggggccg

SEQ ID NO: 9133 - DNA, 579 bp, Zea mays
  Clone ID: LIB3279-195-Q1-N6-B8
cacactgaacacctgagtttattcattaggttatttgttatgtttgtgtttacatccatctaagacaatgataaacatcaggatttgaacaaaagacccacaggcttatagatgctacaagttacagatttgacataggggaatgcttagccaggaagctgaacatgcagaagttgcagatcatggcggccccatagtgaagcaaatttcaaaatcctaaacaacagaaacacccctaacaaggctggcttgcgtacagcagaacttgcactgaacaaatgctgacaaacatgtgaaaacaattgaatcaacaagaagcaagcatctagagactgcggccacaatcttagttgtccacggcaagcttccgcctcttgtagttaaccatcacctcgcccttgatgccaaccaccatggcgttccagtcgttctctgggaatggcgataccagctcgaactcaaagttcctcagtaggtgcgtccagattgccttgatctgcaggtaggcgaagggctcaccgaggcacccatgcctgccgccaccgaaggagatgtatgagaaggcgcctgcagccttgt

SEQ ID NO: 9134 - DNA, 597 bp, Zea mays
  Clone ID: LIB3279-195-Q1-N6-B9
ttacaggctacaaccattagcattacgcacgaggggcgagtaagcgcaactccagatgatattatgcatgttgcttgccacacatggtatattttccatcctctccccaaaactgggtacttactgatgttctggtttaatgacaggagttcggatcatcctcttcacagaaatgggtacttaccgatgttatggtttaataccaggagttcggatctggcagttttacagctacgtaaacacactcaatccagcctcttaagcaagtacgcgacctcaacctccttggttagcggcatgattctgtagctgtacagctcggcgaccaagctcggcctgattttgtagaccggtgggctgccgttgtccttagcaccaatgttcacctcttgcccgaagatcttggctttggcctccaccctgtgttcgatagcacgctccaccgtttcatatgtgagaaggttcatgagttgatcacggtcttgggctattatggctggcgtgtaagcttcaggggactcttgaaacttggcctctgccacaaacttcccatagtggatccttctggagagtgcctgcaagcaggttgtgtcacaa

SEQ ID NO: 9135 - DNA, 614 bp, Zea mays
  Clone ID: LIB3279-195-Q1-N6-C1
caagaaaacataacgccaaacttaataacccagtagcaaagcgggggaataaagtcttacaacgtaagttgtaaaccacacaacgacagatagataagaaccgacagaaacataacacgataggagccactcagggcagatcacaggatagcagtggcacacaagcccgacgacgccgcgccagtagagcgtctagtactcgtcaccctcgtcgccgtcctcaccctcgtcaaactcagcaccgacctcctcgtagtccttctcgagcgcagccagatcctcacgagcctcggagaactcgccctcctccataccctcaccgacgtaccagtgcacgaaggcgcgcttggcgtacatgaggtcgaacttgtggtcaatgcgggagaagacctccacaacactggtggagttggagatcatgcacacggcacgctgcaccttggccaggtcaccgccggggacgacgctgggaggctggtagttgattccgcacttgaagccagtcgggcaccagtccacgaactggatggtgcgcttggtcttgattgtggccacagcagcgttcacgtccttgggaccacatcaccacggtacatgaggcagcatgccatgta

SEQ ID NO: 9136 - DNA, 596 bp, Zea mays
  Clone ID: LIB3279-195-Q1-N6-C10
aataaaggtaccattgtgattatgtaacgcttttgcttagtatacaaatacgtaccagtgccaacagatcgtacataaataaaccatatgccaacgtgcctggagatcatagggcatttcattcggtggacaaaataagggatggtcactgtgtgtgatgccgtaaataaagtacatcaaacattgtacgcacgaccagcgctgcaactgaaactatcctgtcatacaatcaataaggtgttcgtctagtctaccatccaacgatacagcactagcaaactctccgaacgaactatgcgggtctgaccaactcttccccgcatatgctcacaagtttgggaacttagtactgtattcctgatcggacataaatgtcgctgtaatcatctttccggcgaaccatcttccatgaagtgcttgttgggccttccctgctgcagttacactatcgaactgcagatacacgaagcctgcagtatttttgtcaacaaaaatatgcttcactgcaccaaacttggaacattcatcttggacatcatctctaatatccaagtcaaaatcaggatccgtctccaatgatgggtcaaacatgtttt

SEQ ID NO: 9137 - DNA, 389 bp, Zea mays
  Clone ID: LIB3279-195-Q1-N6-C11
aaaagcaagcggggagatacaacttttttccacaacaggggcctcaaatttaagagggccattacaaaccggcgccccgggtttatagagcaggcaagcttgcttctaggcgggttgggggggggactggggaaagggcacaacaaaaaacccttttaacaaatccgggggtcccgcagcgcgctcagttgctggggaacttggggacggccttggttcccttggagacggggtgcttggggagctctccggggaggactaggcccacgggggtctggatctcccgggacgtgatggggggctttttgttgtacccccccagcttgggggccttcccggccagtttttaaaaaatgtccttgatgaaggagttcatgatggacaaggcc

SEQ ID NO: 9138 - DNA, 308 bp, Zea mays
  Clone ID: LIB3279-195-Q1-N6-C12
ggggaaaaagcggtttttttggaatcccatgggggggcggggggaaaaatttttttatccccatgctccactagctggcggggggagggccataaaaaagggggggccccccaatgaaagggttgggggggtttttgggggggccccggcagggaacaggggggggagcaaaaaaaattaggagcgtttgggggcaaattacatcccggggattttgggggggacccccccggctgggggtggcctaggaacaaataccaggacgggggacgcccgccggtaccccaagggttcccccacactttcgg

SEQ ID NO: 9139 - DNA, 560 bp, Zea mays
  unsure (1)..(560): unsure at all n locations; Clone ID: LIB3279-195-Q1-N6-C2
gtattgcaaatctcggaccaatgtcatattccattcattcctggaactggaccaatgtcatattgtatttgcttacgccttaccataccatctgcagtgctagttttgtcttgtccatacatacaaacaaccagatacagtcaactacacccggtggtctacacaacacagtaggacaaggatcctaaaaccaccatctcccttgtgcatgctggtggcatgatcaggcgatatattatacagcaaggaggcgatggttatcattggcagcagcgccgcagccagactgttgccctctaccgtttgtagttacaaaatggtgcatcccttctgcaccttcttcttcctcttcttttgctttggtggctggagaaccaccttaattgctgcgtcaaacactgcttttatgttctgctggatttttgaactgcattcgatgtaggcggcagcaccaattagcttcctcagctcttcgccctgngcagtggaaattggaacagcaccagngtgatcaacaaaaaactgcttatcatcacgcagatcaagttttgtcccaacaa

SEQ ID NO: 9140 - DNA, 580 bp, Zea mays
  Clone ID: LIB3279-195-Q1-N6-C3
caaaacgcagcagcagtagagccgagtgcattgctatacttagggaggaagatctggagattccgaagacgcgtgacggaggcaagtgaaacgaacgcacgccagaacatcaaaacgcaaacgcaggcagaggataactaacaacacgcggccgaagaccttaaaaaaataaaagttcagcggcggtgcgggcagaaggtgacgacgtaggaggcgccggcggagcaggtgaggatggacgtcgggtcgtcgtaggcgtaggagtaagccttggggcacgccgacttgaagaggcgcgagtaggccgtgggcttgcactgctgggggctcccgaactgccccgtgcagcaatactgcggcgcgccgtaggcggcgcaggcgctgcggcaccccaccacgcggccctcgccgcggacggcgagccccgcggggcacacgcggttcaggtcgttcacgcacccggccgccgcgcaccgggcgcccgacccgtgcaccggcgtcatcgcgatggggatgttgtacccgtccaccaggctcacgtcgtagaagtcctgggacggcgcggtgcccagggtgatct

SEQ ID NO: 9141 - DNA, 489 bp, Zea mays
  Clone ID: LIB3279-195-Q1-N6-C4
gaaaataatggggccaaaatttgatgcgctactttgaacgcataggtatctgcctatctgcgtacatcacatacatagaccatcagcctagtgccctagactcaaccttttctgcacactgtgcggccccgcaaagtttttatttaacctaaaggaccagcactgactcttttaaccatgcctaaactagcagctttagttcctttgtggcgtatggtgagctccatggttctcagatgttgactctcaacttcatccttcacaacagtcccgatattgctgctgtgtaatacttgcacccgcttccacagcaaacaaaagcaatcttcacgagcaaaccgaccacaggcatgaaatgatgaaactttccatgcagcggcatatcattgggtcctcaaatccgatttccggcctatcaatgctatgcaaacttcacccctgcatcacctttcgaaaccgcttcgaatcacatgtttccggacgcgtggg

SEQ ID NO: 9142 - DNA, 614 bp, Zea mays
  Clone ID: LIB3279-195-Q1-N6-C5
gacgacaatctaaggtaccactaaactcagcaggaaaagctttacaaaagaggaagcaagatgatgccagcagatccatctccattcgaatgtggcggcgccaggtgatgatttccgggggccagggaagaaccaaaacctaacttagagtgagcgatgtcactgtcaatcaccacacttgtgtcgcgggccgtcacaagagaggcagggcgctgcggacttgataaatatagcatcatcctctcgtcatctaatcgtttaccttttctccctatctcctacaggtcctaccagtctctgcgctaacgaatctcctccagtgctgcaggccagagtcaccttgttggctgatcagatgcctggttggtggcggtcgacggtgccgctgatatcgctggatgcgggtgcgggtgcgctccattgtcctgtggaggtgccgatccccacttcgggtccccgtctaatggctccaccacatggaccttgccgtcgctcatgccgatcgcgatctggttaggctccatggggtgtgcagcgactaccaacgggtagacccgtccagcacaggctagtattgaaggtggaatgtaagccggaagagcaatccgcagcgc

SEQ ID NO: 9143 - DNA, 554 bp, Zea mays
  Clone ID: LIB3279-195-Q1-N6-C6
aatagaaaggcttccaccctttcgcaagggaagcctaagcttggtgtgctcaaattacacgccatcgggtgagccctcgcatcacagtaaagccattacaaaaggattatagctaagggacgaacatcgaataaggtggcaaaacgaccaaaatgaaaacgatagctaaaaaacaagtcgattctagaaacttggagagtactgaagtcgatcatgctggcataacatgttacttctttagtcgagctaaggtacctaaattaacctcatgcgatagcttcaaccttccgagccttgttagaattcttctccgagtctgggtttctatctcgcttcgcgttgaaacgctttcctcctctctggttatttgaagcccttcccttgtagcttctactatccttgtactttccttgaatactgcggattgtgtcccaataatccttctcagcttcaccagtcacaggctccaaagtaacaatgtggtccttaattatcaagccaccatcagcaagtactgcagacatgcgggctttttcagctgccttagaatcttc

SEQ ID NO: 9144 - DNA, 421 bp, Zea mays
  Clone ID: LIB3279-195-Q1-N6-C7
aattattataacccaaacgaacaaaacaaaaaagggaacccaggacaaccacaacggcgacaaagaaaaagggaaaagaaggggccgcagaagccggggggggggggggccacccagacccaccacacccaagggggaaccacccgaggcaggcgcccccggggggcgccccccgcgggggcgcgccccgagggggaacaccaaaagcgcaggggggggcgacgggggaaaacgagaacacggagataggggccctgggtttgggcgccacaagggcgaaaggggccgggccatgggggggggaaacaccggacaaagacgccagggggatcgccaaaacccggcaaaaaataaaaagtcatcattccccgcctcgccacaaccgggatagaccccccagacggggacgggagacatggac

SEQ ID NO: 9145 - DNA, 509 bp, Zea mays
  Clone ID: LIB3279-195-Q1-N6-C8
gagctcaaatgaataacacaaggttcaccactagaatggagctcaaatcactaagaatgccaatcgagtgcgcaaagacggagtgtgaatgatcaagaatgcttagagtatgcttggttgactcctccatgcacctaggggtcccttttatagccccaaggcagctaggagccgttgagagcaatccaggaaggctatccttgccttctgtctggtggtgcaccggacagtccggtgcaccaccggacactgtccggtgctgattgctttcctattctagtgcagccgaccgttgaagatttggagtcgttggcgcaccggacagtccggtgcccccatcaaaccgttggctcggccacgcgtcacgcgcggattgcgcggctgaccgttggcgcagtcgaccgttggctcaccggacagtccggtgcaccaccggacagtctggtgaattatagccgtacgccgttgatcgcttcccgagagcgacgacttcgccgtggatggctcac

SEQ ID NO: 9146 - DNA, 527 bp, Zea mays
  Clone ID: LIB3279-195-Q1-N6-C9
gttaaccaacaagctagccaactatagctaatccggacttatctttagccccgtcttataattaaccattcgtatccaaacaggccctaaacacagtagtacaacacaacagggcagcgatccaccggttcgagcacacacaatggctgcatgagttctaaatgtgtatgcatattacaaggacaagtaaaccaaacgcattagcagtaacaccctcaggcctggaggtgctttctttgatgttacaatatatagcggacattctgaccacagtatacataatgattagaggggattccctttcttgccactctggaacctacaaatcaaccatcgatttccatgtccgccttggctgtcgaagactgcccatgcggtgcatcatggcctgaatcttgttgaggagctgctgctgctgctgctttggtggctgcatctaccaattcctctttgatggcactggcagtaccattttggtgtggtcgtaaggcctcgacgacattctcacacacagtttcaaactgtcg

SEQ ID NO: 9147 - DNA, 504 bp, Zea mays
  unsure (1)..(504): unsure at all n locations; Clone ID: LIB3279-195-Q1-N6-D1
aaacgggaatttcagttctcatagcattatcatgaatctcagaacataacaggtgaaacacgaatcaagcagaggcgccatggggttcacagatccacacctaaaccgctaaattaaactgcgagcgatacatgataaactaagaccaccactcagatcaccaccatcttattcagatccaaaggaacggacgcagggggagtcgacgatgacggagggagggcggccgaacagaccagatcagagagatctaggagagctgtccgcagtcagcgaccttgaccaccttggaggtggagccgttgcgggtgcccaccttctcgatggccttgacgacgtccatgccctcgacgacctggccgaagacgacgtgcttgccgtcgagccaaggggtcgcgacggtgcaaatgaagaactgggagccgttggtgttgggcccggcgttggccatggagagcacaccgggnggcggtgtgcttgcgcacgaacttctcgtcggggaac

SEQ ID NO: 9148 - DNA, 606 bp, Zea mays
  Clone ID: LIB3279-195-Q1-N6-D10
acacaaagttctgggttcagataacagagcagtgcagcagtgagcagtcttgaagggaagagagatggaagattcagcagagaaactaggcgtgggcagacaaggcattcccccccacaggaagacgctcgtccttccggactggcatgcatgtctcagcacacccgcggcagcttaagacctgctcttgaacgggatggccctgatgatcacctggtggtagatggcagccagggcggcgccgatgaaggggccgacccagaagatccactgcaaacaatcgtatagaaacaggaagaggttatggcacaactccttggtaccgatagacgatcaaacacgcactaaaacaaaggacactccatgcaaagcctagattaatgcatgccagctacatagatggagacaagccttcgtgataagcctaacacacagctagatggagacatatgccattctgtctacatcatttagtttggagttggtgagtgaatggttagtcgtcgttttggccacaaaaaatacttctgactggtgaggtgcaagaaacaaaaaatttaaaatgcagcacctagcaagaatcagaatatactttgtagagcatgc

SEQ ID NO: 9149 - DNA, 557 bp, Zea mays
  Clone ID: LIB3279-195-Q1-N6-D11
actgtgtcaaggaagaatgatggtgcaacgaatgatagattcgactggaaaccaaacttacatatactctaattaattgaatcccctcaaacttcccgtagcatgaaagccaaaataaaaggagtaaaaaaaaagatactaccattgtttttagccattagcgacaatttcgtggatcctgtcactgatctctggatcatcagatctaactgccagcttcatggccacctccttcggtgcactaattccaaatgacagtctcaccaagactttcacgttgccaataaacacaccagagagcagacaagtgtgcgaccttgaattgcttgggaccacgtcagttccctcacaaggctgcatgccaaggatgcttataacagcacttacagcctcagccaagctctcccttactccaagcccatactcgtcaactcgctcagtctctggatccatgttttcccaggcatttcggaagttagatactcccaccttcaacatataatcagcagaaacgatttcaagatcttcaagctggtactcatcctcgacaccatcat

SEQ ID NO: 9150 - DNA, 189 bp, Zea mays
  unsure (1)..(189): unsure at all n locations; Clone ID: LIB3279-195-Q1-N6-D12
caaataaaaccaccatataaaagcgtttggtctaaattctatcagtaaccaacgccaacactagnaaggggaagcacggnanatctnntatcaatctgcaagtaccagcgttcaactgttggtggcaacagaagtaaaacatcaactactcaatcgcatgaaagaagtacaacgtttgcattgtttcgc

SEQ ID NO: 9151 - DNA, 503 bp, Zea mays
  Clone ID: LIB3279-195-Q1-N6-D2
ttttttttttttttttttttttttttttttttttttttttttttttttttttttttttttttttttttttttttttttttttttttttttttttttttttttttttttttttttttttttttttggggggggaaaaaaaaggggggagaggaggggaaaacagaacaaaaaaggggggttacgggaaaaaaaaaaaaaaatttttgagccaaaaaaaaaacaaaaaaatttggcccgcccaaaaaaaagtgggggaaaaaaaaaaaaaccccaaaaaccttaggggggggaaaaaaaaaaaaatttttggccgggataataaggacccccacaaaaaaaaagggggggaaaaaaaaaaaaaaaaagggtttttttttattttggggggggcaaaaaaaaaaaaaaaacattttttttttttaaaaaaaaaaaaaaaaaaaaaaggggtggtctaaaaaagctggaaccaaaaatattaaaggaagccgggcgccagttttttt

SEQ ID NO: 9152 - DNA, 502 bp, Zea mays
  Clone ID: LIB3279-195-Q1-N6-D3
atccatcgggttttagttacccattgatatctcttatttttgcagacaacaattcaggaaaggaactacggtctgtgtagtcaacaaagcacgccatattttgtaaggggaacgctggactgctaaaacatacatagccaaagggaaaatgtccagaatgttaagaaacaaccaacatccatccatcaatccatggatttgcagacattgccatggtgatgtagttgagcaagaacgcgtgccatatctcatgcacacggttttaaactaaattaaacaacactaacagagcacaacagcagcagcttggcatcggtactgttttcaagcctgctcttcaccatcttccacttcgccccttttttctgcagcagcggccatcagctcatcaaatttgtcgctctttcccaaaattatctcaatcttggccttttggaatggacgccctcttgattcgtcgtttatttcaacagtagaggtcctaatttttttttcaacccca

SEQ ID NO: 9153 - DNA, 479 bp, Zea mays
  Clone ID: LIB3279-195-Q1-N6-D5
gggactaaaggggcaaccttttttatttctttcttcaaatgaacagctccccgtatcgatcagtttattcaaacctgccaccaagggcaagaaacgagttgctaccaatttacaattttttttttgcaggtacccgaaagaatcgggaattggtttttttttcgcgccggtggtctgggttcgttcttttttacatttcggccaaacacttgcccgctaaaaacacacagtttgattttatttgccaacaacaactttgcgccttgagaggggggcaaaaaaaaaaagcacccccagaacacaaaccgcgcggggcgacgttaacttttcggggagggggacccaaatccgaacccccaaaccccgggccggccggcctgcccttttaccgaaaggagggaaagcaccccctaccgggggggctcgcgctgccgggccttttttggcggagacgccgggcgcgaacttcttttcgccca

SEQ ID NO: 9154 - DNA, 531 bp, Zea mays
  Clone ID: LIB3279-195-Q1-N6-D6
actgaaagaaataaaaaaagatgcaccttatatgaatttaccgcaatccataacgatccacgcagtgaaatactacacttgcataccgaacgttccaaccccaattaactcaagtttttaagaacaaacccaaacacatgagactgctccaactcgccccaaaaaaattagcaaacatatttcatggctaaagggcagaggaactgattcagcacggggaggatctgcgtgcaaccacaccaactactcggctggggctgcatcggctttggtttcggtcactttgccagaatcagtggactccgacttgccactttcctcagatttgccctcgctcacagtgagcttctccagcaatccggccgtggaagagccatcttgaccttccttgtcctcgttctctgtaagtgactcagcaatctcctcaaccaactccttgaacttcttgcagtctatataagatcaaacagaaattgatgtcagcgtaacttagtgaaattcagcaagtttttggaagacaaaaaagaacat

SEQ ID NO: 9155 - DNA, 612 bp, Zea mays
  Clone ID: LIB3279-195-Q1-N6-D7
taaaactatcagcacgatggctgacatccacgcataattcaacggcacgatggccggcaatcaacaatactacatattaacctaatcatgcacgtatataattaacttaatattaaaactaatcatttcatataaatcatacacgtataacataaatcaagcaatcaccttggaggtttcgtcgcgggcgagccgacggggcgcgggcgagacgacggggcgcgggcgagacgacggggcgcgggcgagacgacgggtcgcgggcgaggcgccgggcgggcgagggcacggcggggaaacggcggggtcacggcgaggagtgcggcgggggcggtgggcgggggcggtttcatgtgtagtcctcttaggtttctacacatagtgtctcacaactttctccaaacattgtaaaatttttatcacagcctctacgtatgatatcatgacacgtggacaagtttcatgattttctgactttgtttgtgttttatacaatttttaaacatgtgcatgccaagttgacggtcatgtttagtgagcatgttgctcgaagtttccggtacgcttctgaaacggtcgtaacttatgctaattaacatgaatatcattttt

SEQ ID NO: 9156 - DNA, 560 bp, Zea mays
  Clone ID: LIB3279-195-Q1-N6-D8
ttaactcaaacggtagcctagatgctattagtaatattgatgccgttggccaaccttggcgtacaacgctgacatcaggaagaacagccgaacccgacgtgctggtcagctcacccaccagctgaacactggttagctcacctaccagccaaacagcatagcacagtcctgtctcaagtctacacaactcggcttattttccttataattcgcaccagattacagttcaaaagcctccaacaattccaaacaagagcaaataaaagataaggctcggcctcaacatcaaaacttcctatcgcacacctggcgctgtatggtttggtgatcaggaaagaacagccatcacgtcagacgccctgagcacgatgtactcaccgtcctcgcccttgaactcacttcccgcatacttggaatacatcacgttgcttccaggagtgatcgacagaggattcctgctgccgtcctcgcccaacggccctgggccaacggctaccactgatccaacagaaggtttctccttagttgcctgcgtcaatagcaaaccaccagcagttcgt

SEQ ID NO: 9157 - DNA, 591 bp, Zea mays
  Clone ID: LIB3279-195-Q1-N6-D9
atcgagtgacatttgctagcatttcatctaacgaacgatcaggcaacaaattggccggttacattacatccctcgtcaggagttagcagacataaaaaaaacctctaggctctctaggttttgttacatcaatagtttttacacaacacacaaaaaaacacaaagcacaccgcgacgagccataaataatacatggctgcagtgggggcgactctacatggccccagcgggctaactcctcgcactcttgctgcttgcgtaatctagatctccttgcagactccctgttagattgttttcgcctctccctctttatttcacgttcgtccagttgagtaacgccatcacgtcggacaagtgccaacccaggactcacttccccctgcactgcaggcacagccaaggcaggagaagcattccaaatgtccatcccaatgtttagattcggggtggcactaggaagcgctgcacgcccaggtgcagacactggaagctttgaggcagaccttccttttgcgggatatggtgactcaaccgcagcatatcgcacaacagtagcttgagacggctcatcttcagccgatgtgttac

SEQ ID NO: 9158 - DNA, 577 bp, Zea mays
  Clone ID: LIB3279-195-Q1-N6-E1
gtttcgaaaaagaatcgtccgattctccttctattgattcttttccgatcgagatgtatggatccatgtgtctacatacctagattctgttcatggattaacgaaaatgtgcaagagctctatttgcctctgccattctatgagtcgcttcctttttgcgtatggcacccccactccctttggcagcatctactaattcggaacttaatttgaaagccatatttcgacccggacgcttttgggatgcttctaataaccaacgaatggcaagtgctcttccttgtttagatcctatttcaatcggaactttccgcgtcgatccttttttattacgtcttgtttttactcctatattgggagttactctacgtattgcttgacgtaaaaccaatagtggatttgtttctgtcttttgttgaatctttttcacggctcgatagagaatttgataagccaatgatttttttccgtctttcataatacggttaaccaccatgttaactaatcgattacgaaaaattggatcggattttgcggttcttttttctgcagtacctcgacgtgacatgagcgtgaa

SEQ ID NO: 9159 - DNA, 546 bp, Zea mays
  Clone ID: LIB3279-195-Q1-N6-E10
agtcagcatacatttgtttgtccttcactgtgccaacaagtaggagtattatacaagcaaaatgtctacaaagttttcatcacactatacaaatgataccagctttcaacagctcgctcaaccaacctaatcaccctcatcctatccgatcctacggtataacaggttgcaattctcagactctggctaaggtttcacttgccaaaaaaattctggtaccataaagaatattaattccaaactgtaaccatctacaactccaatgaagtttccaccttcgcttacacagggacgattcaaatcatcgtctaagctctctgcaaaaacatctcagtagcttcccattgctggcatcccgaatgctggcatcggaccagggcccatcggcggcatacccattccacccattggaggcatgcccatcccacccatcggaggtggagggccacccatgccaggcattggcggagcaggcaaagcaagaggaagcaattgcgcatacatgttctgctgagcaacaagatctttctcctccttctctttgac

SEQ ID NO: 9160 - DNA, 598 bp, Zea mays
  Clone ID: LIB3279-195-Q1-N6-E11
gctgcacgcgtcgtaagcttggttcctctagacggccgccttttttttttttttttatcaaaatcaactgaatgattatcatatagaactacgacatcgaaggttcgaaccaaaccatgcaatgcggtcgacagaaaacaaagggctagtacttatactgcacagcctcttacatagaggcaattttaaaaacagaacaggggcaccggttcaactagaaagccctaaaaacataagtgcacaaagcatagcaaattatctacaaaatatgtcgtctgacttcgggcattcatactttggaataatcccgcacaagacgtctcagagtgatgcctcaacgcctactcccagccttgggcagtgggctgggctgctgattcccaaccagtaggagcgaccactggaggaacagtgccatccacaggaacaggggccacagtttgatcccagccatcaccggtaggaaccgaagctggtgcagcaccccaatcagcaccagtaggagcaacaggtggtgcagccacatcagaggtccactggtcaccaccccactgatcagctccttggtaatcagtgactgcagccggacgcgtgggtc

SEQ ID NO: 9161 - DNA, 527 bp, Zea mays
  Clone ID: LIB3279-195-Q1-N6-E12
ccctaaagagattttattagcattacgacgggagggaccgctgcctgggaattcactcagccatggttagggagctaacgaacgaactgtgccttacacacaaattagccaccgaaattacaacacttcacacgatcgctctgccgcatcacgcaactttgtccaccgctctgccgcacttcacttcatagagatagaggctatgaaacaggacgatatctttgtacaggttagaggttaccgtgcaccttcacactatcgcttcaccgctagctgcttcagagatcatcaatcatcatgctacttcctgctgaacaggctgcgcagcctaccgcggtccagcttttcgagcagtttcctcgcgccggccacgtccttttccgagagcttcttcaggtacccgatggcgccgtgagagaccatcagcttcttgcaccgcttgctcgccgaaagcgccagcaggcacgagatggcgtacttcctggccgtgttctgggggctcgggtccagcagctgcaccaggttgg

SEQ ID NO: 9162 - DNA, 496 bp, Zea mays
  Clone ID: LIB3279-195-Q1-N6-E2
atgctaaagccggaactcttatttccatactaaaaaaaaaaaaaaatgggtagtacattagcaaacagctttagagtttagactcgtgtgcgcgcctggacgtccagaactccagacccgaaacgacagcggcggcgtgagcaccgcccagcccagcaaggtagagagagccgcacaccaaagcccggccgccggccgcacacgcgcactggcgcttgacccgtgggagtgggaccccggcggcagcgacgggggcggcggcggcggctggaccagcacggagaccttcatgccactccagcagtagccgcggctgcagatgaagtaaaaccggcccgtgtggttgagccggaagacaaagttgtggccgcggctgtagctgaggatggggctgctggcgtcgcacgccgcgtatgccgtctcgttcacctgcaccacatcgaacctgtccctctcgtacctgaattcgagccagtcgccgacgtggaactggtga

SEQ ID NO: 9163 - DNA, 251 bp, Zea mays
  Clone ID: LIB3279-195-Q1-N6-E3
aagagaagattatgtgcatgatcagattgttaaagcaacacaaaatcagaggcaccaaatagccaacctcagaaccacgcacatcaaaccggttgcctacttgctggaccaaattttccgttgaaatcacggggacccgtttgcagggaccccgcctttgactaccggggcgacgtggatctcctgagacactgtttccacgttggcatccccggccagcttggtcacgccgtccaggaactccataagca

SEQ ID NO: 9164 - DNA, 575 bp, Zea mays
  Clone ID: LIB3279-195-Q1-N6-E4
agattcaaatcggctggcatgattgatgaaacaaatacacaccccaggattacactacacgactcccaacaggaaatggaaagcggaagcctgtaccagttcggtgactgcatacaactcatatatataacatacgtctctttgggcgaataatctgtatattattctctatggaaagaaccctcgcgcccgtgctgtacgtttcgtcgtggaaagaaccctggcctcatgcttcgtacaccttgcactcgtcggtctcggggttgtccttgcagaagtcctccagagggtcgccgctgccggccgccgcggcgccgggccacttggccgccaccaggtgcgccagatcaaccacgcgttggctgtacccccactcgttgtcgtaccaggcgacgaccttgaccatgtcgtcgcccatgaccatgctgagcgacgcgtcgatggtgcaggacacgtcggagcacctgaagtcgacggacacgagcggcacgtcgcagacatccaggatgccctgcagcgggccggcggcggccttgcggaacgccgcgttcacgtcgtcggccgtgatgccagtc

SEQ ID NO: 9165 - DNA, 602 bp, Zea mays
  Clone ID: LIB3279-195-Q1-N6-E5
caatcataacaatgttattatatttattccgtagaatctaccattggcgcggctcgatcctaatccatgcgaaataaaacacacaataatgcaacactggccgtcccgcactgtgcgtgacagcatataaacgatgatggtcgatgaatgaccacgcgatcgagtacatacgtacgtacgtacagtgtgcttgatgagcactagtagcagctagctcctagttccgattcttgatggtggggcgagcgttgagcgtgatcttagcatttgtgcgcggcacgataacgacgtcgacggttttatcgccgtcagcgtcgatatcgaacagcacttcggtgatgcacagggagagcttcactttccgcgtcttcccggcgccggagcccggcacgacggcgaagcttccggcgtactccttgtactgtgggcctacctgcaacgctttgtccgcgggcaggttgatggcgacgtcgaacttattgttcgcctgggggtcgtactcgatgccctcgatcaccagcagctgctccttccccgggtccttggccggcacaggcacggccggcacctccaccacctggcccttggtcagggcgagcggg

SEQ ID NO: 9166 - DNA, 456 bp, Zea mays
  Clone ID: LIB3279-195-Q1-N6-E6
ttgatactgaaacgatcaacttccacgactcaccactcacgagcgaatacatctggatcaaagcacccactggccacacattactacatagagagagtacacagacagaagcgcacacatcggttcatgcctacgtactctgctcgcggcaacatgcatccacgatacaccgtttacgaactgtgtagacgattgctaaacaccataaatgactagagacaggcacacctcgatctagcttaaaataccagtagcattactttattactctccgccatgcatgcattcctcgcccggacgcgcacaggacgcctcatttaattaatcgtgttgcagttaacgttggtgctgatcttgtacggcagggcgacgccgcacttgctgggcagcgcggcggcgcggctgatgtaggtgccgctcccgttggcgccgcccatgcgtccgcccacgcgtccg

SEQ ID NO: 9167 - DNA, 605 bp, Zea mays
  Clone ID: LIB3279-195-Q1-N6-E7
gaacatccaacagtatagtagggtaataagcgttgaacagtaacatcattacacatcaaacaaaaaaaaattatagtgccggtagaagacatctaacagattgcaactgcgattctgtcctgagtttccatgatacatccggagctcctagtcagttcgcagttgatattcaaggtaggcctcaagccttgctcgcaatgttgctggacagccagtccaggccctcatacagaccctcgccagttgtggcacaagtgctctggatgtaccagtgtcgctggcgcagggagtgtaatccaagcttgtcagtaatctcagcagcattcatggcattgggaagatcttgcttgttggcaaaaacaagcagcacagcatcacgtagctcatcctcgttcagcatcctgtggagctcatctctggcttcaacaacacggtcacggtcattgctgtccacaacaaaaataagaccctgggtgttctggaagtaatgcctccaaagaggtctgatcttgtcctgacccccgacatcccagacagtgaagctaatgttcttgtactcaacagtttcaacattgaaaccgatggtggggatggtggtgacaatc

SEQ ID NO: 9168 - DNA, 577 bp, Zea mays
  Clone ID: LIB3279-195-Q1-N6-E8
gaagccaaatagccctgtgggctggaccggtgacccttcctttgattaaacttgaaaatcaagaacacagtcgaagtacaaaatcgctgtggaaccctcggctcaactgttgtctacctagagagaaaactaggagctctataatgagtgctctaaataaatggcagccaagatatgctgaactaatcagccctcctatacatttatagagggttattctcacttcctaaactactactatttacatagagcctatccactccactgggggcgaaatggagcaactcctaggttttcgatccgacggccacatccttcacacggagttgcttcgccttgatgcacccttcgcgatcacaccgtgtgccaccaccggttaccaggtgtctatctctgccgagaggacgacactcagaatactgcctccttaccgatagccttttgctttattttgctctcggcaagattatatgcactcggcaaagatcgcgtatttgatagtgcacttgtcctcgacgtctgtgacgccgttcctgagttgcctgtaggggagggagtcctactggaggtcgtcgtc

SEQ ID NO: 9169 - DNA, 591 bp, Zea mays
  Clone ID: LIB3279-195-Q1-N6-E9
acggttagaattttaggcataataataaacataatgtttgaacgattcgtgacttcttcgttaaccaacgaacagctggttaccttgtacaccgacccaagttaaaatcattggaataatttacatacatgacaaacaagaacacgtttgcatctgaataccttagagacattccttttttcatgctaaaatcaaggaatgctgacttgtagagggtggagttcaggtttcccaccactatatatcccagaccaacatactagctgtcgaatcctatgtatgatctactacggtccacagaagcagccaccgcagcgtaggatactcgatcctgggactcgtcccgtttggcgaatcttctcggccttctgaaccgctatagctgcttgctggttcattttggcgttggccgaagctcgtttctcttcggctatgcggcgcgtcatctctagcttttcggccatcttttccatggcctcacttctcattctctcagcaaattcctctattcttctcatttcatattcaatttttgctctttgacgacccttccaagcttcaatcttcacctcttcttttttgaatcttgct

SEQ ID NO: 9170 - DNA, 166 bp, Zea mays
  Clone ID: LIB3279-195-Q1-N6-F1
ttttatgaaatattccttgatttgatctaccaaaaaaaccatcacctctatctgattgaacaccgtcaggcacagcacataaatgaccaacaagaactaaattctacgctcgtgaagggtcctggtctaaccattaaaaacaaatcagcagcgggggaagccgcag

SEQ ID NO: 9171 - DNA, 599 bp, Zea mays
  Clone ID: LIB3279-195-Q1-N6-F10
gtatgaacggcatcggtgtgcttattactgttgttcggttcctcagaagacagtcaaacaagacaaccaagtaggaggggggaggggacgggaaagccgcgaggaatcctacggtattgctaagcctgctcctgcacctgcacctcgttcgtcctccagcccaagcccagttcaggagagaacggccatcagatccgacgccctcagcacgatgtagttcgtgccgtcggcgcccttgaactcgctgccggcgtacttggagtacaggacagtgctccccgcggagacggacagcgcgagcctctcgccgtcctcgtccagggggcctgggccaaccgctacgaccgttccgatagatggcttctccttggcagtttccgtaagcagtaggcctcctggagttttgtcttcagcttcagcaaccttgattagaacacggtcgttcagaggcttcatgtctttcacgtcatcagtttctaagatacctataacgtcatcctctttgagaaccagatggctgtgatcgttcaacgcgacctcggttccagcgtacttagaatacacaacctgagctccaacctgaatgctgacatcaactt

SEQ ID NO: 9172 - DNA, 514 bp, Zea mays
  Clone ID: LIB3279-195-Q1-N6-F11
gatccaaacaagttgctgtctccaactcagcatatatgaatttttgccgactccaactcagcatatagaattgtttttgccgatacatagccagcattacagcatagttgatagaacaaaaaagggggctgctcgattctccatcggcaggaccaacttacacgaaatttaacagcaaagagactaattaacatacaaatataaagataaccatcatcccacataggaagcatgttttttggatgtccgaaaataagctctaacgagcaaaccacactccgcaacctagctcgtaggcaggagttccaaaacgggcacgcaaagagaagcaactcagtacttgtagtccttgacgtggaggctctcggtgtcggcggcagcatcacccttgtaggtgccgagggtagcctcagagttggccttgcacctggcgaggaaggcagctctagccttctccaagttctccaccttgccagcccaggccttgagggtgctcgcctggagggcacggccg

SEQ ID NO: 9173 - DNA, 596 bp, Zea mays
  Clone ID: LIB3279-195-Q1-N6-F12
gcacgaaaatggatgttgagacataaagggcattatcacaggcctcccacaggtaactcttgttctacaccacaccagatttttaagacaaggggaacacatatgaccctcgcacgattttcactcactaacagattggtaaaatcatgaaccagttgcctagatggcaattgagattcataacaccattggaaatctctctgtacgagggtagcgccttctgaaccacatagtacaacggctagaactgggacttgtcaaggctgttaaagtagggatgctccatcgcagctaaagctgatatcctgtttgaaggatcaagctgaagcattttcgatagaaggtcaactccttcaggttccagtgttgggacgacacgtgccaaaccctggggcttccactgtggaaactcatgccagtcccttaaatcactcactccaggccactgttcctcagtaggtgttcccagcaacctgaagatgtgaagcaactgttgcaactccgagtcaccaggaaagagagcctgccgtcgggccatttcagcaaagatgcatccaacagaccacatatcaacgccagttgagtaatgtgttgct

SEQ ID NO: 9174 - DNA, 589 bp, Zea mays; identical to SEQ ID NO: 8240
  Clone ID: LIB3279-195-Q1-N6-F2

SEQ ID NO: 9175 - DNA, 575 bp, Zea mays
  Clone ID: LIB3279-195-Q1-N6-F3
acatctcacaacatgctgtcatgctgacagggcgtttcttattggtgcgccacaacctttggcagtcatacccacatcatgtcaccaggaagtaccccaaacaaagcatcacactcaaacctcactcatacaccgcatatcaccacgttcaggatatcgtttacaaccaaacaatcaaaccagggacacagcaactgcagctccatcagccctcattcagacagggccttcacagcttcacgccaggaacatgaacccactccagctgcaccacaatcaggccactctcgaccttcctcagcttcagaatcaagtcctggaccaccttgccatccttccactgaacatggctctcgccgccaaggtagtttactccgacagggtagatcgtcttgatccttgtcccatcagaggcgtgcttcaggtccagcttcgcagcatcgtagatgtcagtaatgttgatctcagcaacacccatgctgtcgtctgctgtgaacttgtcttcatcaaaaacttcaaggtgcactggcttcgtaggatgtgttactgagagctgcagtacttcgttccacact

SEQ ID NO: 9176 - DNA, 298 bp, Zea mays
  unsure (1)..(298): unsure at all n locations; Clone ID: LIB3279-195-Q1-N6-F4
gggggggggggggggggggggggggggggggggggggggggggggggggggggggggggggggggggggggnggggtggggggggggggggggggggggggggggggggggggggggggggggggngggggggggggggggggggggnnntnggggggggggngggggggggggggggggggggggggggngggggggggggggggggggggggggggggggggggggggggggggggggggggntgggggggggggggggggtgggggnngggggggggggggggggggggggttgg

SEQ ID NO: 9177 - DNA, 574 bp, Zea mays
  Clone ID: LIB3279-195-Q1-N6-F5
acgacgctcctccacaacggtgccgtgctcgaggacgtcgacggcggcggcggcggcatcgagcggcacggcgtcgtggagggctccgtcatccacgtcgccctcctcgatggccagcacctgccgcagccgcaggacaagaggacggagaagaggcgtggcgagggaccggcgccgccgctgcgggtgatcgtcgtgtcggggtgcgccgagggacgcgtggagatggccgtgggcgcgcgcgccgcggtgtcgatgctgcgggcggagctggagcgcgcgcgcggggcgggggcacggttcccgctcccgcgcgacggcgcctacttcttcatacatgaacagagcgtgatggacgagtcgagatccttcgagtggcacggtgtggccgccggcgacgagatcgtcgtgttcaacagctccgtgacaaggaaccaggcgtagactacttgtggtacggttggcagctcttacacgcgtgcgcgctcgtcatggagcacttctaactcgtggtttctgaatttatctctttagagcaagtttaataatgggttctttaataatagtgcttaca

SEQ ID NO: 9178 - DNA, 554 bp, Zea mays
  Clone ID: LIB3279-195-Q1-N6-F6
attaatctatttccatttatcttatttgtacaaacaatattaaattacaaatgtaccttcggcttgaaggagtgaaaatacaagtatggcgccaaaagcaaatgccgagtcagcgtgaacagtacgggagtactgttcatctatttataggcgcgggtcgcagcccatgcaagattacattaatgccctttacgtttataaataactctatagtaattcttcgaggtctaatctggtttttcatctttaagtcggtttccctttccgccgttatgtcgaagctcttctgtgcatagcttcgtaatgatcttttccttcgtcacaatcaccttccgtcccactcaagcttcgtcttggccttaatcttatatactcgtaatccaattccgaagatacctgctcacacatttcacttggaaaacattgttaaatcatgtttttgaggaccttcggaagccgaaggccgccaacaaatattaatgttgaagattgtgaggtagagtagaggatttgctgactagaataaaatataatataaaaattcatgagtggac

SEQ ID NO: 9179 - DNA, 535 bp, Zea mays
  Clone ID: LIB3279-195-Q1-N6-F7
gtatttgctagcatggccgaagtgcactcgtttccacgacggtggacaggttcagatgacgcaattttgcgagttcttgctccgaagaaggtaataatacagctaatatgtcaaaataggacactgcacatgaatatgaaaactcaactcaatgtacccagatgattgccattgcacccaaaagcacttcatcttcttccacttctatatccgagcccaagtccctaaatgccatcgttcgtgcaggcaccgccagtgctagtcggcaatgaacatctcaccgtctgcggaaaccacgcatggcatccagttggcgctgcctcaggttgccatacttccttctacgccgtccagtaccggcagcagcctgctcctcagctttcatcgattccatgagctcgtccatgtctggtgactcttttccttgcatagcgcccatcattttctgcatttttgcacgcatttggaagagttgcgcgaccaattggctcacctgctgttcggtctttccagagtccttggccactcgtttcct

SEQ ID NO: 9180 - DNA, 333 bp, Zea mays
  Clone ID: LIB3279-195-Q1-N6-F8
gctgggcctcgtggccctgctcgcctaggcacgggcgcgcgcgcgagcgggtggcgcctgcacggccgcaccgcactgccgggacggacgacgacaggaattggtgacgcggatgcagccggtgcgcggcgccgcgctgtattcttggccgggcctcgcgtgtgtagtagtagtgcagtgccactcacgttcggtggcgggtggtacgtgcggtgcggacgtagcaccgtcgcctcggattctttctttctcttctcttccttttttttggttttgctgtactatattgcgaccccattgagatgctttattttatatatttattttattgcc

SEQ ID NO: 9181 - DNA, 487 bp, Zea mays
  Clone ID: LIB3279-195-Q1-N6-G1
aaacaagcaaaaaggcctcgtttttcatcatgccgttgatcagctccatagtccttggggggggatagatttgtctcaaattcaagtaacttctgggcaaaacttggcaggataaaggttctttcactgatctaggccttgatagcgtccttcctcagggggaaatacttctcacgctttttttccctttcgggcttaaaggaaagctggtgcttggggaggcccctgcggatggcgcgggtttttttggggcggaggtcgagcgggagcagctttttttttttgtacccctcacgcagggccgacttttgtttttgcgaaatgacggtcaacaccccccccatggaggggcccacaaccttgatcttggagagcttgttgggagcccccccggggaccttggctacccgtagcagggagagctccgacttaaactccttaagctgcgcttgcagatccgccttgctcttccctttttttttttttg

SEQ ID NO: 9182 - DNA, 526 bp, Zea mays
  Clone ID: LIB3279-195-Q1-N6-G10
ataaattggatccctatgtttggttaataaaaaaactgaatgcaatttatgaactgcaccagacaatgcttttaacagtcaaagaaacatcaaggtacctaacatgacatatgaatgtactggtgattcttgttagacttgccagccatcgaattagctgtctttcaacacttcaaagtcaactcaatattcatgggtaagcccatcacaactgaaatgtacccaaatcctggccatgccttgcaagttcgatagtctttgcaccaatccagtgaacacggtctgaaaggtcaagattatgaagcaataactttagattatccgcctcgcctagttccttttctgaccttccaggtttatcatctaaaatgctagaaattatactcaagcgagcatagttaggtgaaaatccttcccatggaggaacatacataagctttgcgcattgaataggagtaaggcttatgctcagactcttccaccaagcactatctaaggaccaccatcttatgatcaatccgttctc

SEQ ID NO: 9183 - DNA, 589 bp, Zea mays
  unsure (1)..(589): unsure at all n locations; Clone ID: LIB3279-195-Q1-N6-G11
ctaccaagataccacggnaaagataatattaacacagatcacgcactggcaagcggttacggatatagaattcaattcagaatcttctaaacaaaactatggcaaaacaatcgctaggttctcaacatgaggtcccagaactccaaaagcattacatgattcatttgtggcgagggggatagggtttttaagatctcggcttctccttcttctccttgaagagggcgagcagggaaacgcccgagaccttcacaaccttgaaacggacaccgggaatatctcccacagcgtggcccttacgaccgaaccccgcgatcagcacctcatcgttttcctcgatgtagttcaagaagccatcgttcggcacaaaggcggcaatcttcttaccgttcttcaccagctgtacacgagcacacttacggatagcagagttaggctgcttggcctcgatgccaatcttttccaggacgattccctttgcgtgggatgatccagcgaagggtttcttccactcgttgccaagatggctcttcttgtangctttgtcagcccacctctggttcctcctgtgggtcttgagcttgcgccc

SEQ ID NO: 9184 - DNA, 610 bp, Zea mays
  Clone ID: LIB3279-195-Q1-N6-G12
gtagtaagaattttaataagaattttaagctcaatccatccagcacacacaagaacgatgcaaactatataattacccagtcaagcacaatttagcagcagcagcagcactgtactaatcatatgtgacagcaaactatcaacgaagtatatatgcgataagccattattacatgatcgactacgcataacagagatttgcaacgaggcctccctccagcggcttcagcgcgggtaggcggcgatctcgacgcccttgctgccgagcgccgacgacgggggcgcctcgtaggcgctgaaaaggcggtacgaggagatgagggacaggaggatgaaacagaggacggtgccgaaggtgatggcgacggaggtgcgcgcctgacggcagaagctgccgaaaacgccgcaagcttcactccacgtcacctccttgtcaccgttgtaggcgaggtacagcagctccgccgccgctgcgcccgccgccaggatcaggtacgtgaacacctggtcgaggaggaagacgagccaggagcgcgacacggtggcaggcctcggcacggcagtgtagaacgcggataccagcgagtaggcagcgcagaagccgttggcgt

SEQ ID NO: 9185 - DNA, 530 bp, Zea mays
  Clone ID: LIB3279-195-Q1-N6-G3
cgtaatgctctttctttttatttcatccaaagagaacaccacactccacagctgagttttacatgcaaacggattgtaccaacttacagacaatgtcaatcatgtgatgaccttccaatgtgatcccttgtaacaggaaccaaatgggataatgatgatggacacctaacttctgttgctcccagctgtatatgactacaaaatatcaaactggttcagtgactgtgagcccaatttcaatgccacctatgcacattagcatgtgccttgcctgcactttatcagctacaatggaaactccatttgcagcagtacaggggggctcatagagaaggaactcaagccaaactttgaagtttctggttttaatgtagtactagcaaggttcaacaacacaacagtcaatagctgtcttcatctgtctcaggccttcggaggtaataacgcagacaattgatcaacacctgagatgaggagctgtttagttttgcacctctgtaactcacatggaacttgtccttcgcaaccaa

SEQ ID NO: 9186 - DNA, 588 bp, Zea mays
  unsure (1)..(588): unsure at all n locations; Clone ID: LIB3279-195-Q1-N6-G4
aaactgaaacctcattgtttattctttaacaaagcacaaaagaactaaaacttgcgaattcgttacaggacggcagcagataagttaaacacaaaaagacagcgtgtccaaaaccagcatggatccagcgtccaggggcaccgttcacatttattctcagcatagacaagcagcaaagatggtctgcgaccaaaggccattggggacgacccacgatagggaggcagaaatctatctctctactagcctactgggtcttgaacatgtggcggatcaggtcgacgacgcggttgctgtagccccactcgttgtcgtaccacgagacgagcttgatgaagtggtcgttcagggcaatcccggccttggcgtcgaagatgctcgacctgctgtcaccggtgaagtcggtggaaaccagatcctcctccacgtagcccatgatacccttgagtgggccctcagaagcggccttaatagctttcttgatttcctcgtaggaggcccccttctcgattctgacagtgaggtctacaactgacacatccacggtgnggaacccggaaggacatgccagtgagcttgccattcaat

SEQ ID NO: 9187 - DNA, 468 bp, Zea mays
  Clone ID: LIB3279-195-Q1-N6-G5
aacacagttcctacaccacatccagatccagcaagtctttaagagaagatataccccaatcggcagccacaaactagcatgacctacctgggggacgcagagacaagaataccacacatgtccatttggggttggcacttattggagaatctcacctatctacaatctggacaagggaatgaatccacactggattacacacgtttgaattattataccacccccaaacaacaacataattccagggtttattgacatctcaagcaatagtttcagcaccggcacacctgtttatttatccaggggcgtctacactctataatggcaacaaggccttccgatttcactaattcaaacataggctgcttggagcttggatgaaatcattcttccaagtattacccttttcctaaagcagctccagcgatagtaaataagctctgggcacactcgaaaccttttgaaaac

SEQ ID NO: 9188 - DNA, 587 bp, Zea mays
  Clone ID: LIB3279-195-Q1-N6-G6
aaaaatcatcatctgctcataatcactgatggaaaatacattattcttcgtctcgatttattagtgccgcatgttcacaagatgcatcatcgtacgattccggctcaaatgcagggaaatagttcaacatttgcatacgcctgtgattgctacaaggtttccagagcttcacttttttggtgtatctgcatacttccaggaggtatgtgcataggaattgtattgtcttccaccagccacatcttctgcacgtatctggctgccaatttccttcaggtcctcagctgtgagcttcaccttcaaggagtcaacgttggcatctaggttcttcgtttttgttgtccctggtataggaaccacatcatccccttgatgcagaacccaggctagagctagctgagctgggctgcactggtacttcttggccaaatcttctattttcaggtaaatctgcttgttcttctccaagctttctgttgtaaatcttggatgcctttgcagactagattcagaagaaacttgctgtgtcactcctcttccaccaaaaaaccacggccaattggactgtaagccacaattccaatccc

SEQ ID NO: 9189 - DNA, 529 bp, Zea mays
  Clone ID: LIB3279-195-Q1-N6-G7
gaacaaacgcaggagagctgcgtgtcattaaattaagaagaaaaaaagacataggagagacaagacttgtcaacccctaattacaaaggcccctaggccgagacccctccggcaataacacaacgcaccacacacacacaaggtaacaacccgaccaaaaacgactaccagcaggaaaactgctaaggtcccctagggagctggcgcagcaggaggtcctgcagagctgatgcaccagccaaacaccagacgttgccctcctcaatcacagcactctgaactcgctgggtgcagggcacaaccccctcaaaaacacaagcattacggtgcttccaaatctcccaagcaaccaaaatgatcaaggaatagcatgtgataggccgatgactcgatgctttgaaaaggtagcattttatcattttaccatactaattatgaatagaaacggcaatagctcgcgtcatcaacaactatagttcaaagagcatgataacccaagagcatcaaaaggccataattatggtgcaag

SEQ ID NO: 9190 - DNA, 601 bp, Zea mays
  Clone ID: LIB3279-195-Q1-N6-G8
gcggggaaggaaaatgggaaagaagcattacgtaggagacgaatttcatatccctgtcaagttacggaggaatgtaataggcaaacattgcaggtttacatatggtcaactgacaggcgacgttaaacccaagcagcagcaagttacacaactcggcgcagctctcctgtgatgagcgcaaacttacgatgctgtgacagaatggatgccaccatcgtgtctttcacttccaggttggtgagatcgtcagtatctttcaccttcaggttggtgagatcgtgaaggaaagacatgttctccttggctccactgaggacagcttgaaagatttgtagtgggtccccatggctgacaataagaattgcagagccatgaaaatgtgtctctgtagatgacagcacagctgaaaatctactagcaacatctgcgacgctctcgccaccttcaggagccatacagggatgtgcttcatctactgaccatatgtctgcatactacttaataatatcagattcagtaacggaaagaaacaaaaaaatgaaacttatagtggcacacaaaaaacacaactacactatcaattactatgataactgaatta

SEQ ID NO: 9191 - DNA, 449 bp, Zea mays
  Clone ID: LIB3279-195-Q1-N6-G9
gactgcagctcacatcgatttatcaatggagctgcagcaaaaacacatcttggcatgttgcgatttggatttatacagacagctttagaaccatacatacatgaccgcttttacacattttacaccgcagcaccctacaatcttcagtttcagcatctgacaatcaatatacacaatggggcatacgggggatatatttcaacttttcatgggcaaactgcaggctgcaagagttcgttagactgattttacaggagctagtttcaacatcccaactaaagcatgaactgttataaaccaacaagggggaatctgaactgttataaaccaacaagggggaattcttggctagtttgggaaccccatttttccaaaggatttctattttctcaaaaaaaaatgaactaatttcccttgtaaaaatggggttcccaaactgctctaaacca

SEQ ID NO: 9192 - DNA, 517 bp, Zea mays
  Clone ID: LIB3279-195-Q1-N6-H1
aggctaaatatttagagaaaatatattaccttgacagcttcatcacaaatgtttagagcaaggtcatatgacaaggagcaagcattacaggtccgtgaacacatttattccctcttgtgccaacagaaacagtccgcaggacttgagataccaaacatagacaaataagcagacagcttgccttgtcttccccctattatgatgctccgggacacaaactcgtaggaaagctatttcttgccacgcaacttggttcccagggccctctcgagcttgctaatgatctgctggttggggattgccttgcctgattcatactcctgaatcacctgtggcttctcatttatcatctgagcaagttgtgcctgtgtcagcttcttatcgagccttgcttgcatgagattcttcttcagatcacttggaactcgctcatgggcgaggttttcggtgtcgtcgtcaaggcgcttggtgttgagggatgtaccgctggatgccgccttgttcgtaccagcgttgt

SEQ ID NO: 9193 - DNA, 469 bp, Zea mays
  Clone ID: LIB3279-195-Q1-N6-H10
gcatggatctgaggcatcacataaacactgtaaactctgtcttgcaaagcttctaaacatggtctggtggacagaaacatatgaaactagattcggaaaaccacaatacgagttcatcagttcttccccgtcaaactacagggcagacacagcagtagacaatctaggtcatccgctgcgcagcctccttggcgagcagcttttcccgggccttggtcttggcctgcgacttggatcccatgatgccacctccccactttttcctgacctcatcgaacttgtcgttgaagtttgccttaatagcctccaagatcttgctgaactcaagcttatcctcgttcttgacagtggtaagacacaagactgatgcattcttcttgtgaacaatcgatccaagacgagcctttcctttaacaatgcagtaagggacctccatcttcctacacagggctggaagccacacaaccag

SEQ ID NO: 9194 - DNA, 558 bp, Zea mays
  Clone ID: LIB3279-195-Q1-N6-H11
aaaccgaatagcagtgtacataactaaataagcatccaggtttgcacccctgagttaacaactcacacaaacacaataaccaaataactgatgaagcagtaccaggcaagcgttacacagaggagctccaacctgacagctcaactaaaacctacaggatgacaaggactcgccgaggagcgcacagaagtctagtttaaactaaagatgcacatcccctagtcttcactccttggaggacttgttgatcagggacttgtgaatgtgcgggatgacacctccgcctgcgatggtgcccttgatgagggtgtccagctcctcgtctccacgaatggctagctgcaaatggcgaggggtgatacgcttcaccttcagatccttgctagcattcccagccagctccagaacctcggcagtcaagtactccaggatggcagcggagtagacggctgcggtggcaccaacgcgaccatttgcctgagtcctttgcttcagctgacggtggatacgcccaacagggaactggaggccggcgcgggaggagcgtgagattggggc

SEQ ID NO: 9195 - DNA, 590 bp, Zea mays
  Clone ID: LIB3279-195-Q1-N6-H12
aaaaagtcaaatcgacttacaattttctggaatgtagggaacacatagtatacagtacaaaactcaaagctcaaagcatggcaaaccaacacaaaccagtgacaagggtgatggttcgccaagcagcactacttagttattgtaccgaacaattcagcaacacgatcgggcaggccagttcacctgccacctcctgaaatccagtcacctccggctgctcctgcgtggagacgacgcggccttctcctcgacgtattcggcgaacctaacccttggtccggggattctgcagtgggagtttagatccgcaaacatctgctggcagcggttcctggccacctcctgcacccggcaggcctgtctgcgggctgcctgtgttgattccggttggccagcatgcttctccagcaggctcctaagactgtccacctccttcagtaagttacttatgatgtcatcggcttctctcatctgcttcctagagaactcgaaagctcggtcggcgtgtaggcgaaacgtacagcagtccaggcacatgcagatacccttgcacccccgtgtactcctcttgagtatccctttctttgggg

SEQ ID NO: 9196 - DNA, 628 bp, Zea mays
  Clone ID: LIB3279-195-Q1-N6-H2
cagttcaaaaataattatgtaatattctgaaactttttactttataataaagatacaagagcaagtaagaaacattctatttggaggttaatcatctaaaatgtgcatccatctgaccctctttgcttcattggaaccagctccaccatataagttgtaggagacatcaaccagtccatttcttttctccaccacaaccttttatcttcacacaatggttccagcttccagagttctccaaaaacagtagctttaacattaagtcagccttgtactatcatggtcaaggagcacagggacactcgagtatacacaaaataaactacttctagaagtgtaccagagagattgattatgccattagacaaggccagagccgcacaaacgccctaagctcctcctgaagtatcataaccgagcaatagctttgcaatattttttccttcatgttttcaatatttgaagcactcaatgtatatgtaattggtttcttcactttgaaagggagtagatgaattgcgataggtgtacccaaggctttgctcgcacctccgagttcctttgacataagcaaagtttcccttcatgttttcaataaatcaaactattccttgcttgtttcttgttc

SEQ ID NO: 9197 - DNA, 562 bp, Zea mays
  Clone ID: LIB3279-195-Q1-N6-H3
agtccaattaaataatgagatataaaactgaattgatctcaaattcacccagttaactttacaaatgggatgtgttagatgatccatattgttcaaagtagtagatctgagaagaacacttctcaaaatccacacaccaaaaagatacaaacaattctttcacggactggtgagagaacagagaacataaacaaatacaatgagtaagaacataagagacacatgatctatccccaggttcggtcaccccacaatggtgccctacttccttgttgaggcacccacaaagagtcgagtctctttcaaccctaatcctccctccatcgaccacaaaggtcaagcccacatactaatctttgctcacacgtgcgggtaatacacactttcttatggttttctacaagatttggagattcacaagcgacacctagtcttctaggagctagaagctccaagagtaatgaatccacaaaaaactcgatgtagtaccaaagctcgaatcaagaagagcaagaaggatttggagatgaagcacaaaaaaccacagctttcaatctcactc

SEQ ID NO: 9198 - DNA, 428 bp, Zea mays
  Clone ID: LIB3279-195-Q1-N6-H4
aaaatagaccccccagacaaaaaggttaaggaaaaaaaaagggccaagggggggggggggagcttaaaaggttccatttttggccaaaagccaacttttttggccccttagcccccaaaggaaaagggggcccttgcccctttgctaaaaaaaaagcttggggagaaaactttggaaggaggccattttaaactggggcggccaccaagggttccaaaaaaacccctttgaaagagggaaaaaaccgacaggtttacagggaaaaacccaaaagaccccagtatatggacttggtctttgggggaaaccacttggtcaaaaaaattatttaaaacggggattttcccccaggggtggtaaaaccccctcgggaggggaaaggccccaaaaatcccttgggctccaagggctactttagccccaccaac

SEQ ID NO: 9199 - DNA, 544 bp, Zea mays
  Clone ID: LIB3279-195-Q1-N6-H5
ctcttcacccttcctgcggggcctccaccgaatgggcttgacagtgaaaagtcaatgtgcttctcagactccaccctcaccatgaatgatgggacgttgacaatttgcctgccaaccctgatgtgacgctgcttgatcaagacacgagcatggtgaatggacttggccatgccagccttgaagacaagtgtttgaagccgccttgcgaggaagttctcagcggtgagggcaagaacataatcaagcttgttctgaccctcagcaagcagcccatagcggttcatgcggcgaagaagtgcctcaccctcaaagatacgacgggggttcttctcgtcaagggtgagcaagtgccttgcagcattacggatcctgctcagtgcatactggaccctccaaagctcacgcttgcacctcagcccatactcaccaaccagcttcagttcagcatcaagacgctccttctcataaggacgccttggtttcttgaacgtcttaccatagttgcggtagaagttgacgtgcaccatggctggtgctccttccc

SEQ ID NO: 9200 - DNA, 484 bp, Zea mays
  Clone ID: LIB3279-195-Q1-N6-H6
gccatgctgtgggtgtgcgattgaaggctccacaccttgtacgcgtttacaaaccaaatcgttcaatgttttggcaaaggcaaacacacacacacacacgtataccacaggaaattgttcaatgatttggcaaacaattgcaccatgtgattaaacgattacacgtatacctgtaactataacaaatgattatttgtcagtgtcgtccttgtcttgtttgaggctcaccggcaggtctttgccgcggcgctccttgccgcccggtttagcggacgcgttcccgtaccacaccatcccgaggacggcgagggccatcccgacgacgacctggaggctgaggccttccttgccgaagaagggaagccgagggagaggacgagcacggtcttcatgtggcccaggacctggaaggacacggcggagaagcggccgatgcagatgaactggctcaggttgaccccgatcgcgatgaagcacgacagcg

SEQ ID NO: 9201 - DNA, 397 bp, Zea mays
  Clone ID: LIB3279-195-Q1-N6-H8
aggccaaaatgggcccttcgggattggggggcccaattgggggggcaggaaaaacaaagggactttggggagagggggtggaccccaaaaaagcccccttggaactttagggatttggccaaaaatgggtctgaaaaaaaaagggggggggacccccatataaaggggttccctctaaaaaaacgggggggaaaaattccccctaaagggcggttgggaaccaaattttttttttccctgggggggaaaaaacttttttgttttttccccccccaaaactttggggggcaaaaaaaggttcactggtttggggggccccaaagggggaaggaaaatgtttaaggtgcatccccgggaaatgtgtgccccaaccaaaggggtggacctcggggggggg

SEQ ID NO: 9202 - DNA, 534 bp, Zea mays
  Clone ID: LIB3279-195-Q1-N6-H9
tttttatgcctgagcaatcctggaaatcatgattttacttgcaacgggaacacatgcaatgtagttacacatcacgctcattctaaataacctggagtcttgaaatccataaacatgagcagagcaaatgaactcgcagtccagtgcattacagttgcttgtacaacaataacaagatagagggaaggggggcaggcatgaagaacttcattttgtagcctgagcaataatgttacttatggagctggcttcctctttagcagcttcgaccaatgaatcctgtgcagcaataagtcttgcaacattcttcttgctagattcttgaagttcaccagcgatgagaatctcatccagtatgtagtaggccttatgaaaattgaatatcaaatccaactcacatacactgccaaaatagcggtccagtatctcgacgaaatgatggatgatctcaaggacttcaagctcattgtcctcggcatcaatgcacatgcagaaatacaggctagcatacctccggtatacgaccttgtaacc

SEQ ID NO: 9203 - DNA, 260 bp, Zea mays
  Clone ID: LIB3279-196-Q1-K6-A1
ttgtcgcgtggggtttttcagaagccccttgggtctcactgcttgccctgcggcggtatcttttcgtttctcagaagaggatcaagagtgcaactgtataaatacgttagctccaaaacacaaactagcacacatagcgacatggtgcttttggagatgttatgccaaggaataaatgtgaggaatgatcatcagaaatacttgaccaagagagagagagagagaataaggtgtgtatctggggtggattggatgagagg

SEQ ID NO: 9204 - DNA, 352 bp, Zea mays
  Clone ID: LIB3279-196-Q1-K6-A10
cgttgttaatcagtaaatcctcccactgatgaggtatacaaaaagaacaaaagtgcagctgcaacatctaaaaaaagaagaaccataaaaggggatccaagaacagtctgagagttgaccataaatttcttggtagctcatatcacagcactatcatatctgggctttctttaattgcatcttctctgagtgctgctgcttcatctgaacaaaaatcaacatcacctttatacgccttggtgctggttgtttcccaatttttctccatgaatgtctgccttttgtaaatattaatgactttaaattggacccctataagactgagctagcacagaaaattatgactatacaa

SEQ ID NO: 9205 - DNA, 352 bp, Zea mays
  Clone ID: LIB3279-196-Q1-K6-A11
tccgtttttacctcaatattataatgaaaaccccatcttccattgattttgcaatcttgtctatttgataaagccaactttatgtgttcagcagatgccagccggtctctgactgagcacttaaatgatgaatatcgacaccatatgctccaagctgaaatatttcacatagcgtcatcctgtttaccttttccagaaccaaattcatcataaacgcctcaaaagaagaggaaccatattcctctcctgtcacgagagacagagccttcttacgaggagtcaatatcaaaagaaaaaaaaaaacagaataaaaataataagaaaagccacgaaaaggataaaaaaagaatag

SEQ ID NO: 9206 - DNA, 381 bp, Zea mays
  Clone ID: LIB3279-196-Q1-K6-A2
tcgacccacgccgtccggtggtacagccaactcagaaatggtaccatatcccacggtcatggtttcatccctcagggaacatcctcgtggtctttgaggagaagggtggggatcccacgaagatcacattctcaagaagagctgtgacgagcgtgtgctcctttgtgtgagagcactttccttcaatagacttggaatcatgggatgaaagtgccatgaacgaaggcacacccccagccaaagcacagctgtgttgccccgagggtgaaagtatatcttacgtgaagtttgcgagctggggaaaccgcggtggaacctgaggatcataccagatgggaggcagacaacacggaaactgcataataggtggggggaaggccc

SEQ ID NO: 9207 - DNA, 208 bp, Zea mays
  Clone ID: LIB3279-196-Q1-K6-A3
gtaagacgtagcgggtttcagagaattgccattctggcatacagttgactctggttcgttaagctggtagcccgctggacttcctgcggccagaactgtccacaacattttgatggccgtggaatataacattttgcttaatgtgtccagtgtccaacagaatcagggacattttaagaagaatattaaccgattgacattataagga

SEQ ID NO: 9208 - DNA, 476 bp, Zea mays
  Clone ID: LIB3279-196-Q1-K6-A4
cccacgcgtccgtcgaccccgcgccacctccgcctgcctcccccggcaccgatcgggtttgatcgatggcgtcgaagaggatcctgaaggagttgaaggacctgcagaaggacccgcccacctcctgcagcgcaggtcctgttggtgaggacatgttccattggcaagcgaccatcatggggccttcggacagcccatttgcaggtggggtattcttggtgaacattcacttcccaccggattaccctttcaagccaccaaaggtgtctttccgcaccaaggtattccacccgaacatcaacagcaacggcagcatttgccttgacattcttaaggaacagtggattcctgctttaactatcttaaaggttctcctgtaaatctgctcactgctcacggtcccaaaccctgattatacctttatccctgaaattgctcacatctacaaaacctgcaggacacaagtatgaaaccac

SEQ ID NO: 9209 - DNA, 153 bp, Zea mays
  Clone ID: LIB3279-196-Q1-K6-A5
atattatgttttttgttctttatttttctttctttttcctttccttttgtttaacgccggcgcaaaaccggaccgtgccaagcggttgcccaccccgactcgccgccgagcggcggcggcgccaaaaaagaaggctccgacctgctacctggg

SEQ ID NO: 9210 - DNA, 583 bp, Zea mays
  Clone ID: LIB3279-196-Q1-K6-A6
cggacgcgtgggcggacgcgtgggccgacgcgtgggggcaagcatcatgatggtgtcgttgaagatgttgcttggcacttgaggcatgagtacttatttgggtcagttggtgacgattatcatcttttgatttgggacctgcggtctcccgcccctactaaacctgttcagtcagtggtggcgcaccagggtgaggtgaactgcctggcttttaacccgttcaacgaatgggttgttgcaactggttctactgacaagactgtcaaattatttgatcttaggaagattgatacttctctgcacacctttgactgtcacaaagaggaagtttttcaagttggatggagtccaaagaatgaaactgtacttgcatcctgttgtctgggcagaaggctcatggtctgggatctaagcaggatcgaccaagaacaaacaccagaagatgctgaagatggtactacagagctcatgttcatccatgtaggccataccagcaagatctctggttttctcctggaaacccctgcgaggactgggtggtttgcttgcgttcctgtagacaacgttcttcaaatttgggcgc

SEQ ID NO: 9211 - DNA, 585 bp, Zea mays
  Clone ID: LIB3279-196-Q1-K6-A7
cggacgcgtgggcggaggtccgcacgtacggcacctgcgcctggctcaggcccgacggcaagacccaggtgacggtggagtacgtgaacgagggcggcgccatggtgcccgtccgcgtgcacaccgtgctcatctccacccagcacgacgagaccgtcaccaacgacgagatcgccgccgacctcaaggagcacgtcatcaagcccgtcatcccggagaggtacctggacgagaagaccatcttccacctcaacccgtcggggcgcttcgtcatcggcgggccccacggggacgccggcctcaccggccgcaagatcatcatcgacacctacggcggctggggagcccacggcgggggcgccttctccggcaaggaccccaccaaggtggaccgcagcggggcctacgtcgccaggcaggccgccaagagcatcgtggccagcggcctcgcccgccgctgcctcgtgcaggtgtcctacgccatcggcgtgccggagcccctgtcagtgttcgtcgacttctacggtaccgggaccatccccgacaaggagatccttaagatcgtcaaggagaactttgacttca

SEQ ID NO: 9212 - DNA, 358 bp, Zea mays
  unsure (1)..(358): unsure at all n locations; Clone ID: LIB3279-196-Q1-K6-A8
gttcgccttgaaatgaatccgatcgnacaagtcaatctctgctttcaaggatgttcacagtaatactggcatctttggaatccatacatctactgatgcatgatttgttcctaaagctattgacctatcatccacagagctcatttcccttgcaactcctggacaagttgaccaaagccaactggaccgcgctaaagcctcatctaaatcaacgatactgccgaatttggaatcacaggcatcactaacacacgacatggcgctccaaattttggcatttggagaaaggaaacctgctgaccaccttctaaaggctatagatggtgttactatgaaagatataaccactgttgctgaa

SEQ ID NO: 9213 - DNA, 634 bp, Zea mays
  Clone ID: LIB3279-196-Q1-K6-A9
gctgcgctaagtactacgaggccggcgcccgctttgccaagtggcgtgctgttctcaagattggccccaacgagccgtcacagcttgccattgacctgaatgctcagggtctggctcgctacgccatcatctgccaggagaacggtctggtgccaattgttgagcctgagatccttgttgatggccctcatgacattgatcgctgcgcttacgtcactgaaacagtccttgctgcctgctacaaggctctcaacgagcaccatgtcctcctggagggtaccctcctgaagcccaacatggagactcctggctccgactctaagaaggtgacacctcgagtgatcgcccaatacaccgtccgtaccctccaaaggaccgtcccttctgctgtgcctgctgatgacttcctctccgatggacagatccaggaggaggccaccctgaatctaaatgccatgaacaagctcacaaccaaaaaaccatgggccctgtccttttccttcggccgccccctacaggcaagcaccctaaaggcctgggctggcaggatggagaacgcggaaaaagctagagcggccttctcaaccggggcaggacaactccgggctacctacgcccctacagggtgtggctg

SEQ ID NO: 9214 - DNA, 610 bp, Zea mays
  unsure (1)..(610): unsure at all n locations; Clone ID: LIB3279-196-Q1-K6-B10
ccccgcgtccgcggacgcgtgggctttaccaggccctttcaaatgtagcaaatgaggggctattgacagaaggatttttctggattccatcactgggaggtcctacaacaattgcagctcggcaaagtggttcntggaattacatggctcttcccatttgtggatggtcatcctccgctaggctggcatgacacgatatgctaccttgtattgcctgtgctacttgttgcttctcagtatgtatctatggagatcatgaagccacctcagagcgatgacccatcacagaagaacacaatgctcattttgaaatttcttccatttatgattggctggttctctttgtcagtgccatcaggattgtctatttactggtttacaaacaatgtcctcagcacagcccagcaggtgtggttacggaaaatgggaggagcgaagcctgtagtgactgagggaggtagtggaataattaccgcaggacgagcaaaacgctctaatgctcaacctgccggagagaggtttaggcagctaaaggaagaagagaacaggagaaaattcagcaaagcacttgctgcaggagattcagatgcgtcgtcatcgacatatgaca

SEQ ID NO: 9215 - DNA, 560 bp, Zea mays
  Clone ID: LIB3279-196-Q1-K6-B11
gtcgaccccgcgtccgccccgcgtccgatttccctcacccaactccgtccctctctcccagctcagatagatctttcccccgtcctccctcgccttcgccttcgccttcgccggcaggagatttccaccaccaccgccggaccgccccgaccctcctcccctctcgcgctatggcccagactgttgtgctcaaggttggcatgtcctgtgagggctgtgttggagctgtcaagcgggtcctgggcaagatggaaggcgttgagtcctacgacgtagacatcatggaacagaaggtcaccgtgaagggcaatgtgacacctgacgccgtcctgcaaactgtttccaagactggcaagaagacttcgttctgggaggctgaggccgtgacaagtgaatccgccacacctgccggtgccaccgcctgacaggttcgatgatcaggaagtgcccggccaggcggccaagaaaaaatgtgaatgtgtttagcttgggtctgttcccgataattgcaaactgctagctcgggctgtgcattttacaggtggtattcgggttctggg

SEQ ID NO: 9216 - DNA, 604 bp, Zea mays
  unsure (1)..(604): unsure at all n locations; Clone ID: LIB3279-196-Q1-K6-B12
cgcccgttaagcagccgagtcagcagcaatggcggccgtgctgaggagagccgtggcgcagtgcttcgcgtcgtcgtcgtcgtcgtcgccggcgacgttcgggctccggcggttnctgcnggagcngccggggttccgncccgtttttttgtccgnccgcttcgtgggggggggggggggggtcttttncttnggnggngggtgtgnggtgnggggggggtggtgggntgggggttgntnggcnggggggggggggtggggggggtgggggcgggtgcgtgggggggggnggggtggggtggggtgggnttngggggtgggggggggggtggggggtggtgggggggggggggggggggggggggggggggggggggtgggggtgngggtggtgggggggggggggggggggggnngggtggggggggggggnggnggggggggggggggggggggggggggggngggggggggggggggggggggggggggggggggggggggggggggggggggggggggggggggggggggggggggtgtggggggggggggggggggggggggggtgggggggggtgggggggngggggggggggngggg

SEQ ID NO: 9217 - DNA, 318 bp, Zea mays
  Clone ID: LIB3279-196-Q1-K6-B2
cttttctccccgcctggcgattgcagaaaactgcatatacgagtgtaaatgtattttgctcttcgatatggttttagctttcgtgttgtgcgaggatagctccttaagtgggatgtgtgatatagtcttttctgtataacacgttgtcatggagagatgccttttagacaagtttttccagtgttgtggcggtgtatatgtattttgtgcgacttggcgaagaaattgaataggttgactgcttgtatggccgtttgattcatgcctagggcaaaggacaggatgaggaaaactggggatcaaatgagaacccagcac

SEQ ID NO: 9218 - DNA, 556 bp, Zea mays
  unsure (1)..(556): unsure at all n locations; Clone ID: LIB3279-196-Q1-K6-B3
gtcgacccacgccgtccgatccaaaatctggttcaaatgtggngaactgttcgtgaaacctaggcctcctgtgttagcagctgctgtatctgcatggacgtttcttttgactactattggttcatggaggataaatactgatagttggaaagagcccattgcatttctctctactcttttggaagcagatgatcgtgctgttcgaatggctgctggtgaagcattggttttgtgctttgagctaaatctgcttgatgtttcttcttgtgaggatggtgatgttaacacagggggaactggtagttctaagaacaagcttttcctggatatgcaagcattaaaagccaaaatatcaggtctggcctcgaatctctctgctgaggctggggggaaaggtgcagataagaagaaccttactgaccaaagagacttgtttcaacgaatcttagattttgtcaagtatggtgaatgccctgaagaatcaatcaagattgctggaaaacgtgatgttttaagggtgtcatcgtggtctgaattaatccagttgaatttctta

SEQ ID NO: 9219 - DNA, 614 bp, Zea mays
  Clone ID: LIB3279-196-Q1-K6-B4
ccgagcgccgatgggtgcccctgcccctcgatagtcgcgccgctctcctgccccgttcggccgttccccatttgcctcgtcgcccaccgccccattagcgccgccctcccttatccgacccaacgccgccgccgccgccgcatagacctcgccggcgcctctgcgccgccccgtggcctccggaggtgctattcgcgcgcgatccgccgctgcgtccgtcgctctggcatcgattcggcggcgctgggagctgtagaagcgagttggttggagatcagaaacaggctacccaacttgaagatggcactgcgacgggctctaggatggtcggaaggggaggttatgcgaccagagtcaaagccctgctcccggttaatgcggcagactgcgggcatcttctccgtcggtggtggtctggctttctgggtgctctgccgccttcactatggtccaagaatcactgttccaaggagtctcagatgggcgtcatgcggagcagtctctatgagcgcgacatcagcattgcttgtgcggctctttagcccagagtgtgagcctcaaaacatagctggcttcgacaaacctgaacttaagcccaattgcataaccgaaaa

SEQ ID NO: 9220 - DNA, 597 bp, Zea mays
  unsure (1)..(597): unsure at all n locations; Clone ID: LIB3279-196-Q1-K6-B5
cccacgcgtccgcccaggcagccaggcttccagttccagccccacctcgcctctaccctcctcaaaccctacaccacgccccccggcccccagcccccggccttcgcccaacccgatagcgtagcgccggcgcagaaccggaccctgccgtgcggttgtccaccccgctcggcgccgcccgccgccgccgccgcctttgatgtctcctacctgcgacctcggcttcctctgcccccggtcgcagaagagctcccaagaggtcccccgagccaccgcttccggcgcccagcgattggcttccccaccgcagccgagatgagcagcggcggcgagaagatgttgttgtttgggtcctttacggaggacgagactaagttgttacagggtcagcccctcaaaagtccaactaaaagtgtcagcaaagaatgtgaacggacggagatccagtttggcaccctgaacttgtcagtgctgaatttagagaaaatatctacttcaagtgttgttcttcctgcaaaacagcaaaaggggaaaccagtgccatcacgaaggagaatgcatgnncatatgaaaagaaagctgcagggtcaagccttt

SEQ ID NO: 9221 - DNA, 652 bp, Zea mays
  unsure (1)..(652): unsure at all n locations; Clone ID: LIB3279-196-Q1-K6-B6
gtcgggcccatcccgtcgtccctggccgcactccccggcctccggtacctggacctcagcggcaacatgctgagcggcgccatcccgccggagctgctgcacgggagctccaggttcctgatcctgtccaacaaccggctcacgggggagatacccggcgactacggcgacggcgacgtcgacaccatcgacctctcgcacaaccagctcaccggtgacccctcgtcgttcctgttcggcatcacgaagccggcggtcaagatcgacctgtcgtggaaccagctcgagttcgacctgacggaggtcaggttcccgcaccacctcaggttcctggacctgagccacaacagggtcaggggcagagtggccaagtcgctgatggacgtgaggctggagcacttcgatgtcagctataacgagctctgcggcgagctcccggcgggaaggttcatgtccatgcacggggcagagtgctacgcgcacaacaagtgcctgtgcggcacgccgctccctccgtgcaactgaatcactgcattggttcaggctgtgcaatgatcactggtttaatcttgtgcgaacaagttgttagttgtaccagaacagcgaatcagttggtcgggtatccacgctccatgntggctttgggtatcgg

SEQ ID NO: 9222 - DNA, 632 bp, Zea mays
  unsure (1)..(632): unsure at all n locations; Clone ID: LIB3279-196-Q1-K6-B7
ccccgcgtccgcggacgcgtgggcaaaattggatgaaaactgcaatgagattcttgtgggtactgaaaggattatcgccgcctaattccgacagaaggctcaactgaggttcactatttttggcctgccacttctgatgctcgcagcatgtatgaggctatgtggcatgacataaccgaccaatcaggaggaaatattgtttctgtcaccattcctgtaatgtttgggaggtctattgagattcctcaaagctgtaatggtgtcgcaaggtttgacttcgagtatctatgtggtcgcccagtcggagcagcagattatatagcactagctaggaactaccatacaattttcatatcagaaattccagcgatgagtatgaagattcgtgacaaggcaagaaggtttatcactcttattgatgagttgtacaaccaccactgccgccttatatgcctagctgcctcatccattgatgatctttttcaaggaactgaggaaggacctctttttgatttagagagttttcagtttgaaaccgagtccgaagggaccaaagctgagagggatgttttggcggaaagcaatgctggctcangaccatctactaccggccttgtggcgatattgtctgg

SEQ ID NO: 9223 - DNA, 659 bp, Zea mays
  unsure (1)..(659): unsure at all n locations; Clone ID: LIB3279-196-Q1-K6-B8
ctgccaaccgcatccagtccaccccatccccctcgaccccgacaaccccgagtcccgacccgatggcgcccaaggccgagaagaagccagcggagaagaagccggcggccgaggagaaggcggagaagacgaccgcaggtaagaagcccaagtccgagaagcgcctgcccgcctcgaagtcctccggcaaggagggcggcgagaagaaggggaagaagaaggccaagaagagcgtggagacctacaaaatctacatcttcaaggtcctgaagcaggtgcaccccgacatcggcatctcctccaaggccatgtccatcatgaactccttcatcaacgacatcttcgagaagctcgccggcgaggccgctaagctcgcccggtacaacaagaagcccaccatcacctcccgcgagatccagacctccgtgcgcctcgtcctcccaggagagctcgccaaacacgccgtctccgagggaaccaaggccgtcaccaagttcaccagcaattgagcagcctncagcgtccacggatttgttaggtctccccttcttacaagggttcttcgtcgtgtcctctacccctnccctccccgcctatgtatgtgctgtgaaatcgttgatgttctcgtcgggtgaacaaagccagtagctagcttgcct

SEQ ID NO: 9224 - DNA, 321 bp, Zea mays
  Clone ID: LIB3279-196-Q1-K6-B9
aagcacggcatgtagacgcaatgcaagcacaacgtacgtcgctacagatcacgtggaagcgagagcgcggactgcagatctatatacaatgttggatatacgatttgcaactgataaaacccattgaatcctgctagtgcgctgacagcagaccgatgccctaaactgatacacaggcattagtgcactaactaatacaggttgataaacttctgagcatcagtgcactataaactgataacacgggcattgggaggcttgccagcatgaataatagggaactcaacgactaaacattgtaaatctcgacacatgaatttg

SEQ ID NO: 9225 - DNA, 448 bp, Zea mays
  unsure (1)..(448): unsure at all n locations; Clone ID: LIB3279-196-Q1-K6-C10
cagcgtncgtgtttgggttgttaatnagagatcctgccagtgatgaggtagacaaaaagaacaaaagtgcagctgcaacatctaaaaaaagaggaaccataaaaggggatccaagaacagtctgagagttgaccataaatttcttggtagctcatatcacagcagtatcatatctgggctttctttaggtggtgtggtctgagtgctgctgcttcatctggagaaaagtcagcatcaccgttgtaggccttggtgctggttgtttcccaatgtttctccgtggatgtctgccttttgtngatattgaggtcgttgagttggaccccttggtggctgagctagcagagaaatattttggcttttcaatgggtgagcaattgagggtncatttgggagatggcntcnngttcattggagacggtgttgctgcnnatcagtcagtnnntgg

SEQ ID NO: 9226 - DNA, 601 bp, Zea mays
  unsure (1)..(601): unsure at all n locations; Clone ID: LIB3279-196-Q1-K6-C2
gtggacagccaactcagnaatggtaccatatcccacggtcatggtttcatccctcagggaacatcctcgtggtctttgaggagaagggtggggatcccacgaagatcacattctcaagaagagctgtgacgagcgtgtgctcctttgtgtcagagcacttcccttcaatagacttggaatcatgggatgaaagtgccatgaacgaaggcacacccccagccaaagcacagctgtcttgccccgagggtaaaagtatatcttccgtgaagtttgcgagcttgggaaaccccagtggaacctgtagatcataccaaatggggcgctgccaccacccgaactccttatctgttgttgagaaggcctgtctgaacaccaacagctgtacagtctccctgacagacgagagctttgggaaggatttatgccctggagtcaccaaaacactcgccatcgaagcggaatgttcttagtgacctacggagtacgaagtgtctcggtgtgcatctaggttccactgcaagtatgcccgtcaaaattctaaaactgtagtgcttgttgcacggcaatgctattggtacctgggtttgaatgtatccatctg

SEQ ID NO: 9227 - DNA, 208 bp, Zea mays
  Clone ID: LIB3279-196-Q1-K6-C3
gtagtagtaggcgggtttcagagaattgccattctggcatacagttgactctggttcgttaagctggtagcccgctggacttcctgcggccagaactgtccacaacattttgatggccgtggaatataacattttgcttaatgtgtccagtgtccaacagaatcagggacattttaagaagaatattaaccgattgacattataagga

SEQ ID NO: 9228 - DNA, 645 bp, Zea mays
  Clone ID: LIB3279-196-Q1-K6-C4
ccccgcgtccgtcgaccccgcgccacctccgcctgcctcccccggcaccgatcgggtttgatcgatggcgtcgaagaggatcctgaaggagttgaaggacctgcagaaggacccgcccacctcctgcagcgcaggtcctgttggtgaggacatgttccattggcaagcgaccatcatggggccttcggacagcccatttgcaggtggggtattcttggtgaacattcacttcccaccggattaccctttcaagccaccaaaggtgtctttccgcaccaaggtattccacccgaacatcaacagcaacggcagcatttgccttgacattcttaaggaacagtggagtcctgctttaactatctcaaaggttctcctgtcaatctgctcactgctcacggacccaaaccctgatgatcctcttgtccctgagattgctcacatgtacaagaccgacagggccaagtatgagtccaccgcacgctcctggacacagaagtatgccatgggctagaagcaaggctaaaagctggccaaactggtgaatgtgccggaccccaaatcgttatcacctaaataaccagtcaagtcgcaagtatgaatggacttttgaggaccattgtgccctgttggactcatgtattacct

SEQ ID NO: 9229 - DNA, 587 bp, Zea mays
  Clone ID: LIB3279-196-Q1-K6-C5
gtcgacccacgccgtccgttcgacagtgagcaactagaggtccatgaagttccccaggaggttgtagacaagggtagtgtttgggtgagggctgatactgtagctttggggcagctaacacatcagtagacagtagtctcaggactcaggagtgatgtgcagctctcttgcatattcgagaaaaaaatcaagaggagtttgaaaagaaaaacaagtatggagctgtttcatcttcacgggggctttgatcgataaggattcaggagtgctggaagaagatttggagcaagagctgtcgctgtccggcgtctggcggtctgggggagaccagtgattttcctacgcacgcctgccaaaagtgggatggagttgaacgcaaaatgtgttgtttgtcattgggtagatggaggaggacacctcgtttatacgcgcggaggaggtgtagtgcgactgtgcgagttgaatttgtaagaaactcagccgcatgcttgcttggagatacttgagatggaacggaaaactcaggtctcaacagctgtagagaaggtgaggggagggaagcaaacaacctagcttacattgtgatg

SEQ ID NO: 9230 - DNA, 628 bp, Zea mays
  unsure (1)..(628): unsure at all n locations; Clone ID: LIB3279-196-Q1-K6-C6
cggtcgcgtgggcggacgcgtgggcggacgcgtgggggcaagcatcatgatggtgtcgttgaagatgttgcttggcacttgaggcatgagtacttatttgggtcagttggtgacgattatcatcttttgatttgggacctgcggtctcccgcccctactaaacctgttcagtcagtggtggcgcaccagggtgaggtgaactgcctggcttttaacccgttcaacgaatgggttgttgcaactggttctactgacaagactgtcaaattatttgatcttaggaagattgatacttctctgcacacctttgactgtcacaaagaggaagtttttcaagttggatggagtccaaagaatgaaactgtacttgcatcctgttgtctgggcagaaggctcatggtctgggatctaagcaggatcgaccaagaacaaacaccagaggatgctgaagatggtcctccagagctcatgttcatccatggaggccataccagcaagatctctgatttctcctggaacccctgcgaggactgggtggttgctagcgtcgctgaggacacatcctncantatggcagatggctgaggacatctaccatgacgaagatgatctgccaattagcgatgag

SEQ ID NO: 9231 - DNA, 537 bp, Zea mays
  Clone ID: LIB3279-196-Q1-K6-C7
cggtcgcgtgggcggaggtccgcaaggacggcacctgcgcctggctcaggcccgacggcaagacccaggtgacggtggagtacgtgaacgagggcggcgccatggtgcccgtccgcgtgcacaccgtgctcatctccacccagcacgacgagaccgtcaccaacgacgagatcgccgccgacctcaaggagcacgtcatcaagcccgtcatcccggagaggtacctggacgagaagaccatcttccacctcaacccgtcggggcgcttcgtcatcggcgggccccacggggacgccggcctcaccggccgcaagatcatcatcgacacctacggcggctggggagcccacggcgggggcgccttctccggcaaggaccccaccaaggtggaccgcagcggggcctacgtcgccaggcaggccgccaagagcatcgtggccagcggcctcgcccgccgctgcctcgtgcaggtgtcctacgccatcggcgtgccggagcccctgtcagtgttcgtcgactcctacggcaccgggacca

SEQ ID NO: 9232 - DNA, 609 bp, Zea mays
  Clone ID: LIB3279-196-Q1-K6-C8
gtaacgcctcgtaaatgaatttgatcagatcaagtcaatctctgctttcaaggatgttcacagtaatactggcatctttggaatccatacatctactgatgcatcatttgttcctaaagctattgacctagcagccagagagctcatttcccttgcaactcctggacaagttgaccaaagccaactggaccgtgctaaagcctcagctaaatcagcgatactggcgaatttggaatcacaggcatcactaacagaggacatggggcgccaagttttggcatttggtgaaaggaaacctgctgagcaccttctcaaggctatagatggtgttactatgaaagatataacgtctgttgctgaaaagatcatttcatccccattgacaatggcatctcatggaaacgttctgaatatgcctacttatgagtcggtcagtggcaagttccgctcaaaatgaggagtacatgacccttcccttcattttatcaccttgtttgctggacaagttttaccagtaccttgtcattcacgtctaggccatggttcttgttcagtttcagaagaaataagcaacctcatgcagttttgttcgtgaaacctgggatcact

SEQ ID NO: 9233 - DNA, 565 bp, Zea mays
  unsure (1)..(565): unsure at all n locations; Clone ID: LIB3279-196-Q1-K6-C9
gctgcgcntaagtactacnngaggccggtgcccgctttttgccaagtggcgtgctgttctcaagattggccccaacgagccgtcacagcttgccattgacctgaatgctcagggtctggctcgctacgccatcatctgccaggagaacggtctggtgccaattgttgagcctgagatccttgttgatggccctcatgacattgatcgctgcgcttacgtcactgagacagtccttgctgcctgctacaaggctctcaacgagcaccatgtcctcctggagggtaccctcctgaagcccaacatggtgactcctggctccgactctaagaaggtgacacctgaggtgatcgcccagtccaccgtccgtaccctccagaggaccgtccctgctgctgtgcctgctgttgtcttcctctccggtggacagagcgaggaggaggccaccctgaatctcaatgccatgaacaagctcagcaccaagaagccatgggccctgtccttctccttcggccgtgccctccaggcgagcacccttcgggcctgggcttggcaggttggagaacgt

SEQ ID NO: 9234 - DNA, 215 bp, Zea mays
  unsure (1)..(215): unsure at all n locations; Clone ID: LIB3279-196-Q1-K6-D1
ataaaagttatgaaaagaatatgtgtaaagttggaaataggtttatttgtggaaaaagataanatgtgtagtaggngatttattgtggatatatgtgagatggaaggaaagggagttgatgtgtgaatgagaatgtataagggaaattgaatagttaaggataagggagtggggnggtatggtgattgngataagttggttttttgtgtgggggg

SEQ ID NO: 9235 - DNA, 521 bp, Zea mays
  Clone ID: LIB3279-196-Q1-K6-D10
gtccgctacgaaaccctaacgccgccgccgcttcacaggtaagccgccgtcatggtctccggttccggcgtatgcgcgaagcgcatcgtggtggacgcgcgccaccacatgctgggccgcctgtcgtcgattatcgccaaggaactgctcaatgggcagaaggtggtcgtcgtccgctgcgaggagatctgtatgtcgggtggactcgtacgccagaagatgaagtacctccgctttctccgcaagcggatgaacaccaagccatcccatgggcccatccacttccgcgccccgtccaagatcctgtggcgcaccatccgcgggatgattccgcacaagaccaagaggggggaggcggctctggcgaggctcaagacgtacgagggcgtcccgccgccgttcgacaagaccaagcgcctggtcatccctgacgctcttaaggtcctgaggctgcaccctggacacaagtactgcctccttggtgagctttctaaggaggtcgggtgggacttccttgacac

SEQ ID NO: 9236 - DNA, 303 bp, Zea mays
  unsure (1)..(303): unsure at all n locations; Clone ID: LIB3279-196-Q1-K6-D11
ccttcggcccgagcaaacaaggtggacgcggagccggcggcggagcggagatggcggagaagaagcgaggcgccggcactcgcaaggatgaggtggtgacacgcgagtacaccatcaacctccacaaacgcctccacggatgcaccttcaagaagaaggcaccaaatgccatcaaggagatcaggaagttcgctcagaaggccatgggtactactgatgtccggattgacgtgaagctcancacgcacatctggagcagtggtatccgccgtgtgccggggcgtgtccgtgtccgggttgccc

SEQ ID NO: 9237 - DNA, 238 bp, Zea mays
  unsure (1)..(238): unsure at all n locations; Clone ID: LIB3279-196-Q1-K6-D12
gtttgggttggggggggtgggtggggggtttgnggggtggggtgnttggggttgggggggggggtggggggggggggggggggggggggggggggggggggggggggggggggggggggggggggggggggggggggggggggggggggggggggggggggggggggggggggggggggggggggggggggggggggggggggggggggggggggggggggggggggggggggggggg

SEQ ID NO: 9238 - DNA, 271 bp, Zea mays
  unsure (1)..(271): unsure at all n locations; Clone ID: LIB3279-196-Q1-K6-D2
cggtcgcgtgggggcagaatgtgagatgcctctacgtcaagagcaccatggnggaagccactacagggtgttctaagtatgctcttttgtgaagtctgctaggttctggcaccgaggttttattgaattaaactcttgttaaggatatgtttttggacgatcctatatttcgtcctggcgctactatgtttcagaatggtggtactactataagtatcctggcgctctaagtattgcttgaaaggatcaatataatttgcgtgtcataccc

SEQ ID NO: 9239 - DNA, 580 bp, Zea mays
  unsure (1)..(580): unsure at all n locations; Clone ID: LIB3279-196-Q1-K6-D3
gggtcgacccacnnncgtccgcccacgcgtccgaccctcccaaatcagcaccacccataggggccacggccgcgcaatgccgccctctgccgacgcaatgccggcccccggagacgccgcgtgcgccggcgacgtgcgcttgatctcctccaaggagctccgcgagcacgcgtccgccgccgacctctggatctccatctcgggcgacgtgtacgacgtgacgccctggcttccccaccacccgggcggcgacctcccgctcatcaccttggcggggcaggacgccaccgacgccttcgccgcctaccacccgccctcggcgcgcccgctcctccgccgcttcttcgtcggccgcctctccgnctcccccgtctcccccgcgtccggcgnctcccgncgnctcctggcgcngctctcctccgcgggcctgttcgggcgcgtnggccccncccccggggtcccgntcggcctggtgggcggcctgttggtcgcggggctctgccgtgggcggggctgggccggggcgtgggggccgggctggggggggggctctcggcgtcgggggggcccggccgggggg

SEQ ID NO: 9240 - DNA, 608 bp, Zea mays
  unsure (1)..(608): unsure at all n locations; Clone ID: LIB3279-196-Q1-K6-D4
ccgggttcgacccacgccgtccgtttcgaaaagttcgtttcgcgagcggtgaggactgaggagtgtggaggcctaaaaccatggcggcgagcatcgggatcatggacggcgcctacttcgtcggcaggggcgagatcctgcactggatcaatgcgaccctccagctctccctcgccaaggtcgaggaggcagcgtctggcgcagtgcagtgccagctcatggatatgtttcaccctggagtggtgcccatgcataaggtcaatttcgatgcgaagacagaatatgacatgatccagaactacaaggttcttcaggacgtgttcaacaagctgcggataggcaagaatattgaggtcaacaagcttgttaaaggacggccattggacaacttggagttccttcagtggttgaaaagatattgtgattctgtgaatggtggaattatgaacgaaaattacaaccctgtagaaaggaggtcaaagggatgcaaagaacgtgtctcaaagggttccaataagccatctaaatcattgcaagccaataggctttctggtgctgatccaacagatggaggccatggagttgggaaagttgtnacactttttctg

SEQ ID NO: 9241 - DNA, 500 bp, Zea mays
  unsure (1)..(500): unsure at all n locations; Clone ID: LIB3279-196-Q1-K6-D5
ggcgcagccgcagccgcagccgcngcnnnncgnncgncnncaacccacgcgagggcgaaacccacaaacccncnccctcccgnaccccggcccacacacccaggggcgaagacgcngggnagcnccggcgccgngacgagcgncgncgnnccccgaaaccccaggcnaggagaggagcncgagcgnggagagaagggcacnggnganggaacagngagcnanggaagggangangccgangacancnacangcggncanggaccggnaccancannggcccncacaanacngnacangagggncgcancnaccagcngaagnngnnnngngacaaggaccanccggagaagccaccancngncagannccacncaagaancaacangacangcgnnaancacgagaacaggaaggnnganccaaggaagnnnggnnngcnagcgaacnggcagcgggaccacacngaggagaacanccncacccagcncaagaaaagaga

SEQ ID NO: 9242 - DNA, 541 bp, Zea mays
  unsure (1)..(541): unsure at all n locations; Clone ID: LIB3279-196-Q1-K6-D6
cgtccgggctggtcctcctcctttccccgggccatcctcgaggcatcgccggggccgcaacttcgttcaggaggaagcccgctcccggccccgatccgatggtcaacaggaacctcccgcggggtatcatcaaggagacgcagggactgttcagcgagccagcgccggggatctgggcggcgacctcggaggagaacatgcgctacttcaacgttctgatccttgggccggcgcagtggccctatgaaggtggagtttttaagcttgaactgtttttacctgtggattatcccatggttgcgccaatggttaggtttctgaccacgatttttcatccgatcgttggcatgcttggtnggatctgcctggacattctgagggccaaatggngccctgcacttgngattcggacagttcttgtgcgtctgcaggctctactgngtgctccaaatccagatgaccctctctccgatcactttgcatcgcactgggaatccactggggtagcagctgttggatcagctccggtgtgggctcgcct

SEQ ID NO: 9243 - DNA, 525 bp, Zea mays
  unsure (1)..(525): unsure at all n locations; Clone ID: LIB3279-196-Q1-K6-D7
gcaacggnagccaacaatactagnacagctttgcgctgcactaaacgtcagtaaaagaagtgtggatagggaccttgatgtttaccgcaacatactctcaaagttggttcaagccaaggaacttctcaaggaatacgtggatagggaaaagaagaagagagaagaaagatcggaagccccgaagccgaacgaagctgtcacaaaatttgatggaaacctttattccacaaggcattagaatcagccctttgcagaggagagtttcccaggataacagaattaacagtaacatctggaccgtgttgagaaaccaccaaatgttcccctttcatcacagacgtctttggctgctcgtcgtgtgatgtagcattctgccgtacaaaaggatccagattattcttactactggacagatatttgtattttctcatatgtcttgaaatcaaatgtatacattttctgtgtgtaggggtcaatgttactcaagcagagaaatatagttttctcttttgtatttaaaanaaa

SEQ ID NO: 9244 - DNA, 617 bp, Zea mays
  unsure (1)..(617): unsure at all n locations; Clone ID: LIB3279-196-Q1-K6-D9
gctctcgctgcattcgtcttccccgcccgtccgtccgcccgctgatctcagatccagaccaaacgaactccacactaccctctgcccagctcgcgcacgcatgaaaccctagtgaccccgtccagatctcggcgtccggatcactgcgcggcgccgccatggcgccccccgcgctggactctctcccggcgccgctccggtcgctgcggctcaagacgaagcagcaggagctcctgctccgcgtctcggcgctggcgctcatctacgtgctcgccttcgccgtccgcctcttctccgtcctccgctacgagtccatgatccacgagttcgacccttacttcaactaccgcaccacgctcttcctcaccgagaacggcttcagcgagttctggaactggttcgacttcgagagctggtacccgctcgggcgcgttgtcggggggacgctctacccgggtctgatggtgaccgccgcgctgctccaccgncttctncgcgcgctctacctcaccgtccacatccgtgaggtctgcgtnctccccgcgcccttcttcggtggcaacaccacgctcgtcggctaccccttcgggccggagaaatgggactccggggcgggg

SEQ ID NO: 9245 - DNA, 549 bp, Zea mays
  unsure (1)..(549): unsure at all n locations; Clone ID: LIB3279-196-Q1-K6-E1
cccactagaaagacttgattggggcattctaccagccacaatgtgttctaattgacacaaatacacttaacacattgcctgacagggagctagcttcaggcattgccgaggtagtaaagtatgggctcataagggatgcaccattctttgagtggcaagagaagaacatgccgaaattgttagcaagagaaccaaatgctttggcatatgctatcaagagatcatgtgaaaacaaagctgaagtggtggcacaagatgagaaggaaagtggccttcgagcaacactaaacctgggtcacacatttggccatgctattgagactgggacaggatatggagcatggctccatggggaggctgtcgcagctggaacagttatggcaactgacatgtctcaccgnctggggtggatagatgactccatcagaaaacgtgtggttgacatactaaagcaagccaaacttcccattgcacctcctgagaccatgaccgttngagaagtttaaaaacttcatggttgttgacaagaaggttgctgatggtctgttg

SEQ ID NO: 9246 - DNA, 242 bp, Zea mays
  unsure (1)..(242): unsure at all n locations; Clone ID: LIB3279-196-Q1-K6-E11
ttggagggttnagtttttaaaaggtgtntgnttnatgntaagnaaatntttattttgntantgnttgatgggganattttagaatttaganaagttattttgtagtgtgatatgagggaggtaattgttgtagggtgatatgaggnaagnaanataggatggttnnagtggaatattatntttttattntgtgttnnnaaaattgaaattttagaatatttggtttagggtgnnnnatttat

SEQ ID NO: 9247 - DNA, 602 bp, Zea mays
  Clone ID: LIB3279-196-Q1-K6-E2
ctaccgataggtattcaatctctctattcggcaacaccttaaaaatatgtacttcaaaatattgacaagtggattgcaggcttagataatttttggaacacaacattgctccaaaaagtttttctaaagaaaaggtatcaatctgcagtttggtaagtgagtctgaatctgcagcaccaaggacttcaagaattagtctgaacctgcacttacagttccatgggtcttctcaattattaataatattattttttaatgaataattgaatatatattgagtctgtgtcatagattcagtcaccttaacaccctttgttgttttcccacttaagttagttaatgagatgaatggatggaaattacgtagtgaatgtatgataagtccaggctacatgttaaaagacacacttggctacttgagctctgtattgccatgaagaaatcttactgacgggtgctttcatctgctatttggatccgttgctgatggatcttacaaagaagttgagctttaagaggaacgtggtgtcattgtcatctgagctcaagggtgtgaggagcaagcttgcttcctaggagcagctgtttgtaagggaatctca

SEQ ID NO: 9248 - DNA, 424 bp, Zea mays
  unsure (1)..(424): unsure at all n locations; Clone ID: LIB3279-196-Q1-K6-E3
cgtggngcggacgcgtgggncggacgcgtgggctgcctcgtcgcctcctccgacgaccaccgtccaccggcgacaaggacagcgacgatgcagtcggcggcgtggaggcgtcacctcctcgaccaccacctctccccttccacctcggctgccatcgccgccttcagatccgcctgccaggccgggctcgctccccaagggttgtttggagcggatggcgcaagatgcatgtctgcgagggcgccggcggtcaaggggtccgggcatctcgtccgcaggggcaccggagggaggtcttctgcgagtggagttgtngccccggtgtttggagcttctgggttgtttggggcggttcttgtgcggcgncttgccnggatggggtgtctngtgcttgtccctttccggggttgtgggggttcgcgtg

SEQ ID NO: 9249 - DNA, 580 bp, Zea mays
  unsure (1)..(580): unsure at all n locations; Clone ID: LIB3279-196-Q1-K6-E4
ctccgccgccaccagtgcccgtagcgctcgccgccgccgccgccaccaatggagagcctccggctcgccgtcacccaccgaccggctctccctctcccgacctcccatagccacctccgccgccgccatctgcacctccacctccactcttaccccaatcccctctccctctcaccccccatcgcctcccacctctcacctatccctcgccgccacctgcccccgctcctcgcctccgcatcggcctctcaagcgagctctaagccggcggcgtcggcggcatctggcggtgctaaaccgctgcccctctttctctcgcttgccgccggcctcgccgtccgcttcctcgtgccgcggccggccgaggtaaccccagaggcctggcagctcctctccatcttcctctccaccatcgcggggctcgtcctcggcccgctccccgtcggtgcgtgggcgttccttggcctcacagccaccgtcgccacccgcacgctccccttcaccgncgcgttcggggcgttcactaacgaagtcatctggctcatcgtcatatccttcttcttcgcgcgcggctttgtca

SEQ ID NO: 9250 - DNA, 621 bp, Zea mays
  Clone ID: LIB3279-196-Q1-K6-E5
aagggaaagggcaggcaagagatggcgtcgtcgtttgatctgctgccggagtgcgaagaggaagaggaagaggagcgccggagttgtaaagatgttcctggtggactggttctatggggtgctggcatcgcttgggctgtggcagaaggaggctaagatcctcttccttggcctcgacaacgccggcaagaccaccctcctccacatgctgaaggacgagcggctcgtacagcaccagccgacgcaataccccacgtcagaagagttgagcatcggcaggatcaagttcaaggcgttcgaccttgggggccaccagatcgcccgccgcgtctggaaggactactacgccaaggttgatgctgttgtgtacttggtggatgctgttgacaaggaacgttttgccgagtcgaagaaggagctcgatgcgcttcttgcagatgactcccttgcaaacgttcctttcctcatactgggcaacaagattgacatcccatacgcggcttcagaggaggagctgaggtactacctcggcctgagcaacttcacaaccgggaagggcaacgtgaacttggccgactccaacgtccggcccctggagatcttcatgtgcagtgtggtgcg

SEQ ID NO: 9251 - DNA, 684 bp, Zea mays
  Clone ID: LIB3279-196-Q1-K6-E6
cccacgcgtccgctctcttgatctcagccatggcggaggtggagcagcaacaggacacgccgaagctcttcaaccgctggaccttcgatgatgtccaggtgaacgacatctcgctgaacgactacctcgctgtgaacgcgacgaagcacgcgatgtacctgccgcacaccgcggggcgctactccaagaagcggttccgcaaggcgcagtgcccgatcgttgagcgccttacaaactccctcatgatgcacgggcgcaacaacggcaagaaggtcatggctgtccgcatcatcaagcataccctggagatcattcacctgctcaccgatgccaaccccatccaggtcgtcgtcgacgcgatcatcaacagtggaccccgtgaggatgccacccgtattggttccgctggtgttgtgaggaggcaggccgtggatatctcacccctgaggagggtgaaccaggccatctacctcctcaccactggtgccagggagagtgctttccggaacatcaaaaccattgccgagtgccttgcagatgagctgatcaacgctgccaagggctcatccaacagttacgccatcaagaagaaagacgagattgagcgtgttgccaaggccaaccgttgaactgagcttgtatcctggtgcactctgcgctggaaactttatgtcgctggcagtc

SEQ ID NO: 9252 - DNA, 448 bp, Zea mays
  Clone ID: LIB3279-196-Q1-K6-E7
cggccgcgtgggcgccgccgacgcagcagcaggagacgcgccaaggagagcccgcaaggaggcgactatgagggccaagtggaagaagaagcgcatgaggaggctgaagaggaagcgccgaaagagaggcagagatccaagtaggctgatggggattgtggatggtggtgtcggcatagttgtgttacgtttcttcgatgcgtgagttcatggagagatgtcacatcctagttcgtcgtcaccgtttgccatgggtccaatggctcgtcttggaaacctgcacttcagtaggccatctatcgtggtttctagctatatccagagttttgtgctaagacaaatcagtcagtcgttttgtgaacctattatgatggagctttatttgctgctaatatcgacctacctattaagtaattgcaatgttcgtctatgctgtgcttggttcctc

SEQ ID NO: 9253 - DNA, 603 bp, Zea mays
  unsure (1)..(603): unsure at all n locations; Clone ID: LIB3279-196-Q1-K6-E8
ccagcgtncgggtttctcctccccctcttaccaagtcctcttcgggttagggttacttagggttttgtggaggggcgatggcggcggctgatgtggagtaccgttgcttcgtcggcgggcttgcctgggccaccagcaacgagtcgctggagaatgccttcgcctcctacggcgagatcctcgactccaaggtcatcaccgaccgggagacggggaggtctcgcggcttcggcttcgttaccttctcctccgagaactccatgctcgacgctatcgagaacatgaacggcaaggagctcgacggccgtaacatcaccgttaaccaggcccagtcccgtggcggtggcggtggcggcggtggctacggcggcggtcgcggcggcggcggctatggtggcgggcgccgtgacggcggttatggcggcggtggcggctacggcggtcggcgcgagggtggtggcggcggctacggaggcggtggcggctacggcggtcggcgcgagggtggtggtggcggctaccgcggcggcggcggcggctggagggactgatgtgtgggcccatcctggcttcggccgagttatcttatctatctatagtatc

SEQ ID NO: 9254 - DNA, 615 bp, Zea mays
  Clone ID: LIB3279-196-Q1-K6-E9
gcagtcccctcccccctgtagcctgtatccgccccccacactctgcgtctgtagtcttctttctcgcgtcggcagtcagcttggcagggccgaaccaatggcggtcgacccgcggcaggtggtggcgggcttcctcaccctctccatgttcgtcatgctcggcaacatgatcaagcacgaccacttctctcccgtcaccgaggagctgggcttcgaggcaacaggtgtggtgtcgaacacaaggaagcttgacaacgatgctgaaatgagcagcgtcgatacggctggagtggaggacctgatggacgctgtcgaggaagttaaaccttgctggaccaaaccaagtccaaaaaatcagccgtctaatggttttgttacattctccttgactatgggccctgagtatcacatctctcagatcacagatgctgtggttattgcaaggtatctaggtgcaacacttgtactcccagacatcagaggaaatgaattaggaaataagcgaaaattccaagacatttacaatgtggataagttcgtgaggagcctggatggtgttgtcgaagtaatagaggatatacctgatgaagtgagtgctaagaagccagcagtcat

SEQ ID NO: 9255 - DNA, 315 bp, Zea mays
  unsure (1)..(315): unsure at all n locations; Clone ID: LIB3279-196-Q1-K6-F11
gcgccccctacgcccgcccgtccccatccgaggaggcggagaaggcgaagccggcctcctggctcgggctcggcggcacggacgccgagcgcctcaacatcgcgctgtgatttggatctcggttgctacccacccggatcgaccggtggcgatttgattggctgggttcctggctgggggggggggttgctggnttggggctggggtggnggngngggggcgggggggggctntgctgntggctgggggcggggccgggcggggtggggggggtgtggcgcnggcggccggcgggggcgggggggggtcgggggg

SEQ ID NO: 9256 - DNA, 371 bp, Zea mays
  unsure (1)..(371): unsure at all n locations; Clone ID: LIB3279-196-Q1-K6-F12
gaaagtgagntttggttngagatgtttaagtaaatnngaaaaataaagnaggtgngatggggtgtgttagtnatanatggnanagnnngaganatnngtggattggntnanggnaaggggntgtgggagntagnnaagganaagtatgagnngntgtggatnaaaggnggtggggagtggaanntggagatgtannnggagtanattaggnanatgngnaagttnataagngnnatggagaagntggnnaagganagnagnaagggggnnnaggngnngnngnngtngagnatggnngnngaagaaagananannaagtgnttgagattngggaagagatgagatgnnggnganntgganntgggaaggaa

SEQ ID NO: 9257 - DNA, 368 bp, Zea mays
  unsure (1)..(368): unsure at all n locations; Clone ID: LIB3279-196-Q1-K6-F2
gtcgacccagcgtccgcccagcgtccgcggacgcgtgggtaaaatttgaatcttcatcatgggtcnaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagacatttaaaaagaacaaaaggggggggggggtgggggggtccccttcccccctgcccgtcgggggcacgggcttcgtttttcttgcccagccctttcctctgttggccggggcggattcttcgcgccgcccgctttgnaaacctgcccgctccccccctttgtccctgtggcgggcctgccccctgggc

SEQ ID NO: 9258 - DNA, 536 bp, Zea mays
  Clone ID: LIB3279-196-Q1-K6-F3
cctggcctcctggcaaagtgtttctgttgagaatatctcttctcagctttcaccctgggcatctgcactctttgagtttttgcccccttttatcaggaagcagctacttctccatcctgaatctgatgattcagctcaactttctcagattgagacagagaagcttctagcccagttagttgagactgagatgaacagacgtttgaaggagggcacttacaaaggaaagaagtttaatgcaatctgtcacttctttggctaccaagctaggggagcactgccttccaagtttgactgcgattatgcctatgtcttggggcatgtgtgctaccacatcatagctgccggtttgaacggttacatggccacagtgacaaatgttaagagtccagtgaacaagtggcgatgtggtgcggctcctatttcgtctatgatgactgtgcagcgatggtcgcgtggcccttcagccacccaaatcggaaagcctgctgttcacatggctagcgttgacttgggaggaaaagcctacgatgttt

SEQ ID NO: 9259 - DNA, 623 bp, Zea mays
  Clone ID: LIB3279-196-Q1-K6-F4
ccccgcgtccgcccacgcgtccgcccacgcgtccggtcaccgcctaccaccgttttataatccacccctcaccctccccctgttttttcttcttccgctgttctactccggcgtgttggtctacggcggcgcagatgacgaccctcgatcttatgggagggtacgggcgggtggacgagcaggtggccatccaggaggccgccacggcggggctgcgcgggatggagcgtctcatcttgcagctctcccaggccggcaccggggagcggtcgtcgtccccaccggcggtacaggcgcagcgccagcagcagcagcagcagcagctggagcagatccagcagcaggttgactgccgggagctcacggacatgacggtgtccaagttcaagaaggtgatctgcatcctgaaccgcacggggcacgcgcggttccggcgtggccccgtggcggcgcggtcgcagtcgcagggacctgcctcctccgagcccgcgcaatcggcgccgactcccgccgcgaggcccctgacgctggacttcaccaagtcggtgtccgggtacagcagggactccgggttcagcgtgtccggcgcgagctcgtcgttcctgtcgtcggtgacgaccggg

SEQ ID NO: 9260 - DNA, 603 bp, Zea mays
  unsure (1)..(603): unsure at all n locations; Clone ID: LIB3279-196-Q1-K6-F5
cccatcgccgccngaatcccgttgcgtctctcgcgcgttaccaagctctcaagttttctcgcgccgacggcaatggatgaggtcaccgaggccgtgaacaacctcaacatctcgggcgtaggggccgcgggcgttgccggggcggaagggcacaagaagaatcgcatccaggtctccaacactaagaagcccctcttcttctatgtcaacctcgccaagaggtacatgcagctgcacaacgaagtagagctgtcggccctcggcatggccattgcgacggtggtgacagtagcagaaattctgaaaaataacgggcttgctgtcgcgaagagtatcatgacatctactgttgatatcaaggacgagactaggacccggcctatccagaaggccaagattgaaatattgcttggcaagacggagaagtttgatgagctgatggcagcggctgccgaggagagggaggctaatggggccgaggaacaaagctgagtacctgcaaggaaggaccttgttgtagcttatttactgttttctgctgctagatttgtcttcttcatagtttgtcgagtgggctagagacgattacttgtataatcaatt

SEQ ID NO: 9261 - DNA, 588 bp, Zea mays
  Clone ID: LIB3279-196-Q1-K6-F6
cccacgcgtccgcgaccttttggagagcaagctccatttctctctgagaaaccttccaaaggccaaagcttctctgactgctgccagaactgcagccaatgccatttatgtgccgccatctcagcagggcacaattgatctgcagagtgggatccttcatgctgaagagaatgattacaagactgcttacagctacttcttcgaagcatttgaagctttcagttcactggaagatcccaaggctatcttcagcttgaagtacatgcttctgtgcaagataatggtcaaccaagctgatgatgttgcaggaatcatctcatcgaaggctggcctcaagtatctgggtcctgatgttgatgctatgaaagctgtggccgatgcctactccaaaaggtctctgaagtacttcgaaactgctctccgtgattacaaagctcagctggaagaagatcctattgtccacaggcacctttactcgctgtatgacactctcttggagcagaacctctgcaggctgattgagccctactcaagggtggagattgctcacatagcacagatgattgagctgccaatgaaccatgttga

SEQ ID NO: 9262 - DNA, 632 bp, Zea mays
  Clone ID: LIB3279-196-Q1-K6-F7
ccacccgccgctcctcgagcacccccgtcccgcgccgcctccggctccggcgagatgtcacgcttcggtcgatccggcccgccgccgccgatccgcgacacgtactcactcctcgtcctcaacatcaccttccgcacaactgctgatgacctcttccctctcttcgacaagtacggcgagattgtcgacatctacatcccaagggaccgccggactggtgactcgcgcggattcgcgttcgtgaggtacaagtacgaggacgaggcacagaaggcagttgaaaggctcgatgggagattggtagacgggagggagatcatggtgcagtttgccaagtacggcccaaatgctgaacggattaataaagggagaatagtggagccagttccaagaccaggggggcgttccaggagtcacagtccaagacggaggtaccgtgatgattatcgagatgaccatgatagagattatagaaggcgaagtcgtagccggagtagagatagatacacccgtgacaggtacagggatagggattaccgccatcgtagcccgagtcgcagctacagtcctgatgattacaagaagcgtgggagagacagtttgtcacctgagcgaagagccctcgtcgtagc

SEQ ID NO: 9263 - DNA, 604 bp, Zea mays
  unsure (1)..(604): unsure at all n locations; Clone ID: LIB3279-196-Q1-K6-F8
ctcaaactctatgcctcccanaaaaatcctcccaccgcgacggcgacgagcacggggaccctccaccgcctccgcctccgcctctccgcgtgcggcctccgcaccgccccgacgtcgacccctccgccctccccctcggccaccgatgcgccgccgcccgccctccgccgccgccgccggcgcggcgggctcggcctcctctggaagctcccctacggccgcgcgccgtcccgcccgatggacgcgccgccgcctcttcagcgcgccccgtcgccgccgccccagccccagccgcccgcgccgtccaggaggtacggcgtgcacttctcggcgtccagcttcatccaggcgccgctcaccacgctgctcgagtactccggcatcctccgccccgatccaggcggcggaacccagcaggatggggccggggccgggccgggcgaggcgtcgatccggattgtggcgcccggcgaggcggggacgtcgtctgagagggccgaggaggtgatcgtggaggaggaggaagaggatggacacgcaacgagaacgcgcccggaggacccgtcacctgcggctggtggcggggagggcggcngggaatcct

SEQ ID NO: 9264 - DNA, 651 bp, Zea mays
  unsure (1)..(651): unsure at all n locations; Clone ID: LIB3279-196-Q1-K6-F9
tgagtatctttatctcaaaaggaacccgtcactggtgacttcgtttgccttcctttcctgtggatatctcctgagttcatatcaagaggtgagatctgttgtgctgaataccctaaacagagcgaggttcaccgtcgcagtagattccttcattaaaactggtcacattccctccttgaaggaaggaaactcacaggagacgatatttaatccaccttggcggcacgagacagtcgccataggttcaaggtttggagaagcatttcaagagccagcttcatttcttgccataagacccctgtttgaggacgagagatacatggtaacatataacccgacaaaggataaagtgtatgctttgctcaaggaccaagcaaaatcagatgacattatcaaagctgcttttcatgctcatgtgctactganttttattaatgcatcacatgcacggaggctgaagctgaagcagaagcaggcaaaccctgaccaatcagagcatctgtactctagaaacgtggatttcctggcgcacatagctgaatcttgcaaaattgtttcctcatcgtacggaacattcaagaagaaagcaagggaacagggttggataatgtcagaatctttgctcacccctggcaggctcgattatgtgca

SEQ ID NO: 9265 - DNA, 166 bp, Zea mays
  Clone ID: LIB3279-196-Q1-K6-G1
ctgtggcttcccccgctgctgatttgtttttaatggttagaccaggacccttcacgagcgtagaatttagttcttgttggtcatttatgtgctgtgcctgacggtgttcaatcagatagaggtgatggtttttttggtagatcaaatcaaggaatatttcataaaa

SEQ ID NO: 9266 - DNA, 259 bp, Zea mays
  unsure (1)..(259): unsure at all n locations; Clone ID: LIB3279-196-Q1-K6-G11
gggaaacaacgaagagacagggnngccannannggcnggngcagcaggngcnnnnggaggancananccacccnananngcccnnganccgagcnnnnacnccagancnncaggacagacancancancagnnccanccagggaaccnagnacnaanagagggngagaaaggccgcaaanagananngnngaagaggagcnngangagcgccagaacaagccnnagaagaaccccagagagaaccccagccagggaagc

SEQ ID NO: 9267 - DNA, 585 bp, Zea mays
  Clone ID: LIB3279-196-Q1-K6-G2
atcgtcgccctcaaattcgttccgtccaggcaaggaagaaatcgagcagccaaggagaggagaagatggctcgtacgaagcagaccgcccgcaagtccaccggaggcaaggccccgcgcaagcagctcgccaccaaggcggcgaggaagtcggcgccgacgaccggcggcgtgaagaagccccacaggtacaggcccggcaccgtggcgctgcgcgagatccgcaagtaccagaagagcacggagctgctcatccggaagttgcccttccagcgcctggtccgtgagatcgctcaggacttcaagacggatctgcggttccagagccacgccgtcctggccctccaggaagccgccgaggcctacctcgtcggtctgttcgaggacaccaacctctgcgccatccacgccaagcgcgtcaccatcatgcccaaagacatccagctcgcccgccgcatccgcggcgagcgcgcgtaggcgtatctcgcgcccggccccagtggcggcggagggatggaggagtgcaatttgtaactttatgctggttgttcgcttttagacggcgtggcgaagttgtgtaaaaacg

SEQ ID NO: 9268 - DNA, 547 bp, Zea mays
  unsure (1)..(547): unsure at all n locations; Clone ID: LIB3279-196-Q1-K6-G3
nnncgcaaatccaccgccggctcggctcgcccatcttcgcgccaagcaccgaatctccgatggcccgcacgaagcagacggcgcgcaagtcgacgggcggcaaggcgccccgcaagcagctggccaccaaggcggcgcgcaagtcggcgccggcaaccggtggcgtgaagaagcctcaccgcttccgccccggcaccgtcgcgctccgggagattcgcaagtaccagaagagcacggagctgctcatccgcaagctgcccttccagcgcctcgtccgtgagatcgcgcaggatttcaagaccgacctccgcttccagtcctccgctgtcgccgcgctgcaggaggccgccgaggcctacctcgtggggctcttcgaggacaccaacctctgcgccatccacgccaagcgcgtcaccatcatgcccaaggacatccagctcgcgcgccggatcaggggcgagagggcttgatctcccggtgggggcggccccgttggtgggcctttcgtgtggggctgtgggtggggggggcttggttgtggtggggg

SEQ ID NO: 9269 - DNA, 510 bp, Zea mays
  unsure (1)..(510): unsure at all n locations; Clone ID: LIB3279-196-Q1-K6-G4
ttcttgcgtccggtcagttcgttccctcctctgtgtaccggccagtaaaatccgaacccacagcgagaaatggcggcggcagcgctccgtccggcgatcctccgccgcatccgcctctccccctccccttcgctcgccctcgccgccgctgggacaggtgcatcccacccgcacgcgctggggcggtggctcgcgcggcccatgtcctcccacgacgcgcacctcacccgcgacgaagtcatcgaccggatcctcggcgtcctcaagagccaccccangatcgacccctccaaggtgaccccggaggcgcacttcgagaaggatctcgggctcgcccgcctggacaccgtcgnggtggtcgtggccctcgnggaggagttcacgctcgagatcccagacctggnggctgncntgatcgactcacttcctctggcgctcgngtgcgtcgccggccccccgctggctggctgggcctgtgctcgccccggggggggcgggttngggtggggc

SEQ ID NO: 9270 - DNA, 488 bp, Zea mays
  unsure (1)..(488): unsure at all n locations; Clone ID: LIB3279-196-Q1-K6-G5
ctacggccgatctgcgcctccaagccctgtcttccaggggcctcgtgtgactacatcatacgctggtccctgtggtnggccatggctctggtgagggcaangagcgtcgtcacgaactgggccgcaagaatctattggtcgccaccaatcgcccctggcttgctgagcgccggcgaccactcctgtggcgactgttcgctgtcagacacttggcatggaatgtcacttcatggcaagtgacagcattgaagagtgctaataaggagattgccctgtggttccccgagggccctgctgattggcagagcagccagcacccctggatctacgagaagtaaacatggaaagtttcacatcaaaccttgagagccagaggaagcatgtcaccatttgtgctttagcaatgttttcgaaaagattatgatctgtctcttggaaccttatttcaatggaccaaatttctttctttgccaacacatggctgaaga

SEQ ID NO: 9271 - DNA, 591 bp, Zea mays
  Clone ID: LIB3279-196-Q1-K6-G6
gttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggcgggtacggtggtggccgtggaggcggcggctacggcggtggcgggcgccgtgatggcggcggcggctacggcggtggcggcggctacggtggtggcggcggcggctacggtggtggtggcggcggctaccgcggtggcaaccgtggcggcggctacggcaactccgacgggaactggaggaactgagcggtggggcccgcgcggccaagttatcctgttcgc

SEQ ID NO: 9272 - DNA, 482 bp, Zea mays
  unsure (1)..(482): unsure at all n locations; Clone ID: LIB3279-196-Q1-K6-G7
catgcgtcttcgtactcgcctatctccgcgacccaaagcgttcccccttctcccattcttctctcatttctcaccaccgccgccgctaccccctttcgacaacaccatgagggagtgcatctcgatccacatcggccaggccggtatccaggtcggaaacgcgtgctgggagctgtgctgcgtggagcatggcattcaggctgatggtcagatgcccggtgacaagaccattgggggaggtgatgatgctttcaacaccttcttcagtgagactggcgctgggaagcacgtcccccgtgctgtttttgttgaccttgagcccactgtcatcgatgaggtgaggactggcacctatcgccagctcttccatcctgagcagctcatcagtggcaaggaggatgccgccaacaacttcgctcgtggtcactacaccattggcaaggggattgttggcctgtgccttgaccgcttcanggagcttg

SEQ ID NO: 9273 - DNA, 519 bp, Zea mays
  unsure (1)..(519): unsure at all n locations; Clone ID: LIB3279-196-Q1-K6-G8
cggtcgcgtgggctcacctggngaatcaacgaacccaaacagcgacgaatcagaaggaaaagtaggtctgcacaagattttgggttctaaggcagaggcactattgaacaagaaagggatatcatggccttggaaagggcgcgagaatgagggacctgatgaaagaaaccatgtgatattgccgtggttgcatggtggccaagagaatggtgtgaatcatcagaaggtttctgattctagtatatctccagacgcccaaggcgctgaacacaaccaacctagcaaaaatgaggcatcaggttcctggtcctctttcaacaataacagcacaggcagtgcaagcagcacgggaagcactaatagcagtgctctctacaaagtagatcatgaagcagattgtctggattatgagatcctgtgggaagaccttgtcattggagaacaaatnggtcaaggctcttgtgggacagtntatcatgctttgtggtntggttcggatgtggctgttnaagttttctc

SEQ ID NO: 9274 - DNA, 347 bp, Zea mays
  unsure (1)..(347): unsure at all n locations; Clone ID: LIB3279-196-Q1-K6-G9
cgcgtgntgacagtgatttngnagaagcagaagtnggngttgggggaggggtacaagaagaagaacctgctccccctcgacctccgccctaagaagacccgtgccatccgccgccgtctgaccaagcaccagctttctctgaagacggagagggaaaagaggcgtgagaagtacttccccatgaggaagtatgctatcaaggcataggtcagaactgtgagatgctgtgctttgcatatcatcggctgtgttttaatttttggtttgtatggacatttgttgtggctcggaagtacgatgtattcctctgttgccttataaatggctagattggtttgactggcaaa

SEQ ID NO: 9275 - DNA, 372 bp, Zea mays
  unsure (1)..(372): unsure at all n locations; Clone ID: LIB3279-196-Q1-K6-H1
gggggggggggggggggggggggggggnnggggggggggggggggggggggggggggggggggggggggggggggggnnngggggggggggggggggggggggggggngggggggggggggggggggggggggggggggggggggggggnggggggggnggggggggggggggggggggggggggggggngggggggggggggggggggngggggnggggnnggggggggggggggggggggggggnnggggggggggggggnnggggggggggggggggggggggggggggggggggggggggggggggggggggggggggggggggggggggggggngnngggggggnngggggggggggggggggaggg

SEQ ID NO: 9276 - DNA, 543 bp, Zea mays
  unsure (1)..(543): unsure at all n locations; Clone ID: LIB3279-196-Q1-K6-H11
ccacagtanaagacagtaactggtggcatgataaaggaacttctcatttctttcaagagagcaactggacagaagccccagcggatcatattctacagggatggtgtcagtgagggacagttctatcaagtattgttgtatgaacttgatgccatcagaaaggcctgtgcatccttggagcccaactaccagcctccagttacttttgtcgtggtgcagaaacgacatcacactaggctgtttgctaataaccacaacgatcagcgtacagttgatagaagcggaaacatactgcctggcaccgtggttgattcgaagatttgccatcctactgaatttgatttctacctgtgtagccatgctggcattcagggaacaagccgccctgctcattaccatgtcctgtgggacgagaacaagttcacagctgatgagctgcagactctgacaaacaacctatgctacacgtacgctaggtgcacccgctccgtgtcaatcgtgcccccggcatactatgctcatctggcggccttccgagctcgc

SEQ ID NO: 9277 - DNA, 118 bp, Zea mays
  unsure (1)..(118): unsure at all n locations; Clone ID: LIB3279-196-Q1-K6-H12
tgagggggtagggaaggggaagagtggagaagaggggggtgtgtggtaagggtatgnntggaagtggtaaggtagaangngggtgggggtgggggtaggggagaagtatgggtgtagg

SEQ ID NO: 9278 - DNA, 495 bp, Zea mays
  unsure (1)..(495): unsure at all n locations; Clone ID: LIB3279-196-Q1-K6-H2
gggtcgaccccgcgtccggnaacagagagctcctcaggatggccatgaagacctactgaatgttgaggccagaggttccagtggcatggtagatatcaatgtggcatcagcgataatgtttgtggtggttgcgtcatgcttcttaataatgctttacaaactgatgtcttactggtttgtggagctactggtggtaatcttctgcattggcggcgtagagggtctacaaacatgcttggtggctctgttgtcaagatggtttaaacctgctgcagaatcttttgtgaaagtaccgttccttggagccgtttcgcatcttactctggcagtttgcccattttgcgttgcatttgctgttgtgtgggctgtttttcgccagctcccctttgcttggattgggcaagacattctgggtattgcattgattgttacagtcatccaaattgtgagagtacctaacctcaaggtgggnntcggntcttcttggctgggcct

SEQ ID NO: 9279 - DNA, 348 bp, Zea mays
  Clone ID: LIB3279-196-Q1-K6-H3
taatcctgtgggaacattgccttctaggaggaagtgacctagtagatgggatgtgcacaccctagctggtaatgattctgactcaccctcgctcttctctatgtaatttcgtattgctgacacaattgtcgtgagtcgtgacaagtccgtatttcttttaggtgccgttcggttgtttgggattggtgggttggaacgattcttaaccggattgcttctctaatttatataaactttgattagggcttgttcgtttgcgccggattggtgggtcggaacgattcttaaccggattgcttctctaatttatataaacttttattaggtggaacggttcctgctgcaatc

SEQ ID NO: 9280 - DNA, 657 bp, Zea mays
  unsure (1)..(657): unsure at all n locations; Clone ID: LIB3279-196-Q1-K6-H4
ccccggngtcgacccacgccgtccgatgnaaaccgaagacagacacaacggtttgctttcaaatcatacaatccgaggtctcaaagtcgaagagggttaatcccctcccgttccactgttgcccaagtccaaccaccagcgagatggcggggaccgtgaccgcgaccgcaaccacggccaccaccgaggtcgggaccacagtgaccgcagccacctccgagatggaggccaccgcgaccgcagccacctccgagctggaggccaccgcgaccgcagccgccatcgggccgccttcagccatccccgataaatatatgcataaaaaccggttgcagtcatttgctgaacgaacatataagaaaacgccaatctacaaggttgagtctgaaggccagtctcatcagcctaagttcacatgcacagtggaagtgggtgatcaacagttctcatcaactggtagttttagtcgtaagaaggaagcagagcaggacgctgcgagagttgcttatgagatcttgacaacagttagtgagagtgacgttaaggaggcatttgagctaattgatcaggatgcagttttctgcaaatcaattctcattgaatttgctgtcaagacaaagaccactttgncctcttactctgtagtttgggtttggc

SEQ ID NO: 9281 - DNA, 269 bp, Zea mays
  unsure (1)..(269): unsure at all n locations; Clone ID: LIB3279-196-Q1-K6-H5
ctttgtcgggngccgcgtccgccgnacaagcgctaagggggcaagtttacctggccgatgacgctcgcgtgccgcccgcccgctggtgggcgccgccaccnnggcgcctctctccaggnagaatcgatctagnactcttcacggctcatcctgactggttggtcgtacccgcgcttttcctcactctctttacgtttttgctacccaatgtgttagtgtgatacgaggtncttatgttatttgaaaaactgncctctgtgcctggatac

SEQ ID NO: 9282 - DNA, 657 bp, Zea mays
  unsure (1)..(657): unsure at all n locations; Clone ID: LIB3279-196-Q1-K6-H6
caccagatgaagnacagttgccaccaccacctcctctccccccaatgcagtggaggatgacaagacaaacaacttcactagaagaggaaacttgcattacaactaaagatatggttangaaaaacttctagcctaccacatatacacacctctgcccaggaagaacactgtcctccaactgcaccattggatctacaagggcatgctggggaagtgggtgtccagaaaactggtggggtacgagaaattactaatcctcctagtatcattgatataaaatcaagtttgcttcagcagatcagggataagtcagagcagctgaagcttaatggacatgaaaggtcaaaaaaagcagtaggcggtgacattaaaagcttagacgaaagggaggagttgcttcagcaaatcaggagcaagaccttcaatttaagacgcacaaacgcatctaaggcagatggctcatcacaatctacagccagttccaacgttgcagcaattttggagaaagccaacgctatccggcaggctgtggccagtgatgagggtggcgatgatgatacatgnagtgatatatgaccacctaattgcagacgtgcatggtagtcttttcttgttattaagctattacaagatgaagtgattaaatgtgaataccat

SEQ ID NO: 9283 - DNA, 649 bp, Zea mays
  unsure (1)..(649): unsure at all n locations; Clone ID: LIB3279-196-Q1-K6-H7
cgggnatatacttattttggaaaggggacttggatctattgatgcggtcgctggcgctcatgctgacgtggtccgtcgccaccgtgctcactctcctcgccgtgggctcgccccatccaccacctcagcaatgctagaacggaaaaccaggttgtgcaaaagagtacttgcgactttgaaggtcttatggtcagtaatagaggatatgacgaagtacatatcaccagaggatgcaaaaagattgatatctaaagagactgtattttgtaatgtaacatttggtgtggtggatgcaattccatgatagcgaatggcataagatttaatgctaagaagaaacaagttggaaattattactctaccaaggtatatactagagcgaagagcgaacaacaatctaagattgcagcaagaaaggtccagcaaggatggagtcaggacttttatccatgcgagaaggaaccagattatgtacatgtatatgtgtggatagaactaaccgccgatattatcctaaatctaagcacggtcacccacaaaaaatgtgtaatttgcttcttcccagacatacgaaatgtgttatgcggactatgttggctattggaaagcattctaaatgccgtctgtaatgtttgatggttataaacta

SEQ ID NO: 9284 - DNA, 88 bp, Zea mays
  unsure (1)..(88): unsure at all n locations; Clone ID: LIB3279-196-Q1-K6-H8
gcagngggaaacnngggaaaaggaannnanggcnncnggagcggggcgggggnaaaaaaaaaaaaanaaaaaannnaaaaaanaaaaa

SEQ ID NO: 9285 - DNA, 462 bp, Zea mays
  unsure (1)..(462): unsure at all n locations; Clone ID: LIB3279-196-Q1-K6-H9
acccagccagccagcaacggcaaggcagcacccaagacacgcagcgcaggcgcagcccagccangancgacccgagnncgcgacgagaggcacgagaggcgangcggaccgcgcngacnncccnccccgcgcgccggcgcgcccctgcgccccccgcggcgacgggcgggcggggccgccncagcgacgggaaggggcgcgngcncagcgaggaggagcgcgccaaggagagcgncnacanccagaagaaggagagggagcggcaggagaagcncaagaagaggcncgagcaggagaaggccgacncngacaaggccaagcccgccgacaccgacaagaaggccgagggancnaccnagcnaggangggcanggcgcngnnggaaggcaancacgnnncgcaggganccgaanccgaggggcagcnnggggaangaaaaaanncgggaaaacgncaacagca

SEQ ID NO: 9286 - DNA, 600 bp, Zea mays
  unsure (1)..(600): unsure at all n locations; Clone ID: LIB3279-196-Q1-N6-A1
gaaacgaatagccatgcattctgatcaggaagagtaactccatttacacacatgggaggatctgccacaaacgtgtagacagcagcagccaacaccatataggtccccaagttaaaaaattcacgacacccacaaacttctccaatcacccacaaatacaggcattggcggtaaacgacgcatagcaagcacaacacctcgtcaaacagaccccaaaaagaaaaaaaaaagaaaaagggagaggaaagaagaaaatcaaaacaacactagtagtagtacagcccaccgttcggctacttgctgtttttctttttcagtaagctcccaaacttcttcagcagaggcttgttctttttctgctgcggctgctgcggtttcgtaggagacgttgccgctttagtcgncgtcgctgccgtatcctctggcacggncgttccgttggcgctctcggtgctgctgtccttcttcgggtctaactcgtctttggatggttctgtttcttgtctcctgttttctgactgtgctttcttctcagagctagctctgtctctcttctgttggctgngctcagccttcatctcctttcctcccccttgctga

SEQ ID NO: 9287 - DNA, 52 bp, Zea mays
  Clone ID: LIB3279-196-Q1-N6-A10
gaacacaatgactgatgtggagacgattataattactcgagtgttaacaaac

SEQ ID NO: 9288 - DNA, 560 bp, Zea mays
  Clone ID: LIB3279-196-Q1-N6-A12
tttttttttttttttttttttttttttttttttttttttttttttttttttttttttttttttttttttttttttttttttttgggaacaaggggggccttatagatataaactttttcatcccggtttttgggtctaaccccctcggggaggcaaccaagttccaaacttggtttttttccaaaaaaattttttggggtctggggggaacttgccctgacttgaaatttagggccaccattgctcccaaatttgttggaaggtcattattggttaaaaacaacactttcccttatgttttgggaagccttgctgacctttgttggggggggggggctttttttgccccaaattttttaacttggtctgttacattagcatcacttggggaattttggccttttagcccattttgaattttttaaaaaaatattgatggggtgacttttctttattttgaaaaacttttttttaaaaaaagcatttttccgagcgacaaacactttgaaagaaagaaaagggtcccccctgtttgaaatccggaaaattcaattgtgtgg

SEQ ID NO: 9289 - DNA, 469 bp, Zea mays
  Clone ID: LIB3279-196-Q1-N6-A2
gaaaaaaaaaaggggtttttttttccctttcaaaaaggaaagggacacttgggggggggccaaaacccaaaaaaacccttttcgcccctttgggggcccccccttccccgtttttgggaaaaaggggccggtaaaaaaaaaaaccccccgggccggggggtttttcctttttagggggattggggggccttttgggggaattttccctctttttccccccccgggggccctttttcccccgttttttggggcccaaaaaaaggttttttttgggggaccacccccccgggggggggggcccccccccccaaaattttccaaatctcttttttttcccggtcccccaaaaccccggggggggaaataaggcaagtttttttggggccctgggggtttttcccggggggctccaaaacctaagggggggggtttttgggcccccgccggagggtaaaagggggcccccggg

SEQ ID NO: 9290 - DNA, 516 bp, Zea mays
  Clone ID: LIB3279-196-Q1-N6-A3
atataaaaccaagaccaaatattgaaccaataactgactagtcactagattagtcaatgaagcaggtacagaaagttgtgacacaagtggttagcaaaagaaaagcaacagaacagctagcagcatttggctttttctttgctaatgcactaaactaacgacatcgcgaaactaatagatccccttcataaacacctgtttgaaacaacttaacatttaaaggcagcaaaacagtaagctaattggggacctaacacttgatttgctacctcgtggccttggagacagggtttactcatcgtcatcgttttcctcgtcactgctgccatcctcgtcattaacctctgacttcgagccatcctcatccttagtcttagccttctttgagcttgtgctcttcttcttatcaaagtttgccttagtcttctcatagtcctgcttcttctggccaacttggtccacatatgggtgcttctcttgatctgacataacacgccactttttccctgctggctt

SEQ ID NO: 9291 - DNA, 600 bp, Zea mays
  Clone ID: LIB3279-196-Q1-N6-A4
taaaactatcagcacgatggctgacatccacgcataattcaacggcacgatggccggcaatcaacaatactacatattaacctaatcatgcacgtatataattaacttaatattaaaactaatcatttcatataaatcatacacgtataacataaatcaagcaatcaccttggaggtttcgtcgcgggcgagccgacggggcgcgggcgagacgacggggcgcgggcgagacgacggggcgcgggcgagacgacgggtcgcgggcgaggcgccgggcgggcgagggcacggcggggaaacggcggggtcacggcgaggagtgcggcgggggcggtgggcgggggcggtttcatgtgtagtcctcttaggtttctacacatagtgtctcacaactttctccaaacattgtaaaatttttatcacagcctctacgtatgatatcatgacacgtggacaagtttcatgattttctgactttgtttgtgttttatacaatttttaaacatgtgcatgccaagttgacggtcatgtttagtgagcatgttgctcgaagtttccggtacgcttttgaaatcggtcgtaacttatgctaattacatg

SEQ ID NO: 9292 - DNA, 562 bp, Zea mays
  Clone ID: LIB3279-196-Q1-N6-A5
ctcctcactcctccacatcctcgcttcccatctcttttttgtctctgtctccctcacccaaattattcctgaaaggtcacctagagggggggtgaataggcaaatcttaaatttataatctttaagcacaactacaagccggggttagcgttagaaacaaagtcaagtccgaaagagagggcgaaaacaaatcacaagaaactgaagagtgtgacacggtgatttgttttaccgaggttcggttcttgcaaacctactccccgttgaggtggtcacaaagaccgggtctctttcaaccctttccctctctcaaacggtcacttagaccgagtgagcttctcttctcaatcaattgggacacttaatccccacaaggaccaccacacaattggtgtctcttgccttgattacaaatgacttgggaacaagaaatggggaagaagaaaagcgacccaagcgcaagagctcaaaagaacacggcaaaactctctcttatagtcactaattgctttgagtggaattgggacttggagagattttgattcaatctatatgtgtcttg

SEQ ID NO: 9293 - DNA, 420 bp, Zea mays
  Clone ID: LIB3279-196-Q1-N6-A6
ttttagatttcaacattttctccttatatatctatcattccctttgctttggaatcctacaattaaatgaattttggattgaccctggcatgatccgaaaacaagtcagcatgtaatatccaaacccttgtttagtttgtaataagattgaggcagacggccactgttcacacacgatacattcggttggttacacggcagggtttctgcaagtggaaatcagcagccagcagccttgaggaagttgtcgtaggggctcgacggtggcagcctaaggaacggctgctggacgtatacagcaacctgtgcctcaccggcactgatgctctgtaggaggaacgggtttgagctctgattgtcaggcacgactaccatggacgttagcttgttttgcttgaagctcatgaacagggacatttt

SEQ ID NO: 9294 - DNA, 532 bp, Zea mays
  Clone ID: LIB3279-196-Q1-N6-A7
cccggtaagacaccatacgtgctcttgggggtttcatttcagtaaaaatatacgtcctggcgcacaaaaacagaagtccagacgcagcaaagaagattacaatttttctttagcgggctcacatgaccctcacaggggaatcggaatgcacatgaaaattacaaaatttagagctcagtaggagtgattaggcttggcagttcctgtgacatgtccttgggaaaactggtgatgataaacattgcttaaagatcctcagggccattgacatccttgttctcaagtacgtctccatctggaatctccaacttcactccaggcttggcgataattgtcaccttgcccttgagtgtaattccagagccaaaccagacatcaccagaaaccttcaagctgtcaagctcaactatgctggggatggacttgaaccgaccaaggaaattggcaacctttttgaactcaggtccaagctcaattgaagggttagctggattcgctctggatgggttgcggatgacaaagccatcaacca

SEQ ID NO: 9295 - DNA, 563 bp, Zea mays
  unsure (1)..(563): unsure at all n locations; Clone ID: LIB3279-196-Q1-N6-A8
gcacaacattgcttattaaaacagtagactatatacagatcacttgcacaaagattgttactgaaagaaacatacaacttctcccacctggccaccctacaccctcaggttcgttgctgctaaaggtaacaatttccgaacaattgattcatacaaatgccgggacctcaataccagggcatgggcgtcttaatggcactatatacattcattacatacatagtcctaattactagctaagtagtcgaagaagaggcaaggcaccgtccatcttgcagctgaccgcttctttcttcaaaccagggacctgctaaataagccaatggatactcctaccaaacggcacgaacaaatgggaaatggcacgcagatgccagggtgcctcttccaggaggctcatgctggcaaggcagtccaaaagcctccaaaactcaaggcagttgaatgccaaccacaacttcagcccacggagcaaccgtgagcattcacccncataatcaaatgatggaaataacaaaattagagggacgttagcactctgcagtttttgttcatagtcattc

SEQ ID NO: 9296 - DNA, 445 bp, Zea mays
  Clone ID: LIB3279-196-Q1-N6-A9
aaagcaacagcaaaatttcggtatactctatttccttgtcagttttgtagtgttcatgagggctgaagttcaatacatataggacacctacaaaatttctctccaaggagcaaatagcataaacaacgctactttgttaagcacactggcccctgaatggaatttccgtctacttccctctgatcttgcagtaggcatacaatccagatcccagaaagcctagtccctgtccgataacattaaggagatcaaaaggaagaccaccaaatagcacccaaccaattccaacggtgaagaaatccttcaagttgccacacatagattgtgtgagtgcagaattcaggattgtgttccagaagatggtgtagttcagtagaaacgctaagatgcacgaaaatagaagcacaacctgaaacccaagagaatgaaggtatggaaattccat

SEQ ID NO: 9297 - DNA, 246 bp, Zea mays
  Clone ID: LIB3279-196-Q1-N6-B10
agaaataaacaatagttatagtttgaataaatatctcaatatctatttatataatatataacaaccgtagcgcaactggctagtacaacaaccggctagtacaacgtatatgaacggtctggacaatccagtttttgcccaattttgtagaaccatgttcagagaacaccgagagtatttgtagtctacctatacagatactgaatatatgatagagcataaaccaaacttctgtttttctgtgca

SEQ ID NO: 9298 - DNA, 85 bp, Zea mays
  unsure (1)..(85): unsure at all n locations; Clone ID: LIB3279-196-Q1-N6-B12
tgcacgcgtgcgtaagctgggattctttagagaggacgacctgtttatatgttnntacaaatggggcctgaggaagaaggtcttt

SEQ ID NO: 9299 - DNA, 318 bp, Zea mays
  Clone ID: LIB3279-196-Q1-N6-B2
gtgctgggttctcatttgatccccagttttcctcatcctgtcctttgccctaggcatgaatcaaacggccatacaagcagtcaacctattcaatttcttcgccaagtcgcacaaaatacatatacaccgccacaacactggaaaaacttgtctaaaaggcatctctccatgacaacgtgttatacagaaaagactatatcacacatcccacttaaggagctatcctcgcacaacacgaaagctaaaaccatatcgaagagcaaaatacatttacactcgtatatgcagttttctgcaatcgccaggcggggagaaaag

SEQ ID NO: 9300 - DNA, 549 bp, Zea mays
  Clone ID: LIB3279-196-Q1-N6-B3
gctgacaaaatgaatatccgataacgttaaaacatgtttgttttgtttagagtataaatcattacacttacattacatttcatacttacgttacatttaatgaaccaaacagcaccttagttcttactattactaaactccaaatcaacttaactattcccacaaattatgctgacgttcaaaatgcacgaacaacagcatatcggttaaatgcactataaaactccagtatccttaaagtacactatcatgaaggcacatcctccaatggatgtgcaaacagacaaaggcccggatgaaatgagatacagaaatcgatgttgtttccccttctcctcctgaccttgttactcatccaacatgacggcattcttccttacctgggctagacgacgttccttgtttaatctcaaagctctttctttttcctcttcagacctaaaaattttcttatcagtggacgacaaggtttcagttttgtcaaccttaatgtcaaagatatccctgagaagtccattctcctgcacatgcttcagaaagcctttcccc

SEQ ID NO: 9301 - DNA, 497 bp, Zea mays
  Clone ID: LIB3279-196-Q1-N6-B4
tatcccaaacaaacaattaatggcggggttgtaccacgcaaaagtatcttacaggaactgcctggatcattacaaggacagaaacttggatagatcttggcagattaacaaaaacttgcatgggtcttggtagattaacaccagttttcggttatgctattgggcctttagttcaggtttgtcgaaggcagctatgttttgaggctcacactctgggctaaagagccgcacaagcaatgctgatgtcgcgctcatagagactgctccgcatgacgcccatctgagactccttggaacagtgattcttggaccatagtgaaggcggcagagcacccagaaagccagaccaccaccgacggagaagatgcccgcagtctgccgcattaaccgggagcagggctttgactctggtcgcataacctacccttacgaccatactatagcccgtaataatgccatcttcaagtagggtagtctgttattgatcttcaaccaac

SEQ ID NO: 9302 - DNA, 522 bp, Zea mays
  Clone ID: LIB3279-196-Q1-N6-B5
agcataacatcccatcattacttcgctggtcattacaatgatgcgcagttgaaattttacagaacctcaaaatgggctgacgacgaatctccctctcgctatacgaccagtcaaataatatactaataaacacaggcggcaccagggtgcactccacataatactctgctgttactcagcggctacattaacaggaccatagttagatgatgatatctgcctgtttaagcagcggcaatacgaaagagcaactaactattcaactacgtcgtgctttcagactcgtttgtagaagaggacatatgcttggtcatgcaagacattcttctcgccaacgggcacaacggtgttgttgttgaaacgaagccattgcccgaagccatgctttgcgtgagcggtgtattgccccctgaaggggttcctaccatgatgagtgatggttgcaacaagctctttttttctaccctcttgtgttggttgagctcagttgatcacgactaataaccaattcggatggaaagt

SEQ ID NO: 9303 - DNA, 461 bp, Zea mays
  Clone ID: LIB3279-196-Q1-N6-B6
ccgataccaaagccaacattgagcgtggatacccgaccaactgattcgctgttctggtacaactaacaacttgttcgcacaagattaaaccagtgatcattgcacagcctgaaccaatgcagtgattcagttgcacggagggagcggcgtgccgcacaagcacttgttgtgcgcgtagcactttgccccgtgcatggacatgaaccttcccgccgggagctcgccgcaaagctcgttatagctgacatcgaagtgctccagcctcacgtccatcagtgacttggtcactctgcccctgaccctgttgtggcttaggttcagtaacctgaggtggtgcgggaacctgtccttcattaggtttaacttgttctggtttcacttcaggttttttttgtccctctgtttttttttttttttcaggtatctcttggggtttcccgttttgctgttttttctagagg

SEQ ID NO: 9304 - DNA, 215 bp, Zea mays
  Clone ID: LIB3279-196-Q1-N6-B7
aaaataggaaattgtaacttattaataatcacaacctttctacaatcatttacaatgtctgactattaccatctttggttggatttattgcctttttacacgaaacttgaaataaagcaatggttcagtgcgaggctgttaaaccaccggagcaggctgaggaactgtaggcctgtttttgtttgcaagaccaggacgatggttcgtaggatgtt

SEQ ID NO: 9305 - DNA, 204 bp, Zea mays
  Clone ID: LIB3279-196-Q1-N6-B8
cagggaaggcacggatacaactatattccaaaacaggggcgccaaatctaagaggcccattacaatccggttcgatttatgaagcaggcaagctagctactggcctttgtttacccgtcgagaacattatcgattttacagttcatacattggtcggggaggggaggggttgaggacactattaataacctttgtttgaagggg

SEQ ID NO: 9306 - DNA, 96 bp, Zea mays
  Clone ID: LIB3279-196-Q1-N6-C10
aaatctaaaaaattgttattaaatttgtacagttgtactgttttacctatgcttagtttatcatttggtaaaacactgtctatttttggttggttt

SEQ ID NO: 9307 - DNA, 163 bp, Zea mays
  Clone ID: LIB3279-196-Q1-N6-C12
acataaacttgaatcctctataacggacaacctttttttctttttttttttttttttttttttatttttttttcttttcttttcttttttttttttttattttttttttttttttttttttttttttgttttttttttttttataaactaaaaacaatttggg

SEQ ID NO: 9308 - DNA, 407 bp, Zea mays
  Clone ID: LIB3279-196-Q1-N6-C2
gagtaatgcctctgaagactcttaaaatctaggaaacatatttgcgctaatcagatttcatgctgctcagcaacaacgttagtttaagaaagctcctgaaacataacctagctcagatggatacattcaaatccaggttacaatagcattgccgtgcatcaagcccttcagttttagaattttgacgggcttacttgcagtggtacctagatgcacaccgtgacactttgtgctccgttggttactaagaacattttcgtttgatggcgagtgtctcggtgacttcagggcttaatttctttcccaagctgttttttgttttggtgtctgttccgttgttggtgtttctccggttttttctatttcttattttgagttctgttggtggtttttttctcttttttttt

SEQ ID NO: 9309 - DNA, 208 bp, Zea mays
  Clone ID: LIB3279-196-Q1-N6-C3
tccttataatgtcaatcggttaatattcttcttaaaatgtccctgattctgttggacactggacacattaagcaaaatgttatattccacggccatcaaaatgttgtggacagttctggccgcaggaagtccagcgggctaccagcttaacgaaccagagtcaactgtatgccagaatggcaattctctgaaacccgcctacgtcttc

SEQ ID NO: 9310 - DNA, 376 bp, Zea mays
  Clone ID: LIB3279-196-Q1-N6-C4
gggtattaaagaaacagcatcagataacgaaacgggcaggtggaaaccagacacaacgggcttcacaagggaatacatgggttcaacagggcccaatgggcctcaaaaggccattcatacttgcgacttgactggttttttaggggataaccatttggggtccggcacattcaccagtttggccagcttttaaccttgcttttagcccatgggatacttttgtgtccaggaacgtgcgggggactcatacttggccctgtcggtcttgtacatgtgagcaatctcaggagcaagaggatcatcagggtttgggtccccgagcagtgagcaaattgacaggaaaacctttgagattgttaaagcaggactccactgt

SEQ ID NO: 9311 - DNA, 206 bp, Zea mays
  Clone ID: LIB3279-196-Q1-N6-C5
catcacaatgtaagctaggttgtttgcttccctcccctgaccttctctacagctgttgagacctgtgttgtccgtgccatctcaagtgtcttcaagcaagcatgcggttgtgttgtttacaattttaacttgtacagtcgcgctacaccttcttcgtgcgtttaaacgtggtgttcttcttcatttgcccattgtcggtcatcgcg

SEQ ID NO: 9312 - DNA, 413 bp, Zea mays
  Clone ID: LIB3279-196-Q1-N6-C6
agtcaatcagcatatgtataatgctaaaggttcgacgaatacacatacagacggtcgaagaaacgaccaacccgtcaagcataaagttacgaccacggaagcaacctacagccaactctcactcggttaagattctccggcgagcagggttccgatctaggagcaccaacagtcgataggagttaagattcctttcgtgatgtgtagcttcaagaagtttttgccggctcatcggttattggccgatcatctttgttatgggtgatgttcttagtcctgtgccatatttggaggatgttgttcttattgtcccttgctaccacccatttcttttttgggtttctggtgaaattttagatcttgctggtttggtctgcctggttgaacatgttctttttgtggacccttttttt

SEQ ID NO: 9313 - DNA, 449 bp, Zea mays
  unsure (1)..(449): unsure at all n locations; Clone ID: LIB3279-196-Q1-N6-C7
accaaagggtgtgatagatcaaaactgcaaatctctcagcagtttcagtacagactcgaaaaggggaaagaaaaataagataccggacgagaccaaactagtngtaaagataaaagaccagcgcattaatcctggctgctgccacaccaaattataccaatcactaaggcggtcggtggcgccgacatggcttgctgcggcaattgccaattgccgcagccttcttcaccatctgtctctcttcattcgtcttctatggagcagagcagacagtcactgatcaaacacacatccaggggcagcagcagcagcaatccttgcaggtatcagcagagccagacgaagatgaacctcatgttcagtgaactttccaatacattcttaagcggatgccttctttaggggcttgaccaccttccaggtgaagttcgttgttttacggtcaaagt

SEQ ID NO: 9314 - DNA, 558 bp, Zea mays
  Clone ID: LIB3279-196-Q1-N6-C8
gtcaagagttttacgacaattttgtacattctcttggggccttggtaccgaatgaggggccagggttcggttaaatttacaagcacgttactggtctatcaccagcattaaccacacgaatgttccgcaaaagaatgggaaaagggaataattgtgaagtgatcacaggtttcacgaacaaaactgcatgaggttgcttatttcttctgaaactgaccaagaaccatggcctagacgtgaatgacaaggtactggtaaaacttgtccagcaaacaaggtgataaaatgaagggaagggtcatgtgctcctcattttgagcggaacttgccactgaccgactcataagttggcatattcagaacgtttgcatgagatgccattgtcaatggggatgaaatgatcttttttgttacagacgttgtgtctgttatagttacaccctctatagccttgagaaggtgctcattaggtttttctttgtccaaatgccaaaacttggcgccccatgatctctgtttgtgttgcctgtggttccaaatttttccgttttttttttt

SEQ ID NO: 9315 - DNA, 591 bp, Zea mays
  Clone ID: LIB3279-196-Q1-N6-C9
aaagataaccattatgcacataggaagcatgtctttttcatgttcgtatgtcaaagctctaacaagtttacattacttattttccttcttttttgttggagttttattttatctgtttttttttgtgatttttttttttttttgtgtttttgttttttttgtttttcgtgccgtttgttttttttttttcttttgtgttgttgtttttttttgttggttggtttgttgtcttgcgttttgttttttttttttttctttttttttttttttgtttttttttttttttttcttctcgttctcttttcttcttctttctcttttttgtttttttttttttttttttttgttttttttgtgttttttttttttttccttcctctgtttgtttttctttttttttttatttttttttttcttttccttttttttctttattttcttttttttttttctttatatttttttttcttttgccctttttttttcttttattttttttgttttgttttttttttttttttttttctttttttttttttttttctttttttagtttttctttttgggtttgttttatttttcttttttttt

SEQ ID NO: 9316 - DNA, 403 bp, Zea mays
  Clone ID: LIB3279-196-Q1-N6-D1
aggggaagatcacaaaattttctgcttgggttcaatgttttgccctctttggcctttgcctcctccagaaatttttaacccccaaggtgaagggaaaaattttctgcgtgccctggaactttttccccattgctccttttaaggggcgtcatgtggcttactaatctttccaaccctttttcgcccatcgccttggggcgagacctttggaccaagggttgggcccaggcttggttggcgtcccccgagcttcctcgtcgtccccgtcctctccccagttgttgtcccacttttcagacccatcgtcatgttcttttttgcctcccacccaaacccgcgagttttacctgttttgctttttgatcccccgggtcctcccaactggttgcgcccccttctggcc

SEQ ID NO: 9317 - DNA, 269 bp, Zea mays
  Clone ID: LIB3279-196-Q1-N6-D2
gggtatgacacgcaaattatattgatcctttcaagcaatacttagagcgccaggatacttatagtagtaccaccattctgaaacatagtagcgccaggacgaaatataggatcgtccaaaaacatatccttaacaagagtttaattcaataaaacctcggtgccagaacctagcagacttcacaaaagagcatacttagaacaccctgtatggcttccccatggtgctcttgacgtagaggcatctcacattctgcccccacgcgtccg

SEQ ID NO: 9318 - DNA, 594 bp, Zea mays
  Clone ID: LIB3279-196-Q1-N6-D4
agtcaagtgaacagaccctatattctccagaggaaccatacagggacagtcacatcaagcatgaatgcgtaataactacttaaccccactcaagttcttacaggaaaactgtttttgacagcaaaaagacttgtgtcaaatgttattttacgcatttacagactcagaactaagacgatcaatcatggaaaattagctcatgtagccgcacatctcactcggtttcatttgagaacaagcttggtgactttgtgattatatcattcgcctcaggtagcggtgaatcctttgcatcagctgcataaagtatcttccggaccgccttagtcatcggtagatgctctaactcaggccgttgacacagtatctcaatatcacgcaacttcgagaagtagaagtctctttctttttcagtactatcgacagaaactttcaggtctgcaatcttttcagacaacttctgaatctgttctatgtaatgctcttcagaaaaagtgttacatactttcccaactccatggcctccatctgttggatcagcaccagaaagcctattggcttgcaatgatttagatggcttattggaaccctttg

SEQ ID NO: 9319 - DNA, 276 bp, Zea mays
  Clone ID: LIB3279-196-Q1-N6-D5
agggagctgtacctcgaaaccacacacgcacggggtctaatattacatagaaataagacgcatttgtttaccactttcaaagatatccctggaacttggaacaaccggtgttcactgggggtcacgattccagaaccttaaagtcattaaaaatcacaaagaccggttggggccccagatgttgacccttttttttagcccattaaacttttaattactggtgggtcccatgacgggcccagtgaacactttgtttgaagaatgttccttttggag

SEQ ID NO: 9320 - DNA, 602 bp, Zea mays
  Clone ID: LIB3279-196-Q1-N6-D6
gcaactcgagtttcggcaaaattcgttctcaggcgacagtcgacaggcgaacagaggaaggtacagcgaaaatgcaaccaagctaaccagcctcagttccaacattatgaacagttgagaagctcttctacatgaagtgacaaatatattagagtaactgcaagttctaccacatatactgattagtcaaaggtgcccaaaggtaaagggaaccgaccacaggtgtacaaccaaacaattcagagtggtagtcatttagagacttcattccatggcaaatatctccagtctatttttatcaagcaaatggcaacggattaggactgaagtatgatggggttattacacaaagaacagcactgcgctctcatgcaccgctcgcatacaggcgagtccactccttggctgtttcaacagcttctacctcattggatttccagtgctttgcaatgttatcggagagagggtcatctggatttggtgcactcagtagagcctgtatactcaaaagaactgttcgaatctgaagtgctgggctccatttgtccttgagaatgtcgaggcatatcctaccaagcttgtcaatgttgggatgataaatc

SEQ ID NO: 9321 - DNA, 547 bp, Zea mays
  Clone ID: LIB3279-196-Q1-N6-D7
tttaatacaaaagagaaaactttttttttttggttgggttaaattggccccttcacacaaaaaatgttttcattttgttttaagacctttttgaaaattcaaattttttttccagtgttaaaattatttgggttccttttgttgggaggattttttttttcacggcggggggcccaaaacctttttttttaaagggggacatttttgtggtttttttacaccggtccaaaggttcttgttattttttgattcctggaaaattctttttttcaaagggttattattattccttttgggataaagggttttttttaattttttttcccctttttttttttttattgggctttcctttttaatttttttttttatttgattttctttcacccatttttttttttttaatttttttttttttttccccctttttttagttttttttttttttttatttttgtttttttttttctccttttatttttctttttgttttttgttttttgtattttcttttttttcgttgtttttttttttcttgttttttttt

SEQ ID NO: 9322 - DNA, 161 bp, Zea mays
  unsure (1)..(161): unsure at all n locations; Clone ID: LIB3279-196-Q1-N6-D9
gatcaaagacaagtngctctactcaaatatgtgattgcgcctacaaaaactttcagagttaggtcaagaaatgcttaacaattaaaaagtactttgttgttgatacaatatggtttctttttgaatggtactcgtccacactctaaaccaaatgagtgacc

SEQ ID NO: 9323 - DNA, 361 bp, Zea mays
  unsure (1)..(361): unsure at all n locations; Clone ID: LIB3279-196-Q1-N6-E1
agtgaagcttctttactattattactagagaacaactgaccgcagttgattagccatggttctctacaaactcaaaccagcacttaaaacaatataccattatttctgacaaaaaatataccaatgaggcagtgaagataatgtacaccacaatattnnctctgattgatacatagcctagtcctagcatacagaagtgatgtccaaaactgggatgtcttagttgtcgcagaatgcatgtagggtttcatcgagtgccttccccgggtaatcccccggtaatacacagtaccctagcggttcttttcgaaggatgagttttaacagaccatgagtgtccttgttgtggacaggcctgatg

SEQ ID NO: 9324 - DNA, 294 bp, Zea mays
  Clone ID: LIB3279-196-Q1-N6-E11
ggggaaacctttaaattccaaaaaatttccttccaggttttggtttttagggtttcctttttaatttttttgggccggtttttgggctttttttgagcccccccttccgggggaagggttccggcattccgggcggtccaccgattttttccaattccactgtttgggtcccccgggtattcctaaggcccggttcccctccagggccgtggtggggcttacctccggttttcggaaacccctggggcttttatttcctttttttggaaaaattttttccttttttaaccattt

SEQ ID NO: 9325 - DNA, 559 bp, Zea mays
  Clone ID: LIB3279-196-Q1-N6-E2
cagccacctcccatccatcataccatatcaatagctaagaattacaaattataaagcacaaacaaaaggacaggacaccagtccaacataattcacataaataaatatgaaggattattggtccaactaaatatactaccttgtctccatgtcgaacataatgtataagaggatccatagtaattgcagagttcccataaggctcatacatggataaaataggagtttgttccaggcatcatgggggttctagacctgcctaaattctggcctaggttcaaaatccacgatgctatatcccagtcgcagcaagaaaagagcaagggagctagtaacagcggtaggtgcggtggcaaacgcaccagtggatgacaggaccagagacaaaattcaagcttaaaaaccctttttttcagctcctgatcagttctctggtgcttttttaactgtgattcaaggttcttggttttgttcgtccagtgagtagacaatattctgatttcccctctcaacatcgaaatttcaaaagctttggcaacttcatccatgatgttggtct

SEQ ID NO: 9326 - DNA, 511 bp, Zea mays
  Clone ID: LIB3279-196-Q1-N6-E3
acgaaaaaccccctcagctgtaaaactggggaacgattctttcttcttttcacatgcacggaaagttgggtccttattggcgtacaaacaaacaaggcaaagagcaggagccacgccggggaatttggtcctgctgctccaacaggcgagacggcgacgggtggccagaacaatgcagccaaatgatcataggaatctacagtttcttcgggggtggtacgaggctccctacatttccgagctcctcatcttctcgctcacggtcgagccgaacgacggcccgcccttcctgttagacaccaggttctccaccgggtacccctttagcttctgaggcatgatgctgaggtcttcgaaagtcagagcatcttccgatacgaggttgttcacagcaaatgcgttgatttggtctaggttgaaaatggatggtgttggaagcgggaacggctctttattgagcagtatttatcttggggaagcaattgcccttgctacaggttgagggacattg

SEQ ID NO: 9327 - DNA, 469 bp, Zea mays
  Clone ID: LIB3279-196-Q1-N6-E4
tttttttttttttttttttttttttttttttttttttttttttttttttttttttttttttttttttttttttttttttttttttttttttttttttttttttttaaaaaaagcccccagggcttttttttaccgggggggggggaaacggggggcccaaaaaaaaaaaaaagggttttttaccccccgggttttaaaaaacccaaaaaaaaattttggtttttgggggggggaaaaaggcaaaaaaacttaaaaaaagggccgcccctttgtaaaaaaaaaaaaaaggcccccggaaaaaaaaaaaaacccccggggccccccggggggggggaaaaaaaaatcctggggggaaaaaggggccaaattttaaggttttaaacgggcccggactttaaaaaaagcccaaaaatttccccctttagggccccacaatcccccaaaaaaaaaaatatggggggggggggtt

SEQ ID NO: 9328 - DNA, 577 bp, Zea mays
  Clone ID: LIB3279-196-Q1-N6-E5
agaaaccgcaagctcaccattaccgacagaagtccaccacaccaaagcagctggcgaacaatgcgctgcttcatgtaacgtgattacataacttctagctgacccgaagaagtcgcatttttttttgaaccgtttagaccaccccaagaaacaatcagaagagaaagtagaccccacatcacatacctaggattaacaccgacttacaagctttgcctatcactagctaccataaacctttccatgcagctgccatgtcacgaccagacttgatttcaaccacctgcgaaagcagcagcgccatggacaaaagaggacagcagcgactcacttgatgtactgagacatccatttgaagccttcgccatagcccatcttgcgcaccacactgcacatgaagatctccaggggccggacgttggagtcggccaagttcacgttgcccttcccggttgtgaagttgctcaggccgaggtagtacctcagctcctcctctgaagccgcgtatgggatgtcaatcttgttgcccagtatgaggaaaggaacgtttgcaagggagtcatctgcaagaagcgca

SEQ ID NO: 9329 - DNA, 610 bp, Zea mays
  Clone ID: LIB3279-196-Q1-N6-E6
ctgttcccaatcaactacattactcagtaattttaattgtgcactgaaaaccaaaaccgcatataggtctcaaaaaactctaaacattggtaaaacaagaaccgatacgactgccagcgacataaaagtttccagcgcagagtgcaccaggatacaagctcagttcaacggttggccttggcaacacgctcaatctcgtccttcttcttgatggcgtaactgttggatgagcccttggcagcgttgatcagctcatctgcaaggcactcggcaatggttttgatgttccggaaagcactctccctggcaccagtggtgaggaggtagatggcctggttcaccctcctcaggggtgagatatccacggcctgcctcctcacaacaccagcggaaccaatacgggtggcatcctcacggggtccactgttgatgatcgcgtcgacgacgacctggatggggttggcatcggtgagcaggtgaatgatctccagggtatgcttgatgatgcggacagccatgaccttcttgccgttgttgcgcccgtgcatcatgagggagtttgtaaggcgctcaacgatcgggcactgcgccttgcggaaccgcttcttgg

SEQ ID NO: 9330 - DNA, 449 bp, Zea mays
  Clone ID: LIB3279-196-Q1-N6-E7
gaggaaccaagcacagcatagacgaacattgcaattacttaataggtaggtcgatattagcagcaaataaagctccatcataataggttcacaaaacgactgactgatttgtcttagcacaaaactctggatatagctagaaaccacgatagatggcctactgaagtgcaggtttccaagacgagccattggacccatggcaaacggtgacgacgaactaggatgtgacatctctccatgaactcacgcatcgaagaaacgtaacacaactatgccgacaccaccatccacaatccccatcagcctacttggatctctgcctcatctttcggcgcttcctcttcagcctcctcatgcgcttcttcttccacttggccctcatagtcgcctccttgcgggctctccttggcgcgtctcctgctgctgcgtcggcggcgcccacgcgtccg

SEQ ID NO: 9331 - DNA, 495 bp, Zea mays
  Clone ID: LIB3279-196-Q1-N6-E8
ggggtacaacatatgaattttattggtacaaaaattgttgttaacaaaaaccttgtttattttttttttgttttgttatatatttggttagctttttatgtggtttcatcttggtttccttctttttattcattggtttttcggtctctttttttttttctgaagtcttcggtttcctcttttttttttttgtttttatttcttttttctttttttgtttggtctttttttttttttttttttttttttttttgcgcttcctcttttttttttttttgtttttttttttttttttttgtttttttctttttttttttttttttgcattttttccttctgttttttttgttcgtttttttttttttttttttttttttttttttatttgtgtgtcgttttttttttttatttttttctttttttttttttttttttttttctttattgtttctttttctctttttttttttttttttttttgtttttttttttttt

SEQ ID NO: 9332 - DNA, 597 bp, Zea mays
  Clone ID: LIB3279-196-Q1-N6-E9
aaccaacacacagtcgtatgctaatattcctcataacaaaacattagctagtgtacaacatcattcatgtccacgagaggtacttgtatatgcacccagagcactttcccttcagctgatcttattaacggccgtacaaaaggatgcttagcagtagcacgcgtaggcaaggtggttcttgttggagatgtaggtggagatgaagtctgacgcatgtgtcgaggtgctggactgggaaggcacaacgatctgggtgcgtccggacgcgatcctcttacccgtgacatgcccgtagaacaggccagcgacggcagggacgaacacgtcgctctgcgaacagatctcaaggtccagagcccttgctaggtctgcattgctggatttcaggaattcagctttgttctcggctggcataatgtcacccttataccaagtgtttgggaattcttccttcagaacatccaggcctttgtaccacgacgtctctgtcaagtagatggttgtgttagcagagaagccaacactcctcaggaaagccaggacctcatcagggctataacagccttttcttcgagcgccgcggggttgtcttgcaac

SEQ ID NO: 9333 - DNA, 334 bp, Zea mays
  Clone ID: LIB3279-196-Q1-N6-F11
gaacgaagggaagacacgaattgtacatcctccatctttctattatcgaatcaattaacagccaaactctctcgttagggagagagaaaaaaacaagaatacgtttgtacaatcctacgttttcgttcttcacaccaaccccaatccagctagacccaaaagaagccaggaacccagccaatcaaattgtcaccggtcgatccgggtgggttgcttccgtgatccaaattacagtgcgatgttgaggccctcggtgttcgtgccgtcgagtccttaccaggaggtcggtttctgcttctacaaatttttagatggggacgggtggttttttggg

SEQ ID NO: 9334 - DNA, 176 bp, Zea mays
  Clone ID: LIB3279-196-Q1-N6-F12
aatcaaaacgatttttttgttcagtgtcttcatttcagtttgtgtattctgaaaaaaaaaacaagtaaaaatttattttgtttacaggtcttatttcgtggttgctttcttggttaaacataagtcttttttcttttgttttctgttcctttccgttccgtttcagtttttttttt

SEQ ID NO: 9335 - DNA, 410 bp, Zea mays
  Clone ID: LIB3279-196-Q1-N6-F2
ccgccccgggccggggggggggggggggccccccggcgcggggccgggtgggccggcccgttgggttggcccgggccttctggcccggtccggggggggtccccccttttgccttttggggggcgaatgggggcccgggggggaaatgggaagggctgtgattggggggaatttgtttttccgtttcttttcgcggcaaactgggggggggggtgttgggtgggaaaccccccgggtgcctcgtgggggctgttcacccccctttagtggggggggggcctttgtgcccttttgggggcggggttcgtgtttgtcccgcgtgggtggtggtgttcggatttggttgggggggggggggttttgtcttttttttgccgcgggggggggtttttttttttacttgggggggg

SEQ ID NO: 9336 - DNA, 463 bp, Zea mays
  Clone ID: LIB3279-196-Q1-N6-F3
gaaaaaatcgctttaaaattttttttattcaaacaactgggaaaaatttgaatgcagtcaaaaattttggtttattaaaattccgcaatccgtttttttaaaaaattttttgagctaaaacttaaaaaaaaaccttttcataataaacttttgaattaaaaaatgaaaaaacttttccaaaaaattaaaaaaaaaaaacccgtgtggcaccaaaattactggtcctaactttgtcaatcgacaccatggaaaaaggggggatttttattccttccacaaaacggttccaaacgatttaaaaaatatattgatcggtggaccattaggtttttattttttttgtttttttttcataaaaaatggtttcttattatcttttaaggaaattttttttcctctccttttttcaatgtttttccctttttcgattttttatattttttttacaattcctttttttttt

SEQ ID NO: 9337 - DNA, 449 bp, Zea mays
  Clone ID: LIB3279-196-Q1-N6-F4
gggggggtaaaaaaaattatttttatggcccgggccttcccttttggttttttttcccttctccaagggtggggctaacactttcctaatcctttcataaagctggttacgcgaacgcccgaagaaaaaaaaaaattgggaaacggggctgtttaaactggactggggattttgtttttttaacttatgacaaccgcttctttttattggcaggacaaagcaggccggaagccaaatttatgggtgggcaactcccgcagcggggcaagcgacggggggggggggtcctggccggagggggggctttggcggtgctccccctcgtaggggacaatcagcattgacgggtcgggggggtcgccctccacatgctttcggggggggcagccgcgccccgtactgtatttgtagtagccgcgtgggtagggcgaccccttgatgggtttttg

SEQ ID NO: 9338 - DNA, 545 bp, Zea mays
  Clone ID: LIB3279-196-Q1-N6-F6
ataaaaacatcatagccttaacagtacttccatcaaacagaaacatgagtattcatgagcaacatgaccaaattgtaacgcaaacagtctgccacccaaaaccacaaataaaaaaaaatccacaataagatgtctcttggacagctaaagtttggttaactgaactgacaatagaccaagaaaagaagctgacgacacctaggcctcccactgcatctttcaggccatgatcttggccgatctcatgtacaggctgtccacaaccttgccaacattcgtgatcgtttcaagtgtggcagggaagatctcctcagtcttgctgtcctcgaagatgatgaggcagccagcgccttgatcaagtgtccctgcgaatttcttgtcgaggatcatctgggacagcttcttctcaacatggttcattggcagctcaatcatctctgctatgtgagcaatctccacccttgagtagggctcaatcagcctgcagaggttctgctcaagagagtgttatacagcgaggaaaggtgcctgtggacaataggatc

SEQ ID NO: 9339 - DNA, 93 bp, Zea mays
  Clone ID: LIB3279-196-Q1-N6-F7
tttgcgcagataatgtcaacttgaacagttagctacgtgcatgtggaccgggtgtgagtcaggtcatccatactgtcttatgttacttgaaag

SEQ ID NO: 9340 - DNA, 175 bp, Zea mays
  unsure (1)..(175): unsure at all n locations; Clone ID: LIB3279-196-Q1-N6-F8
atactcaccatttctatttacgtagtagntggtgcgtataaggtcaggttaaaaattcttaggtgcttaagcattccgcgagtgcctatacatgggatgaaaatgtgctcaattacagttcacaaccatgttcgcctttagttttagtttggttgttcacttttttagttctcgt

SEQ ID NO: 9341 - DNA, 608 bp, Zea mays
  unsure (1)..(608): unsure at all n locations; Clone ID: LIB3279-196-Q1-N6-F9
caaaaactctgaccgtcttattcaaaatatttattcaaaaatgtaaaattttaagtcaatcacaaactatgatgcctagacacgaaagagatggaacttacaaatagtaaaactcttgctcttcctagaatttggtagtttcagattcacgcctattgctgggaaccaacatatgttagttcagctcctaagaactgagcatcctgtctggttagaaaagttagtctttacaaacatgagattggtatcatctcatcgacactgaactgaaacagtagattcattgtggttttgctgcacataatcgagccttgccagggttgagcaaagattctgacattatccaaccctgttcccttgctttcttcttgaatgttccgtacgatgaggaaacaattttgcaagattcagctatgtgcgccaggaaatccacgtttctagagtacagatgctctgattggtcagggtttgcctgcttctgcttcagcttcagcctccgtgcatgtgatgcattaataaaatgcagtagcacatgagcatgaaaagcagctntgataatgtcatctgattttgcttggtccttgagcaaagcatacactttattcttt

SEQ ID NO: 9342 - DNA, 166 bp, Zea mays; identical to SEQ ID NO: 9170
  Clone ID: LIB3279-196-Q1-N6-G1

SEQ ID NO: 9343 - DNA, 260 bp, Zea mays
  Clone ID: LIB3279-196-Q1-N6-G11
agcttttcaccatgaaatagaaatttctatcacccggggataaaaagacgggcggattcctcttgttggctttccaaaaaaaaaatccatgttggacacgctcatgcaagctgaaaattgttacaaaccgcactcggcggttttcaaaatctacaagcttcggtaatgaagccgtttggtctttgctgtcactatttgcggtcccgtttcattagagttcactgtctccatctggtgtttcttactggttgtttcttttt

SEQ ID NO: 9344 - DNA, 541 bp, Zea mays
  Clone ID: LIB3279-196-Q1-N6-G2
tggcaacacgaatcatcagtcttttaccaagatcgcttcgggacgaagcggtacacgaactaccacacaaaatagacttgtaaagccgtttttacactacttcgccacgccgtctaaaagcgaacaaacagcataaagttacaaattgcactcctccatccctccgccgccactggggccgggcgcgagatacgcctacgcgcgctcgccgcggatgcggcgggcgagctggatgtctttgggcatgatggtgacgcgcttggcgtggatggcgcaaaggttggtgtcctcgaacagaccgacgaggtaggcctcggcggcttcctggagggccaggacggcgtggctctggaaccgcagatccgtcttgaagtcctgagcgatctcacggaccaggcgctggaagggcaacttccggatgagcagctccgtgctcttctggtacttgcggatctcgcgcagcgccacggtgccgggcctgtacctgtggggcttcttcacgccgccggtcgttggcgccgacttcctcgccgccttggtg

SEQ ID NO: 9345 - DNA, 590 bp, Zea mays
  Clone ID: LIB3279-196-Q1-N6-G3
aaagcacattccatttccattaagatagggggaaacgccacttcagaggcaccggtgcaagaacaagcagattagaaaatgcaactcctaacactacgaacaccatcatgcgaacagaaggaaccgaacagaagcaaggattctacaagcagagacacagaggaaaggcccaacaacgtggacgacaacaacgggagatcaagccctctcgcccctgatgcggcgcgcgagctggatgtccttgggcatgatggtgacgcgcttggcgtggatggcgcagaggttggtgtcctcgaagagccccacgaggtaggcctcggcggcctcctgcagcgcggcgacagcggaggactggaagcggaggtcggtcttgaaatcctgcgcgatctcacggacgaggcgctggaagggcagcttgcggatgagcagctccgtgctcttctggtacttgcgaatctcccggagcgcgacggtgccggggcggaagcggtgaggcttcttcacgccaccggttgccggcgccgacttgcgcgccgccttggtggccagctgcttgcggggcgccttgccgcccgtcgacttgcgcgccg

SEQ ID NO: 9346 - DNA, 606 bp, Zea mays
  unsure (1)..(606): unsure at all n locations; Clone ID: LIB3279-196-Q1-N6-G4
gtcaaccagtatatatagatataacacgcacacaaaaacaacaatctaacgctgaaaatgttaatgttccatttcgacatcatcatccgtcaccgtgaagcaatgcagagcaccaagaacaagtttttctgtgccactccagcagattatttgccctcggaaacaaaaccaagcgaagcctcacctcaactcgcctcctctcgggcgagcagaggctcagccagccatggggtggttggcgacgtactcgatggccagagggagtgagtcgatcttgtcagcctccatgtctgggatctcgagcttgaactcctcctcgatggccatgaccacctcgacggtgtccaggctgtcgagcccgagatccttctcgaagtgcgcctccggggtcaccttggaggggtcgatcttggggtggctcttgatgacgtcgaggatccggtcgatgacttcgtcgcgggtgaggtgcgcgtcgtgggaggacatgggccgcgcgagccaccgncccagcgcgtgcgggtgggatgcacctgtcccagcggcggcgagggcaagccaagggagggggagaggcngatgccgcngaggatcgccngacggagcgct

SEQ ID NO: 9347 - DNA, 341 bp, Zea mays
  Clone ID: LIB3279-196-Q1-N6-G5
ggcaaagaaagaaatttggtccattgaaataaggttccaagattcagattattatttttttgaaaacattggttaagcccaaatggggacatgctttctttgggttttaagggttggttttaaacttttccttttttctttttggtgatcccggggtgcttggtttttttgccattaagaggggcctttggggaccacagggcaattttcttttttgcccttttaattgttgcactttccttaattacatttcttccaattttgacaggcaaatttccaccgattgtgcccggctttaaaaccccggggtttgtggggcccatttttttttggcccctttt

SEQ ID NO: 9348 - DNA, 569 bp, Zea mays
  unsure (1)..(569): unsure at all n locations; Clone ID: LIB3279-196-Q1-N6-G6
gcagcaccaagaagcaccatttttttccttaggatttaacttagaataaagcctgacgggggtaacagcacccatcgatccgcagtccatgctggttgatgcatgggtctgctggagccgaggatgaacacagcactaacaactgacacagagcgaccttcaatcaaaaacacagatgggcaacaacaaacacgagacgaacgaagataaacactctggactagggtaaacaacacggtagcgaacaggataacttggccgcgcgggccccaccgctcagttcctccagttcccgtcggagttgccgtagccgccgccacggttgccaccgccgtagccgccgccaccaccaccgtagccgccgccgccaccaccgtagccgccgccaccgccgtagccgccgccgccatcacggcgcccgccaccgccgtagccgccgcctccacggccaccaccgtacccgccgccgccgccgtctccacggncgccgcgggactgggcctcgttgacggtgatgttgcggccgtccagctccttgccgttcatgccctcgatggcgttccgcatcg

SEQ ID NO: 9349 - DNA, 582 bp, Zea mays
  Clone ID: LIB3279-196-Q1-N6-G7
ttttgaaagcaaagcatctcagagatcaagaaaacaataacgccaaacttaataacccagtagcaaagcgggggaataaagtcttacaacgtaagttgtaaaccacacaacgacagatagataagaaccgacagaaacataacacgataggagccactcagggcagatcacaggatagcagtggcacacaagcccgacgacgccgcgccagtagagcgtctagtactcgtcaccctcgtcgccgtcctcaccctcgtcaaactcagcaccgacctcctcgtagtccttctcgagcgcagccagatcctcacgagcctcggagaactcgccctcctccataccctcaccgacgtaccagtgcacgaaggcgcgcttggcgtacatgaggtcgaacttgtggtcaatgcgggagaagacctccacaacactggtggagttggagatcatgcacacggcacgctgcaccttggccaggtcaccgccggggacgacgctgggaggctggtagttgattccgcacttgaagccagtcgggcaccagtccacgaactggatggtgcgcttggtcttgattgtggccac

SEQ ID NO: 9350 - DNA, 424 bp, Zea mays
  Clone ID: LIB3279-196-Q1-N6-G8
caaggaaacgcaggctttttaaaattttaagatttttcttcattgattaaacttacaattaccctttatcacaaccgtttacattttccccccattttttttagagcaaacaattttaaaattatttttccctttttcaaaaacaaaagccccggtttggtttttttttttaaccaccctttttcttttccccgaattaaaaaaacccaaattccccagcaattcggagcttaagcacttctcacttttttgtctttaccctacccttgggtgttaggacccaaagatttcagtcacaattgccctttaaaacaaaaaaaaaagtacccccgtttgtacaaaaaatttttttcaaccttggttgttccgcagaagcaaaaccttacagtacaggagggtccacgcccttttatagacctggggt

SEQ ID NO: 9351 - DNA, 284 bp, Zea mays
  Clone ID: LIB3279-196-Q1-N6-G9
tttgccagtcaaaccaatctagccatttataaggcaacagaggaatacatcgtactttcgagccacaacaaatgtccatacaaacccaaaattaaaacacagcccgtggtttgccaaggccaacattttaaaagtttggcccttgccctggttggcttcttccttatgggggaagtccttttaagcctttttttccttttccgctttaaagaaaggcggggcttggtcaaaccggggggggttggaccggtcttcttaaggccgagggccaaggggaacaagtt

SEQ ID NO: 9352 - DNA, 522 bp, Zea mays
  Clone ID: LIB3279-196-Q1-N6-H11
gaaacaaacacgaccataacatagtggcgtggttacaacttacaacaattggttacaacttacaacaaatagtttacacatcatacagcactaaagctcctcgaaccgcagcgttacaactcacgaataaaaacaggcgttacttaaaatccccagatcactggaagtcttaatgcataaattcggtgtcagatagtatcaccgaaacagtgcgggtacatggaacaagtcaggatattttcttggtgaaggtagctcagcatttcagcagtaaaacatgacacgcttcacgttttccttgagagcaggtaggggcctgaccgaaacactccccgctcctttaatgctgcgtgccgcacctggtggagggccacgggcaccactggccattgagccactgtcagaggtatctggctccatgtagaagcgagctcggaaggccgccagatgagcatagtatgccgggggcacgattgacacggagcgggtgcacctagcgtacgtgtagcataggttgtttgt

SEQ ID NO: 9353 - DNA, 363 bp, Zea mays
  Clone ID: LIB3279-196-Q1-N6-H12
gggcccaacccaggttctttaaatttaagggggtttttttggggttttcccaccattttttgtttggttaaaaattttgggaacagttcttgttgttttttaaaaagcccaaacttgggggagtttggccaaaacaacagtttttttttttgaaaagggttaaacccatttttttgtccgacttctttttagggttcggagcctttttttttttttttggagcaactgttgggcccgagttaccaacaggaaccggggggggaaaaaaaaaattgtttggggccttgagggactcctttattttgtcaacatgtgggttttaatagtcttttttaacagaaacaacaagcacattttttttcc

SEQ ID NO: 9354 - DNA, 124 bp, Zea mays
  unsure (1)..(124): unsure at all n locations; Clone ID: LIB3279-196-Q1-N6-H2
cttaaaaaagaatggggagtntttctatgctgctgctttgcccggaatattcctttttgtttgtccggcttaatctattggcgggctgttccctacatgcatgggtgcccattgggctgttgtt

SEQ ID NO: 9355 - DNA, 373 bp, Zea mays
  Clone ID: LIB3279-196-Q1-N6-H4
agataaagggtgttaccattcgttcgttttttttttggtggaaactgatccagccgaattgttatgccgttacaaaatgcagtggtttcgaattaaagttaaggttaaaaaagcaacctacaacgatttgcagtggtttgggcaaacaacatgacaggcagaggttccaagacgaattgaatgccaaaaggttgaccacaggatcctagatgttgatggctgagaagttaatgacccttggcaacccatgtgttgatgccttctgcttcttgaactttgcccttgcgcttttttgagcgactttcatttgctgacgatgggttcacagattttccaactggaggttcaacatttttgcctttttttacagttt

SEQ ID NO: 9356 - DNA, 231 bp, Zea mays
  Clone ID: LIB3279-196-Q1-N6-H5
atccaggcacagagcagttttcaaataacataagacctctatcacataacaattggtagcaaaaactaaagagatgaggaaaaggcggttcgacaaccatcagatgaccgtgaagagtctagtcgatctcctggagagaggcgccggtggcggcgccaccagcggcggcggcagcgacgtcatcggcagtaaacttgcccttagccttgtcggcggcgcggccccgacaag

SEQ ID NO: 9357 - DNA, 433 bp, Zea mays
  Clone ID: LIB3279-196-Q1-N6-H6
aaaaaaaaaatatggggggttttttttttaaggttttagggggggtcccttttttagaaaaaaaaaaaaagggggttttctaattggggggaaggttttgaatttttccaaaccccagggccgtgggggggggttttttttttttaaaaaaaaggggggaaaaaaaagcccgggaaaattttttttaaaaaaaaaaagggggggggttaaaaaaaaaaacctttttttggggaggggttaaataaaaaaaaaaaaatcccccccccctttaaaattggggggggttttttaccctggtgggttaatttccccccctttttatttggcaaaaaagggggaggaggggggggttttttcaaaaatttggtccacctgtgaaacgggtgttttatgggaaaaaacccttctttatgaggggggggggggggtgaaa

SEQ ID NO: 9358 - DNA, 579 bp, Zea mays
  Clone ID: LIB3279-196-Q1-N6-H7
atgtcaagaccgcatattacatagcacgacaatagtttataaccatcaaacattacagacggcatttagaatgcctttccaatagccaacatagtccgcataacacatttcgtatgtctgggaagaagcaaattacacattttttgtgggtgaccgtgcttagatttaggataatatcggcggttagttctatccacacatatacatgtacataatctggttccttctcgcatggataaaagtcctgactccatccttgctggacctttcttgctgcaatcttagattgttgttcgctcttcgctctagtatataccttggtagagtaataattgccaacttgtttcttcttagcattaaatcttatgccattcgctatcatggaattgcatccaccacaccaaatgttacattacaaaatacaggctctttagatatcaatctttgtgcatgctctggtgatatgtacttgggcatatgctctattactgaccataagaccttgaaagtcgtaagttctctgtggcacaacctggtttttcgttctagcattgttgaggtggtggatggggcgagccc

SEQ ID NO: 9359 - DNA, 669 bp, Zea mays
  unsure (1)..(669): unsure at all n locations; Clone ID: LIB3279-197-Q1-K6-A1
cggacgcgtggggcgaaggcgaccctccctccttcgctccttccgcgccgcctcccggccgtcgccgccatggtgaagtactcgcaggagccgggcaaccctaccaagtcggctaaggccatgggcagggatctgagggtccacttcaagaacacaagggagacagcctttgcgcttcgcaagttgtctttgaccaaggctaagcgataccttgaggatgttattgctcacaagcaggcaattcccttccggagatactgtgggggtgttggtcgcaccgcgcaagctaagtcgcgccactccaatgggcagggccgctggcccgttaaatcagccaggttcatcctggatttgctgaagaatgctgagagtaacgctgatgtgaaaggcttggatgtggacaacctctatgtttcacacatccaggtgaatcaagcccagaagcagaggcgccgcacctaccgtgctcacgggcgcatcaatccctacatgtcctcaccttgccacattgagctgatcttgtcagagaaggaagagcctgtgaagaaagaggctgacaacattgtcgcagcaaggaagcagtgaagtatatcagcatgctgatcgaggccattttgtcgaagtattatagccgtagctcttttatgtaccctttcaggcagncttgcc

SEQ ID NO: 9360 - DNA, 650 bp, Zea mays
  Clone ID: LIB3279-197-Q1-K6-A10
gttcggtctcccacccctttcccctcttcgtcgatctcaccaccgcgccgaccccgatggcctccgccgcctcatcggccgccgccgctggcaaatcgctgttccaggggttccgcaggttcctcaaaaagccgtgggagatcacgggcccctgcgcctcgcccgagtaccgcagcgcgctgcctggcgcgctcgagtaccgcgtcaagtgcccggccaccgtgcgcgacgaccgcgacaaggccatcgtgcccacatccgatccggagacagtctacgacatcaagtacttcacccgcgaccgccgccggaaccgtccgcccgtgcgccgcaccctgctccgcaagcccgacctcgagcgctacatggtcaccaagcagtttgaccccaccaaggacttccccgtgccatacgtcaacaccactgtcgaggaggacgacaacacggtcggcggtggctaccagaaatgatccaggcatccttgttgtgcttggactccatgagcagctgcacaaatttcgtttcagctttcaaatatcttctttttctgcaagttttctggttgtaaaagatgatggtggcaataatatggtacttgagctcacaggtgcacatttcttgtaacctgtattccaaaacttatctacctg

SEQ ID NO: 9361 - DNA, 577 bp, Zea mays
  unsure (1)..(577): unsure at all n locations; Clone ID: LIB3279-197-Q1-K6-A11
gnggnaaagagnagcttggnaaagcttagctatgcaactgtatccttttgttcgctgctgacaaaattagttctattatattctgtggaattggtgagtggccatcttaatatgattctcccaatttgtgtactttccatatctagctgaacactgttcatttcggagctacttgttgaatcttaatattttgaaaggaagattctacggaagaatgttgattcactagatttggctgtcagtcaattgcttcgccttccctagtcaatggatactatcaatgaagttacaaggcaactgactgctggaaatatgaagtggcttatagcaacagaggactggacactggaggacttcccctttttatggcatgataaaacactactagttcttgatttgatttacgtttccatcttatctgtatttgtaaacaacacatttattgaaaacatctctatcttcttgtgatgcgtgcatgaagtttgtatgtaaaatgggtcattgagcccatggactatctctgtaaattggagggaaatggcaacagaagtttttctgtnttnntttttnntttttt

SEQ ID NO: 9362 - DNA, 527 bp, Zea mays
  Clone ID: LIB3279-197-Q1-K6-A12
tgcgggcatcggggccatgatggtggacatgactgccttgcaactgtctgcgtctctaatactaggtgccgctccagcttcacatgcacagcattggtgctgaagatgataacaagaacaacaccccttatatgaaccacatccccatagaggaggtgtaggagcagatgaaatgcacccgataggggctgagctccagagagggccagcagattatagagatcttagatcccaacaggctcgatgagaagaaggatagctagatccttaagtgaattgggagtatgtggaacacactggcgtgaaggactagagatggctgccatatatggattttgcactcgacaacggtgggttgcaaggaacccggactggagggaactcttcggaatctatagagctctaggttataaactgcaccatctgctttattgtggagatcaatgacggaaaacgcagacgtcgtactcatggccaaccttgccaccaaaaccaaggtattaagtagaaggacgaaggtgtgagca

SEQ ID NO: 9363 - DNA, 567 bp, Zea mays
  Clone ID: LIB3279-197-Q1-K6-A2
cacgcccaagtcgaccaccggcgcggaggcgtgggtgtggcacctggccaaggcctacgccaacgtgaacgactactgctggcaccagctcatcagccactggctcaacacccacgccgtgatggagccgttcgtgatcgccaccaaccggcagctcagcgtgacgcaccccgtgcacaagctcctcctgccgcactaccgtgacaccatgaacatcaactccaacgcgcgccagatgctcgtcaacgccggcggcatcttcgagaccaccgtcttcccgcgccagtacgcgttcgagatgtcctccgtcatctacaaggactggaacttcacagagcaggctctccctgacgacctaatcaagagaggcatggcggtcgcagacccgtcgagcccgtacaaggtacggctgctggtggaggactacccgtacgcgtcggacgggctggccatctggcacgccatcgagcagtgggtgacggagtacctcgccgtctactaccccaacgacggcgtgctgcgggcggacgtggagctgcaggcgtggtggaaggaggcgcgcgaggt

SEQ ID NO: 9364 - DNA, 524 bp, Zea mays
  Clone ID: LIB3279-197-Q1-K6-A3
atctcctcgcatttcttcccatccgatccccccttcgcaaccaaaaccccaactcgccccgcatcgatggcgcccaaggccgagaagaaacccgcggcgaagaagccggcggaggaggagcccgcggccgagaaggcgcccgccgggaagaagccgaaggcggagaagcgggtccccgctggcaagtccgctgccaaggaaggcggcgagggcaagaggggcaagaagaagggcaagaagagcgtggagacctacaagatctacatcttcaaggtgctgaagcaggtgcacccggacattggcatctcctccaaggccatgtccatcatgaactccttcattaacgatatcttcgagaagctcgctgctgaggccgccaagctcgcgcgctataacaagaagcctaccatcacctcccgtgagatccagacctccgtgcgcctcgtccttcccggggagctcgccaagcacgccgtctccgagggcaccaaggccgtcaccaagttcacctcggcctaggctgc

SEQ ID NO: 9365 - DNA, 444 bp, Zea mays
  unsure (1)..(444): unsure at all n locations; Clone ID: LIB3279-197-Q1-K6-A4
ngaaacctgtgggaacattgccttctaggaggaagtgacctagtagatgggatgtgcacaccctagctggtaatgattctgactcaccctcgctcttctctatgtaatttcgtattgctgacacaattgtcgtgagtcgtgacaagtccgtatttcttttaggtgccgttcggttgtttgggattggtgggttggaacgattcttaaccggattgcttctctaatttatataaactttgattagggcttgttcgtttgcgccggattggtgggtcggaacgattcttaaccggattgcttctctaatttatataaactttgattaggtggaacgattccgggtgcaatctgatacaaacgaacaaggccttagctggaacgattccgggtgcaatccggcacaaacaaacaaggccttacagtaacaggtttttaaccgacact

SEQ ID NO: 9366 - DNA, 562 bp, Zea mays
  unsure (1)..(562): unsure at all n locations; Clone ID: LIB3279-197-Q1-K6-A6
ctatctcttccctacgagcgcttgcggcggcggcggcggcggaattaggaggcgatggggcactccaacgtctggaactcgcaccccaagaactacgggcccggatcccgcgtctgccgtgtctgtgcgaaccctcatggactgatcaggaagtacgggctgatgtgctgcaggcagtgcttccgcagcaatgccaaggacattggcttcatcaagtaccgctgaaatcaggtgggaatggaccatgtggtagaggcgaggttgtagttttatttccagtaatttagatgttttgttcagaagtctgctagtaaagactgctacgtttatgatggagaacttagccatgttggtcatgttggtcatattgatcatgagttacctatgttgagcttaaactatcttgtgtccaaccgtcgctgggtagtatgattactgtaatgtaggatggttaaggtcgcaaactaatacttatattgcatgtgtggaagatctattccaattgtactcctagcgcactatttgtgaaaaaaaaanaaaantgganntaannnnnnnnnaa

SEQ ID NO: 9367 - DNA, 646 bp, Zea mays
  Clone ID: LIB3279-197-Q1-K6-A7
ccccgtcatcgatctcgtttcaaatccatccatcctcgtttcctccgtcccgcagcatctcaaccccatggccaagatcaagatcgggatcaatgggttcggcaggatcggaaggctggtggccagggtggccctgcagagtgacgatgtcgagctcgtcgccgtgaacgaccccttcatcagcaccgactacatgacctacatgttcaagtacgacactgtgcacggacagtggaagcaccatgaagtcaaggtgaaggactccaaaacccttctctttggtgagaaggaggttgctgtgtttggctgcaggaaccctgaggagatcccgtggggttcggttggtgctgaatatgttgttgagtctactggtgttttcactgaccaggagaaggctgcagctcacttgaagggtggtgccaagaaggttgtcatctctgctcctagcaaggatgcccccatgtttgtcgttggtgtcaacgagaaggagtacaagtctgacattaacattggctccaatgctagctgcacaaccaactgccttgctcctcttgctaaggtcatcaatgacaagttcggtttcgttgggggtctgatgaccacttgtccatgccatcactgctcccccagagactgttgatgggcc

SEQ ID NO: 9368 - DNA, 621 bp, Zea mays
  Clone ID: LIB3279-197-Q1-K6-A8
ccccgcgtccgcccacgcgtccgcggacgcgtgggctcgctggtcgttgcctgctgcggattgcccccaggcggccccactcactccgctgttgatatttcgtttggttctcctttccgtcttgtccgtcgccgaggccttcttcccctcgctccccagctccagcaggcagatcagatccatccaaccacgaacaggaaggaaggtaggaggcctgaggggctgggctgaagttgaaccatgagtgccgtcgcggtttcgtcgtcgctgaacccgaacgcgccgctcttcatcccggcggcgctgctgcaggtggaggacttctcgccgcagtggtgggacctcatcaccaccaccgcctggttccgcgaccactggtcccgcgagcacgcccacctggatgagatagccgagcagctcgagttggtcgccctccttgcctacgatgaggatgaggacctcttctacggcgagcaggcccccgccgccgccgccgcccttaagacagattcggtgctcaaggcgctgaacttgggctccccgaagagcggcgacgccccgcgggggttccgggagaaacccagcactccgagaagccgaccaagtacgccggcagcccca

SEQ ID NO: 9369 - DNA, 653 bp, Zea mays
  unsure (1)..(653): unsure at all n locations; Clone ID: LIB3279-197-Q1-K6-A9
gcaggaccagctagctagctcctcccactgctatcacccggnngccccggcccagccatnnctcgctgaaagganaaaagcgcagccatgaagactactagctcgggcattgcagtcgtcctcctggtggcgatgctggcagtccagtccgcggtggccgacatctcgtgctccgacgtgctcaacgacctgtcgccgtgcctgcccttcctgcagggcaaggcagccaaacccagcgagagcaacaaccagtgctgcgacggcgtgaggaccctgtacgcggcggcggacaccaggcccgacaggcaggccacgtgccggtgcctcaaggcggcctacgttcaggtccacgctgtgctctccgcggcgcaggagctgcccggcgactgcggcctctcgctgtcctacaacatcacccccgacatcgactgcgacaagatcgaatgaagggatactgttcccttaccagaatccatacgacgggatggtgatgttcagtgccctgctagcagtaggctgcatctgcactgagtgactagaataaaggatttggtgatgtttgtgctgattggtgtgttcgcctgtaatcgtgtgatgccgtcgttggcttcttatatccgtgtctaatctcgcaagtgctcgtgtttgcaact

SEQ ID NO: 9370 - DNA, 659 bp, Zea mays
  Clone ID: LIB3279-197-Q1-K6-B1
cgcatacgcacccaggagatacagcgagcgagcgaccaaagccatggctctccgcaccctggcatcgaagaaggtcctatccttcccgttcggcggcgcgggccggccgttggcggcggcggcgtctgcgaggggggtgacgacggtcacactccccgacctctcctacgacttcggcgcgctggaaccggccatctcgggggagatcatgcgcttgcaccaccaaaagcaccacgccacctacgtcgccaactacaacaaggcgctggagcagcttgacactgccgtctccaagggcgacgcctccgctgtcgtccagctgcagggcgccatcaagttcaacggcggcggtcatgtgaaccattcaatcttctggaagaacctcaagcccattagcgaaggtggcggggagccgcctcatgggaaacttggctgggccatcgatgaggattttggttcgtttgaggcacttgtaaagaagatgaatgcagaaggcgctgctttacaagggtctggatgggtgtggttagctttggataaagaggcaaaaaaggtttcagttgaaacaacagctaatcaggatcctctggtgactaaaggtgcaagcttggttccgctgttggggattgatgtctgggaacatgcatactacctgcagt

SEQ ID NO: 9371 - DNA, 609 bp, Zea mays
  Clone ID: LIB3279-197-Q1-K6-B10
cgatttcccatttcaaatccttcgatcgcacagcgccgcccgccctcacgcagctctctccgatggcgcgcacgaagcagacggcgaggaagtcgaccggcggcaaggcgccgcggaagcagctggccaccaaggcggcgcgaaagtcggccccggccaccggcggcgtgaagaagccgcacaggtttcgccccggcaccgtcgcgctccgcgagatccgcaagtaccagaagagcacggagctgctcatccggaagctgcccttccagcggctggtgcgggagatcgcgcaggacttcaagaccgacctccggttccagtcctccgccgtcgccgcgctgcaggaggccgccgaggcgtacctggtgggtctcttcgaggacaccaacctctgcgccatccatgccaagagggtcaccatcatgcctaaggacatccagctcgcgcgccgcatcaggggcgagagggcctgattgctgctctgtcttcctgtttctgtagtgtctgaactaggggatggaatctatcgcttcttgtcctgcaatcgtgtactgatgttctaggcaaatcagtagggctgttatgaatgtgattcagtgctttggattc

SEQ ID NO: 9372 - DNA, 388 bp, Zea mays
  unsure (1)..(388): unsure at all n locations; Clone ID: LIB3279-197-Q1-K6-B11
gtataaacaagtaagcctcatcagccgttatttgattgtttcaaaacaaaggaaaagcattttcaaaaaaaaaaaaanaaaaaaaaaaaaaaaaaaaaaaaaaaaaaaaaaaaaaaaaaaaaaaaaaaaaaaaaaaaaaaaaaaaaaaaaaaaaaaaaaaaataaaaaaaaaaaaaaaaaaagatagggggagaggaaaaaaaaaaaaaaaaaaagggggggctctttttgagaaaatccaaatttccataaccccctcttgcaaatttaatattttttttttttgggcccccaaaaataaaaaaaatgggcccgttttttaaaaaaccttggttggaaaaaaccctgggatccccccaataattccctttgaaaaaaaatccccttt

SEQ ID NO: 9373 - DNA, 605 bp, Zea mays
  Clone ID: LIB3279-197-Q1-K6-B2
acaccgcgtgcgaaccaagcagaccccagcagaagaagcgaagtcgtcgccggagcaggaggaagagcgagcagcaagatgtcgtggcaggcgtacgtcgatgaccacctgctgtgcgacatcgaaggccagcacctcagcgccgccgccatcgtcggccacgacggcagcgtctgggcacagtccgagaacttccccgagttaaagcctgaggaggttgctgggatgataaaggactttgatgaacctggaactcttgcaccaactggtctttttgttggaggtacgaagtacatggtgatccaaggtgaacctggagttgtcatccgaggaaagaagggcactggaggcattactatcaagaaaactggcatgtccttgattatcggtatctatgatgagccaatgactccagggcaatgcaatatggtggtggagaggctcggcgattacctgatcgaacagggcttctaagtttgtcataatgctattttggtcattgggcacttaagtttgcacctcatttggttctgtaatatgtgggcttgtgcatgtgcttggcgtattgcatgcagtgaataatttatcttcgcgttgggttggtg

SEQ ID NO: 9374 - DNA, 175 bp, Zea mays
  Clone ID: LIB3279-197-Q1-K6-B3
agacagcacagaacacctcttggtataattggacccattccatttttgtctgtttggaaagcagtgtcatgttcagtagcctctagaaggaacattttttttctttcatgtaataaattagggtaaaaaggatgttttggatcggaacttaattcacataaaaagtgtgaagctt

SEQ ID NO: 9375 - DNA, 616 bp, Zea mays
  unsure (1)..(616): unsure at all n locations; Clone ID: LIB3279-197-Q1-K6-B4
ccggcgcctctgccctcctccgggctcccanaggaaaagtctcctcttttcctcttcctctcccgttgccaggcatggggttggcctagttgtgcccgttgagcactagcagcctccttgaaacctccagatctgtgcctccaaggcccccgttcctcggcaacaagccgtccagatggacaccgccgcgcccctgcaactgaaagcctgcgccggcgacgccgcggagaagctgctgctcgccgtcgcagccgagggtcctatctgtggtgtgccagacttcaagatgaggggaaagaagagtgatgagctcgaacctgtcgatgctggcgatgaagatgatgatggtggtgacgatggggacgaggatggtgactttggggaggagggtgaagaggacgtctcagaaggggagggatatgacaacccaaagggcaatgagaccaagaagcaaagaggtgatcctgaggaaaatggtgaggaagatgaggaagaaccagaagatcaggagggtggcggcgacgacgacgacgatgacgatgatgagaacggggatgacgaggacgacgacaatggggatgacgatgaggagggtgtagatgaagaagatgatgac

SEQ ID NO: 9376 - DNA, 573 bp, Zea mays
  unsure (1)..(573): unsure at all n locations; Clone ID: LIB3279-197-Q1-K6-B5
gcgttctaaatgtaaaacgcagtgttttatgcattttagaccatacttttgggcccagtctattagttacttttgaggttcaatccagctcatgggtgaagttttggtaagccactaacctctctattttggtatttaacttcatattattgtctgaaattatgatgtattggtatttttcctgtgttgtttaaaactacgtttaaactttgtttaaacgtttaaaagtcaaaatttcacccataagcgttccaacgttttaccgttttaataacctgggctgtatgtaaatctcatcttgatctttgctggaaaagttaaatgtactcatttgaaatggtcttgatgttagggtaaaatcaattttgaaaatacagttggtctgtcacattggatcatagtattctttttgcatggctagctctccttgtgagttgcgttttatgcctgtatcttttaggatcctgctttctaagatgatcacttcagcaattctcaaagtgtccgttaaaacagccttgttcttctgttcactgctgagcatncttgttttgttggtgggtgggcatcata

SEQ ID NO: 9377 - DNA, 647 bp, Zea mays
  Clone ID: LIB3279-197-Q1-K6-B6
ctccccagcaatccctagcagaagccttccatcctcactcgctcgatggcccgcacgaagcagacggcgaggaagtccaccggcggcaaggcgccgaggaagcagttggcgactaaggcggcccgcaagtctgcccctgcgaccggcggagttaagaagccccaccgcttccgccccggtaccgtcgcgctccgggagatccgcaagtaccagaagagcacggagctgctgatccgcaagctgccgttccagcgcctggtgcgggagatcgcgcaggacttcaagaccgacctacgcttccagagctccgctgtctccgcgctgcaggaggcggctgaggcctaccttgtcggtctcttcgaggacaccaacctctgcgccatccacgccaagcgcgtcaccatcatgcccaaggacatccagcttgcccgccgcatccgtggggagagggcctaagcatcgtatattctgtcatcagtgcccgatcagaagatgtagagatgtgctgggttctgtagtttgggttactgtcgaatcatcgagtagttggttgttcactgctgtaacttattatcatgatgcatatgaaaatggcatgaactatgttatcagttctcgaaaaaaaaaaaaaaaaaaaaagggcgggc

SEQ ID NO: 9378 - DNA, 668 bp, Zea mays
  Clone ID: LIB3279-197-Q1-K6-B7
caaacaccatgacaggagacgctcgcgttggcgtcgctcatcgacgacgaaaagaacttggcgactgccagttcgacctctggaagcagtactacgtggccacatgcgtcactgtgttcggcaagctccggcgcagccgtcgcttggacgcggtccagagcggctgcaccgcgttgtccatcttcaaatagggggacctcatggtcgtcgccaacgccggcgactctcgggttgttctaggcaccgcatccgacaacggcgtcgtcacaccgtccagctcatcatccacctgaagctcaacctcccacgtaagtaactactgaccggccatgaattcttgtgcgctgggacgacggtcgttgctgacgttgtgtgagtgtcctcgaacaagatttatgtagaggagtagcacatccggtggtgcaacgactaggtgtactacctcgctgatgagcccggggtggacttcgtttggcagcccagccaagagtcatcagtactcgccatgtcgtgcacgttcgacgactactatatcaaggactatggcgtcatcttggcaccagaggtgacgcagaggaggaccgacggcaatgagcactcgtcatcgtcggggtagcttttgtgccggcctgcctttaattctcttcgcaaacacatacacttgcttt

SEQ ID NO: 9379 - DNA, 598 bp, Zea mays
  unsure (1)..(598): unsure at all n locations; Clone ID: LIB3279-197-Q1-K6-B8
gtcaaatctatcacgcgggnaaanacctctaacctaccacaaacttaccttccaattaatcccttcgatcctaggctgacagatatctcggtttttgatgatgaaccggagatcgaccgacgaaccggaagtgtggtgacgaagcttttgccgagccagtcacgacgatgttctgggttgtctcggaagatgaatggacggtgagaaattttttgcctgagttgtcgctagagttggggaggcagtcgaacttcgatgagatgatcatgacgacttatggctgcgaccttagctgacggcgggctattgtggcttggatggaggcgacactgctgcgaggctatagatgagatgagtctatggttgatggcttgaggtgttaagatgacacatatttatatacgcaaggagctctcttcgtagctttggtggttattgcttcagcctcgatggcagcaacttcagcttcggcttcattgtgtttaacctcaattattacatgtgaagtagaaacttcgcagtaaaagttagaagagaattatcaccatatgcacaaaatggtttagaaaaagcaaaaaaaaaaagcacctttggcttc

SEQ ID NO: 9380 - DNA, 637 bp, Zea mays
  Clone ID: LIB3279-197-Q1-K6-B9
ggccaaggagggcatccctccagaccagcagcggctcatctttgctgggaagcagcttgaggacgggcgcacgcttgccgactacaacatccagaaggagagcaccctccacttggtgctgcgcctcaggggaggcatgcagatcttcgtgaagaccctgaccggcaaaactatcaccctcgaggtggagtcttcagacaccatcgacaacgtcaaggccaagatccaggacaaggagggcattcccccagaccagcagcggctcatctttgctggaaagcagcttgaggacgggcgcacgctggccgactacaacatccagaaggagagcaccctccacttggtgctgcgcctcaggggaggcatgcagatcttcgtgaagaccctgactggcaagactatcaccctcgaggtggagtcttcagacaccatcgacaacgtcaaggccaagatccaggacaaggagggcatcccaccggaccagcagcgtttgatcttcgctggcaagcagctggaggatggccgcacccttgcggattacaacatccagaaggagagcaccctccacctggtgctccgtctcaggggtggcatgcagatctttgtgaagacactcactggcaagacatcacccttg

SEQ ID NO: 9381 - DNA, 648 bp, Zea mays
  unsure (1)..(648): unsure at all n locations; Clone ID: LIB3279-197-Q1-K6-C1
tgcagctccaaggctcttgtctctatatcagctggtctaaaagattttgtactacttgagtctaacagtctactgctaacagcatgcataatttgccacgccagattgatcattccttttattgaagactatgttctgaattgaccataataggagagagaagcatggggagttagcatctcggcctcatccatttccaacaagccaaaagcactaactgaaagtctggcacttttaagcaaaaataacatgtcctaaaagcacagtagtataattgatcacaattcagttcataaaatacatggataagtcataagtgcttgtatgtgagtacaaagaagaggtgattgtatttacctagatctgcaaacgctacatgttagttgtgtaatctccttttgtttctctctcatccgctcgatgagcacagatgaaatgtatatgtttacaacgtcctcataaccatccctcaccatatcctctgacaaaactgaccaaatcaagataagaacaatatcaggtggctgctgggtgatgagatattgaagaccctaggggttcatttgttgggttccataaactttgtagaagcttgttctctctaaaatgagcatcggaatcactgaaagtatcacggnaatagctgca

SEQ ID NO: 9382 - DNA, 508 bp, Zea mays
  unsure (1)..(508): unsure at all n locations; Clone ID: LIB3279-197-Q1-K6-C10
ccgcggcggctngaggcggcgcggtatcagcttggtgatttgtgagcgatggcgccgccggggtcgcggcggtgggcttacgtgcgcgtgatggccggcaccatcctcggtggcgtacttggattctacgtcatgcaccgcatcgagacctcgtacaaggcgaggatggaggagaggctgcggaggtacgaggcgcatatgctcgccaaagccaaggagtcgcagcagttgcaggacgaggtacagcgggaggataaagcccagttcctgcccgactcgtgacaccgacattcttcccctcttgcgcctgctcttttccaagctgttagaataacatagggcactggggcaaaggagtccgtccactcgtttttttcagatgtagagacataagatcgacatgtactttttgcttgttgctgtctttttttttttttggtatcaagaaaaatgcaccattcgaacgcaaggttggggtcaatgtatgaactccnaaaaaaaaaaaana

SEQ ID NO: 9383 - DNA, 287 bp, Zea mays
  Clone ID: LIB3279-197-Q1-K6-C11
tgcgccggcagtagtcacttccgagccgtgggacggcaaagacggtgaggtcatcgcaaaaggatgaattctcccttgccgagctcatgggcgacagctcctcagtaaacgatgagttgtagttctgacgattctgtaactgatctgcgtgccgattagcctgactgtaaatctgaggaactctgatgttttaaaaactcggtaaattttcaatattttggatgctagaattagaatggttaaaaaaaaaatgagaaaaataaaaaaaacctaaacgaaggataaaa

SEQ ID NO: 9384 - DNA, 543 bp, Zea mays
  Clone ID: LIB3279-197-Q1-K6-C12
gtcactgttcgccttgtcctgccgtttctgttccattcctcctcctgcaagccgtcacagaataagccggcagccgtcgctatgggagtgacagtcaagaccgagcacatccagctgaagctcgtaggaggtcaacgctaccgtccaacagcacctctcggctgtccaggaccacatcaacttcaccatgcagcaagcatacttcaagtgcgcatatggttgctctgatcggagccatactgaggaagcgatcagcaactgtgtggagaattgtcgtgtgcctgtccttgctgccaacaatattctttgagagtgagatggctaagtttcagggaatgttgaaccggtcattgagggtctttcaagataagtttgaagctgccaatctccacaagttgaaatcagatgcaacttcgggaactggaatcctgtgccaacagattttattgataacaggcctcaggcccctttcgcattggtggtggatcaagatcaagtcccacccttcaaaatcaattaggaggcactattactttttagcaa

SEQ ID NO: 9385 - DNA, 556 bp, Zea mays
  Clone ID: LIB3279-197-Q1-K6-C2
atttttcatatcctcactcgccgccgccgccgctcgtccctcgccccatcgcgatggcccggatcaaggtgcacgagctgcgggggaagagcaaggcggatctgcaagcgcagcttaaggagtttaagtcggagctctccctgctacgcgtagccaaggtcaccggcggggctcccaacaagctctccaagatcaaggttgtgcgcacctccatcgcgcgcgtgctgaccgtcatctcgcagaagcagaagtcggcgctgcgtgaggcgtacaagaagaagaagctgctcccgctcgacctccgccccaagaagacccgcgccatccgcaggcgcctcaccaagcaccagctctccttgaagaccgagagggaaaagaagcgtgagaagtatttccccatgaggaagtacgctatcaaggcctagatcagtgaaagaacatttatcctgtcaagttttgctcagaagttacttgaatttgagacaaatctatctccatccaagtactatgtagctgatcaactgcatgatgaaaaacgagtactttttgcttgttt

SEQ ID NO: 9386 - DNA, 672 bp, Zea mays
  unsure (1)..(672): unsure at all n locations; Clone ID: LIB3279-197-Q1-K6-C4
cgcagaggcgcagagacaggcgtcttcgtactcgcctatctccgcgactcaaagcttcttccatttcctaccgccgccgctgcagctccaccccattccgtcgacaccatgagggagtgcatctcgatccacatcggccaagccggtatccaggtcggaaacgcgtgctgggagctttactgcctcgagcatggcattcaggctgatggtcagatgcccggtgacaagaccattgggggtggtgatgatgctttcaacaccttcttcagtgagactggtgctgggaagcacgtccctcgtgctgtttttgttgaccttgaaccaactgtcatcgatgaggtgaggactggcacctaccgccagctcttccaccctgagcagcttatcagtggcaaggaggatgcagccaacaacttcgcccgtggtcactacaccattggcaaggagattgttgacctgtgccttgatcgcatcaggaagcttgccgacaactgcactggtctccagggcttcctcgtcttcaacgctgttggtggaggaacaggctctggccttggttccctcctcctggagcgtctgtctgttgactacggcaagaagtctaagctnggtttcactgtacccatccncccaagtttcgacctcagtggttgagccatacaacagtgtcct

SEQ ID NO: 9387 - DNA, 659 bp, Zea mays
  Clone ID: LIB3279-197-Q1-K6-C5
cccagcgtccgcggacgcgtgggcgccggagaccgagaagcaatctctcctccccccggccagccgaccgaccgaccgaccgaccgacccatggaccgccgtcctgctctcgccgtctctccgcgccgcctccgcccgcgcccgccccgggtgccccgcccgcccctcgtgccagcctcctccgtgcaaacgcctccaggatcgatgaagaaggcggcggctccgatgcgcgcgtccgtctgcgcgatcccgtcgccggtccgcttcgagcccagcccgatgcgcgcctccatctccgctctcccgtcgccgatccgcgccgaaccgagccctatgcgcgcgcgcgtgaccgccgcgctccagccaccaagtcgcgtcaagctcgacctggctgcgtcgtcgcctcctccggcaagggcggcggccgacaaggagaacttcctcctcgccgcggctccgtcgtccccctcggcgagggtggggttcgacaaggagaacctcctcccggccggcgcggacgcccacgacgagcttgtggcgctcaacctcgccgcgattgccaggacagcgggcacgccgtctggtggcccgctcttcgtgcggggcagactctacgacctctactcggcgcgccgcaacgagcggctcaagcgcaagca

SEQ ID NO: 9388 - DNA, 689 bp, Zea mays
  unsure (1)..(689): unsure at all n locations; Clone ID: LIB3279-197-Q1-K6-C6
gcctcactcgatgctgctggcaccaatgcggatgctgccagtaagatcgagaggtttctgatccaaccgagagtagaggatgcagtgcttggccgtcggaaggctgaaaaggcaatggcttggcgggcagtttttacatcggctgggtttgctccagtgccactcagcaaccttgcagaagcacaagctgactgcctcttgaagcgggtgcaggtccgaggattccatgtggagaagtgtggaatgggtctagcactctactggcagcggggcgagctcgtgtctgtctcggcgtggcggtgctgatcatagcaacctcatccgtcaaccatcgtcgtcgtcgcgcctacactattcgcaggcatgtttaactccggtaatatgcgttttatcttgcaaacattgcaaagaaactattgtcatggttgttccacgcctctgattgctttactgctgtttttggagtattagctaggcctaatgaatgttgcaatcttggtgtgggtgtccccctacaatgtaacatgttggtactagggtctcaacgctgttcgtgctctcttcttggttagccggaggctactttggcatatttgtggcaatggtgttcgttattttactaggtaaatcagatgaagactgacatatgaactgaaatggtntggcatttttttttctttcttggcttc

SEQ ID NO: 9389 - DNA, 577 bp, Zea mays
  Clone ID: LIB3279-197-Q1-K6-C7
aaggataacgatctaaactgtattaaggttaggtatcacctaacacagcaacatttcgaggtacagatgtctcgagtcaacttagggcactagcaatgcaagagagtcttaccagaaaacgcacgcgcctacggtatacggctgccgaatttacatcagctctcgctgtcctttttagtttaacgccgcatcattccaagtcacgtagactactatgtctgactagatagtatgcaacacaactgccatttccttttcccttactactgtaaatcagtcttcaccaatatggaggatacaaatacaacacttaatttgagcagatcccttgtcctttcatcagcgcctactacccaggatgttagcccagccgagtccagaaaatcgtatcgcctgcagccaacaagccaaacagtcgcatcagtcagatattggtagattgcgtgtaaaggtggtctgaaagcaactccgagacaccatgagcggtaagactttcacgtccaaagagttgtttaagcttcgagtcacacagtatcaccgtaggattctctggatcctctaaatcattgcttttaat

SEQ ID NO: 9390 - DNA, 652 bp, Zea mays
  unsure (1)..(652): unsure at all n locations; Clone ID: LIB3279-197-Q1-K6-C8
cggccgcgtgggctcttnctggagtgagattagaagtgtggtgttggctgggaggagattttatgagaaggaagggctccctgctttcccttatgggaaaaattgatcaaacacgtatgtggaaggtgggtgaaagggtccgttcaaccaggccacaaggtgatcttggcccactgcatcccttcactgccggagtgtatgttgcattaatgatggctcagattgaggtccttaggaagaagggccactcttactcagagataattaacgagagcctgatcgagtccgtggactcgttgaacccgttcatgcatgctcgcggtgtggccttcatggtcgataactgctccacaactgctcgtttgggatctaggaaatgggcaccacgcttcgattacatcttgacccaacaggcgtttgtgactgttgacaagaaagcaccgatcaaccaagacctcatcagcaacttcatgtctgaccctgtgcacggtgccatcgaagtctgtgctcagctgaggcccaccgttgacatctcagtgaccgctgatgcagatttcgtgcgcccagagcttcgacagtcttcataagcttgtatggatccgcagtgtgactgcaatggctagtttgtaagaacttaatatgcctgggcttt

SEQ ID NO: 9391 - DNA, 653 bp, Zea mays
  unsure (1)..(653): unsure at all n locations; Clone ID: LIB3279-197-Q1-K6-C9
cgccgcggcgaagaganaactcgaactcggcaggacttgtgcggaataggaggggagcggccgagcgggggtcagagagggagatagagttcatcaggtttgccatgtcctccagggctggcggcggcaagccgttgtggtctgcctccaccatcgtcgccaaagtcgcgagtgggtaccacatcctcaggatcgatggctactccaggaccatggagacccccacaggagagtccatcgcgtccctcccgttctcggtgggcggccgttgctggcgcattcgctactaccccaacggcgacaagttggagaataaagaatacatctcgctttatcttaatctccacgacagaagcgtcgaggcagagaaggcgcagttaatgttccgtttcgtcggtgacgtagcggagcagccgctgattctgggaggactgcataccttcgaaaagcaggttgggggtacggcaagttcatcaaaaggaaagatttggaagagtcgaagcatctcgtggacgattctttttccatcaggtgcgatgtggccgtgcgcttcaacgatgtccgcgtggagaaggcgccggaagccgctgctgcagcagctatgatttccgtgcaaccatctgacctgcaccagcacctcggcagtctcctgc

SEQ ID NO: 9392 - DNA, 663 bp, Zea mays
  Clone ID: LIB3279-197-Q1-K6-D1
ggtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggcgggtacggtggtggccgtggaggcggcggctacggcggtggcgggcgccgtgatggcggcggcggctacggcggtggcggcggctacggtggtggcggcggcggctacggtggtggtggcggcggctacggcggtggcaaccgtggcggcggctacggcaactccgacgggaactggaggaactgagcggtggggcccgcgcggccaagttatcctgttcgctaccgtgttgtttaccctagtccagagtgtttatcttcgttcgtctcgtgtttgttgttgcccatct

SEQ ID NO: 9393 - DNA, 385 bp, Zea mays
  unsure (1)..(385): unsure at all n locations; Clone ID: LIB3279-197-Q1-K6-D10
gggccctngaaggacagcaagagttcatcgacattgtggagaccgtatacaggggcgcccggaaggccgtggtctggtgattgctccaaaggactactccaccaagtaccgttactaagaaggcaggcattccccttatgcaatctattggggatgtttacacggacagttagtccgacaggtgatccctaactgtatcttggcataccctagtaattcaagttgctggctggagtgatgcttatccatgtcttggcatgccatagtgaacatgtaaacctgtgatttgaggtgattattcgagtgtaaagaaaccaggattgcgttcgcctatgactatgtgtctagttgtctacttaataagaaacagttattggtttggaat

SEQ ID NO: 9394 - DNA, 86 bp, Zea mays
  unsure (1)..(86): unsure at all n locations; Clone ID: LIB3279-197-Q1-K6-D11
cggtccggaactccgggtcgcccagcgtcggttaaacaatgtagcctatagccgtatttgattgtcaaaactataaagcattncaa

SEQ ID NO: 9395 - DNA, 621 bp, Zea mays
  Clone ID: LIB3279-197-Q1-K6-D2
ctttcctctcttctcccgtcccctcttccgcggcaaccccggcgcggcatggcgagcccgtcctcctcctctttcccgtcccggaaggccctgagcaagatcgcctgcaggcgcctgcagaaggagctaacggagtggcaggtcaacccgccggccggcttcgagcacagggtcaccgacaatctccagaggtgggtcgtcgatgtagccggggcaccagacacgctctacaccggcgagacctacaaactgcaggtggatttctccgagcattatcccatggaggcacctcaggttatatttctgcatccagcaccgatgcatccacacatttacagtaatggacacatctgtttagatatattgtatgactcgtggtccccagcaatgactgtcagttctatctgtatcagcatattatctatgctgtccagctcaccagcaaagcaacgcccagccgataacgatcgctatgtcaggaactgtcgcaatgggaggtcaccaaaggagaccacgtggtggttccatgacgacactgtgtgatgggtgtttccggctgttgtcctgcccgcattttagttgccagactacatgggagatgatcttggcatatttcaagcg

SEQ ID NO: 9396 - DNA, 644 bp, Zea mays
  Clone ID: LIB3279-197-Q1-K6-D3
gaaaatcttcttctggatgcaggaaccaaatgctgatggggactcccagacttgcatgcaagttaatgcctacataaatcgatcattagatgctgaggctgatcttcgagtacctattgaagcagaaagtctgaagatacggctgatgatgatatctcttccagagctgggaatctagttgagagcatgaccgctgatttggctggtgaagtgacgtctgctgctggacctgtacgcttggaggatctgcagagaattctgagtgcaatacagtcatcaggtgctgcagctgaccctgatgctggagtaggactaggagacatcttgaagcctgatctggtcttgccattaattgaggacttgcccattgaacaattggcatcacatcttccggagggtggctcatggagtcctggtgatatcgttgagcttctccaaagtcctcctttgcgccaacaattagatgcattcacccacgttctgcggactgggcagatagatcttgctcaatttggagttgaccctgacaaatataagttcacggtggtgtcgttcctggaggcattggaagactcggttggaagaggtgcttctgaagctggagacaagatgcagaggtcgagcgaagcagtggaaatgatgac

SEQ ID NO: 9397 - DNA, 647 bp, Zea mays
  unsure (1)..(647): unsure at all n locations; Clone ID: LIB3279-197-Q1-K6-D4
cttctttttgctcagaacggactgtcttcgtcccgccatctccgtctcctcctcggcctccccgcaccccatcttcgccgtattcgctatacttgatggccataatggtaacgcagccgcaatatacacaagggacaatttgctcaaccatgtccttagtgctatgccacgggggctgtccagggaggagtggttgcacatgttgccccgagcactggttgcagggtttgttaagacggacaaggagttccagagcaaagggcaaacttctggcaccaccgctacatttgtgataattgatgggtggactatcactgttgcctctgttggtgattctcgctgtattttagatgctcagggtggggctgtttctttgcttactgtggatcacagactagaagaaaatgttgaggagagggagcgcgttacagcaagtggaggtgaagttggaagactcagtgttgttggtggagcagagattggtccgctacgatgctggcctggaggtctatgcttatcaagatccattggagatatcgatgttggcgaatntattgtccctgttccatatgtgaagcaagtgaagttgtcaaatgctggnagaagacttattattgcttcagatggcatttgggatgcattatcct

SEQ ID NO: 9398 - DNA, 578 bp, Zea mays
  unsure (1)..(578): unsure at all n locations; Clone ID: LIB3279-197-Q1-K6-D5
gngcttatattcctatatgactactagctagaaattaagagcgctaatactatattaattgtgtaccatattcatcatttgctcgttcgaggagaaatttaaagtcttactagtgtcactactgatattttatttattctaaaatattaagaataatagtaaaagtgtgtcttgtagaacacattataatatctatttttagatgcgtgttattagagtggtctaccgtgtgttgttattgccgttaaatcctgaccatattgaatcctaaagctaaaaaggtcgaacatcagcgatggagtggaagagcaacgacatcccctccggcgttgttagccccgtgacgtcggaaggtgcaagggagtcttcgacgtcgagcaagaagatgagcagcgaggagcaacaacaagagagcgaaggccgtcatcgcacggaaggcatgccaacgttcgtttgaatgggctcaagtgggccgtgtaatacttaagtgggccgctgggtcccgatgctgatataggtcagtctgtgagaacattaaggccatcgaataacaaaatagcaaatccatttttgccgct

SEQ ID NO: 9399 - DNA, 664 bp, Zea mays
  unsure (1)..(664): unsure at all n locations; Clone ID: LIB3279-197-Q1-K6-D6
cgccgncgtacactccaagccccaaacctccgacgcccaagccgaccccaccgacgtacaccccttcccccaagcctccgacacctaagccgaccccgcctacgtacactccaagccctaagccaccggctaccaagcctcccacgcccaagccgaccccgccaacgtacaccccttcgccaaagcctccgacacccaagccgaccccgccgacgtacaccccttctcccaagcctccgacgcccaagccgaccccgccgacgtacactccaagccccaagcctcccacacacccgacgcccaagccgaccccaccgacgtacaccccttccccaaagcctccgacgcccaagccgaccccaccgacgtacaccccttccccaaagcctccgacacccaagccgaccccaccgacgtacactcccacaccgaagccgccggccaccaagccgcccacctacactccgacgccgccggtgtctcacacccccagcccgccgccaccatactactagaaagcgatgcctaccataccacactgctgtcagtctctggagcatttaggtggtctggatcaatggaagggttgtgtcctagccagccggcaaagatgagctgctgatggtaatgatgatgataagaggccactgctaccctactacgt

SEQ ID NO: 9400 - DNA, 392 bp, Zea mays
  unsure (1)..(392): unsure at all n locations; Clone ID: LIB3279-197-Q1-K6-D7
gcntcactgaaaaggtngaagtgacgagcaggttgttttggttagccagatggcactgcaacagaatcaagttaaagaatatccgtccagtctcgacgctcgaggggagtgattctgatgaggctggagcatgnccggaaagatccagtcagcatcactgatatccgcagcggcagcagaagtaactgaagattagtcttgcacccaagatgcaagtagtttagtctgaatttaatccctggcgtacgctgcagcatgaaatttgtctgctttcctgtggctagtaagcgtcaggaatcatgtaaaatcctacgccaaggagtagtcggtagctgatcatttggtggatcagaaactaaatactcactctaatcagaaaccaatgttgtcct

SEQ ID NO: 9401 - DNA, 406 bp, Zea mays
  Clone ID: LIB3279-197-Q1-K6-D8
cggccgcgtgggcggccgcgtgggtggcaatagaatcagggaattgtggcaaggacaccattgatatgctgttgaaagatgctgattcctctgataaaataaacaggacgtcccccaaatcaggcagttagtcattctttggtcgatactaggtgtggaacatatatatctatcgagattcgttgctcaatcggaatattgtaaagggttttcattacaagtaaacatataaagagctgcagccttttgcttgcaggaagtgttttctgtttaatttgtaaacttgcgcaaaatgttagtagttgctgccaaagaacctaggccatgctttaattttgtggcttctctttgtgatatctatatatatattaaacggtataataagcggctggtccaaacttatcag

SEQ ID NO: 9402 - DNA, 621 bp, Zea mays
  Clone ID: LIB3279-197-Q1-K6-D9
ccccgcgtccgcgagtggtatctttgcaaatcagttgtctagcaacatactatggacgactagtcatattagacattattagatgtgagcctatatattactaataaaagaagagagttttatccaaaagcatcccatcacagaagacaaatataatgtttttaatttttagttgttttcattgtcgttagtaaagctggattgcatgcacaagtcttgcgaaaaatctcactggaaatccgctagtgaaaataatctaaaatgatagatcagtctaaaatgattcttccatgataaatgtccaatttgacatcaactactatcatgtagtcacaacattctgcattgtaagcatggctaacaattacattaattattcaagactggaagtcatgtaaacaaacttgccaacaacataaggaattttgtgttgttctggggaaagaaactaaatcatagctcatgattttttacacacagtcttcctaagtgttgtgatataagaaccttgaaataagggaactagagaagaaattttttataaagaaaaatttattcgttggtcaccataacactatatattcagtggtcatcatccaaggtatggtttgggctttgcct

SEQ ID NO: 9403 - DNA, 626 bp, Zea mays
  Clone ID: LIB3279-197-Q1-K6-E1
aattgaacagagtaagcaaatggtgacagcatagagtcaactgtcaagcatttgctagtcttcagttatacagcagtatgatagaagcagtagctgctctacgaatcattgatctcgaatacaagaaaaacgtccgatagtactctgtgaagcaaacatcaattttatcagaagagaaactgtaacttattagttcacaagatttacagaaagactaatcatatgatcaggcgttcagcagcaaaaactaacagagtatggaactggcgtcatgcacagatgcgctattgcaagaactagaaaacattatggcgaaaagtttataccaaaatcttgcaattctcatcccaagatgcccattgatcagtatcaatttgaacactggggcgcgaggaaatggtacaaagtgccaaaccaattaacgagaatctatctgctattcgctttcatcagatcattggatctgagccaagaactaacagaacattgcttagttcatcacaagtgaacgtagatcagaacaaaagaagaaacaagctaagtttgttcagttccgacgtagcaaaaaaaaaagtaaatgactccatgagaaccgatccagaccatcagcgagatgcaataccctt

SEQ ID NO: 9404 - DNA, 654 bp, Zea mays
  unsure (1)..(654): unsure at all n locations; Clone ID: LIB3279-197-Q1-K6-E10
ggntgctactgcnaatgagaggaagaaaaggaagaggacaaggagatgactctggaggaatttgagaaataagagaggagaagaggaaagcactacttgcattgaaggctgaggagaggaaagttgaagttgacaaggatttgcagtctctgcagccactttcaaacaagaaagaaaatgatgaagttttcattaagctggttagtttccctgtaattaatgctttgataccttaagtttgctgagctttgcacgggttcttcgatgttcttttgttctcttagggttctgacaaggataagaagaaggaaaatgctgagcgtgatgagcgtgccaagaagtcggtgagcatcaacgagttcctgaaacctgctgaaggagaaaggtactacggcggccgtggccgtggaaggggccgtggggatcgtggtggttttagaggcggatacggagggggatacagtcgtggcccagctgctgctgctccatccattgaagatcaagctcagttcccaagcctcggtgggaagtgaagggcgcccagctgctgctgtcaccgagcgttgtgttgtctgctgttgtcatatttaaattttgtccgacgttaaatttctgtgccacggtttaaacggaacaaataatgatgttgcatgt

SEQ ID NO: 9405 - DNA, 630 bp, Zea mays
  unsure (1)..(630): unsure at all n locations; Clone ID: LIB3279-197-Q1-K6-E12
cgtccgacccccggtcgcccagctccccccgctccgcgcgctgggaacacagccttcttttattttttttatcacatggcctcctggtatgaatatgcagcctcattcgaggcatgtcggtcagtcaccatcagcgagcgtgagatcacaagcgcttcgcagcaccacagctgaaattgctgactggccattggctccggctactacgaagacttctacatggcaataatctatgttgatacaaatgccttctatgatagcgatcaactactgtagatgagttaatatgcacaatttcttgcgtccgtctaactgagtcgttgtagtctggcgaagcaaatacctgttgagtcaggccatgctgctcgaagaggtagaggagctatgtgcgctcctggtggacaccccaagcgagcacgctgaacctccccatggggtgtcttccaactatgctcaacactccacttccggacgagagcaggtcgtcgtacctgcaggacgcactctccgtcttcaccgaaatcctttgcagctatccgtagcacaagggnccacggtgttgccgtaatctgggtgaaaggaagtgaagcctacaggcaacacgcccgaaaagtttgtaccgtctcatgt

SEQ ID NO: 9406 - DNA, 663 bp, Zea mays
  Clone ID: LIB3279-197-Q1-K6-E3
agcaccggatcggagcaggcgatacggcgccgacgacaatggcagcaacaagggtttccccggttcttctcttgctgctcaccgtccagctcagcttgctcttccgcctccccgactccccctccaccctcgccctcgccctcgccgcggaaccagagcaacagaacgccaagcagcatcgccagcccgcgctgctggtgcagtcgacgtgcaactccaccagcttctacgacctctgcatcgccgcgctcgccgccgaccccgccagctccaccgccgacgtcccgggcctcggcgccatcgccgtgtccgccgccgcaaacaacgcctccggcacggccgccttcctcggcaacgccagcgacgccgcggccaccccgcaggcggaccgcgccctcctccgcacctgcgccggcaagtacgccgccgcccgcgacgcgctcgtgcaggcgcgcgcgtccctcgccgagcaggcctacgactacgccttcgtgcacgtgagcgccgccggcgagtaccccgcggtgtgccgcacgctgttccggcgccggcagcagcagcgtggggcgagtaggactgcgtacccggcggagctggccaagagggaggaggcgctgcggcgcctgtgcaccatcgccctcgacatcatctccctgctgcaaa

SEQ ID NO: 9407 - DNA, 664 bp, Zea mays
  Clone ID: LIB3279-197-Q1-K6-E4
gccaaggcaaactcgaacaaaagccctaaagatgaaagcgacactgaagatggcagcagctgggagacaataagccacgaagatgtccagggttcaagcggttcacctgatggaagcgagccttcggtcagcaacaaggtctgcgacggaagcattccttggaagagcagaaatggattcgagcgtatggagagtgagaagctgaaggatgagtcagctgatgcctgcctgacaaacatgaaccagcccaagaagaaagaatcggccatttcaaagctctggaagtcgtcccgcccaaagaacagcgagatatgcaagaaagacgcagttgaaacggtaaatgcaagatcgtcaaacgtgcggctctcagtcgggacctattccactgttgaaagtggcatccaagaaatagggctcagtccaccgtgtgttgagcagtggagctcaccagactcgatgaacgtccaattcaaccggggattcaagggctgtatagagtacccgcggatgtcccagaagcacagcttgaaggcgaagctcatggaggcacggttggagagccataaggtccagctccgccaggtgctcaagcagaagatctagtgcaggccagaaccagaaggcgaaacattgtaaacctagcattcaatccaaggaataatgt

SEQ ID NO: 9408 - DNA, 698 bp, Zea mays
  unsure (1)..(698): unsure at all n locations; Clone ID: LIB3279-197-Q1-K6-E6
gcaagatccanaccccgaccgatgaggtagtggtgccgtacgataccctcacgtcgcctcctgaagatctcgaggagacgaagaagctgctggacaagctcgttgtgctcaagctcaacggagggctcgggacgaccatgggctgcaccggacccaagtctgtcattgaagtccgcaatgggttcacattccttgaccttattgtgattcaaatcgagtccctgaacaagaagtatggatgtaatgtccctttacttctgatgaactctttcaatacccatgatgacacacagaagatcgttgagaagtattccaactccaacattgaaattcatactttcaatcagagccagtatcctcgcattgttaccgaggacttcttgccacttccaagcaaagggaaatctgggaaggatggctggtatcctccaggccatggtgatgtgttcccctctttgaataacagtggaaaactcgacatcttattggctcagggcaaggagtatgtcttcgttgctaactcagacaacttgggtgctatagtcgacatcaagatcctgaaccatctgatcaataaccagaatgaatactgcatggnaggttactccaaaaacattggctgatgttaaaggcggtactctcatctcttacgaagggagagttcagctttgggagatgcccaagtacctgagagcatg

SEQ ID NO: 9409 - DNA, 486 bp, Zea mays
  Clone ID: LIB3279-197-Q1-K6-E7
ctggtaacagacagccttgttcgatctactgaccagatggccaaggtcatgaataatggggttccatcctttgcaaaccaccaacggtctccgctgctagttccagtgggcattcctgagagactacagtgacatgcagatgcttcaactagatagagttaggtaccacgactgttaacatatctggtagccggaactccatgcattagactgagcctagtgataacatctgaatgaagatagtctcactgctgctaaagatgactgtatcaagaacatgcatgactggtgcagacatgagcctctagcgcagaaattatgaactttccctgattattagtggtgtgatcagtgaaatggcattatctcctgcttagttggttgaaaaaaaaaaaaaaaaaaaaaaaaaaaaaaaaaaaaaaaaaaaaaaaagggcggacgatataaaaaaaacaaaaattgggggggcctttttaaaggatcaaa

SEQ ID NO: 9410 - DNA, 606 bp, Zea mays
  Clone ID: LIB3279-197-Q1-K6-E8
aaaaacaacctaccaacgtaatcaaacgagcttgagtagcagcacaaacaggcggtgcagagagggaacaagtcaattcccgaaccaagacccttcttccctgatagcctgggatcagatggtcacaactggtttggttcgctcttgactcctcctctcgcaccttttctcttgctctcctaaacaatcaagtcctcagtctcttctaatacagagttacacggctctacgcccgaccattacgcgcgaactactaggtaaatctcccgtcttattattattacaaaaatcgaaataagcataccaatcgaagctaaccttcttcacagttctgacttctgagcaagggaacagaccgagagagagagagctaccagcagcaacacctgcatgaccaagctgccccggattgttttctgcgtgatagagaatcggccggcacaagtgagagcttgacaggaccctttcttttccagtagctgtagatgacaccgcactagcttcccaaaatgatcaaaatgcccccaccattctcttcgttcggtcaggggtatttttgtcattttaagaggcatatggcgggaaagagagggggggtttttgaac

SEQ ID NO: 9411 - DNA, 638 bp, Zea mays
  unsure (1)..(638): unsure at all n locations; Clone ID: LIB3279-197-Q1-K6-E9
ngattatagtagtagatatttgtgtggtgtttacctgtatcttgtccatgtctaagttttgtacatccaccacttatcaataaataattcacacctttagttctttcttgcacttaccaaatggtcatccaactcaccttataatttagctgtgtctccatctatactggtattatacaagctcatcataatctaaattgataaaacaaactgttgaaagtatctctgcataaaaagaagttttttggcctgcacaacatctctttgctgtggatgcaagatattgacaggaagatctaggaaggaagcaaatctgatagcttctgagacaactgtagttgatatttatggtacttgttctagatattgaaacaagacataaataagtaacatataattcagtaaaatgtattgccattgtggctttgtgtggaacttagtttgagttcttacttcgatgccatcagggaattatgtcgttgtggccggaaagccttaaatttatgtagattgtgcaatagttgccttaacctatatcaaatgtgatggtggtgttgtaatttttgcatgaatatttggtttattctagactattttttatgcgaatagttcctaacttatgtttgttccatctatgc

SEQ ID NO: 9412 - DNA, 655 bp, Zea mays
  unsure (1)..(655): unsure at all n locations; Clone ID: LIB3279-197-Q1-K6-F1
ngcgaggcgaccctccctccttcgctccttccgcgccgcctcccggccgtcgccgccatggtgaagtactcgcaggagccgggcaaccctaccaagtcggctaaggccatgggcagggatctgagggtccacttcaagaacacaagggagacagcctttgcgcttcgcaagttgtctttgaccaaggctaagcgataccttgaggatgttattgctcacaagcaggcaattcccttccggagatactgtgggggtgttggtcgcaccgcgcaagctaagtcgcgccactccaatgggcagggccgctggcccgttaaatcagccaggttcatcctggatttgctgaagaatgctgagagtaacgctgatgtgaaaggcttggatgtggacaacctctatgtttcacacatccaggtgaatcaagcccagaagcagaggcgccgcacctaccgtgctcacgggcgcatcaatccctacatgtcctcaccttgccacattgagctgatcttgtcagagaaggaagagcctgtgaagaaagaggctgacaacattgtcgcagcaaggaagcagtgaagtatatcagcatgctgnatcgagccattttgtcgaagtattatagccgtagctcttttatgtaccttttcaggcagccttg

SEQ ID NO: 9413 - DNA, 649 bp, Zea mays
  unsure (1)..(649): unsure at all n locations; Clone ID: LIB3279-197-Q1-K6-F10
ngtctcccagnacctcctcagacccgagaagcgcagctgcggccatggacgccaccggcactggagctggagggaaggcgaagaagggagcggccggtcgcaaggccggcgggccgaggaagaagtcggtgacgaggtccgtgaaggccgggctccagttccccgtcggccgcatcgggcgctacctcaagaagggccgctacgcgcagcgcgtcggcagcggtgcccccgtctacctcgcggccgtcctggagtacctcgccgctgaggtcctggagctcgccggcaacgctgccaaggacaacaagaagacgcgcatcgtcccgcgccacgtgctgctggcgatccgcaacgacgaggagctcgggaagctgctgaccggcgtgaccatcgcccacggcggcgtgttgcccaacatcaacccggtcctgctgcccaagaagacggcggagaaggcgtccagcggcgggagcaaggaggccaagtcgcccaagaaggccgccaagtcccccaagaaggcatagggtttggaggcggatccgatgttgtcatgtgtaggttgtaagcgggcaatgtgattggctgtgtatctgcttcgctcaagttgctttatgtcattcctaatggaataggaaatgccgtgtttctt

SEQ ID NO: 9414 - DNA, 670 bp, Zea mays
  unsure (1)..(670): unsure at all n locations; Clone ID: LIB3279-197-Q1-K6-F2
ccggtccggaatccgtcgcccagcgtcgggaaaccaaaaataactcacaagcagctgccctcctttggccatcggaatcttggaaatgaaccctgaggatgaagctgaggaggatgggctacattgatttaactcacaaagaaggaaaatgtgttgttctgaagacctccacaagacaaactatattccttcctgttgttgggctagtggaccctgacaagctaaagcctggtgatctggttggagtcaataaagatagctaccttatactagatacattgccatcagagtacgattcacgagtgaaggcaatggaagtggatgaaaagcccactgaagattataatgacattgggggtcttgaaaagcagattcaagagcttgtagaggcaattgtactgcccatgacacataaagaccggttccagaagttgggtattcgtcctccaaaaggggttcttttgtacggaccaccaggaactggcaagacactcatggctcgtgcatgtgctgcacagacgaatgcaacgtttcttaaattagctggtccacaacttgtgcagatgtttattggtgatggagcaaagcttgtccgggatgcattccagcttgccaaagagnaagctccttgtattatatttattgatgagatagatgccattggcaccaa

SEQ ID NO: 9415 - DNA, 174 bp, Zea mays
  Clone ID: LIB3279-197-Q1-K6-F4
gagagcatgcctgtgactattgcgtgcgtgcagtacctgtttgatcccggacttgtccatggatgcagcgagcttcatcacgacgtcgtagacttccttgtaagtccaccaggtgtactcgcccgcctgcatgcatgcagttttatttacaaaaccaatattatacgtaagcac

SEQ ID NO: 9416 - DNA, 516 bp, Zea mays
  Clone ID: LIB3279-197-Q1-K6-F5
cagcaagcattgcactccgattatctttttattctttccttaccggggtcaaaaccccaaaagcagctagaaagtcggcaagtcacgcacccaaacaggaaaccaaggcatacgggggctagctactgtcttacacacctaaacaggtacctcctatagctatccccagcatgtaacttgggccaagaacacccaccaccaccaccaccaggtcaccaccctaagcatcaacaaaacaaggggtcgactgtctttttcttttccgagtcaccacagctattcctaccctcctttgggtttggctccggctactcaaaaagccagtggcggcagtggcaggctgctgttgagccccgatcgcatcctccttttcctaagcctttttgggatgataaaggcgagctccagggactgggaggcattcagccttgggtcgcagtgggtgtggtagcggtcgctcaaatcgtcaaaggtcacggtccgtgatccaccgatgcactcggtcacgttctgccc

SEQ ID NO: 9417 - DNA, 432 bp, Zea mays
  unsure (1)..(432): unsure at all n locations; Clone ID: LIB3279-197-Q1-K6-F6
gngtacaaggacaaggtccctgctngagtcaccaaggagatcgagtctgctgtctctgatctgagggcagctatggctgaggacgatctggacaagatcaagcagaagctggaagcagcaaacaaggctgtttcaaagattggagagcacatgcaacaaggtggtggtggcggcagcgctggcggcagcggcagtggaggagaccagactccagaagctgagtaccaggacgcaaaggaagccaagatgtaggtcgaacctccatcaagtctctagtttttgcatgtgcccatttaggaagtaaacttacctacctccgatttcttatttttctgtgagggttaagaggactgtaactgttgttgccaaattttgggtcacggataaattgaggggaacggactcatacgttaattgaaccatttatatact

SEQ ID NO: 9418 - DNA, 468 bp, Zea mays
  Clone ID: LIB3279-197-Q1-K6-F8
ccagcgtccgcgaactttgaacctccaccgtttggaaacctttctaagagctggtgtcccagagcccataagaatgatgctggttaaattccacacgaagactgatgcgatgaatgccttcatcaccaaaaacaggagtttctgtctgaacagtcaagttagcatgcgtgttctccagtaactgagtagccagtcgaatctcgtgatgtttgccccggctttgtcaaacaaaaagccttttaagtccgatctgaggtctatccagtatccacaaatgttgccgtattgtgtggttgtgcaggttatattggactggcagcctgctttaggttttgattcctactagtttgtggtttcagctgtactgcaccgcttttatttcatgagtactctggaaaatgtaccaccattccgctttacaatgaaataattaacggcacaaaaaaaaaaaaaaaaaaaaagggcgat

SEQ ID NO: 9419 - DNA, 626 bp, Zea mays
  unsure (1)..(626): unsure at all n locations; Clone ID: LIB3279-197-Q1-K6-F9
gnaaaactcctagtcctaggttggagcggttgcgttgtgctagctacactagattctagctagagagctagtagctacttgcattaggctactagccggccatgggttgctgccgcaccggcgtccactgcggtgctggaccgagaagaaaccaactgcggcgatgttggggtggtgggggctcgctcgtgctgctattgctgctgctggtggcggtggcggtgccggcgcgagggcagcggtcggacggcgtggtgatcgcgcaggcggacctgcaggggctgcaggccatccgccaggcgctggtggacccgcgcgggttcctggccggctggaacggcacgggcctcgacgcctgctccggcggctggacggggatcaagtgcgcgcggggcaaggtcgtggccatccagctccctttcaagggccttgccggtgcgctctccgacaaggttggccagctcgccgcgctccggaggctcagcttccacgacaacatcatcggcggccaggtgcccgccgcgctcggcttcctccgggagctccgcggcgtctacctccacaacaaccgcttcgccggtgccgtgccttcggcgctcggcgcctgcgcgctcctgcagacgctc

SEQ ID NO: 9420 - DNA, 642 bp, Zea mays
  unsure (1)..(642): unsure at all n locations; Clone ID: LIB3279-197-Q1-K6-G1
gttcagacggtccaanaacagcaccaanaaagactccttgccgctcttcttgcttggctactgactaggagagctccctgccgctggttgatcaacagaggcaggcggacggcatggtcagctctatgccgctgtcctcgctgctgctgctgctctccgcagccagcttcggcggcggcgtaaggctcggcgatggtggctacgaggactggaggctcggcaccgccacctacgtcaaggagttccagtcacaccctctcaatgacggcggtggcgcctgcgggtacggcgacctggacatcttcaggtacgggcgctacacgacggggctgagcgcggcgctgttcgggcgcggcggcgcctgcggcggctgctacgagctgcggtgcgtcaaccacatccagtggtgcctccggggcagccccacggtggtggtgacggcgacggacttctgcccggccaacatgggcctcgccgacgacgacgccggcggctggtgcaacttcccgcgggagcacctcgagctgtcggaggccgcgttcctccgcgtcgccaaggcccaaggccgcatcgtgccggtgcagttccgagaggtgagctgcgacagggcgggcggcatgcggttcaccatcaccggcagcg

SEQ ID NO: 9421 - DNA, 581 bp, Zea mays
  unsure (1)..(581): unsure at all n locations; Clone ID: LIB3279-197-Q1-K6-G10
ggnccagctagctagctcctcccactgctatcacccgggccccggccagccatctcgctgaaagagaaaagcgcagccatgaagactactagctcgggcattgcagccgtgcctgcccttcctgcagggcaaggcagccaaacccagcgagagcaacaaccagtgctgcgacggcgtgaggaccctgtacgcggcggcggacaccaggcccgacaggcaggccacgtgccggtgcctcaaggcggcctacgttcaggtccacgctgtgctctccgcggcgcaggagctgcccagcgactgcggcctctcgctgtcctacaacatcacccccgacatcgactgcgacaagatcgaatgaagggatactgttcccttaccagaatccatacgacgggatggtgatgttcagtgccctgctagcagtaggctgcatctgcactgagtgactagaataaaggatttggtgatgtttgtgctgattggtgtgttcgcctgtaatcgtgtgatgccgtcgttggcttcttatatccgtgtctaatctcgcaagtgctcgtgtttgcaactataccatttataatgtc

SEQ ID NO: 9422 - DNA, 625 bp, Zea mays
  unsure (1)..(625): unsure at all n locations; Clone ID: LIB3279-197-Q1-K6-G11
atgcatgcgatgcaactatttggaatccctaatggattctcgcgcgttggtactctttcatacacagnaatattcactgagaaattctatcctaaaagagcagcaaatacctgtccatcgaaacttagcgctctaaagtatntgcatcaggaggcaagaagtatgtttgatcacagtctaaatagacatacttacagttagtttggatagagaaacatatgataatncaacagtattctggaatacaatttgaacatcgtncacatncacattttggatggacacatctgattcgtgaagggataagtatgactatgatacacaggtgaaaggacaataccgtggaagactaataataggacttatagggaatctgggtgccagtctgaagcagcaaaaatacatacgtggaaattagacatgtgaacctggagaatgaagaaaaggaaatccaatatgacttgtaaaaactaatgaacaactttaattgaacaaccagcctcatcatataataataaaaaagctataggaggaagcatataaaaaggtatactggacaaattaaatatttaagcatgttccaacaaaattgttagtttcttacaaaatcgagggggggaaatct

SEQ ID NO: 9423 - DNA, 662 bp, Zea mays
  unsure (1)..(662): unsure at all n locations; Clone ID: LIB3279-197-Q1-K6-G12
cccacgcggccncgggcncgtggggaaacatctattcattttatnatctnnnnttgatgaacggggcgttcctggggtnnatatgcaggcacttcattcgggggtattnggggctcagctaaccactcggagggctggagnnncncnagnngcttgngtaaccacaaggctgatattggcgggcgggggggggggggggccgggggggggggggggctgctacggttgggagagaagtgggtggggggggggggngggcgtggggtgggtgggtggtgggcggcgaggagggtgggtgaggtggtccgggttgcgggcgggttgtgtcggcgacgtggggggggcgcggggcgggtggggtgatgggggggggggggggggggcggggggcggggggggggtcgggggagctgggttgggcgggggggtgggggtcgggggcggggggggggggaggggggcggtggcgcggggcgggtgggtggggtgggggcgggggtgggggggcggcgaggggggtgggcgggcgggggtggggggcgcgtgctgttgttggcgctgtggtggntggcgtggggtgggggtcctgggggcggggggtggggtggtggggcgggggggggggaggggcggggggggcggcgggggttggggtggggggg

SEQ ID NO: 9424 - DNA, 653 bp, Zea mays
  unsure (1)..(653): unsure at all n locations; Clone ID: LIB3279-197-Q1-K6-G2
cgaaaggaagacgttgcagccctctctcaaaattgttgctactttacaccagagagcgcaagacaggatggatgctctggatgagaccagtgtgattgtgggtgccgagtcctcaaccttctcacggaggttatcagaagcgcagaagcaacaggatgagcaggacgatgatgaaggcactatcgctttcagtaagaactggctgtctgaaaataagaaacccaaaaccccaaaggaggataaaaagcgaccccgggaggatgatgatgtcgcgactgaggaggatcgggttgaggatttggtcttgagctcagatgaagaggatggcaacaatgaggaagcagacgatggttttgttccggttgaaggtgatagtgatgaagactttgtagaccctgacagcgaatataagaaacaaaagaaggcgaagctgaagaagaggaacaagcgccagccatttctgcacaaggcgccctcgagaacaaaaagtaattcagggcccaagaagaaggccagacattagttatgcctgatagggcttggcaaatatgctgccgttgtgatgtatgcttctgagttccgaccgataaaaacattgtcccttgagtggaaaaatattatattttttcaagaaagttncaagtctttttttg

SEQ ID NO: 9425 - DNA, 636 bp, Zea mays
  unsure (1)..(636): unsure at all n locations; Clone ID: LIB3279-197-Q1-K6-G3
ccccgcgtccgattcgttccccgcctcaccccgagccagccgtctcgctagggtttcgccgccgccgccgccgccgccgccgctatgcctcgccgcagctcaggaaggtctgccccacgcccagctccccgtgctgctccagtgaggaacccgccacagccagcacgccaggctcctcctccagctcctgttcgagatggtggtggctccatgtttggaggaattgggtccaccattgctcaaggtatggcgtttggcacgggtagtgccatggcacacagggctgttgatgctgtattaggtccccggaccattcagcatgagactgttgcctcagaagctgctgctgctgcccctgcccctccagtgatgaatgctgacgcttgcagcatccattctaaggctttccaagattgtctcaacaactatggcagcgagatcagcaagtgccagttctacctagacatgctgaacgagtgccgccgtggtggtgtgtctgcctaagctgcttctggggttattcgtggattttctttcggtgatgctatctcattaataagatacccgtgaaactnttgtctccacagcttgaagctaaacttcctgggattaatacattttgttatcctatgctgt

SEQ ID NO: 9426 - DNA, 615 bp, Zea mays
  Clone ID: LIB3279-197-Q1-K6-G4
cccacgcgtccgcccacgcgtccggcttgcttgattgttccagatattcgcagttgaccgggtcctcggagcacgatgaagtttgttgctgcctacttgcttgctgtcctcgctgggaacgccagcccctccgctgaggatttgactgccattctggagtcagttggctgtgaagttgacaatgaaaggatggaactcctgctgtcccaactgagcggtaaggacatcaccgagctcattgccgcgggcagggagaagtttgcttcagtcccatgtggtggcggtggtgtcgctgttgcggcagcttcacctgctgctggcggagctgctcctacagctgaggcaaagaaagaagagaaggtggaagagaaggaagaaagcgatgatgatatgggcttcagcctcttcgactaggctgcacagtcatcacagtattgtttcgggcagtgaaaccagaggaaaaccagagtcatgtttagattttaaccttgttttatgttggaaagtactgctacttgtctttatatttggtaattcagccgtaggttgctatgctggttgggatttactcgtgaaccagagtttttctatcttatatcctgaatttggtatccc

SEQ ID NO: 9427 - DNA, 668 bp, Zea mays
  unsure (1)..(668): unsure at all n locations; Clone ID: LIB3279-197-Q1-K6-G5
gnaaacttgaccatacttgtctcaatgagactttggagtgaaccaaatgagcttatgttcttatatgactactagctagaagttagagcctagatgatggctgcttctgttggcgtgaaagctcgagtgctcctaaatggtcgtcgtattagctgatacgacatctacccgatgcaatagataatattgtttacacgcgtgagtccaaaattgttggctttgggtcggagcagttaatgcgagaagtgtattttatcacttctgagtgcaaccttttttttattatttttccgagcttctgcctcttgcatatgttgtagattctcgccgagaagggagtagtagtattacctgatatctatgctaattcaggtggtgtggtcgttagctactttaattgagtgggttcaggtaaaatgcatgttcgtcgctgcttcattgctcgattggttccttgctctaatctgctttcttgtgccatgttgattgatcgtgcagaacattcaaggtttcatgtgggccgaggagaaagtggacgatgaactagaaaagacatgagcagtgcttttcaacacatgaaggccatgtgcaaatctttggtgctgccgaagtgtgtcgtgacattggaattgcgggtctagaaaaacagctcatagatttctgaaaaa

SEQ ID NO: 9428 - DNA, 643 bp, Zea mays
  Clone ID: LIB3279-197-Q1-K6-G6
cccacgcgtccgcaattcctctggaattagcgaagatgcagctgggctcccatatttgtgaggcagtcaaatttcaagttacctgctgacccatccactccgattatcatgattggtcctgggacagggctggctccttttagaggtttcttgcaggaaaggttagcactgaaacaatctggagcagaactgggcacttcaatccttttctttggatgcaggaaccgtaatatggactacatatatgaagatgagctgcaaactttccttgaggagggggcgctttctgagctaattgttgcattctctcgggaagggccaactaaagaatatgtgcagcataagatggtggagaaggccacagaaatttggaacatcatctcacatggtggttacttatatgtatgcggtgatgccaagggaatggctagagacgtacacaggatgcttcatacagtagtccaagagcagggatctttggatagctccaaaaccgagagctacgtaaagagcctgcagatggaaggcaggtacctccgtgatgtatggtgacacatcacccccattcagccatagctctagcgtgtggaagtaaagctggctttgcgtgtacgacatgcctaatgccaaatgaagcgtgcca

SEQ ID NO: 9429 - DNA, 631 bp, Zea mays
  Clone ID: LIB3279-197-Q1-K6-G8
cccagcgtccgcggacgcgtgggggcagttcgagagagagagagagagagagagagataaagatgtcgtggttcgggcaccaccaccacaaccagccggctcccccggcgtcgggccccaaccaggtgttcaagatcttctgccgcgccaacgagaactactgcctggccgtccgcgacggcgccgtcgtgctggccccggtcaaccccaaggacgaccaccagcactggtacaaggacatgcgcttcagcacccgggtcaaggacgaggaaggcatgccggcgttcgcgctcgtcaacaaggccacggggctcgccatcaagcactccctcggccagtcccacccggtcaagctcgcgcctttcagcccggaccaggaggacgcgtcggtgctgtggacggagagcaaggacgtgggcaagggcttccgctgcatccgcatggtcaacaacacccgcctcaacttcgacgccttccacggcgacaaggaccacggcggcgtgcacgacggcaccggcgtcgtgctctgggagtggtgcaagggcgagaaccagagctggaagatcctgccgtggggtcccgaggccaacttcgccgcggcccacgcgggtaggcccgcacgccgtgcgcg

SEQ ID NO: 9430 - DNA, 656 bp, Zea mays
  unsure (1)..(656): unsure at all n locations; Clone ID: LIB3279-197-Q1-K6-G9
ccccgcgtccgcagggcgcgatcgagtacatcgagcagctacaggcggaggagcggcgggcgctgcaggcgctcgaggccggcgagggggcgcgctgcggcggccacgggcacggcgaggaggcgcgcgtggtcctgcagcagcccgccgccgccccggcgcccgtggaggtcctggagctgcgcgtgtcggaggtgggcgaccgcgtgctggtggtgaacgtgacgtgcagcaagggccgcgacgccatggcccgcgtgtgccgcgccgtcgaggagctccggctccgcgtcatcaccgccagcgtcacctccgtcgccggctgcctcatgcacaccatcttcgtcgaggtggattcggaccagacgaatcgtatccagatcaagcacatgatcgaggccgctctcgcccagctagatgatgcctccgcgagcccgccgagcgtgatgagctactattagaatcggacaaccgtcacgctgacatgcacgagccggcctagctactgtggccgaccggtactgttccgtgcgcgtatataggaactaggaagaagtgggtgctttgtttgctatatatgaggcactaggtcaggggctttatgcaactttgatgtaatggaccgaanagacagattgagtgttggcggctagctc

SEQ ID NO: 9431 - DNA, 656 bp, Zea mays
  Clone ID: LIB3279-197-Q1-K6-H1
gcacgtgccccgtgctgtttttgttgaccttgaacccactgtcatcgatgaggtgagaactggcacctaccgccagctcttccaccctgagcagctcatcagtgggaaggaggatgcagccaacaactttgcccgtggtcactacaccattggcaaggagattgttgacctgtgccttgatcgcatcaggaagcttgccgacaactgcactggtctccagggcttcctcgtcttcaacgctgttggtggaggaacgggctctggccttggttccctcctcctagagcgcctgtctgttgactacggcaagaaatccaagcttgggttcactgtgtacccttccccccaagtttctacttcggtagttgagccatacaacagtgtactgtccacccactccctcctcgagcacactgatgtggctatactgctggacaatgaggccatctacgacatctgccgccgatcccttgacattgagcgcccaacctacaccaacctcaacaggcttgtgtcccaggtcatctcatcccttactgcctccctgaggttcgatggtgctctgaacgtggatgttaacgagttccagaccaacctggtaccctacccgaggatccacttcatgctttcttcgtacgctccagtcatctctgctg

SEQ ID NO: 9432 - DNA, 633 bp, Zea mays
  unsure (1)..(633): unsure at all n locations; Clone ID: LIB3279-197-Q1-K6-H10
ccccgcgtccgccagccgccaccaggtgcagagtctttcgtcatctcttctccggcgaagaacccccagtcgcccaccagatcacttgttaaactttgttgaggggtgatggcggtttctttcgcaaacctcaacaccgaggcagggcttaaaaagcttgatgagtaccttctcactcgcagctacatcactggctaccaagcttccaaggatgacttggctgtctacacttcgttttcgtctgctccctcgtccaagtatatcaacgtagcaaggtggtttaatcacattgatgcgctcgtgaggctgagcggaattactgcagagggccaaggtgtgaaggttgaatcctcagcagttccttcagccccaactccagatgttgctgaagcacaggccccagctgctgaggaggaggacgatgatgatgttgacctttttggtgaggagaccgaagatgagaagaaggctgctgaagagcgtgctgcagctgccaaggcttctggcaagaagaaagaatctgggaagtcatcagttntacttgatgtgaagccatgggacgatgagactgacatggccaagcttgaggaagctgttaggagtgtccagatggaagggctgctctggggcgca

SEQ ID NO: 9433 - DNA, 687 bp, Zea mays
  Clone ID: LIB3279-197-Q1-K6-H3
cccacgcgtccgcggacgcgtggggtgaagtgttcggatcgcggcgacgggggcagttcgccgcccccgacgtcgcgagaagtccattgaaccttatcatttagaagaaggagacgctcgcgttggcgtcgctcatcgacgacgaaaagaagcttggcgactgccagttcgacctctggaagcagtactacgtggccacatgcgtcactgtgttcggcaagctccggcgcagccgtcgcttggacgcggtccagagcggctgcaccgcgttgtccatcttcaaatagggggacctcatggtcgtcgccaacgccggcgactctcgggttgttctaggcaccgcatccgacaacggcgtcgtcacaccgtccagctcatcatccacctgaagctcaacctcccacaggagtagcacatccggtggtgcaacgactaggtgtactacctcgctgatgagcccggggtggacttcgtttggcagcccagccaagagtcatcagtactcgccatgtcgtgcacgttcgacgactactatatcaaggactatggcgtcatcttggcaccagaggtgacgcagaggaggaccgacggcaatgaccactcgtcatcgtcggggtagcttttgtgcccgcctgccttttattctcttcgcaccacatacacttgcttttttgtttaagcagcgtg

SEQ ID NO: 9434 - DNA, 664 bp, Zea mays
  Clone ID: LIB3279-197-Q1-K6-H4
gtggccatggcgtcatccgccgccgccgcctcctcggcttccgcgctcttccgcctcccggggtcgggtcacctgcgtgcaccgccacgaagcgggtggcgagaccacaggcggtcccgtcgcgcgaccgtgcggtgctcgttcgcgccggtggagacggcccggataaaggtggtgggcgttggcggaggcggcaacaacgccgtcaaccgtatgatcggcagcggcctccagggcatcgaattttatgctataaacaccgattcccaagcccttattaattcacaagcgcaatatcctctgcaaattggagagcagttgacccgcggcttaggtaccggtggaaatccgaatttgggagagcaggctgctgaggaatcaagagaaaccatagccactgccctgagggattcagatcttgtcttcataacagctgggatgggagggggtactggatctggtgctgctccagttgttgcccagatatcaaaggaagctggttatcttactgttggtgttgtcacctatccattcagtttcgagggccgtaagcgctctgtacaggcattggaagcactagagaagctggaaaagagtgtagacacacttattgtgattccaaatgataagttattagatgttgcggatgaaaacatgcccttgc

SEQ ID NO: 9435 - DNA, 631 bp, Zea mays
  Clone ID: LIB3279-197-Q1-K6-H5
cccacgcgtccgtctttttcggcggcgacggctggtcgagttgcggcgctctgttcagtgttcattgtgcccttcgccacgacgattatcctccagtagtaagtcaccatgtcttcgtccatgcaatcttcataccttcctgctaccactgagtccgtagccaaggctcaggaggccaaggacgcttctgagtccatctcaatcctctaccacgtgcttgaggatccctcttcatctgcggatgcactgagagtaaaagagcttgccatcacgaatctcacaaactacctcacaaaagagaacagagctgaagacctcaggaaccttttgacccagctcaggcccttttttgcattgatccccaaggcgaagactgcgaagattgtgcgtggcatcattgatgccgttgccaaggtgcctggaacatctcagcttcagatctcactgtgcaaggagatggtagaatggacccgtgcagagaagcgaaccttcctcaggcagcgtgtggaagcaaggctggcagcccttctgttggagaatcaggagtatactgaggctcttacactcctttctggactcatcaaggaagttaggaggctggatgacaagttgcttcttgtggacatcgacc

SEQ ID NO: 9436 - DNA, 660 bp, Zea mays
  unsure (1)..(660): unsure at all n locations; Clone ID: LIB3279-197-Q1-K6-H6
gcggcgngagcggaggcgnaagagtagcagcagcaggcggcgccgagtagcggctccccacctcgagcttgccaccatggctagaggattgaagaagcatttgaagaggctcaatgcgcccaagcattggatgctggacaagcttggcggagcttttgctcccaagccatcttctggacctcacaagtctagggagtgcctgccactgatcctcatcatcaggaacaggctcaagtatgctcttacataccgtgaggtcatttccatcctgatgcaacgccatgtacttgttgatggcaaggtcaggacagacaagacctaccctgctgggttcatggatgtcatttccatccccaagaccaatgagaactacaggctgctgtacgataccaagggccgcttccgccttcacccaatcagggatgaggatgctaagttcaagctttgcaaggttaggtctgttcagtttgggcagaagggcatcccgtacctgaacacgtatgacggccgcaccatccgctaccctgacccgctcatcaaggccaacgacaccatcaagatcgatctggagaccaacaaaattgtggacttcatcaagtttgatgttggcaacgttgtcatggtgactggcggaaggaacactggccgtgtgggtgttat

SEQ ID NO: 9437 - DNA, 625 bp, Zea mays
  unsure (1)..(625): unsure at all n locations; Clone ID: LIB3279-197-Q1-K6-H7
gcgaactgcccttcctgaaccgtggtggagcaaccagcaatcaagacggtcttggaggcctaccttccccagattgcactcattgtgttcctcgcgttgctacctactcttcttatgtttctctcgaaacaagaggggatcccttcgcagggccatgcagtcagggcggcatcggngaaaatatttctatttcatcgttttcaacgtcttcctttgctatacgcttggaagcacattgttcaaatctttgacgaccattatcaatcaccctgctgagattgtgaatatgcttgccaagagcctgcctggaagcgcaacgttcttcctcacgtttgttgcgctgaagttcttggttggctatggccttgagctctctcgcctggttcctctcatcattttccacctgaaaaggaagtacctatgcaagacggaggaagaagtgagagcggcatgggctccagtggatctgggatataacaccagggtaccaaatgacatgctcatcgcaacagttgttctgtgctactcagtcattgcgcctttgattattccgttcggtgtcgcatactttgccctcgggtggcttatagcaagaaatcagatcctgagagtttacgttcctagc

SEQ ID NO: 9438 - DNA, 71 bp, Zea mays
  Clone ID: LIB3279-197-Q1-K6-H8
aaaaaaaaaaaaaaaccatttttttggggaggaaccacgggatttattttttttttttttttttttttttc

SEQ ID NO: 9439 - DNA, 575 bp, Zea mays
  Clone ID: LIB3279-197-Q1-N6-A1
atcttaagagctattgtattacgagctgaacttacagtccaacacagtagttcagtacagaacatagataatccagatttaaaacatcggtgccggaaacgtctcgagaggcaaggctgcctgaaaaggtacataaaagagctacggctataatacttcgacaaaatggcctcgatcagcatgctgatatacttcactgcttccttgctgcgacaatgttgtcagcctctttcttcacaggctcttccttctctgacaagatcagctcaatgtggcaaggtgaggacatgtagggattgatgcgcccgtgagcacggtaggtgcggcgcctctgcttctgggcttgattcacctggatgtgtgaaacatagaggttgtccacatccaagcctttcacatcagcgttactctcagcattcttcagcaaatccaggatgaacctggctgatttaacgggccagcggccctgcccattggagtggcgcgacttagcttgcgcggtgcgaccaacacccccacagtatctccggaagggaattgcctgcttgtgagcaataacatcctcaaggtatcgc

SEQ ID NO: 9440 - DNA, 395 bp, Zea mays
  Clone ID: LIB3279-197-Q1-N6-A10
gcacattagaaaacctttggttattcttaaacagtaactatggtttcaggtagataaagttttggaatacaggttacaagaaatgtgcatcctgtgagctcaagtaccatattattgccaccattatcttttacaaccagaaaacttgcagaaaaaggagatatttgaaagctgaaacgaaatttgtgcagctgctcatggagtccaagcccaacaagggtgcctggatcatttctggtagccaccgccgaccgtgttgtcgtcctcctcgacaggggtgttgacgtatggcacggggaagtccttggtggggtcaaactgcttggtgaccatgtaacgctcgaggtccggcttgcggagcacggtgcggcgcacgggcggacggttcctaaggc

SEQ ID NO: 9441 - DNA, 562 bp, Zea mays
  Clone ID: LIB3279-197-Q1-N6-A11
acaaaaaaacttctgttgccatttccctccaatttacagagatagtccatgggctcaatgacccattttacatacaaacttcatgcacgcatcacaagaagatagagatgttttcaataaatgggttgtttacaaatacagataagatggaaacgtaaatcaaatcaagaactagtagggttttatcatgccataaaaaggggaagtcctccagtgtccagtcctctgttgctataagccacttcatatttccagcagtcagttgccttgtaacttcattgatagtatccattgactagggaaggcgaagcaattgactgacagccaaatctagtgaatcaacattcttccgtagaatcttcctttcaaaatattaagattcaacaagtagctccgaaatgaacagtgttcagctagatatggaaagtacacaaattgggagaatcatattaagatggccactcaccaattccacagaatataatagaactaattttgtcagcagcgaacaaaaggatacagttgcatagctaagctttccaagcctctcatttcctccgga

SEQ ID NO: 9442 - DNA, 56 bp, Zea mays
  Clone ID: LIB3279-197-Q1-N6-A12
cctgaatttcatcttctatgttttaggaggattttgttcagtgcttttctaatctt

SEQ ID NO: 9443 - DNA, 123 bp, Zea mays
  Clone ID: LIB3279-197-Q1-N6-A2
ctttcttaagctttgattccttttaaagcggcccgccctctcttttttttttctccttttttcttttgttcttttgtgttttttttttttaaacaagcaaaaagtccctcgttttttattatg

SEQ ID NO: 9444 - DNA, 538 bp, Zea mays
  Clone ID: LIB3279-197-Q1-N6-A3
gcagcctaggccgaggtgaacttggtgacggccttggtgccctcggagacggcgtgcttggcgagctccccgggaaggacgaggcgcacggaggtctggatctcacgggaggtgatggtaggcttcttgttatagcgcgcgagcttggcggcctcagcagcgagcttctcgaagatatcgttaatgaaggagttcatgatggacatggccttggaggagatgccaatgtccgggtgcacctgcttcagcaccttgaagatgtagatcttgtaggtctccacgctcttcttgcccttcttcttgcccctcttgccctcgccgccttccttggcagcggacttgccagcggggacccgcttctccgccttcggcttcttcccggcgggcgccttctcggccgcgggctcctcctccgccggcttcttcgccgcgggtttcttctcggccttgggcgccatcgatgcggggcgagttggggttttggttgcgaaggggggatcggatgggaagaaatgcgaggagatcggacgcgtgggtc

SEQ ID NO: 9445 - DNA, 443 bp, Zea mays
  Clone ID: LIB3279-197-Q1-N6-A4
agtgtcggttaaaaacctgttactgtaaggccttgtttgtttgtgccggattgcacccggaatcgttccagctaaggccttgttcgtttgtatcagattgcacccggaatcgttccacctaatcaaagtttatataaattagagaagcaatccggttaagaatcgttccgacccaccaatccggcgcaaacgaacaagccctaatcaaagtttatataaattagagaagcaatccggttaagaatcgttccaacccaccaatcccaaacaaccgaacggcacctaaaagaaatacggacttgtcacgactcacgacaattgtgtcagcaatacgaaattacatagagaagagcgagggtgagtcagaatcattaccagctagggtgtgcacatcccatctactaggtcacttcctcctagaaggcaatgttcccacaggattt

SEQ ID NO: 9446 - DNA, 445 bp, Zea mays
  Clone ID: LIB3279-197-Q1-N6-A5
ttgttttttttttttttttttttttttttttttttttttttttttttttttttttttttttttttttttttttttttttttttttttttttttttttttttttttttttttttttttttattttattttattttatttttttttttttttataatttttttttttttaaaaaaaaaaaaattaaaaaaaaaaaaaaaaaaaaaataaaaataaaaaaaaaacgggggaaaaaaaaaaaaaacattttggtcatagaaaaaaaaaaaaaaggagaaaaaaaaattataaattatattactggcgcggaaaaaaaaaattaaaatgagagcttttttttaaaaaaagaaaaaaaaaaaaagttgtggtataccaaataaaaaaaaaaaagcctttcttttgaataaggggacatgtttaagaagaaaaaaaaaaatttttttttttt

SEQ ID NO: 9447 - DNA, 428 bp, Zea mays
  Clone ID: LIB3279-197-Q1-N6-A6
cacaaatagggcgctaggagtacaattggaatagatcttccacacatgcaatataagtattagtttgcgaccttaaccatcctacattacagtaatcatactacccagcgacggttggacacaagatagtttaagctcaacataggtaactcatgatcaatatgaccaacatgaccaacatggctaagttctccatcataaacgtagcagtctttactagcagacttttgaacaaaacatctaaattactggaaataaaactacaaccttgcctttaccacatggtccattcccacctgatttcagcggtacttgatgaagccaatgtccttggcattgctgcggaagcactgcctgcagaaaataagcccgtacttcctgatcagtccatgagggttcgcacagacacggcagacgcgggatccggg

SEQ ID NO: 9448 - DNA, 336 bp, Zea mays
  unsure (1)..(336): unsure at all n locations; Clone ID: LIB3279-197-Q1-N6-A8
ttcttttttttttttttttgtttatacaacatttccacaccgtcaatgagttaattttaaaggacctaaagcgcgagcattacaagcacaatctatgagttcaaaagcccaggcctattaagttcttacaaactagccattgcagacacactgcggatccatacaagcttatgaagactgncaaagctctgggcgcacgaaatatgcttcagcggtgactgagatgtcaacggttggcctcatctgatcacaaacttttatggcaccgttcacagggtcagacatgaagtttctgatgaggacctggaagttcggtctcttttttgttaacagtta

SEQ ID NO: 9449 - DNA, 368 bp, Zea mays
  Clone ID: LIB3279-197-Q1-N6-A9
aaaacgaaggacaagcaggaaaaggtggcattataaaggggatagttggaaacccgagcccttgggagattagacccggttttaaaaagccaagggcgggttgacacgattacgggggaacccaccaatcagcaaaaacatcaccaaatcctttattttagccactcaggggaaatgcagcctactggtagcaggggactgaaaatcaccctcccgtcgtatggattttgggaagggaacaatatccctttatttaatcttggcggaaaaaatggcgggggtgatgttgtaagaaaaggagaggccgcagttcccgggcattttctgggccggggagagcacaggggggaccttaacgtaagccccct

SEQ ID NO: 9450 - DNA, 598 bp, Zea mays
  Clone ID: LIB3279-197-Q1-N6-B10
gaatcaaagcactgaatcacattcataacagccaaactgatttgcctagaacatcagtacacgattgcaggacaagaagcgatagattccatcccctagttcagacactacagaaacaggaagacagagcagcaatcaggccctctcgcccctgatgcggcgcgcgagctggatgtccttaggcatgatggtgaccctcttggcatggatggcgcagaggttggtgtcctcgaagagacccaccaggtacgcctcggcggcctcctgcagcgcggcgacggcggaggactggaaccggaggtcggtcttgaagtcctgcgcgatctcccgcaccagccgctggaagggcagcttccggatgagcagctccgtgctcttctggtacttgcggatctcgcggagcgcgacggtgccggggcgaaacctgtgcggcttcttcacgccgccggtggccggggccgactttcgcgccgccttggtggccagctgcttccgcggcgccttgccgccggtcgacttcctcgccgtctgcttcgtgcgcgccatcggagagagctgcgtgagggcgggcggcgctgtgcgatcgaaggatttgaaa

SEQ ID NO: 9451 - DNA, 576 bp, Zea mays
  unsure (1)..(576): unsure at all n locations; Clone ID: LIB3279-197-Q1-N6-B12
ttttgaagacaaatcacagcaaccatttagaagatactacaaggagacattaaccacataatgagatcttcaaagctcaggtcacagacacacaggttcacattatgttccaaaactctcatccaggcacagagcagttttcaaataacataagacctctatcacataacaattggtagcaaaaactaaagagatgaggaaaaggcggtacgacaaccatcagatgaccgtgaagagtctagtcgatctcctggagagaggcgccggtggcggcgccaccagcggcggcggcagcgacgtcatcggcagtaaacttgcccttagccttgtcggcggcgcggccccgggccttgcggtcgaggagcgccttacggtccttgtcgagcttcagcttggtgacgatcaccttggaggggtggatgcccacgttcacggtggagccgttcaccttctcgcgggtgatccgctcgacgtggatgacccagcggcggcggtacacctgcaccaccttcccctcacggcccttgtaggtgccgcgcacgacctgcacctngtngtccttgcggatcgggatgg

SEQ ID NO: 9452 - DNA, 558 bp, Zea mays
  Clone ID: LIB3279-197-Q1-N6-B2
tttcaccaacccaacgcgaagataaattattcactgcatgcaatacgccaagcacatgcacaagcccacatattacagaaccaaatgaggtgcaaacttaagtgcccaatgaccaaaatagcattatgacaaacttagaagccctgttcgatcaggtaatcgccgagcctctccaccaccatattgcattgccctggagtcattggctcatcatagataccgataatcaaggacatgccagttttcttgatagtaatgcctccagtgcccttctttcctcggatgacaactccaggttcaccttggatcaccatgtacttcgtacctccaacaaaaagaccagttggtgcaagagttccaggttcatcaaagtcctttatcatcccagcaacctcctcaggctttaactcgggggaagttctcggactgtgcccagacgctgccgtcgtggccgacgatggcggcggcgctgaggtgctggccttcgatgtcgacagcaggtggtcattgacgtacgcctgccacgacatcttgctgctcgctcttcctcctgctccg

SEQ ID NO: 9453 - DNA, 175 bp, Zea mays
  Clone ID: LIB3279-197-Q1-N6-B3
aagcttcacactttttatgtgaattaagttccgatccaaaacatcctttttaccctaatttattacatgaaagaaaaaaaatgttccttctagaggctactgaacatgacactgctttccaaacagacaaaaatggaatgggtccaattataccaagaggtgttctgtgctgtct

SEQ ID NO: 9454 - DNA, 619 bp, Zea mays
  Clone ID: LIB3279-197-Q1-N6-B4
caatctggaggctttcatcactcaagtcgaattatgttagcgaaacatctgttcgactccacagaagcaagcaacaatgacataagagttgtccctaattgcctcaaatcataaagctcctacaagcccacacgtgctgctgaacgtgtggatccttcttaactctctatgggaaagttgaaatgcgaggatatgacgaaaagccaggcagaactcagcgcacggtaactaaagccgcagaagatcttcacttcttcctcttctttgggggctggagcgagtcttcatcatcatcttcctcctcatcctcgtcctggtcatcatcttcttcatctacaccctcctcatcgtcatccccattgtcgtcgtcctcgtcatccccgttctcatcatcgtcatcgtcgtcgtcgtcgccgccaccctcctgatcttctggttcttcctcatcttcctcaccattttcctcaggatcacctctttgcttcttggtctcattgccctttgggttgtcatatccctccccttctgagacgtcctcttcaccctcctccccaaagtcaccatcctcgtccccatcgtcaccaccatcatcatcttcatcgccagcatcgacaggttc

SEQ ID NO: 9455 - DNA, 603 bp, Zea mays
  unsure (1)..(603): unsure at all n locations; Clone ID: LIB3279-197-Q1-N6-B5
agatggcaaccatatttattctagcacaaggcaaccgcaacaccgagagatagtaacgcgtacactaatgtacctagaagaccaccctcttgttaaacgctattctacacccatgaaaaataaaaccataggggagaatatgggagaacatagagtacacaatttacagggaaactactctgcctatacaggtggatgggagggcagcgagaagacacaaatgaggtgcaaagaattagttggcaggccagacccagccagccatcatcatatggggctactgaaacctctactaattacacagctacggaagccagcagctggctagggcggtaggagagcgccccagcactggctagcactgtggtggcaatctccgccgctgttgttgtgccatctttgtatgagcctgctgcatcctatcagcatacatcgggagaagacttatctcatcaatctcttcgagaagcttttcctcggtaatgttatctgtgatactcctcatcacctgcagaccatgcaaataaactgtaaaaatanttgcagtatccccacccaaatatggagtacttgtttcaaagtggacaaaatatgatgcccaac

SEQ ID NO: 9456 - DNA, 574 bp, Zea mays
  Clone ID: LIB3279-197-Q1-N6-B6
ttcgagaactgataacatagttcattgccatttcatatgcatcatgataataagttacagcagtgaacaaccaactactcgatgattcgacagtaacccaaactacagaacccagcacatctctacatcttctgatcgggcactgatgacagaatatacgatgcttaggccctctccccacggatgcggcgggcaagctggatgtccttgggcatgatggtgacgcgcttggcgtggatggcgcaaaggttggtgtcctcgaagagaccgacaaggtaggcctcagccgcctcctgcagcgcggagacagcggagctctggaagcgtaggtcggtcttgaagtcctgcgcgatctcccgcaccaggcgctggaacggcagcttgcggatcagcagctccgtgctcttctggtacttgcggatctcccggagcgcgacggtaccggggcggaagcggtggggcttcttaactccgccggtcgcaggggcagacttgcgggccgccttagtcgccaactgcttcctcggcgccttgccgccggtggacttcctcgccgtctgcttcgtgcgggcca

SEQ ID NO: 9457 - DNA, 508 bp, Zea mays
  Clone ID: LIB3279-197-Q1-N6-B7
gccggtagaagttcccttgtacattatcagtcattagatacgcaccaccattcacgcttggttaaacaaaaaagcaagtgtttgtgtttgcgaagagaattaaagggaggccggcacaaaagcttccccgacgatgacgagggggcattggcgtcggtccttctttgggtcacctttggtgccaagatgacgccatagtccttgatatagtagtcgtcgaacgtgcaccacatggggagtactgatgacttttggctgggctggcaaacgaagtccaccccgggcttattagcgaggtagtacacctagtcgttgcaccaccggatgtgctacttctctacataaattttggtcgaggacacttacacaacgttaggaacgaccgttgttccagcgcacaagaattcatgggcggtcagtagttacttacctgggagggtgagcttcaagtggatgatgagctggaccgtgtgaccacccccttgtcggatgcggtgcctaaaacaac

SEQ ID NO: 9458 - DNA, 551 bp, Zea mays
  Clone ID: LIB3279-197-Q1-N6-B8
gaagccaaaggggcctttttttttttgctttttctaaaccattttgggcatatggggataattcttttttaacttttactgggaagtttctacttcacatgtaataattggggttaaacacaatgaaacccaagctgaagttgctgccatcgaggctgaagcaataaccaccaaagcttcgaagagagctccttgcgtatataaatatgtgtcattttaacacctcaagccatcaaccatagactcattttatttatagcctcgcagcagtgtcgcctccatccaagccacaatagcccgccgtcagctaaggtcgcagccataagtcgtcatgatcatttcatcgaagttcgactgcctccccaactttagcgacaacttaggcaaaaaatttttcaccgtccattcattttccgagacaacccaaaacattgtcgtgactggctcggaaaaagcttcgtcaccacacttccggttcgtcggtcgatctccggttcattatcaaaaaccgagatatctgtcagcctaggatcgaagggattaattggaag

SEQ ID NO: 9459 - DNA, 112 bp, Zea mays
  Clone ID: LIB3279-197-Q1-N6-B9
caaacaacaaacttattcatgatttgtcatagttctgggtagtacgcacacacaacacaaccggtccattattaaaccaacactgacacgactcatgacacgaacagcagat

SEQ ID NO: 9460 - DNA, 596 bp, Zea mays
  Clone ID: LIB3279-197-Q1-N6-C1
ggtccactgtgatatactcagtttattgcattggcacgtcgttgtaacttgcttacatagtcattatagacacacatgtacaagctgaaacctgcagctaattccgtgatacctttcagtgattcctgattgctcattttagagagaacaagcttctacaaagtttatggaacccaacaaatgaacccctagggtcttcaatatctcatcacccagcagccacctgatattgttcttatcttgatttggtcagttttgtcagaggatatggtgagggatggttatgaggacgttgtaaacatatacatttcatctgtgctcatcgagcggatgagagagaaacaaaaggagattacacaactaacatgtagcgtttgcagatctaggtaaatacaatcacctcttctttgtactcacatacaagcacttatgacttatccatgtattttatgaactgaattgtgatcaattatactactgtgcttttaggacatgttatttttgcttaaaagtgccagactttcagttagtgcttttggcttgttggaaatggatgaggccgagatgctaactccccatgcttctctctcctatta

SEQ ID NO: 9461 - DNA, 494 bp, Zea mays
  Clone ID: LIB3279-197-Q1-N6-C10
ggagttcatacattgaccccaaccttgcgttcgaatggtgcatttttcttgataccaaaaaaaaaaaaagacagcaacaagcaaaaagtacatgtcgatcttatgtctctacatctgaaaaaaacgagtggacggactcctttgccccagtgccctatgttattctaacagcttggaaaagagcaggcgcaagaggggaagaatgtcggtgtcacgagtcgggcaggaactgggctttatcctcccgctgtacctcgtcctgcaactgctgcgactccttggctttggcgagcatatgcgccttgtacctccgcagcctctcctccatcctcgccttgtacgaggtctcgatgcggtgcatgacgtaaaatccaagtacgccaccgaggatggtgccggccatcacgcgcacgtaagcccaccgccgcgaccccggcggcgccatcgctcacaaatcaccaagctgataccgcgccgccttcagccgccgctgg

SEQ ID NO: 9462 - DNA, 413 bp, Zea mays
  unsure (1)..(413): unsure at all n locations; Clone ID: LIB3279-197-Q1-N6-C11
agaataaaaaattggggggggggggggggttttaaaaatttaaggttttaaaaaattaaaagggggggaaaagggtggaaaaaaaattaagaaatttaaaaaattaaatttttttgttttattggggagtttttttttttggggggattaggggggaattttttttttttaaaaaatttttggtttttggggggnnaggggtttgggaggggtaaggggggggaaaggantntgggggaaaattgggatttttgggggggggggtggagggtttaaaatttgttgtaaaaggagggggtgttaaaattggggtaattaggggggtggggggggggggggtgaaaatttttttttggggaaaattttaaaaaaattggaggnggggggaaaaagggggaggggggggggggggt

SEQ ID NO: 9463 - DNA, 441 bp, Zea mays
  Clone ID: LIB3279-197-Q1-N6-C2
aaacaagcaaaaagtactcgtttttcatcatgcagttgatcagctacatagtacttggatggagatagatttgtctcaaattcaagtaacttctgagcaaaacttgacaggataaatgttctttcactgatctaggccttgatagcgtacttcctcatggggaaatacttctcacgctttttttccctctcggtcttcaaggagagctggtgcttggtgaggcgcctgcggatggcgcgggtcttcttggggcggaggtcgagcgggagcaactttttttttttgtacgccttacgcagcgccgacttctgtttctgcgagatgacggtcagcaccccccccatggaggtgcgcacaaccttgatcttggagagcttgttgggagccccgccggtgaccttggctacgcgtagcagggagagctcccacttaaactcctta

SEQ ID NO: 9464 - DNA, 554 bp, Zea mays
  Clone ID: LIB3279-197-Q1-N6-C4
ccataacgacgttcttaataacccagtggcaaagcggggcggacataaccagaaagtcttacaacatcaggtgttgcaaaccacaacggggacaagagcagcacacaagcctgacgatgaccgcatcaggatacttctagtactcatcaccatcatcaccttcctcaccctcatcaaactcagcaccaacctcctcgtagtccttctcgagcgctgccagatcctcacgggcctcagagaactcgccctcctccataccctcaccgacataccagtgcacgaaggcacgcttggcgtacatgaggtcgaacttgtggtcgatgcgggagaacacctccacaacactggtggagttggagatcatgcacacagcgcgctgcaccttggccaggtcaccaccaggcaccacacttggaggctgggtagttaatgccgcacttaaagccagttgggcaccagtccacaaactggatggtgcgcttggtcttgatggtggccacagcagcattcacatccttggggaccacatcaccacggtacatgaggcagcaggc

SEQ ID NO: 9465 - DNA, 566 bp, Zea mays
  unsure (1)..(566): unsure at all n locations; Clone ID: LIB3279-197-Q1-N6-C5
gattcgcaattcgcatctgggttgctcgccaaaccaattccgagcacaaaaaactggcaatgtttcttactgacatctactagttataggtagaccgcatcaccaaatccacatgtgacagtgacatatcgaaccagagagtggaagctagaaaacctcagatgaagagcgctacaacactcagaaccggcgaaccgaagacctggggttgaccctcctcaccttggtggccatggaaacggcgccggacgcggcggaagccttcttcatctccttactgctcctgagcgaggacctcggccccaagtctccaccgcggcatgctgcgaagtcgacggctggcatagacctcctcacggactccgcgccgctggcggcgtaggccttcttggctacgcggcgtttggacagctcgacggcgacacaggggttctcggccatcgtctcggggtccactgccgcggacgcgaactcctcggaatagaaggggaagccctgcttgcgcttgagccgctcgttgcggccngccgagtagaggtcgtagagtctgcccgcacgaaagcggg

SEQ ID NO: 9466 - DNA, 503 bp, Zea mays
  Clone ID: LIB3279-197-Q1-N6-C7
gccggcgccggaccccacgggttcgcgtaaggatcccttcgaccccgcaaccgctgccgccgccggcgggccccgcgccgagactcctccacagcagatgcacttctctaccgccgccgcgtcgtcggcccccgccccttctccagccgttccccacttcttcccgcagcagcaccagcaccagatgcagtacttcctgtccgccccgcagcagtatcagcaccagcagcagcagcaacgcgccggcgcgtccccttcgccgtttgacatccccgcgtcgtaccgctacgggcaccagcccttgccgcaggccgaccaggcgcagctgcagaggctcgtccagctacagcaccagcagcagcaactggccgccgcggcgagagttgcagctgcagcggcaccgactccggggggagagtccccgtgcgccggagccgccaccggcgccggcgccggcagcctccaagaagaacagcagtgctagtgttggagcaaaacgaaaa

SEQ ID NO: 9467 - DNA, 485 bp, Zea mays
  Clone ID: LIB3279-197-Q1-N6-C8
agtttaaaccaattatttttattcttgcaaatcacaacagtaccacaccgccaagagtttaattttctggtcctcaagcacgagcaatacaagcacaatctaagagttcaaaagcccaggcatattaagttcttacaaactagccattgcagtcacactgcggatccatacaagcttatgaagactgtcgaagctctgggcgcacgaaatctgcatcagcggtcactgagatgtcaacggtgggcctcagctgagcacagacttcgatggcaccgtgcacagggtcagacatgaagttgctgatgaggtcttggttgatcggtgctttcttgtcaacagtcacaaacgcctgttgggtcaagatgtaatcgaagcgtggtgcccatttcctagatcccaaacgagcagttgtggagcagttatcgaccatgaaggccacaccgcgagcatgcatgaacgggttcaacgagtccacggactcgatc

SEQ ID NO: 9468 - DNA, 604 bp, Zea mays
  unsure (1)..(604): unsure at all n locations; Clone ID: LIB3279-197-Q1-N6-C9
aacaataacaagaactgcattgcattccaagtttccaacgtctgagaattgtatgttaaggacatagacggacttctggcagacattcaaagctaccagataccaaaatcatccgctgcgaaatggtgtaccaaaagcgccaacggattcaactacttcagaatctacttgaaacttaggatgcatagctactggaagtggacactatgaactagtagcatttttccaagaccgcttgataatacaagtcgatccagaaaaaaacaccaagtgcagtttcctgcttagatggaggtctacgctgagttgccaagcatggcaaccaactccaccataacagaggggcagctgctgctcagatgcttaaaggcgtcgctggctacgactgccctcaaatttgcaggagatctgagaaaatggaggcacaacttcttcagtccagggcangcggtgttgctcagctagcgtcaggatgattgctaccgtgcccacatggatgcactcagacagcttcttttcacatagcgatttcagcctctccaagttgtatctgtctgcagcgaccagtaggtgctgaacagaacgtcttcatcgtcgccgccta

SEQ ID NO: 9469 - DNA, 386 bp, Zea mays
  Clone ID: LIB3279-197-Q1-N6-D10
attccaaaccaataactgtttcttattaagtagacaactagacacatagtcataggcgaacgcaatcctggtttctttacactcgaataatcacctcaaatcacaggtttacatgttcactatggcatgccaagacatggataagcatcactccagccagcaacttgaattactagggtatgccaagatacagttagggatcacctgtcggactaactgtccgtgtaaacatccccaatagattgcataaggggaatgcctgccttcttagtaacggtacttggtggagtagtcctttggagcaatcaccagaccacggcctttccgggcgcccctgtatacggtctccacaatgtcgatgaactcttgcttgtccttcagggccc

SEQ ID NO: 9470 - DNA, 414 bp, Zea mays
  Clone ID: LIB3279-197-Q1-N6-D11
ggggggggggtttttttttgttttgaaaaaaaaaaaaaggggggggggggggttttttttttttttccgggggggggggggcccccgggattttggggccgggcctcgggggggcccaaatttttttttttgggggggtttttaaaaggggggggaaaaaagggaaaaaggttttttgggggaaaaattttttcccttaaaaattccacaaaaaaaatgagggggggaaaaaaaatgtaaaaccgggggggcccaaagggggggccaacccaaattatttggggggggcccctggccccttttttttgggggaaaacttgggggcccccttttttatttttttccccaacccccgggggggggggggttttttttttttcccccggggggttttttttttaccccggggggggg

SEQ ID NO: 9471 - DNA, 590 bp, Zea mays
  Clone ID: LIB3279-197-Q1-N6-D12
ggagaacgagcattatccaagagttgccagcaagctggggagcaaacgtagtagtacgtaacatctactggcatcggagtaacaaacagcatggaacagggtagcagacaagctatacatgcacaacagtagcatccaaaattacacgacacaaccccctccccccttcccccggttcaccgtcacttcccaaccaacagcaatcaacaccgacatcaggaataactccctctgacgatcaccaagaataatcagcgcaggactcaacaacaagacgaccaaaaagagcaaaactccccatggtctttctcctcgccggtgccagggcacaccagccatctgtaagtcacgcccccctcctcacttgctgccgcacttgaagccgtggcacaccgacaggatgatgatgaggatcagcgcgatgatgatgcccaggacgatcagcttgatcttcatgttttggagccacatctttcgccgcacgttggtgccctgctgtctgaaatcctgtgcctgagaacgcagattttcagttttgtcaactagcagctcaatcttctcaccacggtcaagaaccttctcaatgtttt

SEQ ID NO: 9472 - DNA, 336 bp, Zea mays
  Clone ID: LIB3279-197-Q1-N6-D2
ggcaatactcacacaacagatttttttttacacgatcacacagccactcccaaaaaagctctgccatagtttgggctagagggaagtaaaactagagctaaagctggtgcatttggggcagactaccaagcatttttaaccctcgtttcaactttcaactagaaggattcaaaaattttgcaagtcaacagggacctgcatttcatgtttgttccgtaaattgacaaaaatacaaacatttttttacatactataaacggggtaagggtcaacaagtacaaaaacctgacgctgatgcacactcatttacaaaccaaaaaagcgggttagtttctg

SEQ ID NO: 9473 - DNA, 616 bp, Zea mays
  unsure (1)..(616): unsure at all n locations; Clone ID: LIB3279-197-Q1-N6-D3
acccccgcagaacacaatcaatctagccttgcaagcttctcaatgccatggaatccatgatccaccaaccagaccatctgttgcctagcactacatctcacagcagcaataatgtccaaaacttgtccagaaacttgctttctgtgtgccataagcccaaaatactatgagctagcgttctacccaaaacaacaacacaagacttgtcacgtatgaattcagacacctagtacacggatatcaactctcgtccatgtcatcatttccactgcctcgctcgacctctgcatccttgtctccagcttcagaagcacctcttccaaccgagtcttccaatgcctccaggaacgacaccaccgtgaacttatatttgtcagggtcaactccaaattgagcaagatctatctgcccagtccgcagaacgtgggtgaatgcatctaattgttggcgcaaaggaggactttggagaagctcaacgatatcaccaggactccatgagccaccctccggaagatgtgatgccaaattgttcaaatgggcaagtcctcaattaatggcaagaccagatcaggcttcaagatgtctnctagtcctactccagcatcagggtcagctg

SEQ ID NO: 9474 - DNA, 576 bp, Zea mays
  Clone ID: LIB3279-197-Q1-N6-D4
tttttaaagaatatgttagctgtcattactcgtgagctgagttactgtctgtccattccgaatggaagagaacaaaaattgaaggcaaccctattcatccattccgaatggaagagagaaagaaaaatgaagggatgccctattcgctcgcttcacatttccttttgccaacagctacttacatagttggctatttcctcgcaaaataagacgcatcctaaaatcatccgaatttaaaggaaacaaattgtaaaactttgaaagggtcctcacgagaaaaggaaataagaagggtgggatttttcgggcagctacaaggatcggttgctgtatactacagaaccttgacgccactgggccgtttgccttccatggcatccttcttctcacggcagtccgagcagaggaatgggccttcccatggcctggaggtcgaagagaagatcgatccagcatgcaccgaaatgccttcacttggctccaggtctaactggcagatggcacatgtaaacaggctttgaggttctcctgccatccaaatcaggacctaacctttctgatagcatcgctgaacct

SEQ ID NO: 9475 - DNA, 446 bp, Zea mays
  Clone ID: LIB3279-197-Q1-N6-D5
tttttagcggcaaaaatggatttgctattttgttattcgatggccttaatgttctcacagactggacctattttagcattgggacccaacgggccactttagtttttcacgggccacttgagcccattcaaacgaacgttggcattcctttcgtgccatgacgggctttgcttttttggtggtgcttctcgcttgttatttttttgcttgacgttgaaaaattccttgcacctttcgaccttacgggggttacaacccccgaagggatgtcgttgctcttccacttcattgcttatgttcgacctttttagctttaagattcaatatgggcaggattttacggcaataacaacacacagtagaccactcttataacacgcatctaaaaatagatattataatgtgttctacaagacacacttttactattattcttaatattttag

SEQ ID NO: 9476 - DNA, 378 bp, Zea mays
  Clone ID: LIB3279-197-Q1-N6-D6
ccccggaaaataaaaagtggtttttttttttaattttttgggggagacctttttttttttttttagggggggggggggaaaaaaaaaaagggggggggggaaaaaaacccctttttttttttttttttttcccccccccgagggggggggggggggggtgggaaaaaaaaaagaggggggggtttttttttttggggcgggattttttttttttttttttttttttttaaaaaaaattttttttttttttgggggggggggggaaaaaaacttttttttttttttttccccaaatttttttttttttttttaaaaaaggggggagggggggggggggggtttttttttttttttttttttttttggaaaccggggggg

SEQ ID NO: 9477 - DNA, 109 bp, Zea mays
  Clone ID: LIB3279-197-Q1-N6-D7
aggacaacattggtttctgattagagtgagtatttagtttctgatccaccaaatgatcagctaccgactactccttggcgtaggattttacatgattcctgacgcttac

SEQ ID NO: 9478 - DNA, 406 bp, Zea mays
  Clone ID: LIB3279-197-Q1-N6-D8
ctgataagtttggaccagccgcttattataccgtttaatatatatatagatatcacaaagagaagccacaaaattaaagcatggcctaggttctttggcagcaactactaacattttgcgcaagtttacaaattaaacagaaaacacttcctgcaagcaaaaggctgcagctctttatatgtttacttgtaatgaaaaccctttacaatattccgattgagcaacgaatctcgatagatatatatgttccacacctagtatcgaccaaagaatgactaactgcctgatttgggggacgtcctgtttattttatcagaggaatcagcatctttcaacagcatatcaatggtgtccttgccacaattccctgattctattgccacccacgcgtccgcccacgcgtccg

SEQ ID NO: 9479 - DNA, 561 bp, Zea mays
  Clone ID: LIB3279-197-Q1-N6-D9
gtaatatcacttcatcacaatgagacttacagattggcaactgtattttagcagaaatcttagttacatggaaataacactatagcgtaaatggacatgtctccctctaatttttgtgtgagtttctagaacttatcatttgtctcaagcacttctattgagaatcaatatggaggcttctttgtgagattaatctaggcaaagcccaaaccataccttggatgatgaccactgaatatatagtgttatggtgaccaacgaataaaatttttctttataaaaatatttcttctctagttcccttatttcaaggttcttatatcacaacacttaggaagactgtgtgtaaaaaatcatgagctatgatttagtttctttccccagaacaacacaaaattccttatgttgttggcaagtttgtttacatgacttccagtcttgaataattaatgtaattgttagccatgcttacaatgcagaatgttgtgactacatgatagtagttgatgtcaaattggacatttatcatggaaagatcattttagactgatctatcatttt

SEQ ID NO: 9480 - DNA, 582 bp, Zea mays
  Clone ID: LIB3279-197-Q1-N6-E1
agcctggaccagcgggaggaggtccgcacgctctcctgcggtcacgtgttccacctccgcaagggtcccaagtgcatgagcaacatcgacgactggctccgcgagaaccgcatgcgctgcccctcctgctgcaagcccgtctaccccgtgttaccgtggaaggcgccgacgacatcggttccaccgaccgcgcccgtgccactgccagcacagtcgtcgacgtcgacgtcgacgtcggatttggaggctcaggagccgaggcggtgggcgtcgtcggagcaggggccacagcggcgactgtcgttggacctgggaagaccgcggtatccaccgtcgatatgattccaggacgcgctacagtttgggtctccgtcgtaaagacgcatgatcgagcttggatgggacagtgttggagcgtcttttggatcagttcttccagaggttctttaaggattctttcgtcgtttctttctctgcatgcgttattggaactggtcaaagggtattgcatctcgctgatggtctggatcggttctcatggagtcatttacttttttttttgctacgtcggaactgaacaaa

SEQ ID NO: 9481 - DNA, 337 bp, Zea mays
  Clone ID: LIB3279-197-Q1-N6-E10
tttttcaaggaccacataactaaagatagccacatgcaacatcattatttgttccgtttaaaccgtggcacagaaatttaacgtcggacaaaatttaaatatgacaacagcagacaacacaacgctcggtgacagcagcagctgggcgcccttcacttcccaccgaggcttgggaactgagcttgatcttcaatggatggagcagcagcagctgggccacgactgtatccccctccgtatccgcctctaaaaccaccacgatccccacggccccttccacgggcacgggcggcgtagtacctttctccttcagcaggtttcaggaactcgttgatgc

SEQ ID NO: 9482 - DNA, 587 bp, Zea mays
  Clone ID: LIB3279-197-Q1-N6-E12
tttgtacatgtagcacaacaagttcatccagcctttcaatgcctaagctgtgttctcagtagagttcaaaatgtcgacgctgttgacatgccaggactaggtggtaagagcagaatccaaaaaactacgatagggtgatcatgttctatcaatatcggtaagagctctgaaaatgtggagttatgcagcgaatgtgaatatgaaacattctcaactatatctggttcatttgctaaaagtaatagtgcctctaattgattttgagggtggacttgatctgatccaccacatgcggaaggaccctgaggctgtcatcaatagatctgttgacacaggattccagttcccgagttgcatctgatttcaacttctggagattggcagcttcaaacttatcttgacagaccctcaatgaccggttcaacattccctgaaacttggccatctcactctcaaaaatattgttggcagcaaggacaggcacactacaattctccacacagttgctgatcgcttcctgagtatggcgccgatcaaagcaaccatatgcgcacttgaagtatgcttgctgcatggtgaagttgatg

SEQ ID NO: 9483 - DNA, 471 bp, Zea mays
  unsure (1)..(471): unsure at all n locations; Clone ID: LIB3279-197-Q1-N6-E3
aaattgaaaagacgtttgacttgtttgggattcaaacacatccaatcccactcaatccacatggattgagagctaaccgaacaagcccttactactcctgtgcatcgacaagatcgactaatcgactgacaacggcattactgtgagagttgaaaattgagatgcatggagctagtaggtctcctggttttgcagcagggagatgatgtcgagggcgatggtgcacaggcgccgcaacgccttctcccttttggccagctccgccgggtacgcagtcctactcgccccacgctgttgctgccggcgccggaacagcgtgcggcacaccggggggtactcgccggcggcgctcacgtgcacgaaggcgttagtcgtaggcctgctcggcgagggacgcgcgcgcctgcacgagcgcgtcgcgggcgggggcgtacttgccggcgcaagtgcggaggagggccccngtccccc

SEQ ID NO: 9484 - DNA, 82 bp, Zea mays
  unsure (1)..(82): unsure at all n locations; Clone ID: LIB3279-197-Q1-N6-E4
ttttttttntttttttttttttttttttttttttttttnttttttttttttttttttttttttttttttttttttttttaag

SEQ ID NO: 9485 - DNA, 604 bp, Zea mays
  Clone ID: LIB3279-197-Q1-N6-E5
aacagaattccaaccggaacggtgtttcgaattaaagcaaattaactctggtactggtacattcgactcgaataggatccaaaaatactcacggcaatatcactggccacacaaagcagacatatagctatggaaaaattaggctggtgcattgcccagccaccaccatcgccagcaccccaggggaaggactgatcgaaagtcacgcctagatcttgttgaaggcaacgatgtcgcagctctggacgtactcgttaactggctcagcgcacagatagtcctcaatgagagtgtcgacagagacaagatcgtcgactatggtcatcatgatttgcagcttcttgataccatatccgactgggacaagcttggatgcgccccagagcagcccttccatctggacactcctaacagcttcctcaagcttggccatgtcagtctcatcgtcccatggcttcacatcaagtaaaactgatgacttcccagattctttcttcttgccagaagccttggcagctgcagcacgctcttcagcagccttcttctcatcttcggtctcctcaccaaaaaggtcaacatcatcatcgtcctcctcctcagcagc

SEQ ID NO: 9486 - DNA, 603 bp, Zea mays
  Clone ID: LIB3279-197-Q1-N6-E6
ttttagcacctccggcacgcaaagctatggtagtatcatttcagcaaaatatacgtccctggcgcacaaaaacagaagggcagacgcaccaaagaagattacagtcatattctctagcgggctcacaggaccctcacagcgggagcggaatggcacgagaattacaaaaggtagagctcagtgggagtgatttgggttggctgctcctattgacaaatccttgggaaaaactggtgacggcaagcatagcttaaagatcctcagggccattgacatccttgttttcaaatacagctccatctggaacctccaacttcactccagacttggcggtgattgtcaccttgcccttgagcgtaattccagaaccaaaccagacatcaccagaaaccttcaagctgtcaagctcgacgatgctggggatggacttgaaccgagcaaggaaattggcaaccttcttgaactcaggtccaagctcaatcgaagggttagctggattcgctctggatggattgcggatgacaaagccataaccaaggtgttaagatcagactgcacaagcaataaattagatgtagccttcaccggggagaaatcttgagc

SEQ ID NO: 9487 - DNA, 409 bp, Zea mays
  Clone ID: LIB3279-197-Q1-N6-E7
ccacccaccaacccgggaaaaaaggccattgccctgaccacccccctaataagcggggaagggccaaaattttgggggtgggggctaaggtctgccccagcaaggcttgttcttgatccattcatttttagcagcggggaaacttttttaattaaaagtttatcactaggctaattttaacgcagggggtcccggcccccaaatatttaaaaagtgggggtcccaaactttttttagtgaaagcccctccgtgccacggaagcctttcagaaatgcccattgaaactaggaggggaaacctttggtggtttgaaaaggatggacccccttttttaaaaacctggcccatttggcaagaaaatcaaaaaaggctgttttttcccagcgaacccttggttcaccccgaaat

SEQ ID NO: 9488 - DNA, 581 bp, Zea mays
  Clone ID: LIB3279-197-Q1-N6-E8
accctcgccaagatgtgccgcgcgggcgagtcgctctggctgcggcgccgtggcgcgagctccgaggtcatggtagccgacgagcacgcccggatgttcagctggcctgtcaacggcggccagcaggatagcagtgcctcccctggcggcgccgcggccaggaccgagggatcaagggacggcaccgtggttatcatgaacagcatcacgctggtggatgccttcctggacgctaacaagtggatggagctgttcccttcgatcgtatccaaggcaagaaccattcagatcataaaccatggagctgcatctggtcatatgggcagtggatctctcctcttgatgcaagcggagttgcagttcccgtctcctttggtgcctgcgcgagaggtggtgttcttcaggtactgcgtgcacaacggcgacgaggggacctggtccctcgtcgacttcccggccgaggggttccagctggaggcactgcaaaccccatctgttgtaagggtgctgtaggcgcccctccggttgcatcatccaggacatgcccaatggctactctagcgtggtgtgggtggagcaca

SEQ ID NO: 9489 - DNA, 529 bp, Zea mays
  Clone ID: LIB3279-197-Q1-N6-E9
attctctaacgaaaaaagagcaattttcaactgataaggttagtcaggttctccagttcaggaggtattggcccacttatgttgttgttctcattccctaaggggtgatgatgtgcctaatatcatttgtcatttcctcccaaccccaattgtcacacatgcctcatgctttgctccatgttgactttcaccattttgacaagcatttttttcgctttgccgccacggtcttcaccatttatttgggaagcaatattggtcacaatgttcttgatcgtgtctgcctgcaactttgatctcgagtaccgggagttccgcaacaagtcaaaaagaactatcttggttttatttctgcatagatggaacaaacataagttaggaactattcgcataaaaaatagtctagaataaaccaaatattcatgcaaaaattacaacaccaccatcacatttgatataggttaaggcaactattgcacaatctacataaatttaaggctttccggccacacgacataattccctgatg

SEQ ID NO: 9490 - DNA, 583 bp, Zea mays
  Clone ID: LIB3279-197-Q1-N6-F1
aaaccaaattagtccatgcagattaagtgcccagatatcttaagagctattgtattacgagctgaacttacagtccaacacagtagttcagtacagaacatagataatccagatttaaaacatcggtgccggaaacgtctcgagaggcaaggctgcctgaaaaggtacataaaagagctacggctataatacttcgacaaaatggcctcgatcagcatgctgatatacttcactgcttccttgctgcgacaatgttgtcagcctctttcttcacaggctcttccttctctgacaagatcagctcaatgtggcaaggtgaggacatgtagggattgatgcgcccgtgagcacggtaggtgcggcgcctctgcttctgggcttgattcacctggatgtgtgaaacatagaggttgtccacatccaagcctttcacatcagcgttactctcagcattcttcagcaaatccaggatgaacctggctgatttaacgggccagcggccctgcccattggagtggcgcgacttagcttgcgcggtgcgaccaacacccccacagtatctccggaagggaattgcctgctt

SEQ ID NO: 9491 - DNA, 578 bp, Zea mays
  Clone ID: LIB3279-197-Q1-N6-F10
aagaaacacggcatttcctattccattaggaatgacataaagcaacttgagcgaagcagatacacagccaatcacattgcccgcttacaacctacacatgacaacatcggatccgcctccaaaccctatgccttcttgggggacttggcggccttcttgggcgacttggcctccttgctcccgccgctggacgccttctccgccgtcttcttgggcagcaggaccgggttgatgttgggcaacacgccgccgtgggcgatggtcacgccggtcagcagcttcccgagctcctcgtcgttgcggatcgccagcagcacgtggcgcgggacgatgcgcgtcttcttgttgtccttggcagcgttgccggcgagctccaggacctcagcggcgaggtactccaggacggccgcgaggtagacgggggcaccgctgccgacgcgctgcgcgtagcggcccttcttgaggtagcgcccgatgcggccgacggggaactggagcccggccttcacggacctcgtcaccgacttcttcctcggcccgccggccttgcgaccggccgctcccttcttcgccttccc

SEQ ID NO: 9492 - DNA, 596 bp, Zea mays
  Clone ID: LIB3279-197-Q1-N6-F11
gacacacaaataccatacatgtacatatagaaagttgcaaggttctcacaacacagcacaatacaatgcactggagttcttaagctaaccattacaatcaggcagctaatcattggtgcagtttcagcacatatatagttccgcttccgcataccgcaggaaactatatgcatgcatcgacattatttggggggcatcggaccggagcatctcatatccatccagaccgaccgtgctcgtcagggtccgccatgtcctcgttcagctggtccatgtaggcctgctgatggtaccgtgtctgcagggaaggatcattgccatggtactgaaggagtccctggaacggatcaagaacactactcccactgtgcccgccttcctcccaggagacgtcgtggagcacattctgcggacttgtttcttgcagctttttccttaggtctttgttgagatcctgcagctcttgttccttgcttttgagatcaaagagctgatcgagtagcatctgattctttcttgacctgatatgcttcagggatacctctatctggttctccagctgctcgagctccttcatgctgagtgggcccagatct

SEQ ID NO: 9493 - DNA, 472 bp, Zea mays
  Clone ID: LIB3279-197-Q1-N6-F12
acaggtaaatttttttataaatacgggtatgaaatggtactacccgacgagcatgtagtacgcccttgcccttcaactaacagtcaacgtctcccctctccagctttgccaaccgccggaggctgctttgtttcaacgtgtttgacccaacacaagcaccagaagatgacgctgctgcacctacacctgccgtcgccctttgtagcgcaacgacatgagattgcagttaccaccggtcagtcgtctgatgatgctcctcggatgctgaactcagtctcggatcagtcattggcaactgatcctacttccatgataacgcagggaagtaatttatcacgcaatctcatgtttcctttgcatcagatattaccagggttccatgggcaaagagtcgatttagcctaccagacacaacagcaaaagagtttaaagaaacgaatgttgtcctaggagagtctcactccagtcccat

SEQ ID NO: 9494 - DNA, 629 bp, Zea mays
  unsure (1)..(629): unsure at all n locations; Clone ID: LIB3279-197-Q1-N6-F2
gctgtaaaaatcttgcattaaaaacatagcttcgattattcatacagtagtgttacaaacaccttatggtccatatgttttgacaaacagcttaagcatagtagttcaagcttgactttttcttcgcctggacctgtacgatcccttcattgaaatcctcgtgagttacctctgtagcatcccgccgtagggcaagcataccagcttctacacaaactgcctttagctgtgctccgttgaagtcatcagttgagcgagccaattcttcaaagttgacatcaggatttacattcattttccttgaatggatttgcaagattctagctcttgcttcttcggatgggtgagggaactcaatctttcggtccaaccgtccagatcgcatcagagcagggtcaaggatgtcagcacggttagttgcagctatgacctttattctctcatcgctgctgaatccatccagttgattcaataattccaacattgtccgctgaacttctctatcaccgctaacttcactatcaaaacgtttggtgccaatggcatctatctcatcaataaatataatacaaggagctntctctttggcaagctggaatgcatcccngacaaagcttgctccatcacca

SEQ ID NO: 9495 - DNA, 176 bp, Zea mays
  Clone ID: LIB3279-197-Q1-N6-F4
gtgcttacgtataatattggttttgtaaataaaactgcatgcatgcaggcgggcgagtacacctggtggacttacaaggaagtctacgacgtcgtgatgaagctcgctgcatccatggacaagtccgggatcaaacaggtactgcacgcacgcaatagtcacaggcattgcttctc

SEQ ID NO: 9496 - DNA, 122 bp, Zea mays
  Clone ID: LIB3279-197-Q1-N6-F5
aggcgccaactcctccgcctcggcggtggccacgccggagaagaagccggcagcgcacgggaagtgggcggtctacagctggaggtcgaagaaggcgttgcagcttcccgagtacccgaacg

SEQ ID NO: 9497 - DNA, 432 bp, Zea mays
  Clone ID: LIB3279-197-Q1-N6-F6
agtatataaatggttcaattaacgtatgagtccgttcccctcaatttatccgtgacccaaaatttggcaacaacagttacagtcctcttaaccctcacagaaaaataagaaatcggaggtaggtaagtttacttcctaaatgggcacatgcaaaaactagagacttgatggaggttcgacctacatcttggcttcctttgcgtcctggtactcagcttctggagtctggtctcctccactgccgctgccgccagcgctgccgccaccaccaccttgttgcatgtgctctccaatctttgaaacagccttgtttgctgcttccagcttctgcttgatcttgtccagatcgtcctcagccatagctgccctcagatcagagacagcagactcgatctccttggtgacttcagcagggaccttgtccttgtactc

SEQ ID NO: 9498 - DNA, 589 bp, Zea mays
  unsure (1)..(589): unsure at all n locations; Clone ID: LIB3279-197-Q1-N6-F7
ggaggaacttctgatgacatagcgtggaaaaataaaaataaaaaaatgtacaaaccaacacatcgagaccatgaggcattcgtgtaaccaaagctctctctctctctctctctctgccttttgtgcgtgtgcgcgatcaatctacagcaaatcctcgcccaaaaaatcaccgttttctagagctattcttcgagtgccgcctcggcctggtgaggagcttgagcatgctgtcagtcaggtccagcggcgagtcgtcgtctttctcgtcctgagccttcacgccggaggtctgcgtcagccaccccagcgcctcgatggcggcgtcccgctccgcgagctgcttgttccgcttcggcttccccacgaactgcatccccttgaactccaccacggccctgaactcgtttgtcttgaggtgcttcgtcttgtacctgggcggggtgtggccggcccgcatcagcagcgtctgcagcaggctcttggggttcatcccgtcctttatgaggttgctcttgccgtcgtcctcggggctccggagcctggcccggctcgtctcgcggccgaacacgaacctnccttcgcacaggtc

SEQ ID NO: 9499 - DNA, 429 bp, Zea mays
  Clone ID: LIB3279-197-Q1-N6-F8
gtgccgttaattatttcattgtaaagcggaatggtggtacattttccagagtactcatgaaataaaagcggtgcagtacagctgaaaccacaaactagtaggaatcaaaacctaaagcaggctgccagtccaatgtgacctgcacaaccacacaatacggcaacatttgtggatactggatagacctcagatcggacttaaaaggctttttgtttgacaaagccggggcaaacatcacgagattcgactggctactcagttactggagaacacgcatgctaacttgactgttcagacagaaactcctgtttttggtgatgaaggcattcatcgcatcagtcttcgtgtggaatttaaccagcatcattcttatgggctctgggacaccagctcttagaaaggtttcaaacggtggaggttcaaagttcg

SEQ ID NO: 9500 - DNA, 602 bp, Zea mays
  Clone ID: LIB3279-197-Q1-N6-G1
cttatgactggaaatcctttcgccattcaatacgtctcgttttgtcgagtcaccggtcacgactcgcgagcaagaagccacccgtataattctacttacatcaccaccgccggagacttggttttcggcgtcgatctctactcggcgaactgcttgccctcgaacgtctgcgcgaacatccagtccgccggcgccacgctgtaggcggtgaccgtcctgccccgcccgccggtgacctcgaacgacagcggctgggcgcggaggtcggcgtcgcactgccagttctggccccagttccgccccatcgggatccaccccgtcctcgagcccttcaccttcacggccgccacctcgccgtccgccgccacgttggtgatgagcacctgcaggaagtgggcgctgccggtgatggtgaaccgcatgccgcccgccctgtcgcagctcaccctccggaactgcaccggcacgatgccggccttggccttggcgacgcggaggaacgcggcctccgacagctcgaggtgctcccgcgggaagttgcaccagccgccggcgtcgtcgtcggcgaggcccatgttgggccggcagaagtccgtcgccgt

SEQ ID NO: 9501 - DNA, 575 bp, Zea mays
  unsure (1)..(575): unsure at all n locations; Clone ID: LIB3279-197-Q1-N6-G10
gacattataaatggtatagttgcaaacacgagcacttgcgagattagacacggatataagaagccaacgacggcatcacacgattacaggcgaacacaccaatcagcacaaacatcaccaaatcctttattctagtcactcagtgcagatgcagcctactgctagcagggcactgaacatcaccatcccgtcgtatggattctggtaagggaacagtatcccttcattcgatcttgtcgcagtcgatgtcgggggtgatgttgtaggacagcgagaggccgcagtcgccgggcagctcctgcgccgcggagagcacagcgtggacctgaacgtaggccgccttgaggcaccggcacgtggcctgcctgtcgggcctggtgtccgccgccgcgtacagggtcctcacgccgtcgcagcactggttgttgctctcgctgggtttggctgccttgccctgcaggaagggcaggcacggctgcaatgcccgagctagtagtcttcatggctgcgcttttctctttcancgagatggactggccgggcccgggtgatagcagtgggaggagctagctagc

SEQ ID NO: 9502 - DNA, 542 bp, Zea mays
  Clone ID: LIB3279-197-Q1-N6-G11
gagcgactaaatagtcactattagtggcataatttaaatgcctctacaaaatttaagttaatctcatgttggcattaatcaccaacactagttgaaagtttagagccaacaaaatggaacacatggcaactagagtacactagattttctcaagtttttagatataaccgctaccctgaatcagggtaacaatcagcaatcgacacttttttaacatatacattcaggagtccattaagactgataaaaccaaaattaactggtcctcaaggaccacctcagcgcttagcttcatgggtcatggtttgatggaaggaaaacttctcatggtgcaggcacccctgcgctggcttcctgacgcttgtcaacggcttccttcagcttcctcccaagtgcataggcaagaggcgggggcacggcattgccaatctgccggtgcttgttctggatgttgcccgcaaattcatagctgtcaggaaagccctgtgaccgagcacattcccggactgtgatgatcctgtcttgatcagggtggaagcaca

SEQ ID NO: 9503 - DNA, 510 bp, Zea mays
  Clone ID: LIB3279-197-Q1-N6-G12
caccggagcaacatcaggtcatagttttccattcctaatttttctacaggtcccaaacatgagacgtacaaacttttgggggtgttgcctgtaggcttaatttcccttaacccaaattacggaaacaccggggacccttgtgctacggatcgttgaaaaggatttcggtaaaaacggaaagtgcttcctgaaggtacaacaacctgtttttttccggaactggagcgttgagcattgttaaaaaacaccccatgggtaggttcagcgtttcgtttggggtgtccaccaaaagcccacatagctcctttgccattttgaagtagcatgcccttgactaaacaggtaatttgtttccccaaactaacaacgacttttttaatcggccaaaaaaacttttgcatgattaactcatttcctcgagggaacccgaatcatccatggcattttttttttgcattgagtttttaaaaacgtaaaagtctacttattttccggcaccaaggtcccagt

SEQ ID NO: 9504 - DNA, 574 bp, Zea mays
  unsure (1)..(574): unsure at all n locations; Clone ID: LIB3279-197-Q1-N6-G2
tttcaaaaaaagacttgaaacttttcttgaaaaaatataataattttttccactcaagggacaatgntttttatcgggtcggaactcagaagcatacatcacaacggcagcatatttgccaagccctatcaggcataactaatgtctggccttcttcttgggccctgaattactttttgttctcgagggcgccttgtgcaaaaatggctggcgcttgttcctcttcttcagcttcgccttcttttgtttcttatattcgctgtcagggtctacaaagtcttcatcactatcaccttcaaccggaacaaaaccatcgtctgcttcctcattgttgccatcctcttcatctgagctcaagaccaaatcctcaacccgatcctcctcagtcgcgacatcatcatcctcccggggtcgctttttatcctcctttggggttttgggtttcttattttcagacagccagttcttactgaaagcgatagtgccttcatcatcgncctgctcatcctgttgcttctgcgcttctgataacctccgtgagaaggttgaggactcggcacccacaatcacactg

SEQ ID NO: 9505 - DNA, 600 bp, Zea mays
  Clone ID: LIB3279-197-Q1-N6-G6
ctacaacagttcctcccattccatataatgataaaatagttagatgtcaaagaattacactgatcgactgaacatttcagtttctaaacaatggcacgcttcatttggcattaggcatgtcgtacacgcaaagccagctttacttccacacgctagagctatggctgaatgggggtgatgtgtcaccatacatcacggaggtacctgccttccatctgcaggctctttacgtagctctcggttttggagctatccaaagatccctgctcttggactactgtatgaagcatcctgtgtacgtctctagccattcccttggcatcaccgcatacatataagtaaccaccatgtgagatgatgttccaaatttctgtggccttctccaccatcttatgctgcacatattctttagttggcccttcccgagagaatgcaacaattagctcagaaagcgccccctcctcaaggaaagtttgcagctcatcttcatatatgtagtccatattacggttcctgcatccaaagaaaaggattgaagtgcccagttctgctccagattgtttcagtgctaacctttcctgcaagaaacctctaaaagga

SEQ ID NO: 9506 - DNA, 501 bp, Zea mays
  Clone ID: LIB3279-197-Q1-N6-G8
agccaataatgattcattcattcagtaggagaaaggagatgagatctcatacatagttgattcagagttcagaccttagacatgatcagaaattcattatgcagcagcctttgaccaggccctttttttgggttaggcacccccactttcttgcgccagccgggtggccaatgttggaacacttgccacacaatgggtgggtgtcttacgcaaacaccacttgagagttgagaagaacgcgatgcattgcacccttgcttttttatttggggatcgccgcaaccacgcagaattattatttgggtgcccgcttgtaggttctttcggtcggtcaccaaaggaggatcttccagcgctgtttgtgggcctctcaccacatttagagaacaatatctgtaccgccatggacgccgccgtgagccttgtcgccgtggaaggcgtcgaagatgaggtagatgttgttgaccatgcggacgcagcggaagacgctgtcgacgtcgc

SEQ ID NO: 9507 - DNA, 293 bp, Zea mays
  Clone ID: LIB3279-197-Q1-N6-G9
ggggttaaaatttggttggttttttttttctttcctttgattttaaaattttgggggtttgcggccaaactttattttggggttttggggccttttatttaaatttgttttaagcccttgcctttttgcttttttttttggaaaaaagggcccccttttttcttggttcttttttaccgcccgggaaaattccggttgggcacaatttttttggccggttttgttttttaaagttaacggttttccattttttttttgggtttttaccctttggggggtttcgggggggtttt

SEQ ID NO: 9508 - DNA, 385 bp, Zea mays
  Clone ID: LIB3279-197-Q1-N6-H1
ggggagccaccccgaaaacccccattatttttcaaaaacccccgggggcagggggggggaaaaaaaccccctcacaacaagggggggggaaaaccacaaaatttttgaaaacacccccccaaaacgggggggggggggcccctttgggaaaaacaggggaaagggggaacacacgggcctgatgctgggaaaaaaaaaaatttttttaaatcttgaccccctggggcccatcccccccctaaaaaaacaaaacaccccccccctggaagccctttgagggccccccggggccctcaggggccaaaaaaaaaaaaattttctaaatcccctccccggtttcccagggcaaaagggccccctggggaaaaaagaggcaaaacttggg

SEQ ID NO: 9509 - DNA, 474 bp, Zea mays
  Clone ID: LIB3279-197-Q1-N6-H10
aattccaaccggaacggtgtttcgaattaaagcaaattaactctggtactggtacattcgactcgaataggatccaaaaatactcacggcaatatcactggccacacaaagcagacatatagctatggaaaaattaggctggtgcattgcccagccaccaccatcgccagcaccccaggggaaggactgatcgaaagtcacgcctagatcttgttgaaggcaacgatgtcgcagctctggacgtactcgttaactggctcagcgcacagatagtcctcaatgagagtgtcgacagagacaagatcgtcgactatggtcatcatgatttgcagcttcttgataccatatccgactgggacaagcttggatgcgccccagagcagcccttccatctggacactcctaacagcttcctcaagcttggccatgtcagtctcatcgtcccatggcttcacatcaagtaaaactgatgac

SEQ ID NO: 9510 - DNA, 474 bp, Zea mays
  Clone ID: LIB3279-197-Q1-N6-H11
cgaataacaataaagagtaagtaataatatgaaagactagagtcatttacatagtaaaatcaaagtacacataatagaaacgtagccaatgtaaataaacccaccacaggcagctgactgggggaggtcgctagcctaatcctcgaactcgtcgaagccctagaactcctggagatccgcctcgacgccttcttctttacctgagcatagattgcaccaaaggcaaccttcaccaaacagatgctcagaatcttcaatttcgtaaagctcgaggagcttgatcacttggtcgacgaagcttgactgtcgattccttgaagcttggagatggatcgcattctcgcgctctcgacgatggccggaggtgttgtgaatcggcatgaacggccgtggcgagctccgggagatgggcggcgcggctagacgggcttggtcgcgggcaccaggcagcggcgacttgagatggagttgttg

SEQ ID NO: 9511 - DNA, 416 bp, Zea mays
  Clone ID: LIB3279-197-Q1-N6-H12
aacagcagtatacaagactttatttattatttgaatccacaaaggacgactcagaaaaaagaaggaaccaagaagaagaagaagaaacagcatccgggttacagtttttacacaacgctgacaaacaagggtaataagcctgaggcttgctgcgcatggaacaaggattaagtgcagcaatcgctataaggtgtcgttttgagtctgttctcttctatctggaaatccaaagctatgctatcacgcccctccccaggttgagccagagctctttctgccttgccctttcagtttggacttcagaaggaaaccttgacgccgagcaacgccatgagctgggacaccaactctgggtggcctggccaggctgcgccggtcacaaagttgccatctgtgaagcagcggtggatcgggtc

SEQ ID NO: 9512 - DNA, 486 bp, Zea mays
  Clone ID: LIB3279-197-Q1-N6-H3
gcaaccatcagtatcatgcagacttcgatatatgccatgatttgcatgggctcatcattgaatagcacttgtcacacctgccggtagaagttccctcgtacattatcagtcatcagatacccaccaccatacacgcttgcttaaacaaaaaagcaagtgtatgtgtttgcgaagagaattaaaggcaggccggcacaaaagctaccccgacgatgacgagtggtcattgccgtcggtcctcctttgcgtcacctctggtgccaaaatgaccccatagtccttgatatagtagtcgtcgaacgtgcacgacatggcgagtactgatgactcttggctgggctgccaaacgaagtccaccccgggctcatcagcgaggtagtacacctagtcgttgcaccaccggatgtgctactcctgtgggaggttgagcttcaagtggatgatgagctggacggtgtgaccacccccttgtcggatgcggtgcct

SEQ ID NO: 9513 - DNA, 477 bp, Zea mays
  Clone ID: LIB3279-197-Q1-N6-H4
gaggaaaaacaaacggttggagaaataggcacccacattctgttgaatccaacagagggttgttggcatgttgcagcaataaaagcaatcaaagatcttctacaacagttcaatgttgagttgctgagcactttttttagcctcaccgcctgatcctcaaaaacataaagcaaagcaacgatacatacactgaaacttattttaccactaccgaacactagcccaagctataaatctccaaatatccgaagatcaccttagggactgccctcaacacgctaaatgcaaatctaatgcactacgagtcacggttcaccaaatgagcttctcaggagaagagtcttcgagaccaaacaaaagcagggaccggttgaactgcagctgctgctgctttatgggcgagggttgctgctttctctttggattccactatacgtgctccctttggatccgccaaaagggatttctggaaggact

SEQ ID NO: 9514 - DNA, 524 bp, Zea mays
  Clone ID: LIB3279-197-Q1-N6-H5
agccttaacagtacttccatcaaacagaaacatgagttttcatgagcaacatgaccaaattgtaacgcaaacagtctgccacccaaaaccacaaataaaaaaaaatccacaataagatgtctcttggacagctaaagtttggttaactgaactgacaatagaccaagaaaagaagctgacgacacctaggcctcccactgcatttttcaggccatgatcttggccgatctcatgtacaggctgtccacaaccttgccaacattcgtgatcgtttcaagtgtggcagggaagatctcctcagtcttgctgtcctcgaagatgatgaggcagccagcgccttgatcaagtgtccctgcgaatttcttgtcgaggatcatctgggacagcttcttctcaacatggttcattggcagctcaatcatctttgctatgtgagcaatctccacccttgagtagggctcaatcagcctgcagaggttctgctccaagagagtgtcatacagcgaggaaaggtgcctgtggac

SEQ ID NO: 9515 - DNA, 601 bp, Zea mays
  Clone ID: LIB3279-197-Q1-N6-H6
agctgcaaaaatcgttcatgaattataagcatcaggcagacttaaaaacatggtagtcttagaacattgttctatatccttgcagagcaactagaaaaaactctcaacacagcacattcagaggatttatgcgttggcagcagcctgggcagcggcatcccgcttcctttgctcttctatgatgctcagcttgattcccttgcccttgggcaggctcacccacggcttattacccttgccgatggtgaacacgttgcccatacgggtggcgaactggtggcccagggagtcctccacgtgaatggtctcaaagctgcccttgtgcttctccctgttcttgataacacccacacggccagtgttccttccgccagtcaccatgacaacgttgccaacatcaaacttgatgaagtccacaattttgttggtctccagatcgatcttgatggtgtcgttggccttgatgagcgggtcagggtagcggatggtgcggccgtcatacgtgttcaggtacgggatgcccttctgccaaactgaacagacctaaccttgcaaagcttgaacttagcatcctcatccctgattgggtgaaggcggaaga

SEQ ID NO: 9516 - DNA, 581 bp, Zea mays
  Clone ID: LIB3279-197-Q1-N6-H7
tttagaaccctccaatatccacagcatctacctacctacagcagtccacatccacacacgctcagcagacacacagatcgagcatatgtacattcttcacatcagattcctatcctgaaacaagtccagagggttcaacgtggaagcattgaaatccatcagaaatcccacacgaatgtaatgacaagtgaacagaatttcttcaagtcttccgcggaagtcgacgatgtgcacagctaaatagacgggactctggaggtggcgcgcgactgggcgtcctcgaacgcgtccagatcttcgagcttatcaggcttcaagcacggcggtatgtacgcggtgtagatggcctccatgttcggagtctccttcaggtcgtgccgcaccaccacctccaggggagtcttggcgaacgccgggtagaagcgcatgtggcagacgtaggcgaagattatgctggctggaagcaggggcacgagaacggacgcgtaggcgaacttcttcagggagatgaagccgatcatggtggtctggtaaaccatcagagccgcgatgatcctcgtgtgcatgtgtggccacattcg

SEQ ID NO: 9517 - DNA, 490 bp, Zea mays
  Clone ID: LIB3279-197-Q1-N6-H8
ctaccaagataccacggaaagataatattaacacagatcacgcactggcaagcggttacggatatagaattcaattcagaatcttctaaacaaaactatggcaaaacaatcgctaggttctcaacatgaggtcccagaactccaaaagcattacatgattcatttgtggcgagggggatagggtttttaagatctcggcttctccttcttctccttgaagagggcgagcagggaaacgcccgagaccttcacaaccttgaaacggacaccgggaatatctcccacagcgtggcccttacgaccgaaccccgcgatcagcacctcatcgttttcctcgatgtagttcaagaagccatcgttcggcacaaaggcggcaatcttcttaccgttcttcaccagctgtacacgagcacacttacggatagcagagttaggctgcttggcctcgatgccaatcttttccaggacgattccctttgcgtgggatgat

SEQ ID NO: 9518 - DNA, 647 bp, Zea mays
  Clone ID: LIB3279-198-Q1-K6-A10
gtctcctcttcgcacgagcgcaacaccatccacccaccagttcgaagcggaggcgaccggcaacctgcggcggagatgtcaggcaggggcaagggcggcaaggggctcgggaagggcggcgcgaagcgtcaccggaaggtgctgcgcgacaacatccaggggatcacgaagccggcgatccggaggctggcgaggaggggtggcgtgaagcgcatctccgggctgatctacgaggagacccgcggcgtgctcaagatctttctcgagaatgtcatccgcgacgctgtgacctacacggagcacgcccgtcgcaaaaccgtcaccgctatggacgtcgtgtacgccctcaaacgccagggccgcactctctatggcttcggcggctaggttaggtgtgggtaattgcctgtccaggtgtctcggatctgtggtactagtttggctgccttcctgtgttcgtattgtagcagttgtggtagctggttgctttgtcgtcctgtagtcgtgcttctttgggtctgtaagaaccgctggttcgatgggattggattggacggtgaagtaggaatgttggcatgttagacttttctccaacgtagcgttgcctctaatttgatctctcaattattttcaattggggtgcactg

SEQ ID NO: 9519 - DNA, 636 bp, Zea mays
  Clone ID: LIB3279-198-Q1-K6-A11
gcacaatttacctgtctaatataaggatggtgtttgttgccaacaagcatgttggcaacttctttgcttttgatatgccactgttgtttgtgcacggtcagaagttcaatcagccaatatttcactgcaacaacatctctggattcgttgagccagttgttccagacaaccagaacaggaccctgtactcaactcacaccttcaaggtcttgttcaaggacggcggctgtggtactttcgttcctctgttcctcaacctgactgcatctgtgcggcgctacaaccagtttgaaacccagtctgctgctagcatggcacctcgtgtggaccctctgcaagctgtgcagactcctgttgatgacatgatgcgtcatgcgtatgttgacccaaacgatcctaccaagatcttccttcagcaacctgcgccagaatcgcagctgaggaggaggaactaccacggcccagctgatgcaaattagcgcttggctggattggcagaactcatgctcaatttagtgctgggtccatattagcatggcacctatccttgtcgtttaccacaactgacttgcatattcgggtacccctggtttcctgtgaccttacatatataggacataatgatgcgagttctcc

SEQ ID NO: 9520 - DNA, 615 bp, Zea mays
  unsure (1)..(615): unsure at all n locations; Clone ID: LIB3279-198-Q1-K6-A12
gtctcaagcccgagnacacatttctcagtacaccatgctaacgggctcgccgacgtcctcaggtgaagccgcaacaatggggtacatgcggggtcagcgtggcatcgacgccggcgcttcttccgccaccggccgccggacggcttgtcgccgtcgagaccaggaggaggacgaggacggttgcctccgccgcgcttggtcctgtggccaccgagcccgcagaaaggtctcccgtgccacagcctccgccactgtccagcgacgaggagacggtgctccggctcggcaactacgtcccggtcttcgtcatgctcccagtaagctaaagctaaacgttccaccagagacacgcctgcaaaaaatcgatcaagttgcatcactgtccaatgtccatgatgaacacgacgtggcagcttgaagtggtgaccaccgagaacgacctggaggacgcgggggaagctgcgggagcagctgcggcggctgcggggggcccggcgtcgacggcgtgaaggtggacgtgtggtggggcgccggggagggcgccgggccggcgctgtacgaatggcgcgcgtaccgggaacctgtttccgggtcgggcagggcgaggggctcaag

SEQ ID NO: 9521 - DNA, 630 bp, Zea mays
  unsure (1)..(630): unsure at all n locations; Clone ID: LIB3279-198-Q1-K6-A2
ttcgtgaacgttcaaacaggaaaccaacggaagggtgttgatgtgattctggataacattggaggatcatatctccagcgcaacctgaatagcttaggtgttgatggtagacttttcatcattggcttccaagggggcatagcagctgaagtgaacctgcaagctgtgcttgcacgccgtttgaccatacaagctgctggactgcgcaacagaagccttgctaataaggcagagattgttagtgaggtggaaaagaacgtgtggcctgctgtcgctgctggcaaagtgaagccggtgatttacaagacgtttccgttatgtgaagctgctgaggctcataggttgatggaagctagcacccacatcggcaagatactgctgctcccatgactgcacctgtggcgtttgcgctcttgctctcggaggagtcagttcaaaaacatatgcaattcctgagactgtgacaacctgcacggatgttgtactggtgtcgcatgtcttttttatatatatcttgtagtactagattggatcttttaccccgagaaattatcttgtcaattggatccttaaagtgctgatgacattnttctgtgagctatgatataataaatctggcagatagagccc

SEQ ID NO: 9522 - DNA, 655 bp, Zea mays
  Clone ID: LIB3279-198-Q1-K6-A3
tgcaaatgtcttttcttgtgcatacttggttaacatgtctcggccagaacatcgccgtatacctgtaaaacatcaaaaggcactttggttcagtggtcttagaggggccatggcttttgcacttgctctccaatctgtgcatgaacttcctgaaggacatggaaaaacgatattcaccaccaccactgccattgttgttttgacggtacttctcattggagggtcgacaggaactatgcttgaatctttggatgttgttggagatgaaaacacatcaagagaaaattacgaggacaacaatggttacatgcctccgagttatgaagaaggaacatcctctggaggaggattgagaatgaaactcaaacagtttcacaaaagcacaacatcattcactgcccttgacaagaactatctcactccattttttaccagtcagacagatgatgataacgatgacgacttcagtcagcaaccccaaaaccgaagactagctttttatgatcaatagcggaatttgatactctacatatcaagctaaatacacggagcagaactgacgtgcatgactatgtctatgtgtgattgggtcgaacaaatatagcaggagcatacttagttgagtagcatatggcagagcatatctgtataccgt

SEQ ID NO: 9523 - DNA, 328 bp, Zea mays
  unsure (1)..(328): unsure at all n locations; Clone ID: LIB3279-198-Q1-K6-A4
atcaaggagcgcatcaagagnccaagatgagaagaaagcgaagaaggcggaggtgagcaagtcccagaagacgcagacaaagggtgcggtccagaagggttccaagggccccaagttgggcggcggtggtgggaagcgctgaaagaacttagtgtcgtttctcgacattgcagtcgttccttagccaaagccactttcgtagaacctgtgttgaatttgcaagacttattcaagcgttgcttgtgcgtgctaaataccatggcaagagaacggatttatatttatgcctgaaaaaaatgaccgttcatattcttaactcatcttggat

SEQ ID NO: 9524 - DNA, 668 bp, Zea mays
  unsure (1)..(668): unsure at all n locations; Clone ID: LIB3279-198-Q1-K6-A5
tatagatgtggaactctccttaaagtcaaagttacaattaatcctgatgatctatgtatgcacaactatcaaatatgtttttggatctctttggtgatgcaaagtcaatcaggaaggcttcaactcggcatacaactcttttttcatgtaagagaagcattctgccatcaaagaaacggaaggctgatgatgctgttgtgtcagacagggacaagtttgctaaaactgggtctgttcagtcagccacaggaactgatccaaatgcttccaatcctcctgtttggcctgcgacttctgaaacatctggacatcaatggggagcttcttatgctcagcaggctgcatatcctgcatatggaacttatgactacagccatcaaatgccacagcctgctcctcaaacagctgcctatggcgcttatcctccaacatactctgttcaggcctatacacaacaaagctacacacaacctgcagcaattccggcagcaccagtgccagcagtggtaccagcacctacaccggcgtcagcttaccctcagcaacctgcggcagctcctcaaccttattatggaacaacctactactgacaagtagagtaatcttcgatggcgatctgacgagcctgttaantcagcagtttgtcgatacgaggtcaaaggcatcac

SEQ ID NO: 9525 - DNA, 613 bp, Zea mays
  unsure (1)..(613): unsure at all n locations; Clone ID: LIB3279-198-Q1-K6-A6
ngaaaaaaaataagtcattggcatgacttgagagtttagaggcacctgcaaatgagatattcaactgtttgtcattgctctttctggcattatcggcaggtggtgtgcaacaacctatcgtgtttctgccactcctatagggtgctaagtctgaaatcagacacatttagtttgtcgagctcatcgacgaggatgttttgcggcttgaggttatggtagtaggcgtcgtgcctatgggagtactcaaatgagtcgaccaactagtggaattacatcctggtgacgtcctacttgagtcagcccctagcgactgaaagagacgtcagtgttcaggatcctcatgcaatgccaacgagtaggaggacgtaatctatcgcattatgtgctttgagttgtctctcagtgagctgaggatttgttcttcctcttggattggttggctcactagtagtagtcgactactaataggctagcttggtatttgtgttcgatttttggttctaattaagtgctatttctagtgactgtcgagtagtgcaacatgtatcaatactatggcctaaccacataccacacaattattgtttttggtatggaaacccggtgatcaatt

SEQ ID NO: 9526 - DNA, 643 bp, Zea mays
  Clone ID: LIB3279-198-Q1-K6-A8
gcaatacatcaaacactaaacttgatgtcatagatggaaaattttgggactcctgttggagcagaaattgagagagttgacatctggtgtgagatcaccctacactaaaccagccgaaggtgctcaagtgtaccacacttcaacagctttggaagatatggcatcagcatgtgaaacatctagcattgcttctactgattatgatagggagtcattacagtctttcagtgatggaaaagctactctgccctatacaaatcttgctactagaagtgtccagtcatctcagcctgtgaagtacgatcatggcgtcacggaccgatcagagctcgagcatcttggccaaagcccccttttcacatgggaggtttctatttcaactgaaacctgcagctcatcagagagctggaggaggcctgcaaatggaggaacaagactgttcagttcgaccgaaggagcgacaacttctgattcgacgcgcttcaacaaactcctagaagcggacgcctcttcagaatactccgacacggcctcatcaatcacagtggccacagcagaaatcgctcgatcagaaagtagcagctcgtggcatatggatagcagacaggaggtggagtttataagagagatactgaacgccagc

SEQ ID NO: 9527 - DNA, 465 bp, Zea mays
  Clone ID: LIB3279-198-Q1-K6-A9
gtgaagaagaacttggtgacatcaaggctcgcaacccctccctccccttccttgtccgcgagtgctccggtgtccagccccagctctgggcgcgctacgatatgggtgtggagagatgcgtgaacttggatggcctgacggaagcacagattgataaaaagctggaggagcttgccaaggccggcgagtctcttaaaaccaaatagttttggaactctatcctaccatgtttaactttcccaaataaatgatgccatatgggtgagcaattgttactctatcgttatctgtagttgtgcctggaattaagtctttaattggctcaactttgtgaaataatcactactcttttacttgccatgcattttctagattacatgctatattgaaaaggaaaaaaaatcaatgatttgataagaagaatatatacctagtagcttgtgcatgagagattgatcgtgcaat

SEQ ID NO: 9528 - DNA, 244 bp, Zea mays
  Clone ID: LIB3279-198-Q1-K6-B1
ggtgaagagtcgtagcggacggacggactgatgtcgatcgccgctcgaatcgcggagccggtacccggggatgagggttcagacggggacgtggacgcggcgggaggtgaccgccgccacacctgtgttcgctctacataccgccgcttcgggcacgccacccgcgccctcgaggtggtgaggacctgtcgcggggcacactcacgtgtaccgcggccgatctttacaccaatgctcccagctc

SEQ ID NO: 9529 - DNA, 476 bp, Zea mays
  unsure (1)..(476): unsure at all n locations; Clone ID: LIB3279-198-Q1-K6-B11
caggaacacaaccgcagcaagaggagaggagaggaggctcaccggtcgcgaccaaattctcccagagacggtcggaaatgaggagccaagcgctgttcttcctcacgatcgcccttctcaccgtgctcgcgcgatccagcaacaggcaccaccaccaccaccactcccacgttcaaagcagaggggggggggggcatcatgaggaggaggaggaggaggggagctggcgagccgggcgccgtcgccggcgcgcgcgtggccgtgctgcgacaggtgcggcggttgcccctggtcggagccgcggttgtgccggtgcctggacgcggcgcccgcgggtgccacccggcctgctggactgcgttaagtcctcctcagcgccgacccgccggtgtaccagtgcttgggcccgcgtccctgtcttctgcctgtgccccngcaccgcgcttgtcgtcgccgtcgcgcggtgacccacgcgg

SEQ ID NO: 9530 - DNA, 54 bp, Zea mays
  unsure (1)..(54): unsure at all n locations; Clone ID: LIB3279-198-Q1-K6-B12
aaaaannaaaaaaaaaaaaanaaccacgaataaaaaaaaaaaaaacccacaaaa

SEQ ID NO: 9531 - DNA, 575 bp, Zea mays
  Clone ID: LIB3279-198-Q1-K6-B2
cccacgcgtccgcatccccgctacgccatggctgctgcctcctccccaaccttcccgccgccggcgaccgaagtcgccgctccaggcgtccccgatctctcgatcccgtacgacctggccacccgcgggcagtggcaggcgctcttctcccacctctcccatccggcccacacgccccatccgcaccaccgcctcctcctctccgctctctccgccctctgcctggccaagctccgacgcttccccgacgccgctgcgcttctagcttccctccacccggatccggcctgcccgccgccacccttcctcatccgcctcctccatgctctcctcccactcttcctccccgaccgccccctcgcgctcgaccgcctctacacgctcctctcctccgtccgcgcccgccccgacggcgggcaccccgagtggcgccgccgcgacgcgctcgtcgcgtccgtcctcgccgccgaccacctcgcccaccgcgagttcgacgtcgcactcgcgctcctcgccgacatcgccggccgcgagccgggcgacccggtgctcctctcgcgcctcgcctacgcgca

SEQ ID NO: 9532 - DNA, 200 bp, Zea mays
  Clone ID: LIB3279-198-Q1-K6-B3
cggccgcgtggggcattagcggacatcttgtacgaatgagttgtgatggttggattctgttcctgatggggcccggtaagatactcttgcaacgattgtggtcttgcggcaacgctgcgcgttgtttctgtagtgaacatgaactgtgcagttaattggttactttttcaaagaatgatataaagaaatacaggtctctt

SEQ ID NO: 9533 - DNA, 289 bp, Zea mays
  Clone ID: LIB3279-198-Q1-K6-B4
cggcggtcggcgcgagggtggtggtggcggctacggcggcggcggcggcggctggagggactgatgtgtgggcccatcctggcttcggccgagttatcttatctatctatagtatcgtgttaccgttcgcttctgtcaccgtgttagtgtccgttctacctttggattaggtgttggtacccctgttgttccctttggttgctcccgctatgaaacgagacgagagaagaatgagcaaggtttttgttcgcagctatttttgtccaatgatattgatatgttgttcccc

SEQ ID NO: 9534 - DNA, 501 bp, Zea mays
  unsure (1)..(501): unsure at all n locations; Clone ID: LIB3279-198-Q1-K6-B5
cttcctggtgttgatcccaatgatccatctgttaaagatttgctggcatcattgcacagccagggagagcaagagaagaaggaagacaagtcagacaaaacagaagacgagaagaactgatgtagccatgttcatgcttccatgctcacaaagaaattgaacattggtctgcattggctgcgcttactctcttggctatgaaatttgcttatcctcatgtaacagtgctttgtttataacttaatgccgagggaatttgtattgtgactgcaacaatcttctcgtcataaatgttcaagtgatttcgtgtttcaagctctatttgcttgtgtttatttcaagctgtaaccaggccattcgatctcgtgtatgccgtatgcggcggatctgctcggttataagcgttgccctagaattttacaaaanaaaaaaaaaaaaanannnnnnnnnnnnnnnnnnnnnnnnnannannaaaaaaaaaaaaaaaaaaaaaaggggggc

SEQ ID NO: 9535 - DNA, 590 bp, Zea mays
  unsure (1)..(590): unsure at all n locations; Clone ID: LIB3279-198-Q1-K6-B6
gnttgcggagctgctgaggtatcactccaccaanagcggagatgagctgacaagcctcaaggactatgtgactaggatgaaggagggccagaatgacatctactacatcactggcgagagcaagaaggccgtggagaactcccccttccttgagaagctgaagaagaagggctatgaagtcctgtacatggtggacgccatcgacgagtatgctattggccagctcaaggagttcgagggcaagaagctcgtctcggccaccaaggagggcctgaagctcgatgagagtgaggatgagaagaagcggaaggaggagcttaaggagaagttcgagggcctgtgcaaggtgatcaaggaggtgctgggcgacaaggtggagaaggttgtggtctctgaccgcgtggtggactccccctgctgcctggtgacgggcgagtacggctggacggccaacatggagaggatcatgaaggcacaggcgctcagggactcgagcatgtctgggtacatgtcctccaagaagaccatggagatcaacccggacaacgccatcatggnaggagctgcgcaagcgcgcggaggccgacaag

SEQ ID NO: 9536 - DNA, 317 bp, Zea mays
  unsure (1)..(317): unsure at all n locations; Clone ID: LIB3279-198-Q1-K6-B7
ctgngtacctgcacaggcaccttggtggcgactccatcgtggaggtgatgccctctgaaggccatcttccccagcttagctctccagacatcgtaacccctgtcttactccggcacatccagcatgacatcgcagtctaggttggccagtcgttccaacaagacaatgtggaaattgtagcatatatatatgaccatgtaatctattgttcgtctaatgtaggataccgtgttggatgctctgacatcttaagtccttgagaagctcttcatgtcatttgtgttttttccatgaaacagaaactactaccatgtggt

SEQ ID NO: 9537 - DNA, 645 bp, Zea mays
  Clone ID: LIB3279-198-Q1-K6-B8
ccccgcgtccgccccgcgtccgcccacgcgtccggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggcgggtacggtggtggccgtggaggcggcggctacggcggtggcgggcgccgtgatggcggcggcggctacggcgtgtggcggcggctacggtggtggcggcggcggctacggtggtggtggcggcggctacggcggtggcaaccgtggcggcggctacggcaactccgacgggaactggaggaactgagcggtggggcccgcgcggccaagttatcctgttcgctaccgtgttgtttaccctagtccagagtgtttatcttcgttcgtctc

SEQ ID NO: 9538 - DNA, 653 bp, Zea mays
  Clone ID: LIB3279-198-Q1-K6-B9
ctcgcctgggttgtgttgtctcttcttccgattgttggtggtgtagctttggcatcccttactgaggcctcctttaactgggctggattttggagtgcaatggcttcaaatgtaaccttccagtcaaggaatgtgctaagcaagaaacttatggtgaagaaagaggaatctctcgacaacattaacctattctcgatcattacagtcatgtcattcttcctgttggccccagtaaccttacttacagaaggtgttaaagttagtccagcagtgttgcagtctgctggtttgaacttgaaacaggtatacacaaggtcattgattgctgcattctgcttccatgcataccaacaggtatcatacatgatcctcgccagggtatccccagtcacacattcagtgggcaattgcgtcaagcgtgtggtggtcattgtgacctctgttctgttcttcaggacccctgtttctcccatcaactctcttggtaccgggatcgctcttgctggagttttcctatactcgcaattgaagagacttaagcccaagcccaagactgcttgatcatatacatttgtaggtccattcaatagaactttggaagttatgctatgtcattgggagtgatcagtgagtgccgtagttagaatgataag

SEQ ID NO: 9539 - DNA, 598 bp, Zea mays
  Clone ID: LIB3279-198-Q1-K6-C1
ctctcgcccacccgccccggccccatgtcgccgcccctcgagccccacgactacatcggcctctccgccgccgccgcggcgccgccgaccccgacctcctcctcgtcgtcctcgtcctcgccggcgccccgcctcaccctccgcctcggcctgccgggctccgagtcccccgaccgcgaccgcgaccgctgcgaggacgtcgccgccgcgctctccctcggcccgctgcctgctacccccaaggcgcccgctgccgtctccgccaagcgcgccttcccggaccccgcccagcgccccggcgctgccaaggctagcgacgacaggcaggcctcccccgccgcgccgccggccgccaaggcgcaggtggtgggatggccgcccgtgcggaactaccggaagaacaccctcgccgcgagcgcctccaggagcaaggcgccggcgccggcggcggaggacgccgcgtctgcggcccggcccatgtacgtgaaggtgagcatggatggcgcgccctacctcaggaaggtggacatcaagatgtactccagctacgaggacctctccgtggcgctcgagaagatgttcagctgcttcatcgctg

SEQ ID NO: 9540 - DNA, 653 bp, Zea mays
  Clone ID: LIB3279-198-Q1-K6-C10
tcctgctcggcctcttcaccgttgccatcagctttgctgtgggcatgacatgtgccttcaccagtggcaaggtcattctggagtctgcaattctgacaacagtggtcgtgctcagccttaccgcatacactttctgggccgtgaataggggcaaagacttcagcttcctgggtcctttcctgttcgccgccctcatagtgctgcttgtgttcgcactcatccagatcctgttcccactgggcaagctctcccagatgatctacggcgggctggcgtcgctcatcttcagcgggtacatcgtctacgacacaaacaacatcatcaggcgctacacgtacgaccagtacgtctgggccgcagtctccctgtacctggacgttatcaacctcttcctgtccctgatgaccctcttcagggcagccgactaggcgctctgctctcatcctgtctatctacgagtcggtgcctgaatgctcccgtggttaagctccggtacccagaattccagttccaagaatagagttgtatatagctacctgtgttgcctttctactagtatggtcttattcggcttggctcggttcgatcagagtctttatacgtagttggatcgcgaacaaagaacctgcatgggattatggagagccatctgc

SEQ ID NO: 9541 - DNA, 618 bp, Zea mays
  Clone ID: LIB3279-198-Q1-K6-C11
ggcatccgcagagagcttgttccgtccaggcaaccaaaaagcagttgccccgccgcgcagaggaagaagagagcagaggaggatggctcgtacgaagcagaccgcccgcaagtccacgggaggcaaggccccccgcaagcagctcgccaccaaggcggcgaggaagtcggcgccgacgaccggcggcgtgcaagaagccccacaggtacaggcccggaaccgtggcgctgcgcgagatccgcaagtaccagaagagcacggagctgctgatccgcaagctgcccttccagcgcctggtgcgcgagatcgcgcaggacttcaagacagacctccgattccagagccacgccgtgctggcgctccaggaggccgccgaggcctacctcgtcggtctcttcgaggacaccaacctctgcgccatccacgctaagcgcgtcaccatcatgcccaaggacatccagctcgcccgccgcatccgtggcgagcgcgcgtagccatcatctccggggatctgatgaaatgtctagttaccaaacaaataggctgtattagcgtcgttgttctgttttcgttattttggattcggttgcagtgaaaaacagctttactaatcttatt

SEQ ID NO: 9542 - DNA, 664 bp, Zea mays
  Clone ID: LIB3279-198-Q1-K6-C2
aataaaagcgtgcatggatatatcatggaggtgcacgctgcgtaaaccaatggacaggccaacgacgcagcacatcctacttacactggaggaaacagaagcaaagatcaaatcggtcgttgggcctactccaccaaatgccgggcagcttcagattgccaaatttgggccgtggggtggagatggagggaagacgcgagacataagaatgacgccttgccatttgcatagcgtaacaattagcagtggaactattatcgattctatcgggttttcattcactgatcactatggtcagcaccacacaacagggccttggggcggtaaggagggtacgaataagcttgggggactacatccaaatacattccagcatagcatgcacatccaaatacgggtagccagcatgatggctagggtcgcaaggatcgggcgacctttgggtggagatgaaggggttcttcatggcatcacagacctcagtgggcagcagcgcagcagaggtggaggtccatcgggagaatgtggagacagcgacgacgagcccaacggtgatttcgccaaattcggcccgtggggcggcgacgggagacagccgcaggacatcggaacactaccctgccgtctagacaggatcaagatcagcagtgggcttatcatcgac

SEQ ID NO: 9543 - DNA, 624 bp, Zea mays
  unsure (1)..(624): unsure at all n locations; Clone ID: LIB3279-198-Q1-K6-C3
cccacgcgtccgcagactttggctttgggtgtgcggcgggcggcggcaccgtggcagttggcactgcggtctacagactgcatcagccggcaggactctgcgtctcctcccgtcctccggttctccctgcgacggacaaatctgctgctcgatttctctggttgtccctgtggcggacggcacatcggcaagccaggcagccagctcgtcagctctaaatcagattcagtaattattcattctattttgactgatctaaatccttcggaaacctgcatggattttgaggaacaagatgctgatagtgatcccgatgtcatgaatgattatggtgagctttaactgcgagtctaccactagttatggtgcttaatccttggcaatatgtttgtaaactttagatacattgtatagagcagcagcagctctgtaccatgaaccttgatatatcttgtgtgctgtgtgtgatgaaccatgagcttttgtatcaaactattgtatggagcagcaacagttctgcaccatgaaccttgatatatcttgtgtgctgggtgtgatgaaccatgaactnttgtatcaaactattgtatggagcagcagcagctctgcacttgtgtgcctttt

SEQ ID NO: 9544 - DNA, 696 bp, Zea mays
  Clone ID: LIB3279-198-Q1-K6-C4
gatcactaaccattcattgtctgataatacaaccgaattgcaaatagttcatgacatatgctccataattgacttctaacattaaaagtgctaagaacacaaatagcaaaactttgaaaatgcaaccagagacaggcacgcttgttgtcttgattgggaatgatcggacagtggcagtatccaagcacccgacgagctgctcagcggtagcggcggagggagagggtctggttgcgcttccaggtggctctccttgagggcctgttcttgtggtgggtgtggcccttgccacgcaggccacggtacttcttgcctgctgaggtgaggccacggagctcacggtgcttgtgcacagggttgcatagccagttgatcctcgggtcggttttgatggctttgtgggcaacgtccacaaggatgatctcaaagtacttgtaggtactatcctcattcacccagtaggagttaagaaccctcagtccaccaagcttacgtccagctctctcctcagcgacagacctcttgttcctctggaacttgagctgggtgataccctggtgcttgggcttgccatagacaatacccttgggcacaggcctcttcctgccaccacgcttcacacggacacggtagacaacatatccctgcttggccttgtagccgagaagacgggccttgtcggggcgggtgggcctg

SEQ ID NO: 9545 - DNA, 652 bp, Zea mays
  Clone ID: LIB3279-198-Q1-K6-C5
gggtacgccatggaggccgtcaagcagggctccgcctgcgtggggctccggtcccgcacccacgccgtcctcgccgccgtcaacaagcccgcctccgagctctcctcctaccagcggaaggtgttccgcgtcgccgaccacgccggggtcgcgctcgccggcctcaccgccgacggccgcgtcctctcgcgcttcctccgcaacgagtgcatcaaccactccttcgtctacgaggcgccgctccccgtctccaggctcgcgctcaggctcgccgacaaggcgcaggtctgcacgcagcggtcatggaagaggccctacggcgtgggcctcctcgttgccggactggacgagtcaggagcccacctgtactacaactgccccagcgggaactacttcgagtaccaggcgttcgccatcggctcccgctcccaagccgctaagacgttcctggagcgcaggttccagggctacgacgactacaccccggagcagctcgtcagggacgctctctccgccgtgaaggagacgctgcagggcgagaagctgtccggatccaactgcaccgtggccatcgtcggcaggaaggacgacggcaccgtcgagccgttcgaggtgatcggcgcggcaggggtccaggaacttatcgactcca

SEQ ID NO: 9546 - DNA, 634 bp, Zea mays
  Clone ID: LIB3279-198-Q1-K6-C6
ccccgcgtccgcacgtgctcagcctctgtcctggctggtgctcttctggaacccgaccacctctcataattcatcttctacatgtgctggagaggaatcatcatttggtcatgccactgctgaggacttaacttttagccatagtgttgctagctctgctatccaagatacacctgctcggatgtcaggagacggtgtggtttctgtgaacaacatatccaatgtggccaatgacatgcgtagtcctcgtgactgtgatgaatttctatcggagttgtctagatttatgaatgattctcctctgcgtaacactcctcttggagagtgctctggtcttcctccgatgtctgaagctgaggctcatgcttttgaagtcaactcttttggcctctacaatgaattatcagagcttgttgggttaggatgcgcggataacaacttaaacaccagcaatgtggaaactacggattatctcatgttgccacctgacagagaactgtcggctaatgattacatggaactaaacgatctccttgctcctgacccaagcttccccagtgaattttctgctcaggacaatcaatatatgcagcatcctcttgctcagtacaatggacattatgatctgtcaggt

SEQ ID NO: 9547 - DNA, 668 bp, Zea mays
  Clone ID: LIB3279-198-Q1-K6-C7
cgtcggaagcgtgtaacagagacccccaggtgaggtgacaaagacaaaaggcactgcaacactaaaaaagaagaacataaaagggatccaagaacagtctgagagttgaccataaatttcttggtagctcatatcacagcagtatcatatctgggctttctttagttgcatcttctctgagtgctgctgcttcatctggagaaaaagtcagcatcaccgttgtaggccttggtgctggttgtttcccaatgtttctccgtggatgtctgccttttgtagatattgaggtcgttgagttggaccccttggtggctgagctagcagagaaatattttggcttttcaatggatgagcaattgaaggtccatttgggagatggcatcaagttcattgaagacagtgttgctgcaaatcagtcagtaaatggcagtaccagaaatgcattcaaaatacttatcctcgatgttgattcatctgatctaagctctgggctgtcttgcccaccagaaaactttgtcgaagatcctttccttctaatagcaaaggagttccttttggagggcggcctttttgtcatcaatttagtctcgcggtcagcctcagtgagggaaacggttgtttcaagactgaaagcggtcttcgaacacctgtactcactgcaacttgaa

SEQ ID NO: 9548 - DNA, 680 bp, Zea mays
  Clone ID: LIB3279-198-Q1-K6-C8
cggccgcgtgggatctcaaccagttctcttgtatgctattcttctgatgatcctcctttctccttttgatatgttttacttatcatcacgcttttactttctgagaacagtctggcgtataatactgcctttacaagcaattacatttcctgacttctttttggctgatatttttacatccatgtcaaaggtgttctcagatctggagcgttcggtttgtcgtatggtgaatcgccaggttgcaacaatcgcttggtttgaagcagattctatttgtggcagtcattccgtagctattcctcttgttctcgtgtttccctacttgtggcgtttcttccaatgtctccgtcagtacaaggatacaaaggagaagacatgtcttttcaatgctctcaagtactcgacagcaattcctgtgattttcctttccgctctcaagtatcatgtatatcctgatcaatgggttggcttctaccgccccctctggcttatctctagtgttgtaaattcactgtattccttctactgggatataaagcgagattgggatttgagcatcctaaccaggattttcatgttcaaaaatccaagcatatggactaatcttctttacgggcagaactgggtattctactgggtactgggcagcaacttggttctgcgatgcacatggacataca

SEQ ID NO: 9549 - DNA, 637 bp, Zea mays
  Clone ID: LIB3279-198-Q1-K6-C9
ccccgcgtccggctcgcagtcccgggagggaaggctcccaggaagcagcttgccaccaaggctgcccgtaagtctgcccccaccactggtggagtgaagaagcctcaccgctaccgccctggaactgttgccctccgtgagatccgcaagtatcagaagagcactgagctgctgatcaggaagctgcccttccagaggctcgtcagggaaattgcacaggacttcaaaactgatttgcgtttccagagccatgcggtgcttgccctccaggaggctgctgaggcataccttgttggcctgtttgaggacaccaacctgtgcgccatccatgctaagcgtgtgaccatcatgccaaaggacattcagctggcaaggaggatccgcggcgagagggcctaatcgccacctcaaacatcgtgacaaaaacatgaagtcctggggttattgttaatctggtgccattgtaaggacatatgagtagggtttgttttgtggatcgcaagtttctcttctgctactgttgctgctacctttgctggtgttattgctagggtcgaatacttaagttaactatgcgctgacagtctggactagcagtgttatgtgcgctgctggaccttgcgcgcaatgctgtggc

SEQ ID NO: 9550 - DNA, 435 bp, Zea mays
  Clone ID: LIB3279-198-Q1-K6-D1
gtttacctgtgaggcctgctcccctgccgccgccgccatgggacactccaacgtgtggaactcgcaccccaagactacggccctggatctagggtttgccgtgtgtgcgctaacccccacggcttgatccgaaagtcgggctcatgtgctgcagacagtgcttccgcagcaacgccaaggacattggcttcatcaagtaccgctgaaacttggggagctccaaagcatggcaataatggaagcatggatggggacctaaaagatagcctgtactcttattcttatgataaaaccatgtaatgaattgtttggctttgtgtggacgaagttggtgtattctagatggtactcttgaatcttgatgcttccctgctatgctagctgagcatgtcgaaccgctatgaatcagacaatacagtatcaatgttaccactc

SEQ ID NO: 9551 - DNA, 636 bp, Zea mays
  unsure (1)..(636): unsure at all n locations; Clone ID: LIB3279-198-Q1-K6-D10
gggnacagtccgtgctggtgtgggacctgaccaacccggtccactccaccccggaatccggcgtcaccgccgactacggcgtccccttccgccgcctcaccggccactcccacttcgtccaggacgtcgtccttagttccgacggccagttcgcactctctggctcctgggacggcgagctccgcctttgggacctctccaccggcctcaccacccgccgcttcgtcggccacgagaaggacgtcatctccgtcgccttctccgtcgacaaccgccagatcgtctccgcgtcccgcgacaagaccatcaagctctggaacactctcggcgagtgcaagtacaccatcggcggcgacctcggcggcggcgagggccacaacgggtgggtctcctgcgttaggttctccccaaacaccttccagcccaccattgtctccggatcctgggaccgcaccgtcaaggtctggaaccttaccaactgcaagctgcgctgcactctggatgggcacggtggctatgttaacgccgtcgctgtgagccccgacgggtcgctgtgcgcctccggcgggaaggacggtgttactctgctgtgggatttggctgaggggaagaggctgtactcgctggacgcgggct

SEQ ID NO: 9552 - DNA, 629 bp, Zea mays
  unsure (1)..(629): unsure at all n locations; Clone ID: LIB3279-198-Q1-K6-D2
cggacgcgtgggggagatgaagaagaggggaaaactgatctggatgattatgggtatgctaatatcgctggtgagaacgatcaggatcctcctccagagaatgtatcggttcccttgcctgacatggtgcttcccccttcatttgattgtgacaatcccacataccggtaccgctttttggagtcaacctcgactgtcctagcaaggcctgttttggatgcgcatggatgggatcatgactgtggttatgatggagtgagcgttgaagagacactggctatccttagcaggttcccggcaaatgtagcagttcaggtcaccaaggacaagaaggaattcagcatccatttggactcttccatcgcagcaaagcatggagagaatgcatcatcacttgctggttttgatatccagactgttgggcgccagcttgcctatattctccgcggcgaggcaaaaatcaagaacatcaagaagaacaagaccacaggaggcttctcggtaactttcctgggtgacattgtggcaactggactgaaggtcgaggaccagctctcccttgggaagaggctgtcgctagttgccagcactggcgcgatgcgagcccaaggngaaactgcatatggagc

SEQ ID NO: 9553 - DNA, 636 bp, Zea mays
  unsure (1)..(636): unsure at all n locations; Clone ID: LIB3279-198-Q1-K6-D3
cccacgcgtccgtcgcacgagggctgattcctttccagctcgcaccgcggttgaacagcgtttcgttgtttcctccccaacttccaacacgcctcgatctagatccactcttcccccttctccttccggtcctccccccgagactattcatataggcgggtaggcgtccgaggcctcgtttgttctcggcttctcgtctccaagggtgctactccgtccgcgcttggtctgctctcgtccttccggaggccgcggcgcaacatggcgaagatcaagccgaaggccttgctcgcgcaaagcaaggtgaagaaggtccccggccaaatcagcgtggccacgatcgtcacctacatgatcctcggcgtcctggtcgtgtcctccgtttacgctgcctacaggtactgctgggcaggcacaggagcagcggaggcagtgagcgcccaggggaactgatcccccgccgactgcgtggctgatctcgctgttgttgtatcatccggttggggtaaaatttttggttgttgctgtctagcaaatggggttcttgggacatggataggttgtatgttgatcccgttacaccgtagccgatgatatgtatngtgaatttcttccctttattatcctttgatgatc

SEQ ID NO: 9554 - DNA, 415 bp, Zea mays
  Clone ID: LIB3279-198-Q1-K6-D4
gagctgctgatccgcaagctgccgttccagcgcctggtgcgtgagatcgcccaggatttcaagaccgaccttcgcttccagagctccgccgtcgccgcgctgcaggaggcgtccgaggcctaccttgtcgggctcttcgaggacaccaacctctgcgccattcacgccaagcgcgtcaccatcatgcccaaggacatccagctcgcccgccgcatccgtggggagagggcctaggcgtcgtcgcggtggaggtggaagtagtagtcgcagtttctgtcatcactgtctggctagaagttgtagagatgtgccggtttatgtagtttgggttattggtcgaatcattatgtagttgggtcttcactgctgtaatttaactatgactatgcaatggcaatgaagttctcggttatca

SEQ ID NO: 9555 - DNA, 671 bp, Zea mays
  Clone ID: LIB3279-198-Q1-K6-D5
cacaagccgccacgccagttccccatcccatcgcggcgcctaccccacccgccctgctcccgcccggtagtagtagcagagcctcgccgccgctgccgagaatagatggggttcgtgtccttcgtcgggcgggtgctcttcgtcgccgctttcctcctctccgcctaccaggagtttaatgaatttggcgctgatggtgggccagcagctaaggcccttcagcccaagttcaatgtgtttgtaaaaaatatctctgcgcatctgggagtagttgtgccgcacattgagttgaagcatgtgattgctgctacaattgctcttaagggacttggaagtctcctttttattttgagcagctccctcggtgcttatctcctgctgctgtacctcgctctgatcactcctatcgttcacgacttctacaactacgacacggagaaggaagaattcgcgcggctgtttgcgaagttcacccaggacgtggcgctggttggagctctcctcgtcttcctgggcatgaagacctccatcccgaagcgacagggcaagaagaaggctcacaaggcgaagacgaactagtaagaggttgctcgctcggcctcaggcgggtgtcaggagacgaatagtggcccagtgcgaagcagtcgatgcgcatcgagctgtcggctgcg

SEQ ID NO: 9556 - DNA, 655 bp, Zea mays
  Clone ID: LIB3279-198-Q1-K6-D6
cggcgccgtgtgcctcgcgcccaccaacccgcgcgacgagtaccagcactggatcaaggacatgcgccacagcaacagcgtcaaggacgaggaagggtacccggccttcgcgctcgtcaacagggtcaccggcgaggccatcaagcactcccagggcgagggccacccggtcaagctggtgccctacaaccccggctaccaggacgagtcggtgctgtggacggagagccgcgacgtcggccacggcttccgctgcgtccgcatggtcaacaacatctacctcaacttcgacgccttccacggcgacaaggaccacggcggcgtgcgcgacggcaccaacatcgtgctctggaagtggtgcgagggcgacaaccagcgctggaagatcgtcccctggtaaatgtgctgttctgtggctgcactggtcatcaccatgatctggagctttgaaggcatagccacctgtggtcagcagctgctgccgtgttgttagaataaagttggtggcgatcgatcgatctgtggtgatgagtgtccctatctgtgtgtttgtgtttagttccagtcgtctgtgaggaagtcagttatgtttgagtgagaggggtacttcgctcttcggtgaacactgtacttgtcatgaggagagttttcatac

SEQ ID NO: 9557 - DNA, 329 bp, Zea mays
  Clone ID: LIB3279-198-Q1-K6-D7
ctttggtggtaaatacattgtggggggtatactcctgtggtgttaagaaataagtaggctagtagttagtagaggaggggctggagaaattgtataatagtttcaactggttggagctaggtagtttagtggaggtcagttcttggcaatgtctttatttgatctttggtgatgtagataagagggtctgatctcggggtggtatatcatggaatctctgtttttttttgggtggtgatggtggtgttcaatgctattccatggattcgaactttcaattttattagctggtgtctaccagcacatgcctatgaattgtgattcaactt

SEQ ID NO: 9558 - DNA, 622 bp, Zea mays
  unsure (1)..(622): unsure at all n locations; Clone ID: LIB3279-198-Q1-K6-D9
cccggngctgtttcttcgtcgcaggaatgggcaaggacggcatccagtacgcagtggtggacgccttcacggcggagccgttcaagggcaaccccgccgcggtgtgcctcctcgaggacgccgccaaggccgccgacgagcggtggatgcagtccgtcgccgccgagttcaacatctccgagaccgccttcctcctccgggaaaagtcctccgcggccggcgccgtcccgctgttccagctccgatggttcacccccgtcgctgaggtggagctctgcggccacgccacgctggcttccgcccacttcctcttcacatccgtcctcgcggagcacgagaagctcgtcgagttctcgaccaagtccgggattcttacggccaaaaaggtccctgcgccgcagagcacgggcgtgtcgggcgaggggaagctgttcattgagctggatttccccacgattgaccttgttgattgccatccttccgagctgccggcaatccccgacaccctcaacggagcctccattgtcagcgttcacaagtcaacgacggccggtgacctcattgtggagctttcatcaggaaaggaggttgctgatatcattcctaacattcatgaaattga

SEQ ID NO: 9559 - DNA, 634 bp, Zea mays
  Clone ID: LIB3279-198-Q1-K6-E1
tgattactacccagaattgttaaagaagctgtcaatcttgccctagataaaggcaccaattttgttgatcctcttgttaggctactggagcatttgtacacaaagaaaattttcaagactcaagacctggaatccggttgcttgttatatggtactctgctggatgacattggcattgaccttcctaaagctccagcacaatttggtgagatcattgctcgcctgactttgttgggtgccttgagatttgaagctctggaggttattttaaagaaaatggaggatacctacaaccgcaaagcagtttctaatgctttcatgaaaaccttggaagcaaacccatcaggtcaggctatcttaggctcacctgctgctgctgcagtaatagacgcttgcaacagccttttggaataatcttcctagcagctttggcctatcaaccttttcagattctgtatcttgcgaaagacggtctcgtgtactctctatagtttaggtgtcaaggaattgaggaacagacaattttgagctgtataattttgcgagatcagatgagtgttgattgttattgtttcggccaagaaggaaagaaagagccatgaattttggtcttgggcgaccagcttaatttgca

SEQ ID NO: 9560 - DNA, 369 bp, Zea mays
  Clone ID: LIB3279-198-Q1-K6-E10
atttttctgctttgaatctatgagagaaatattgttattccgtttactggctatgacacaaaaacctgaatgctgttataatatatgcccatcttgtaccttttcaaaaaaaaaaaaaaaaaaaaaaaaaaaaaaaaaaaaaaaaaaaaaaaaaaaaaaaaaaaaaaaaaaaaaaaaaaaaaaagggggaaaaaaaaaaaaaaaaaaaaaaaaaaaaaaaaaaaaaaaaaaaaaaaaaaaaaggggggggcgtttttaaaaaaaaaataattaaaccccctttaaacaaaataaaaaatttttaaaaacgggcccaaaaaaaaaaaaatcggcccggttaataaaacctttggacagggaaaaaccctg

SEQ ID NO: 9561 - DNA, 401 bp, Zea mays
  Clone ID: LIB3279-198-Q1-K6-E11
cggccgcgtggggagaggaccgcaggaggtcaagaacatcaagcacagcggccacatcagtctcgacgacgtcatcgagattgccaggaccatgaggcccaggtccatggccaaggaaatgtccggctgcgtcaaggagattctcggcacctgcgtcagcgtctgctgcaccgtcggcggcaaggaccccaaggacctccagcaggagattgacgacggcgaggtggagatcccgtccgcttaagaagagggtatcatgagcaaatttctgttgttcggttgtaatattggtgaaccatttcgctttgtcggttggagctgctgtagccgatacagttaatggatgtactttgttcgcgatcacgtttcctccatttaagcgatgctccggtgattctttt

SEQ ID NO: 9562 - DNA, 571 bp, Zea mays
  unsure (1)..(571): unsure at all n locations; Clone ID: LIB3279-198-Q1-K6-E12
ggcggcgcgggcggacaagnagcaggcggaggaggagctgtgccaagccacaatgggtatctcgcgtgactcgatgcacaagcgccgggccaccggtggaaagcagaagcctggaggaagaagcgaaagtatgagcttggtcgccagccagccaacaccaagntgtcaagcaataagacagcgaggagggtccgtgttcgtggaggtaatgtgaaatggagggctcttcgccttgatactggtaactactcatggggaagtgaagctgttacccgcaagacccgtatcctagacgtggtctacaatgcatcaaacaatgagctcgtgaggacacaaacccttgcgaagagtgccattgtgcaagtcgatgctgccccatttcagcagtggtacctcactcactatggagttgacattggtaggaacaacgaaacccctgctgcaaagaaggataacgcttggggacaagaggttgaggcagcagttgcggaatcgaacaaaagccccatgtcatagtgtagcttgagaagcgcaggagggacgtgcccttcgcccaccattgaggagcaat

SEQ ID NO: 9563 - DNA, 630 bp, Zea mays
  Clone ID: LIB3279-198-Q1-K6-E3
gtcggcatccgccccggcaagggtaagatgcgcaaccgccggtacatcaaccgcaagggcccgctcgtcgtctacggcacagagggctccaaggtcgtcaaggccttccgcaacctccccggcgtggacgtcgccaacgtcgagcgcctcaacctgctcgaccttgcccccggtggccacctcgggcgctttgtgatctggaccgagagcgcgttcaagaagctcgaggaggtgtatgggagctttgacgcgccgtcgcagaagaagaagggctttgttctgccgaggcccaagatggccaacgctgacctgggcaggattatcaactctgacgaggtgcagtctgtggttaagccactcaacaaggaggtgaagcgcagggagaagaggaagaacccgctcacgaacatggctgctgtgctcaagctcaacccctacctcggcactgcccggaagatggccacccttgctgaggctgcccgagtcaaggcccggaaggagaagcttgattccaagaggaccaagcttacctcggagactgccaaggtcaaggctgccggcaaggcgtggtacaagaccatggtctcggacagtgactacaccgagtttgagaacttcaccaagtggctc

SEQ ID NO: 9564 - DNA, 692 bp, Zea mays
  unsure (1)..(692): unsure at all n locations; Clone ID: LIB3279-198-Q1-K6-E4
cccacgcgtccngagttctcgcgcccacagccaaatttttctccactcaatcgcggcataagctgcactgcagccatggacgccagcggagccggtagcaaggcgaagaagggggcggctgggcgcaaggctggcggccccaggaagaagtcggtgtcgcggtccgtcaaggccgggctgcagttccccgtcggccggatcgggcgctacctcaagaaggggcggtacgcgcagcgcgtgggcaccggcgcccccgtctatctcgccgccgtgcttgagtacctcgccgccgaggtgctggagctggccgggaacgcggcgaaggacaacaagaagacgcgcatcgtcccgcgacacttgctcctggcgattcgtaacgacgttgagctcggcaagctgctgtctggcgtcaccatcgcgcacggcggtgtcctccccaacatcaacccggttctcctgcccaagaaggtggcggagaaggcgtccagcggcggcagcaaggagagcaagtcccctaagaaggccgccaagtccccaaagaaggcagccaagtccccgaagaaggcttagaaattagtcacttcactagcgctctgctgtagcatgttcgtgtntagatctgtggaacttatgtgttccagcctaatttcctctttgccttgtggctcctgatatgttcactggcatgtttg

SEQ ID NO: 9565 - DNA, 630 bp, Zea mays
  Clone ID: LIB3279-198-Q1-K6-E5
gccttttcttctccttccctcacctgctctctctctctctctctctctctccctttctttcccgcggcgacggtgacgacgaccgcgcgagcgccgccgacttcctactgcagcaggtgcctcggccttcgtcgtgctctccgccggcaacgagtatagacgggcgcgcatggccaccttcgagctgtaccggaggtccaccatcggcatgtgcctcaccgagacgctcgacgagatggtctccaacggcaccctcagcccggagctcgctatccaggtcctcgtccagttcgacaagtccatgacggatgctctggagaaccaagtgaagagcaaggttactgtcaagggtcacctgcacacctacaggttctgtgacaacgtgtggaccttcatcttgacagacgcaagcttcaagaacgaggaggccacggagcaggtgggcaaggtgaagattgtggcatgtgattccaaattgctcggacaataggcctgtgtaccctcgaggtcaaggaaggaagcttttaagtgcggcggggcggggtctgtctgcgcgtcagctgtacacgcctaggctaccgcccgaggcggggtctgtctgcgtcagctgtacacgcctaggctaccgcc

SEQ ID NO: 9566 - DNA, 675 bp, Zea mays
  Clone ID: LIB3279-198-Q1-K6-E6
tcttgatccagccaagccagggatcgccatgtcggactcggaggagcaccacttcgaatcgaaggccgacgccggagcgtccaagacctacccgcagcaggctggcaccgtccgtaagaacggcttcatcgtcatcaagaaccgcccctgcaaggttgtggaggtttctacctcaaagactggtaagcatggccatgccaaatgccactttgttgccatagacatattcaacgggaaaaagctcgaagatattgttccttcgtcacacaactgtgatattccgcatgtgaaccgtactgagtaccagctgattgatatatcagaggatggatttgtgagccttcttacttcagatggcaacactaaggatgatcttagactcccaactgatgagactcttgtggcccagatcaaggaagggttcgaaagcggcaaggatcttgttgtgactgtccagtctgctatgggggaggagcagatctgcgcgctgaaggatgttggccccaagtaacttccctgccttggaatactgtatctcaaaacctaaatcgaaaaagaagtgtatcaaggattgctacagagacatccatctggcttgagctggcttttgctatggcaaacacaagtgcagggatcgctgggtgttgcaccgtgtctgcattatctgtggttaca

SEQ ID NO: 9567 - DNA, 644 bp, Zea mays
  Clone ID: LIB3279-198-Q1-K6-E7
taaagcgctgggagcaacatgttacaggcagcacctgctgtcaaagctattagtgcagtgtctcagacgaaaccacgtagggctaagcacaggcaagtaaatgctgcagacaaatctccacgtcatatgaaggtaaatcgggggaacagcaaagccgctagtaaggagtctctatcttgtggagaaatgctacggcagatctcattagcagcatgtggtcttaagcagagagaggaaattgctccttcaagtgttaatttctttaccgattttaggaagaactccattttttctagttctgatgtcgatgagaggatgcctgagaaggcaaccaacgccgagtccactccttcagaacagcccattgttgatcatatgcaggatgactattggtccgacattctcattaatgtggaggagccgttatctagcctcaaaaagaagatatataagagtaagaaaagagcaaacaagaaggcacctcaggttaagaaacctcctgttaattcattggcgactgcagaaaatgcggatgagccaaggagtgaaggcaaccaagatacagaaaatggggaacaacttaggaacaaaacgaagctgttttctgcaaatggatctcaacagaatgggacaaaatctggtga

SEQ ID NO: 9568 - DNA, 653 bp, Zea mays
  Clone ID: LIB3279-198-Q1-K6-E8
ccccgcgtccgccccgcgtccgccccgcgtccggaatctttcaccctcctgacctctctctctcctcttctccctcccgtgagtgagtgagctggagccaagctagccgagcgagtgatggcatggggagcttgcactgctgcggcagctgctctccttctgctcctcctcctcctcgccgccgccgcagcaggtggtaacggcggcgtgcattgccttgaccttgaccttgaggaggggaggcggcaccacctgagcaggagagccttgcaagggaggcagaggcggcaccacctgaggtcaagggcggtgggtggcgccacggtgctcgagctgaggcaccacagcttcagccctgcaccggccaacagcagggaggaggaggcggacgctctcctgtccgccgacgccgcgcgcgtctcgtcgctgcaagggcgcatagagcactaccggctgacgacgaccagctcgtcggccgaggtggcggtgacggcgtccaaggcgcaggtgcccgtcagctcgggcgcgaggctccggacgctgaactacgtggccaccgtggggctgggcggcggcgaggcgacggtgatcgtggacacggccagcgagctgacgtgggtgcagtgcgcgccgtgcgagtcgtgccacgacca

SEQ ID NO: 9569 - DNA, 637 bp, Zea mays
  unsure (1)..(637): unsure at all n locations; Clone ID: LIB3279-198-Q1-K6-E9
gcggcgcagnacgggacagccaagcacggagacggcgctgcgcgcgtcgctcccgcctccgacgcggaggacgacgacgacgacgaaggcgagagggaggagtcgcgggctgtcaacccgggctacccggcgtctccgcctcgtccggggccgaggccgacccacgcggcgcagaacgggaccgcgcgccgcgacgaggttgaggaggagtgcgagatcaccgtcgtcgacgagtcggaggagcacggcgagagcgtcgaggaccacggagggcaggaacaggaggaggaggtcagcggcggcggcaggacgagggcgagcgcccggtcgccggccacggacgacgggagggaggccggcggagagacgccgcggcagcaggcggtcaacccggactgccccaacgccgccaaccccttccaccgctgcgccgagtactgccccgtccccgtccccaaggctccgccgctgccgcggccacgtgggtacgaggggagcacgcacagcgaccccggcgagctgcaccccaggccgcgccgccgcgacaagggcggcggctccggcggcggcctcccgctctacgtttttctgcgcgaaggctccgacggcgacggcaagaaggtggatccccgttgcc

SEQ ID NO: 9570 - DNA, 271 bp, Zea mays
  unsure (1)..(271): unsure at all n locations; Clone ID: LIB3279-198-Q1-K6-F1
cctctctcgcatccgcagcctctcgagctctactccatcccctcgatctcgaagcgcagcagcagcagtcaggcggccatggacgccagcgcagcaggagccggcgggaaggcgaagaagggcgcggccgggcgcaaggccggcgggccgaggaagaagtcggtgnnacgaaaggggtccgtnncaaggggccgnnggctgcnnagttncnncccgtcggccgcatcgggcggtatctgaagaaggccggtcgcgcagcgcgtngcacggg

SEQ ID NO: 9571 - DNA, 611 bp, Zea mays
  unsure (1)..(611): unsure at all n locations; Clone ID: LIB3279-198-Q1-K6-F10
ttgagtttcatctttaagtttccctttattatctcttttgagattttggagaaaaaacaaatcaatgattgattttattgaatttacttgagataaggggaccatgcaagtatcggtgcaacagttttatttcagttgctagtttgtacaaaaatcagttatggtggatataatttagggtgttgagactaaagctcgacaaaaaaaattaatacagtaaaattaattaaggagatgtttgcgactactccgatccaccattttaagttctgctccaccaactccaccatgaagttgctccatgatcgaagtttttagagttttcaaactgcttagcttatagggggacttggtgggtggagaatgacttattataggtcgaccacgcgttcttcttgtttgacacaggtgacatgaggacgctgctttctggaggcgacgacgtcgtcgattttgctgtcttctcgggattcgtgacccgacacttcttgatccccgggaccacgatcattgcaacttctatggtattgacgcatctcgagctccgtgctaaaccgcatggcatgcttaatgaccgnaatcaatgtatgctcagtcatggaagttaagcg

SEQ ID NO: 9572 - DNA, 663 bp, Zea mays
  Clone ID: LIB3279-198-Q1-K6-F2
cccacgcgtccgcatctcccaacgcccccgcctcgcctcgggatcccgccgccgctccatctgcctttgctcccccacccgcaggcagcgagcgacagcgacggcgagggatggccaaggccaggtcgttggcgaagcagaagcaggcgcagcaatcaaacggcggcggcggccacgcgctgtcctccaagctcgcccggtacctcgacccggaggcctccttggacaaggaccaactgctggacgcggtgcactggatccgccaggcggtggggctcatatgcggcctgctctggggagccgtccccctcgtcggcgccgtctggatcgcactatttatggccatctcgactggcattatctattggtactacacctacttgctgaaggttgacgaggaggaatatggaggccatggggcgcttcttcaggagggtcttttcgcttcattcacccttttcctgctttcgtggactctagtatacagtctggctcacttctgagaagctcctttggcgcacatacctttgttcactgtgccagacagaaaagactcaccaggacagtgtagactaaggagcattttagaacgagcgttgtatcaaaacggttctgagctgtaatggtatttcccaaccccccagtgtatcttggtgctatggg

SEQ ID NO: 9573 - DNA, 675 bp, Zea mays
  Clone ID: LIB3279-198-Q1-K6-F5
gcgcctctgaagttcggagccgccggcccgtccgcctccctctccgcctcccgtccccaaggccaatagttttcaagtggcaatggcggaccaggctaaccaacccactgtccttcataagctcggtggccagttccacctgcgctcgatcatctctgaaggtgtacgggcccgtaacatatgcccatctgtctcatcttatgaaaggagatttgccacaaggaactacatgacccagagcctttggggcccttcaatgtctgttagcggtggcatcaatgtcccagtgatgcagaccccgctctgtgctaatgctcctgctgagaaaggaggcaagaacttcatgattgatttcatgatgggcggtgtttcagctgctgtttcaaagactgctgctgctcccatcgagcgtgtgaagctgcttattcagaaccaagatgagatgattaagtctggtaggctatcagagccgtacaagggtattgttgactgcttcaaacgtaccattaaggatgaaggtttctcttccttgtggaggggtaacactgctaatgttattcgttacttccctactcaggctttgaactttgcatttaaggactacttacggaggttgttcaacttcaagaaggatagggatggctattggaagtggtttgctaccaacctggcctt

SEQ ID NO: 9574 - DNA, 537 bp, Zea mays
  Clone ID: LIB3279-198-Q1-K6-F6
caaattcaaagtcacagcggcgaaactctcggcgatgtctggccgcggcaagggcgggaagggtctgggcaagggcggcgccaagcgccaccgcaaggtgctgcgtgacaacatccagggcatcaccaagccggcgatccgcaggttggcgaggaggggcggcgtcaagcgcatctccgggctcatctacgaggagacccgcggcgtgctcaagatcttcctcgagaacgtcatccgcgacgccgtcacctacaccgagcacgcccgccgcaagactgtgaccgccatggacagttgtctacgctctcaagcgccagggccgcaccctctacggtttcggcggttaggtcgcccctctcccggtggcgaattacgtggtggcggtggcggtcgtgttgtgttcttggtctagttagtctgtgttgtctttatcggtgctgttttctgtggtggttgtactgcatcgttctagtttctagtccatgtgctgtaatatctcgctgctgtaatcaatggaatgtcctcgtttcaagcctc

SEQ ID NO: 9575 - DNA, 567 bp, Zea mays
  unsure (1)..(567): unsure at all n locations; Clone ID: LIB3279-198-Q1-K6-F8
ngcaggcgaggcgagggtgtgagggaaggagcaccagccatggtgcacgtcaacttctaccgcaactatggtaagacgttcaagaaaccaaggcgtccttatgagaaggagcgtcttgatgctgaactgaagctggttggtgagtatgggctgaggtgcaagcgtgagctttggagggtccagtatgcactgagcaggatccgtaatgctgcaaggcacttgctcacccttgacgagaagaacccccgtcgtatctttgagggtgaggcacttcttcgccgcatgaaccgctatgggctgcttgctgagggtcagaacaagcttgattatgttcttgccctcaccgctgagaacttcctcgcaaggcggcttcaaacacttgtcttcaaggctggcatggccaagtccattcaccatgctcgtgtcttgatcaagcagcgtcacatcagggttggcaggcaaattgtcaacgtcccatcattcatggtgagggtggagtctgagaagcacattgacttttcactgtcaagcccattcggtggaggccccgcaggaagggtgaagagt

SEQ ID NO: 9576 - DNA, 628 bp, Zea mays
  Clone ID: LIB3279-198-Q1-K6-G1
ggatcctgaaggagttgaaggacctgcagaaggacccgcccacctcctgcagcgcaggtcctgttggtgaggacatgttccattggcaagcgaccatcatggggccttcggacagcccatttgcaggtggggtattcttggtgaacattcacttcccaccggattaccctttcaagccaccaaaggtgtctttccgcaccaaggtattccacccgaacatcaacagcaacggcagcatttgccttgacattcttaaggaacagtggagtcctgctttaactatctcaaaggttctcctgtcaatctgctcactgctcacggacccaaaccctgatgatcctcttgtccctgagattgctcacatgtacaagaccgacagggccaagtatgagtccaccgcacgctcctggacacagaagtatgccatgggctagaagcaaggctaaaagctggccaaactggtgaatgtgccggaccccaaatcgttatcacctaaataaccagtcaagtcgcaagtatgaatggacttttgaggaccattgtgccctgttgaactcatgtattaccttgtgaagtccgttgtgtctggtttctaccctgaccgttcgttatctgatgctgtttcttt

SEQ ID NO: 9577 - DNA, 381 bp, Zea mays
  unsure (1)..(381): unsure at all n locations; Clone ID: LIB3279-198-Q1-K6-G10
nggcggcgccgggaggagcgcgaggacgccaagtacctgcgcatggagcggcggatgggcaagttcatgcgcaagttcgtgctgccggacaacgccgacatggacaaggtcgccgccgtgtgcagggacggcgtgctcacggtgaccgtcgagaagctgcccccgcaggagcccaagaagcccaagaccatcgagattaaggtcgcctgagtgtagaccgttgtcggagcagtgccagtgagctgggtggctacctgcgggactctggtgaggaagagcaaatggtagaaagcagtagctgtgcttctgaacattgtgtgtgtttgtttcccttgttaccgccaatcatcctacctgatgtgtcgtctggggtttcgtttg

SEQ ID NO: 9578 - DNA, 449 bp, Zea mays
  unsure (1)..(449): unsure at all n locations; Clone ID: LIB3279-198-Q1-K6-G11
tagtccaccatgctaacggtctcgccggcgcctcaagggaatccgcgacgatggggcccatgcggagtcagcaccgcatccacgtcgagccttattcggccacacggccgtcggacggctcgtctccgctgnatccaggtaggtacgaccggttcggtcgccttccctgcgcttgctcctgtggccaccgagcccgcagcaaggtctcccgatccaacagccttcgtcactgtccagcgacgaggagatcgggcttcggttcgggaactatcgaccggtctggggcatgttcgcagtaagctaaagctaaacgctccatccgaaacacgcctgcttaaaatcgatcaagtggcanagttgtcaaatctgataaataaacaccatgtggctactagaagaggtgaccactgagaacgactggaggacgcggggaaagctgtggaagcagc

SEQ ID NO: 9579 - DNA, 538 bp, Zea mays
  unsure (1)..(538): unsure at all n locations; Clone ID: LIB3279-198-Q1-K6-G12
gaggaggctcaccggtcgcgaccaaattctcccagaccggccggaaatgaggagccaagcgctgttcttcctcacgatcgcccttctcaccgtgctcgcgcgatccagcaacaggcaccaccaccaccaccactcccacgttcaaagcagagggcagggagcaccatcaggaggaggaggaggaggaggggagctggcgagccgggcgccggcgccggcgcgcgcgtggccgtgctgcgacagctgcggaggctgcaccaggtcggagccgcggctgtgccggtgcctggacgcggcgccccgcgggtgccacccggactgcagggactgcgtcaagtccagcctcagcgccgacccgccggtgtaccagtgcatggaccgcgtccccgacttctgcctgcgccgntgcaccgcgcctgccgccgccgccgcgcggtgaccacgcggtcgacgccgacccagcgactggtctctggttgctcttggaatcttgacccacccacccaccaccaaccgtttcagccttttctccacccca

SEQ ID NO: 9580 - DNA, 638 bp, Zea mays
  Clone ID: LIB3279-198-Q1-K6-G2
cccaaaacgcagcgcgcgaaaacgcagagcaacccgcccactcgccaccaccgcccgcgcgcacggcggcgaccgatggccccgctcgtgccgatgtcgcagccatgggtggagaaataccggccgaggcaggtcaaggatgtggctcaccaggaggaggtgattcgcgtgctcaccaacaccctccagaccgccgacctgccgcacatgctattctacggcccgccggggacgggaaagaccaccaccgcactagccatcgcctaccagctctatggtccagagctgtataagtcaagggttttggagctcaatgctagtgatgatcgtggaattaatgtggtgaggacgaaaatcaagaactttgctgctgttgctgttggtactgcacggaaagctggttatccctgcccaccttacaagattattatacttgacgaagcagattcaatgacagaagatgcccagaatgctttgaggcgtaccatggagacttactccaaagtgaccagattcttttttatatgcaactatatcagcaggataatagaaccacttgcatcaagatgtgcaaagtttaggttcaagcctctttcagaagaagtgatgagcagtcgcattatgcatatatgcaatga

SEQ ID NO: 9581 - DNA, 307 bp, Zea mays
  Clone ID: LIB3279-198-Q1-K6-G3
cgtgttgttattggcacacttcggggattcgaccagttcatgaatctggtgatcgacaacactgtggaggtcaatggaaatgacaagacagatattggaatggtggttatcaggggaaacagtgttgtcatgatcgaggcactggagccagttgccaagtcgcagtgaatccttatttttcagctgatatagtcgcagcatgaaaactgatgtaaatgctatgagtgaaccctgttgtacttcggactcgtgcttttgcacagcaacataactcggctaccagcacccctgtttcaatggtgacttc

SEQ ID NO: 9582 - DNA, 666 bp, Zea mays
  unsure (1)..(666): unsure at all n locations; Clone ID: LIB3279-198-Q1-K6-G4
cggccgcgtgggcggacgcgtgggagccgcagccttagccttgccttcgaactcgaagcccgttgcatccggctaccgcagcgtcgccgaccgtcacagccggtctcctccctccgctaccatggnggaagacacgcggaatgggagctgggcgcaagctcaagacccaccgcaggaaccagaggtgggctgacaaagcatacaagaaaagccacttgggcaatgagtggaagaaaccttttgctggatcatctcacgccaagggcatcgttctggagaagattggtattgaggccaagcagccgaactctgccatccgtaagtgtgcccgtgttcagctggtgaagaatgggaaaaagattgctgcctttgtgccaaatgatggttgcctaaactacatcgaggagaatgatgaggtgttgattgctgggtttggtcgtaagggccatgctgtgggagatatccctggtgtcaggttcaaggttgtgaaggtatctggtgtgtcgctgctcgcgctcttcaaggagaagaaagagaagccaaggtcttagatcactgtcgatagtctagaatggagtaaactgacaggctctactatggagtaaactgccaaggtttttagatcactttcgatagtgaggttcaaggttgtgaagtttagcgaca

SEQ ID NO: 9583 - DNA, 662 bp, Zea mays
  Clone ID: LIB3279-198-Q1-K6-G5
ccatgccggcgtacgagttcgcgctgcagcacccgggccgcaccctcggcgtggtgtgcctgggcatccccttcaacccggcccccatgtccttcgacgccatcatgcccgaaggattctacatcctgcgctggcgcgagccgggcagggcggaggccgacttcggccggttcgacgtgaggcgcgtggtgcgcaccatctacgtgctcttcgccggcgccgagatcccgattgccaaggaagggcaggagatcatggacctggccgacctgtccacgcccctcccggagtggttcaccgaggaggacctggacgcctacgccaagctctacgagaagtccggcttcgggtacccgctcaagatgccgtacagatctatgcacaagctcccgaaccggctggacgccaagttccaggtgccggtgttcatggtgatgggggagaaggactacgcgttcaagttcccggggttcgagaccgccatgcgcggcggcgtcatggacaacttcatgccggacctcaagatcacctacatccctgaggggagccacttcgtgcaggagcagctcccagagcaggtcaacgacctgctcctcggcttcctcagggaccattcctccgccgcataagcagtgggtgagaccgtcagaataatggaatgc

SEQ ID NO: 9584 - DNA, 681 bp, Zea mays
  unsure (1)..(681): unsure at all n locations; Clone ID: LIB3279-198-Q1-K6-G6
gnacagnanagctcctcagggtggccatgaagacctactgaatgttgaggccagaggttccagtggcatggtagatatcaatgtggcatcagcgataatgtttgtggtggttgcgtcatgcttcttaataatgctttacaaactgatgtcttactggtttgtggagctactggtggtaatcttctgcattggcggcgtagagggtctacaaacatgcttggtggctctgttgtcaagatggtttaaacctgctgcagaatcttttgtgaaagtaccgttccttggagccgtttcgcatcttactctggcagtttgcccattttgcgttgcatttgctgttgtgtgggctgtttttcgccagctcccctttgcttggattgggcaagacattctgggtattgcattgatagttacagtcatccaaattgtgagagtacctaacctcaaggtgggttcggttcttcttggctgtgccttcctgtatgatatcttctgggtgtttatctccaagagatggtttcatgagagcgtgatgattgtggttgcgcgtggcgacaagaccgacgaggatggtgtgcccatgctgctaaaaatcccgcgcatgtttgatccatggggtggatacaagctcattggcttgggggatatccttcttcctgggcttttagttgctttctcgct

SEQ ID NO: 9585 - DNA, 645 bp, Zea mays
  Clone ID: LIB3279-198-Q1-K6-G8
cactcattggtagccgtcgtggtaatgatgaagtaatggcaaggggaacgtttgcaaacattaggatcgtgaacaagtttttgaacggagaagttggacccaagaccattcatgttcctactggggagaagctttctgtttttgatgcggccatgagatacaaatctgatggccatgctactataatcctcgctggtgctgagtatggaagcggcagttctcgtgattgggctgctaagggtccgatgctcctgggagttaaagctgtaattgccaagagctttgagcgtatccacagaagcaacttggtggggatgggaatcattcctctgtgcttcaaagctggtgaggatgctgattcgcttggcctcactggacatgagcggtacagcatcgatctccctaccaacctcagtgagatccgtcccggccaggatgtgactgttactaccgacaatgggaaatctttcacttgcatcgttcgctttgacactgaggtggagctggcgtacttcaaccatggaggcatcctcccttatgtcatccgcaacttggcagttgcgcataacttgagcaaggtcaacacaccgtttgacccacaatggcagtggcaggctccatgttcccagagcttgcgacctggtt

SEQ ID NO: 9586 - DNA, 657 bp, Zea mays
  unsure (1)..(657): unsure at all n locations; Clone ID: LIB3279-198-Q1-K6-G9
cggnggcgctgcccacgacctcgtcaagcgcgggctggccgtgcgcggggaggacggggagctggagctcaccatcaaggactacccctacgcccacgacgggctcctggtctgggactccatcaggcagtgggcgtccgagtacgtcaacgtctactacaagtccgacgaggccgtggccgccgaccccgagctgagggcgttctgggacgaggtgcgcaacgtggggcacggcgacaagaaggacgagccgtggtggcccgtgctggacacccgcgacagcctggtggagacgctgaccaccatcatgtgggtcacctccggccaccactcggccgtcaacttcgggcagtaccacttcgccggctacttccccaaccggccgaccaccatccggaagaacatgccggtggaggagggcgggccgggcgaggagatggagaagttcctcaagcagccggagacgacgctgctggacatgctgcccacgcagatgcaggccatcaaggtcatgacgacgctggacatcctctcgtcgcactcgcccgacgaggagtacatgggnggagttcgcggagccgtcgtggctggcggagcccatggtgaaggcggcgttcgagaagttcggcggcaggatgaaggagatccgagggttca

SEQ ID NO: 9587 - DNA, 552 bp, Zea mays
  unsure (1)..(552): unsure at all n locations; Clone ID: LIB3279-198-Q1-K6-H1
aatttctcaagaacggtgatgctggtatggtgaagatggttcccactaagcccatggtggtggagaccttttctcagtatcctcctcttggtcgatttgctgtccgtgacatgaggcaaacggtggctgtcggagtcatcaagagtgtggagaagaaggacccaactggagccaaggtgacgaaggctgctgccaagaagaaatgatctatctggctggtgacgaaggctgctgccaagaagaaatgatctatctggctggtgctgtgcttgcttgttggttacctcgtggaagcttaaaatatctcgtcttgttgacatccttgcagttgtcgcgtgaacaagtaatctatgatggcaatgtttgcctggtcatgaagtattattactttcgttgaaaccgtgatgctattaagacttaattttttttatggaacatcgaatgtaaggcatacatggttatgagttttgtacttttnaaaaaaaaaaaaaaaaaaaaaaaannaaaaaaaanananaaaaaaaaaannnnnnnnnnnaaaaanannnnnna

SEQ ID NO: 9588 - DNA, 646 bp, Zea mays
  Clone ID: LIB3279-198-Q1-K6-H10
tatgggatgcattacagtacatgggatgcatgatccatgaaccatgatacatagactaatagtatactcagttactttttagataggcatgagtacttgtgttcatgatttaaccgtttcttgcattttatattatgagctttgcaggttagccagattaaggataaaatctctgcgaaaggacaacacattgcagatttgcagaagaaagctcagaaattagaggatgaactggctgctgcacggaaagtctcttcagaacgacaattagctgttacagacaattataaatgcagctgtacaaacattttcttcaactccaagactacaacgatagggtcaaaacagctgaacataggctgcagtctcttgttgacgctgccatggccgagcttgacatggccgaagatgctactaccagagatggctcgatgtatgagaacggcgtggtttgaacaccgaaagggggctgccagctgtcatgtagtcatgtctgcttgtgaggtttactaatttgttagatttgtagtttggatttgccatgtataatagaactgtactgtaactagaaacgggaaatgttgtgtaaggatcagagtatgaatgggtgcacacaagcacatttggtatgggttgtttttttttc

SEQ ID NO: 9589 - DNA, 593 bp, Zea mays
  unsure (1)..(593): unsure at all n locations; Clone ID: LIB3279-198-Q1-K6-H2
ccgctctccaccagcctgagtcccgttctccgccagccccgttcggctgctactgcngcagcagctttcatccatccaggcatccggcgataagcagttgcatattctcagaacagtggccttgactatcagctcaacagggcaacaggcctgagcggctgccttggctggggactggggtgaccgtgacctacagaggagcaggaggagcggtcgctggcgaagacagagagagagctcgagcgagagagaaccaagggcaaatgaggaactccagctccggtccagcagattacgagcggcgttaagggcttaaggcaagtgtgtgagtgtgtctcagtcccatatctgaaagagtgcaacgttgatgaacaaaggtgaaaacggccatattggtagtctcatttttgcaataagctcatcaaaaagatgcttcttcctcgtaagcttctcccatggcggcgctccgctcaggacgcccaggccctggcaggccgcctcctgcgctcctcttcatcctcctttgaccccgaagacgacgaccctccgttcacgcgggttcctaagctcccacctcgggcgccatcgacgcc

SEQ ID NO: 9590 - DNA, 646 bp, Zea mays
  Clone ID: LIB3279-198-Q1-K6-H3
caaatcgaccgagcgaattcaccacagcttctcaccaccgctaccttcgatggcacccaaggcggacaagaagccggcggcgaagaagcctgcagaggaggagcccgcgacagagaaggcggagaaggctccggcggggaagaagcccaaggccgagaagcgcctcccggcgggcaagtccgccggtaaggagggcggcgagggcaagaaggggaaaaagaaagcgaagaagtccgtggagacctacaagatctacatcttcaaggtgctgaagcaggtgcaccccgacatcggcatctcgtccaaggccatgtccatcatgaactccttcatcaacgacatcttcgagaagctcgcggccgagtccgccaagctggcgcgctataacaagaagcccaccgtcacctcccgcgagatccagacctcggtgcgcctcgtcctccccggtgagcttgccaagcacgccgtctccgagggcaccaaggccgtcaccaagttcacttcttcttaggctcatagtactaggctgggtggtgttggtagacgtggctcaatttatctggtaggggtagtgatggatgatatgatctgcgtctatttgagctgttaagactgatgaacattgttccacgtcacgttgtggttt

SEQ ID NO: 9591 - DNA, 664 bp, Zea mays
  unsure (1)..(664): unsure at all n locations; Clone ID: LIB3279-198-Q1-K6-H4
nganatcccttggtataatttgttatcttgaaataacaaggttgatgttcctgaggccttctctccaagagagattacttgaattgtcaatctctagcaagtctactgatgatagtctttcattgggttgtgagacaccacgtgaaagcatctttgatccatttgctccaggacctgaggaggcagcctgtgcaccaaagaagaaagtgactagaggtgctcaagttccacctcgcaggaagctaaattttgattcaggtgactacccagttaaaaggttaagtttcgattgcagtgattctgaagaggaggatcaatatatcgaagtgattcacaagatgatcctggatctattaattctagatgtccctcttggtggacaaaaagaaactggaaagaatgcgacagatttgggcctacatggaagctgcaagacacctgattcaaagcctctacttactggcattgcatccacatgcccagatgcacctttgaggccatctcttaaagcgttaaagctgagcccaggcatttgtcgaaagattgactttgacttcgatgcagtcagtggctcaggaagtctaagttcttccatggataaagaaagtaattgatcgttctgcccttcttgattgacaatgacaagtaatgaactgtgcatttt

SEQ ID NO: 9592 - DNA, 396 bp, Zea mays
  unsure (1)..(396): unsure at all n locations; Clone ID: LIB3279-198-Q1-K6-H5
cttgtttcngagttcattccagaagttattggtaaagagattgagaagtctacctccagcatcttcccacttcaaaacgtcttcatccgcaaggtgaagatactcaaggcccccaaattcgatcttgggaaactcatggaggttcatggcgactacaaagaggatgttggtgtgaagcttgagaggcctgtcgagggagatgaggctgggcaggaggttgctgctgccgagtagtttgtttgctacttctgtatctaggcgagtctggacatgaggttgcttatgacgtgaacttattgagttgtcttggctacgtgttttcatctggccctaagattttgtcttgaaacaagtttaaaattaagattactcgtggcgatcttctgtgttcgnnan

SEQ ID NO: 9593 - DNA, 648 bp, Zea mays
  unsure (1)..(648): unsure at all n locations; Clone ID: LIB3279-198-Q1-K6-H6
gtgatattttntctggaaaatggcaaaagaaattcactgtgttcccactacataaacattctctatactgacactggtccatgctccatttagattactttcattgtattctatttcctccattctaaattataagatattttgacttttctagatatatagcttttgttatgcacttagatatacaccatgtctaaatacataacaaaagcgatgtatctaggaaaaggcaaaacgtgagggagtattatggtggagctatactttttgtagagtttagagattatactatgaggttttataatcccatttaaaattcaaagccatgatatgattctttggtgtttggaaatttgtgcagtataactgatttaaatgtgttgtttagttgctagatcaccttttcatagagtgtaagcaccatggcaaggatctggtcgctgaaggagtgataacctcaaaagatatagaaggaacaaaggcaggcaaagccagcactggggtacttaatgttgggttaccagcatatgttatccttaaggctctcctccgatctgctaaagccaattctgatggtctcgttctaagtaatggatctgagataacatccgacaataggcctacgagtaaaatttttgagtggttttt

SEQ ID NO: 9594 - DNA, 636 bp, Zea mays
  unsure (1)..(636): unsure at all n locations; Clone ID: LIB3279-198-Q1-K6-H7
ngcacaaccaccaccaccgccgcctggccgtaacgtcacacgctcgcctccttcctggcgcccaggaacgctgtccccgccgccagcgccgtggccaacggcatggtgatggagccgaggttccgcggcgtccggaagcgcccgtggggcaggttcgcggcggagatccgggacccggccaggaaggcgcgcgtgtggctcggcaccttcgacaccgccgaggccgcggcgcgcgcctacgacgccgccgcgctccacttccgcgggcccaaggccaagaccaacttccccgtcgcgttcgccgcgcttccgccgccgccgcccaagaagccggccgccgtgaccgtgagccccagcagcagcagcaccgtggagtcctcctcctcctcctcccgggactcgcccgccacgccgcccagggccgcgtctccgtcccagcaggccccgtcgctcgacctcagcctcggcggcacgccggccatggtggccgcccagccgttcctcttcctggacccgaggctcgcggtgaccgtggccgtgccggcgcccgccggtgccaacaagcatgctgcagcatcctgccgtgaagaggagcgagcgacaccgggtcgtcgtcatccgtggtggacgcctccc

SEQ ID NO: 9595 - DNA, 536 bp, Zea mays
  Clone ID: LIB3279-198-Q1-K6-H9
aaaaaacccccatttcttcgaggcgaggagagcgtgaaagacagggcaccggcagcgacgatgtcggggcgcggcaagggcggcaaaggtctgggcaagggcggagcaaagcgccaccgtaaggtgctccgtgacaacatccagggcatcaccaagcccgcgatccgtaggctggctcggaggggcggcgtgaagcgcatttcggggcttatctacgaggagacccgcggcgtcctcaagatcttcctcgagaacgtcatccgcgacgccgtcacctacaccgagcacgcacgccgcaagactgttaccgccatggacgtcgtctacgcgctcaagcgccagggccgaaccctctacggcttcggaggctaggctggatgcctcttctccttgctgtcgtggatgcctgtttgttgttagggttatttcgtttagttccttgtctgtgacgtgttggactattgttagtagtattcttgaagttgtttcgaatgtaatccaatcttatcgttcgataattgaaatgattcctgggc

SEQ ID NO: 9596 - DNA, 414 bp, Zea mays
  Clone ID: LIB3279-198-Q1-N6-A10
cagaaaggggatttgaattagacaggaagaattacagtgcaccccaattgaaaataaattgagagatcaaattagaggcaacgcctcgttggagaaaagtctaacatgccaacattcctactttaccgtccaatccaatcccatcgaaccagcggttcttacagacccaaagaagcacgacttccggacgacaaagcaaccagcttccacaactggttcaatacgaacacaggaagggagccaaactagtaccacagatcccagacacctggacaggcaattacccacacctaacctagccgccgaagccatagagagtgcggccctggcgtttgagggcgtacacaacgtccatagcggtgacggttttgcgacaggcgtgctccgtgtaggtcacagcgtcgcggatgacat

SEQ ID NO: 9597 - DNA, 471 bp, Zea mays
  Clone ID: LIB3279-198-Q1-N6-A11
ttggtttttttttttttttttttttttttttttttttttttttttttttttttttttttttttttttttagaacaacccacattcaagttgacccttcaggctccagcaataatttttgaacaccccacttttgtacattacatattgggagaactcgcaacattttgtcctttttttgtaagggcacaggaaacaggggtacccgaatttggaagtcagttgtggtaaacgacaaggattggggaaatgctaaaatggacacagcacttaattgagcatgagttttgccaatccagccaagcgctaatttgcattaactgggccgggggagttcctcctcctcagctgcaattttggcccaagttgcttaaggaaaatcttggtaggatcgtttgggtcaacatacccatgacgcatcatgttatcaacaggagtttgcacagcttgcaaagggtccacacgaggggcca

SEQ ID NO: 9598 - DNA, 576 bp, Zea mays
  Clone ID: LIB3279-198-Q1-N6-A12
aaaccacccctaatacacgtacattaacatgaatacgtgaaaattcaaacaacatctaaaacatcttacccaagatgctgtaaatttcatcagtatatcataaatagccttccgctaaaaggaggacgaagcagaagcgtgtacaggtacaatgtcggtgtcatgacatggtgctgctagcgcaactgcatgtatcactggccatgccattcctgttgcggatcaatggttcgtgtccaacggaaatgctgatcgcctgagtgtgatctgattctgatcctatccaaatagccacgcgatcttgtcgagcacccagtcgacagcctctgcgagcccgccgccgacgctcatgtcggtctccggatcaaacgggaacgccggcgccggcgcggtggcttccagcagccgctccatgggcatctccggcgcggaccgctctaggggcttgaggggccgaccgtaccggtccgcatcagggcagtaatccaggtcggcgtgcattttccggacgaatgtccggaagatccggaagttgttgctcgccaggagctcgtccgagagccggaggaacgtcac

SEQ ID NO: 9599 - DNA, 607 bp, Zea mays
  unsure (1)..(607): unsure at all n locations; Clone ID: LIB3279-198-Q1-N6-A2
ggctctatctgccagatttattatatcatagctcacagaaaaatgtcatcagcactttaaggatccaattgacaagataatttctcggggtaaaagatccaatctagtactacaagatatatataaaaaagacatgcgacaccagtacaacatccgtgcaggttgtcacagtctcaggaattgcatatgtttttgaactgactcctccgagagcaagagcgcaaacgccacaggtgcagtcatgggagcagcagtatcttgccgatgtgggtgctagcttccatcaacctatgagcctcagcagcttcacataacggaaacgtcttgtaaatcaccggcttcactttgccagcagcgacagcaggccacacgttcttttccacctcactaacaatctctgccttattagcaaggcttctgttgcgcagtccagcagcttgtatggtcaaacggcgtgcaagcacagcttgcaggttcacttcagctgctatgcccccttggaagccaatgatgaaaagtctaccatcaacacctaagctattcaggttgcgctggagatatgatcctncaatgttatccagaatcacatcaacaccctttccgttgg

SEQ ID NO: 9600 - DNA, 534 bp, Zea mays
  unsure (1)..(534): unsure at all n locations; Clone ID: LIB3279-198-Q1-N6-A3
ataatcagccatgtcaacattatatatggtacgcgtcaatttcccactggtgcaaccagccagtggggcaactggtgcaacgcgtcaattacaacaagagaataatagccgacttagcggacaaacggtcgggtttattaaaattaacctaacacgaggtagggtctataaaattccaacaacacactgcttttcatctggagccccactaagttcttaaggaagcctagaaatatatacatgctgcctggctatcatcatcctcatcccccatgggaacaactgattcgaacccttatgatttttgtcctacggtatacagatatgctctgccatatgctactcaactaagtatgctcctgctatattttgttcgacccaatcacacatagacatagtcatgcacgtcagttctgctccgtgtatttagcttgatatgtagagtatcaaattccgctattgatcataaaaagctagtcttcggttttggggttgctgactgaagtcgtcatcgntatcatcatctgtctgact

SEQ ID NO: 9601 - DNA, 330 bp, Zea mays
  Clone ID: LIB3279-198-Q1-N6-A4
atccaagatgagttaagaatatgaacgggcatttttttcaggcctaaatataaatccgttctcttgccatggtatttagcccccacaagcgacgcttgaataagtcttgcaaattcaacacaggttctaccaaaggggctttggctaaggaaccactgcaatgtcaaaaaaccacactaagttttttaagcgcttcccaccaccgccgcccaacttggggcccttggaacccttctggaccgcaccctttgtctgcgtcttttgggacttgctcacctccgcctttttggctttcttctcatccttgggcttcttgatgccctccttgat

SEQ ID NO: 9602 - DNA, 532 bp, Zea mays
  Clone ID: LIB3279-198-Q1-N6-A5
ggcatgaaacagtgaataatgttaattatatgttcataggattggttagcacccgctgcctcttctacagtaaagattatgctattacaagaaaaacaatagcaatccctagggacacatgctaacgacaaaaatgcagactataccaatctcaaatttgttctcaagtgatcatctcgtcgacggcatctgtctgaaggggggctaaacaatggcagtacaaagggttttgtgatgcctttgacctcgtatcgacaaacctgctgattaacaggctcgtcagatcgccatcgaagattactctacttgtcagtagtaggttgttccataataaggttgaagagctgccccaagttgctgagggtaagctgacgccggtgtaggtgctggtaccactgctggcactggtgctgccggaattgctgcaagttgtgtgtagctttgttgtgtataggcctgaacagagtatgttggaggataagcgccataggcagctgtttgaggagcaggctgtggcatttgatggctgtag

SEQ ID NO: 9603 - DNA, 547 bp, Zea mays
  Clone ID: LIB3279-198-Q1-N6-A6
aattgatcacccggtttccataccaaaaacaataattgtgtggtatgtggttaggccatagtattgatacatgttgcactactcgacagtcactagaaatagcacttaattagaaccaaaaatcgagcacaaataccaagctagcctattagtagtcgactactactagtgagccaaccaatccaagaggaagaacaaatcctcagctcactgagagacaactcaaagcacataatgcgatagattacgtcctcctactcgttggcattgcatgaggatcctgaacactgacgtctctttcagtcgctaggggctgactcaagtaggacgtcaccaggatgtaattccactagttggtcgactcatttgagtactcccataggcacgacgcctactaccataacctcaagccgcaaaacatcctcgtcgatgagctcgacaaactaaatgtgtctgatttcagacttagcaccctataggagtggcagaaacacgataggttgttgcacaccacctgccgattatgcccgaaagagcaatgacaaac

SEQ ID NO: 9604 - DNA, 593 bp, Zea mays
  unsure (1)..(593): unsure at all n locations; Clone ID: LIB3279-198-Q1-N6-A7
gatcaaaattttcctcaattgccattaaaggcgccaacagagtacattgttcttccattcagagatcagttcacacacacgcacagagacagagaggggggagctttattttgtttcggtctacacaatggtactcagccactgtaacagttcagtcacggtactcagccatgaacgcctcatggaaagccttgaagcgggtgatcaccgcggggattttgtcttcctgcggcaggatcgtgcatctgacgtgccatgttccaggaacttggccaaatccagatccaggaaccacaacaattccagttgattcaaggagacggagcgcatagaatgcatcaggtgctttcttggcagctttagcagcctcaattgccttatgtggcagatggatctgagggaaaaggtacattgctccttcagccttgttacatgaaaatccctcaagcgtgttgaatgcatcttccagtgcctttgcacggcgagctaaagactgaaggattccatctttctctgccttgtaggaagcatatgattcgtccccaacctttngtggattcatgacgaggctcgcaaggatttgaccagtgata

SEQ ID NO: 9605 - DNA, 580 bp, Zea mays
  unsure (1)..(580): unsure at all n locations; Clone ID: LIB3279-198-Q1-N6-A8
caagaatgtttcttctttccactctcggcaggaaaccgatcaaccatcgaacaattgtaagttagtgacatttcatcttaggaatgctacgctacacgaatttctcgagcgacctaccgatatacaggatacaaacaaggaacaatacatggagcaaaaaccttgcggctgtcaactggtatcgttagcgcggggacccaatccaatccaatccaacatcagctacaaagacgacgacgagccgccggaagtcagaagttcagcaaccgcttcatcgaccaaggaacccagcagctccgccgccacgtctccgccggcctggtacgcttcagtcctgaaatcgacccagctccccataggaccactcatctccctgtacacgagctcgtccaccatccactcctcggcgaccgtcaggctcgtcatctcccgatgcatttctgccgccgacaggctctgcagaaccgccatccccgtgaaccataagctgtagccggcgctgaagtagtgcgcgtatttcacgctcagcgattcattgacgcagtcgaagagcagcctncgcctcagtctgtgacctttg

SEQ ID NO: 9606 - DNA, 466 bp, Zea mays
  Clone ID: LIB3279-198-Q1-N6-A9
attgcacgatcaatctctcatgcacaagctactaggtatatattcttcttatcaaatcattgattttttttccttttcaatatagcatgtaatctagaaaatgcatggcaagtaaaagagtagtgattatttcacaaagttgagccaattaaagacttaattccaggcacaactacagataacgatagagtaacaattgctcacccatatggcatcatttatttgggaaagttaaacatggtaggatagagttccaaaactatttggttttaagagactcgccggccttggcaagctcctccagctttttatcaatctgtgcttccgtcaggccatccaagttcacgcatctctccacacccatatcgtagcgcgcccagagctggggctggacaccggagcactcgcggacaaggaaggggagggaggggttgcgagccttgatgtcaccatagttcttcttcac

SEQ ID NO: 9607 - DNA, 600 bp, Zea mays
  unsure (1)..(600): unsure at all n locations; Clone ID: LIB3279-198-Q1-N6-B1
cagatatcgaccacaaagataccatggtttcaaatattttcttcgacatacaagttgtttcgcagcttatcactagagttttctatggctactagtattattattgccgatcaatctttgtcccatttattggcatcttgggcgtagcgcgtgggatacgatacgatcaatacgaccgtgagggtacggccgaccgagaagagctcttcctcctcctccttcaatcagacggcgacgtggaccggcgccgaatcttcaggtacccaaacttgccggcgccgggagacgagccgtcgaaaacagtcgggaggtacccagtcgccgctttgtacctcttctggatctcgaggatctcctcgctgcttttcaggcagttcttccccatcacgcagaccgagccgccggacccaccgccggtgatcttcgcgccgaacaggctgnggcctccggcgcgcgagctcttcctgtgccggatttcttgaactagattcactagcctgtctgtgccgtcagagccgagcccgcaagcgttgtagctgtagtggcactggaacatcagctctccaagggctgagagctgctcgtctgttttggcagctg

SEQ ID NO: 9608 - DNA, 289 bp, Zea mays
  Clone ID: LIB3279-198-Q1-N6-B11
acagcgcagagcagtgtgaagtcggattaaaaacaaaagaaaacagaagaacaagagaaaggacaacacaccacaccacaccacagacggacagcgtccaaggttggtttggtcggttgttcgctcatcagattacagatccctcgtctctcagcctccctttccacgcaacaaaaaaaaccctaatccacagctggctcagagttcagacgacacgattcgccggcggtggggtgggcgaaaggctggagcggttggtggtgggtgggtgggtcaagactcaagagca

SEQ ID NO: 9609 - DNA, 569 bp, Zea mays
  Clone ID: LIB3279-198-Q1-N6-B12
ttttttttttttttttttttttttttttttttttttttttttttttttttttttttttttttttttttttttttttttttttttttttttttttttttttttttttttttttttttttttttttttccccaaaaaaaaaaaaaaaaaaaaccgtgtaaaaaaaaaatagggggccccccaaaaaaaaaaaaaaaaaaaccccccccggggcccttttttaaaaaaaaaaaaactatttccaccccttggggaaaaagggggaaaaaacccaaaaaaaaaaaaaaaaattttcctaaaaaaaaaaaatttttttttttaaaaaaaaaaaaaaaccccccccccccccttttaaaaaaaactcccttccccccccctggaaggggggccgccccaaaaaaaatttaaaaaagggggggggggggcttttccccttttgggaaaaaaaaccccccccccccccctttttccgggaaaaaaaaaaaggggggggaacacttttaaaagaagggggggaaaaacaggaggaaggggccccccccccgggcggggggacaaaaccctttgaaccc

SEQ ID NO: 9610 - DNA, 478 bp, Zea mays
  Clone ID: LIB3279-198-Q1-N6-B2
ggagaaaaactgggattcttcgcaggtatgatcacaacagcatgtttgtctccaattcactcttgttttcaatcatgtataccaatcatgtcacaattcccatgcacataaacagaaattggttgaattggagtgctatctaaacagagataatcacatttcagcatgttgacataacagccatacacatgcctggctacaatgctgaattgcaaaaggcagagtacctcctacatggttggctacatgcgcgtgcaggaggtgtcgaagtcgtcgggcgcaaccctcgcgatccactcagcaaggctcctcttgacctcgccgtggttgacgaaggcgagctcgtacatgctgcacaggttgaccaccaccgtctcgttgagcgccgccgtggggaccctttcgagggcacccttcagcaccttgatggcgtcgccgaggtcccgcgagtacatgaggcacagcgccttgttgttga

SEQ ID NO: 9611 - DNA, 201 bp, Zea mays
  Clone ID: LIB3279-198-Q1-N6-B3
aagagacctgtattttctttatatcattctttgaaaaagtaaccaattaactgcacagttcatgttcactacagaaacaacgcgcagcgttgccgcaagaccacaatcgttgcaagagtatcttaccgggccccatcagggacagaatccaaccatcacaactcattcgtacaagatgctccgctatgccccacgcgtccg

SEQ ID NO: 9612 - DNA, 291 bp, Zea mays
  Clone ID: LIB3279-198-Q1-N6-B4
ggggaacaacctttcaatttcattggacaaaaatagctgcgaacaaaaaccttgctcattcttttctcgtctcgtttcatagcgggggccacccaaggggacaacaggggttccaacccctaatccaaaggttgaacgggcacttacacggggaccgaagcgaacggtaaccccattcttttgatagataagataactcggcccaagccaggatgggcccacacattagtcccttcagccgccgccgccgccgccgtaaccgccaccaccacccttgcgccgaccgccgtt

SEQ ID NO: 9613 - DNA, 407 bp, Zea mays
  Clone ID: LIB3279-198-Q1-N6-B5
ggaaaaatctaggggaacgcttttaaccgagcagatcccccgcattcgggatacaccaaatccaatgggccggttaccggggggaataaacacaagcaaatagagcttgaaacacgaaatcacttgaacatttatgaccagaaaattgttgcagtcacaaaacaaattcccttgggattaaattataaacaaagcactgttacatgagggtaagcaaatttcatagccaaaaaagtaagcgcagccaatgcaaaccaatgttcaatttttttgggagcatggaagcatgaacatgggtacatcaggttttctcgtcttctgttttggctgacttggcttcccttttctcttggtctccctggctgggcaatgatgccagcaaatctttaacagatgggtcattggga

SEQ ID NO: 9614 - DNA, 499 bp, Zea mays
  unsure (1)..(499): unsure at all n locations; Clone ID: LIB3279-198-Q1-N6-B6
aggtgttggggtcgtcaaggctgaagcccgaggtgagcagcgccgtctcgaacagaagcatgacaaggtccttgacagacttgtcgttcttgtcggcctccgcgcgcttgcgcagctcctccatgatggcgttgtccgggttgatctccatgggcgggttggaggacatgtacccagacatgctcgagtccctgagcgcctgtgccttcatgatcctctccatgttggccgtncagccgtactcgcccgtcaccaggcagcagggggagtccaccacgcggtcagagaccacaaccttcttcaccttgtcgcccagcacctccttgatcaccttgcacaggccctcgaacttctccttaagctcctccttccgcttcttctcattctcactctcatcgagcttcaggccctccttggtggccgagacgagcttcttgccctcgaactccttgagctggccaatagcatactcgttgatggcgtccaccatgtacaggac

SEQ ID NO: 9615 - DNA, 317 bp, Zea mays
  Clone ID: LIB3279-198-Q1-N6-B7
accacatggtagtagtttctgtttcatggaaaaaacacaaatgacatgaagagcttctcaaggacttaagatgtcagagcatccaacacggtatcctacattagacgaacaatagattacatggtcatatatatatgctacaatttccacattgtcttgttggaacgactggccaacctagactgcgatgtcatgctggatgtgccggagtaagacaggggttacgatgtctggagagctaagctggggaagatggccttcagagggcatcacctccacgatggagtcgccaccaaggtgcctgtgcaggtactcag

SEQ ID NO: 9616 - DNA, 393 bp, Zea mays
  Clone ID: LIB3279-198-Q1-N6-B8
ccttggggtttaacttaaaaaaaagcctggggggggggggggggcccattgatccccaatccatgctgggtgatgcatgggtttggtggggcccagggtgaaaacaggattaaaaactggcaaagagggacctttaataaaaaaaacaagggggggacaacaaacccgagaggaacgaagataaaccctttggactaggggaaaaaaaacggggggaaaaaagaaaacttgggcgggggggccccaccgttaaatttctccaattcccctgggagttgccgaaaccccccccccgggtgccaccgccgtaacccgcgccaccaccaccggaggcggcggcgccaccaccgtaggccccgccacccccgtaaccgccgccgccataaaggggcc

SEQ ID NO: 9617 - DNA, 265 bp, Zea mays
  Clone ID: LIB3279-198-Q1-N6-B9
cccaaaaatgctagcaagtaaatcataaattatccacccaactggtaacaaaacggagaggcttatcattctaactacggcactcactgatcactcccatgacatagcataactttcaaagttttttttgatgggccttccaattttttttattcaaccatttttggctttggcttaaatttttttaatttgcaattttggaaaacttccaccagaaccattccggttcccaaaaaatttattggaaaaacaagggttcttaaaa

SEQ ID NO: 9618 - DNA, 525 bp, Zea mays
  Clone ID: LIB3279-198-Q1-N6-C1
gtggcacggtggatgatttcatagtagaataacagggaatactggaaaagcaagcatacataggaagcagagagctccctgatttgacctttgaagggcacaagaacagatctgacggatcacatcacagacatacaaatacacacgtctcaagaacacgtggaaactacactaacatttgacgacttttgataattccgagcaactatttcagccttcaacatggcctcccagctagctcagatttcttgcgtgggtgcaggcaaagaccaagcttatttgttctgacctgtctgctctatggttcttggagctattccaacagcatcagagcccctcatgattttgagcttccgacagatagaggtaaaataatcccagggaagatcaccgacaagcatccagtctgcatccttatcctcatatgtaagtacatactcctgatctttgagggcatccaccttcgagccattagttagcctgtctttgctcgatgatttatgcaggacactttgaccagcgatg

SEQ ID NO: 9619 - DNA, 579 bp, Zea mays
  unsure (1)..(579): unsure at all n locations; Clone ID: LIB3279-198-Q1-N6-C10
atagggcgggcggtaggtggcccgttttataaggttctccagtggttcacaattctattcttggcagacaacagcccacatgttgttttcagctttcagctgatacaacgtggtgggcaggcaagtgaggatcataaagcagatggctctccataatcccatgcaggttcatttgttcgcgatccaactacgtataaagactctgatcgaaccgagccaagccgaataagaccatactagtagaaaggcaacacaggtagctatatacaactctattcttggaactggaattctgggtaccggagcttaaccacgggagcattcaggcaccgactcgtagatagacaggatgagagcagagcgcctagtcggctgccctgaagagggtcatcagggacaggaagaggttgataacgtccaggtacagggagactgcggcccagacgtactggtcgtacgtgtagcgcctgatgatgttgtttgtgtcgtagacgatgtacccgctgaagatgagcgacgccagcccgccgtagatcatctgggagagcttgcccagtgggaacaggatcntgatgagtg

SEQ ID NO: 9620 - DNA, 275 bp, Zea mays
  Clone ID: LIB3279-198-Q1-N6-C11
gggcgctgccatcaagctcgcgctcttctgacggagcacggccgggtcgtctcaggggagagacagtgcatgcaggctacgttcttggcggttcatagttttccgctggcgattgttcgccgcgcagttcatgtatgtagtgtatgcatgtgtgtatgctactctgcggtggcgagtgctttttctgatgcctctgtcgttgtgtgttcatcaccgtcgtgtgcgattgttctttgggatgtctttgcctcaataaaactgcttcattctccagt

SEQ ID NO: 9621 - DNA, 571 bp, Zea mays
  Clone ID: LIB3279-198-Q1-N6-C12
ggcaataaaaaaaatcttttgacgccaacagcaatagccacatgagttcataacaccagaacagaagaactagccaattatcaaaaagattcagataagtttgccagctcgtttgaactgctgaaggtacaaaaattctctctagtaaccgcccttgagatcgttgaccacatcataaggaataggagtgactgtctcgagtgtagcaccctcaaccatgaagccaggtttgggtcccacaggctgcctcttggtgctgatcacctcaccgcgggccttggcatccgccttgagctggtcattcttggctttcctcaagcggaactcctccgtgcaacgggagggctgcacatgctccacgcggacatggatccgcttcctgatgatgcggccattaacctgcttgttgatctcgacgccgatggcgcgcttggtgacgttccagacgctcccggtgcggccgtggtagaacttgtgcggcatgcccttgtgcacggcgccgttaaccttgacgtcgacgtagtcgccgatcttgtaggtgcgcaggtacgtggtgagtgggatgtacccc

SEQ ID NO: 9622 - DNA, 340 bp, Zea mays
  Clone ID: LIB3279-198-Q1-N6-C3
aagggacacaagtgcagagctggtggtggtccatacaatagtttgatacaaaagttcatggttcatcacaccccgggcacaagattttttaagggtcatggggcaaaactgttgctgctccatacaatagtttgatacaaaagctcatggttcattccacccagcccacaagattttttaaggtttatgggacaaaactggtggtgctctttacaatggatttaaaggttacaaacattttgccaagggttaaaccccctaacttgggggagactcgcagttaaaggtcaccattatcttttatgacatcgggatcacttttagcattttttttcttaaa

SEQ ID NO: 9623 - DNA, 548 bp, Zea mays
  Clone ID: LIB3279-198-Q1-N6-C4
cgccgccgccgctgccaacgccgcctgctgccgcagccgccatgggggcgtacaagtatgtgtcggaactatggaggaggaagcagtcggacgtgatgcgcttcgtgcagcgcgtgcgctgctgggagtacaggcagcagccgtccatcgtccgcctcaccaggcccacccgccccgacaaggcccgtcgtctcggctacaaggccaagcagggatatgttgtctaccgtgtccgtgtgaagcgtggtggcaggaagaggcctgtgcccaagggtattgtctatggcaagcccaagcaccagggtatcacccagctcaagttccagaggaacaagaggtctgtcgctgaggagagagctggacgtaagcttggtggactgagggttcttaactcctactgggtgaatgaggatagtacctacaagtactttgagatcatccttgtggacgttgcccacaaagccatcaaaaccgacccgaggatcaactggctatgcaaccctgtgcacaagcaccgtgagctccgtggcctcacctcagcaggcaag

SEQ ID NO: 9624 - DNA, 235 bp, Zea mays
  Clone ID: LIB3279-198-Q1-N6-C5
acctccaaaaccagagcaaaagcactcgcagtcttgcaaatagtatgcgtggtggcaagctggcctccaaaaccaacacgttatgtgttcgcatcacgtgataaattgtcagtccaaaccaaagcaacataatttacgttggtgtttaaaagaagtggtcatccccctatcccagccctctagatgtccatgggtgcagcagcgtcatccgagcccctcttcccctcctcctgca

SEQ ID NO: 9625 - DNA, 540 bp, Zea mays
  Clone ID: LIB3279-198-Q1-N6-C6
tgataaacgagttccatattacgacattattatggtttgcatattgtcaaaactcaaaacacaagacaatggtaatcaggcaggttgcgatacacacaagtaacagcataatcaaagatttacaggctatgatctgctcagcagagtgagccgagattggccgttagctcaaccagttgggagcatacagcagtcgatgcaaattgttccaagcaccgtgctttcaagaaataccagccaaggtcggcttggttcaaaagagcaacagaccatttcatgagcccaggcctgacatcaatgacgtccttgacgttcaaggtggatagagttgtagcaacaacgaactgcaagttgcaacacccaagcagtctagacaagttcaagcacaaaaagagcaggtataaacattcgtacctccctgacaaatggtgaccaatcatgagaaagggaactgcatggctgggtccaaatagttggctggatcatctgttgcgaggactccattattgggaggaaaaacatcgaaaatgctaggcattg

SEQ ID NO: 9626 - DNA, 511 bp, Zea mays
  Clone ID: LIB3279-198-Q1-N6-C7
aaatctaaaaaattgctattaaatctgtacagctgcactgttttacccatgcagagttgaacatatgggaaaacacggccaatttgtggaggtttcaaagtttgaaatgcgctctagcctgttctaggcccaatcaggtcaagccagatttttcacctctttggttgtaaaagacattctggcaggccaaaaattttctatagcacagttggacaaaattctggtgtccaaaacagctggtcccaatttggcttccacgagcaaaacaaaggacattttggtgtgccctgctggggtgagaactgaacagcacctaaatcaagtggatgcaaatggatggtgctccgcgtcaggtgagattgttactggagtttctgcaacttctgtatatctgattctacatcaaccggaattttgagcaagtcctgcagtttggaggctcctgcagtaatgtcattgatttctaggaatcttccgctcggtgatgcaaacagaacctcatttatgtctt

SEQ ID NO: 9627 - DNA, 572 bp, Zea mays
  Clone ID: LIB3279-198-Q1-N6-C8
aaaatttcagcattacttttattctttcatgtctcaacgaatacctcctgttagattcaatcgttcaagacggctataacagtatacatcctcaagaggtataacatccgaagccgccaacaaatttcaacttttttatatagaaacctattgtgtatccctttgaccttttgagctctacagacaaaatctgaaccgtcgacgtaagattggccacaatggtcacgctaaaagaatggcaatgaatctgtatcgagaaatgtgaggctgctgttcagctcacactgtgtggttactcgaatccagtagcctgtccccttcggaaggcatgtcagatgacatctccaagttttgtttggccgtcatcttgttccactcgttctcgacccggaagaacacccactgccaccgtctcaggatttccagagctgctatggtgaacactgtcaggtagttgtgccggagatgcgccgagagcttgtatgtccatgtgcatcgcagaaccaaagtgctgcccagtacccagtagaatacccagttctgcccgtaaagaagaatagtccatatgcttg

SEQ ID NO: 9628 - DNA, 521 bp, Zea mays
  Clone ID: LIB3279-198-Q1-N6-C9
caaaaataaaaatgcggggacacacatttttacacgcactgtaacacaattcttgacattaacgaacaaatcggccacagctttgcgcgcaaggtccagcagggcggataacactgttagtccagactgtcagcgcatagttaacttaagttttcgaccctagcaataacaccagcaaaggttgcagcaacagtagcaaaagagaaacttgcgatccacaaaacaaaccctactaatatgtccttacaatggccccagattaacaataaccccaggacttcatgtttttgtcacgatgtttgaggtggcgattaggccctctcgccggggatcctccttgccagctgaatgtcctttggcatgatggtcacacgcttagcatggatggcgcacaggttggtgtcctcaaacaggccaacaaggtatgcctcagcagcctcctggagggcaagcaccgcatggctctggaaacgcaaatcatttttgaagtcctgtgcaatttccctgacgagcctttggaa

SEQ ID NO: 9629 - DNA, 441 bp, Zea mays
  Clone ID: LIB3279-198-Q1-N6-D1
gaggggtaacattgatactgtattggctgattcatagcggttcgacatgctcagctagcatagcagggaagcatcaagattcaagagtaccatctagaatacaccaacttcgtccacacaaagccaaacaattcattacatggttttatcataagaataagagtacaggctatcttttagggccccatccatgcttccattattgccatgctttggagctccccaagtttcagcggtacttgatgaaaccaatgtccttggcgttgctgcggaagcactgtctgcagcacatgagcccgtactttcggatcaagccgtgggggttagcgcacacacgggaaaccctagatccagggccgtagttcttggggtgcgagttccacacgttggagtgtcccatggcggcggcggcaggggagcaggcctcacaagtaaaccgga

SEQ ID NO: 9630 - DNA, 595 bp, Zea mays
  Clone ID: LIB3279-198-Q1-N6-D10
gccaccttatggttttttttttcccatagctaagtatctaaaatggccgggcgaccggaaagtagcgaagagacaatgtcgttcaggacatcaaaaacttgacgaacattccaatgttcccccccgaaagactgcctagaccaagctgatttcaacatctagcctgcgtagccgtacccggagatcttccaaaccctgatagacccatcgttgtgaccagtgtacagggtgcttacgtccggacatccaactcaagcttggacaggacaggatctggttcttggagacctgtatgttaagcttgaggtctctgcacaacgtgctttgactcgaggtcccacatcttgacagactcctgcactctagtgcagaaccaggatcggggggatgagaagcactcagagggggtgatggaccccatgtacagtgagtgcagcctactccactgatactgattctacagctagagaaacacgcgtccttcccagacggaggcgcacagagacccgcacgtgctcacagagactgagttaacatagccaccgtgcccatacagagtgcagcgcagctcgcagttggtcaggttccagacctt

SEQ ID NO: 9631 - DNA, 564 bp, Zea mays
  unsure (1)..(564): unsure at all n locations; Clone ID: LIB3279-198-Q1-N6-D12
ggcagcaaataactgaatgtggatcgtagggtcattttttctagcacacattgaacaaaaccctatactagctcctctatggttctgccttctatacacacatatgtattttatatgctgaaaaatgacgtcaggtacaaactgtccgtctatggattgtccctccttggcttgcaaaaactgaagggttgcaacataagggttctggattatttctgtcttggtaactactgaagcatgatgaaaatcactacacatatatgcgtggagatagctaggggacaacagaaggtccatgaatcctcaataccttgtgtacttctaatgccacagtctctacaccaccatggctgatggatcacactatcgagtcagcgatggtggactggttctcaggcgcagctggtctttgcttctgatcctcgccaacgtgcctaggggacgatacggcagacgacgacgacgaggaggaggaggacgacgctaccttgcgcgggcttgacggcatgtgcagcctncgcagctcgctcatggggcttctcgggctcaggagcagcggcggcg

SEQ ID NO: 9632 - DNA, 471 bp, Zea mays
  Clone ID: LIB3279-198-Q1-N6-D2
ctcgacattatttattcagctacagttccagataaatcgcacaaccctcttcagccaaaattatggtaggaaacgatctgccaattacaagggagtaaactgaaacagcaagaaacatggttcatgtgaagaagaaaattgccaagagaaaccacatggttatgaagtaattggactgagactcctgacaggctaataagcgaaggacggttcactgggccggaagctcctgtagatggaggctgcaaccggtacgagacccaaaagtgcgatctggacctgctccgaggtgcttgtcctgaccgtgatctgcccgctcagcttgttgttcagaccaagtcgcactgccatcttcgacccccttccgatggagaactgggactgcaagttcgcgcccagagcaaggtcccggcgccacttcatcagagagagacccaccgttgagagggactggccaatcggatagtcttt

SEQ ID NO: 9633 - DNA, 604 bp, Zea mays
  unsure (1)..(604): unsure at all n locations; Clone ID: LIB3279-198-Q1-N6-D3
gatcatcaaaggataataaaagggaagaaattcaacatacatatcatcggctacggtgtaaccggatcaacatacaacctatccatgtcccaagaaccccatttgctagacagcaacaaccaaaaattttaccccaaccggatgatacaacaacagcgagatcagccacgcagtcggcgggggatcagttcccctgggcgctcactgcctccgctgctcctgtgcctgcccagcagtacctgtaggcagcgtaaacggaggacacgaccaggacgccgaggatcatgtaggtgacgatcgtggccacgctgatttggccggggaccttcttcaccttgctttgcgcgagcaaggccttcggcttgatcttcgccatgttgcgccgcggcctccggaaggacgagagcagaccaagcgcggacggagtagcacccttggagacgagaagccgagaacaaacgaggcctcggacgcctacccgcctatatgaatagtctcngggggagggaccgaaggagagggggaagaagtgatctagatcgangcgtgttggaaagttgggaggaaacaacgaaacgctgttcaaccgcggtgcgagctggaa

SEQ ID NO: 9634 - DNA, 415 bp, Zea mays
  Clone ID: LIB3279-198-Q1-N6-D4
tgataaccgagaacttcattgccattgcatagtcatagttaaattacagcagtgaagacccaactacataatgattcgaccaataacccaaactacataaaccggcacatctctacaacttctagccagacagggatgacagaaactgcgactactacttccacctccaccgcgacgacgcctaggccctctccccacggatgcggcgggcgagctggatgtccttgggcatgatggtgacgcgcttggcgtgaatggcgcagaggttggtgtcctcgaagagcccgacaaggtaggcctcggacgcctcctgcagcgcggcgacggcggagctctggaagcgaaggtcggtcttgaaatcctgggcgatctcacgcaccaggcgctggaacggcagcttgcggatcagcagctc

SEQ ID NO: 9635 - DNA, 247 bp, Zea mays
  unsure (1)..(247): unsure at all n locations; Clone ID: LIB3279-198-Q1-N6-D5
tntttntttttttttttttttttttttgggtnntttttttttttttaatcaaatcgaaaagatttacccccgttaggcccgtttaagaaacccacccacccattggaattaccttccttacccggttgtgttggcttaaccggcggccactttttaaacctttttttgggcccggccccggaaaatgggattttgattttccattccttttaaaaggcaaccgacaagttgattggcattgacttgt

SEQ ID NO: 9636 - DNA, 592 bp, Zea mays
  Clone ID: LIB3279-198-Q1-N6-D6
acggttgataaaataaaacccacttcgatgaaaaaggaaggatccgagtacagtacagagttcctacactccgggtatgaaaactctcctcatgacaagtacagtgttcaccgaagagcgaagtacccctctcactcaaacataactgacttcctcacagacgactggaactaaacacaaacacacagatagggacactcatcaccacagatcgatcgatcgccaccaactttattctaacaacacggcagcagctgctgaccacaggtggctatgccttcaaagctccagatcatggtgatgaccagtgcagccacagaacagcacatttaccaggggacgatcttccagcgctggttgtcgccctcgcaccacttccagagcacgatgttggtgccgtcgcgcacgccgccgtggtccttgtcgccgtggaaggcgtcgaagttgaggtagatgttgttgaccatgcggacgcagcggaagccgtggccgacgtcgcggctctccgtccacagcaccgactcgtcctggtagccggggttgtagggcaccagcttgaccgggtggccctcgccttgggagtgcttgatgg

SEQ ID NO: 9637 - DNA, 115 bp, Zea mays
  Clone ID: LIB3279-198-Q1-N6-D7
aagttgaatcacaattcataggcatgtgctggtagacaccagctaataaaattgaaagttcgaatccatggaatagcattgaacaccaccatcaccacccaaaaaaaaacagaga

SEQ ID NO: 9638 - DNA, 59 bp, Zea mays
  Clone ID: LIB3279-198-Q1-N6-D8
aaaggcgtgcctttgagcattccatcttaggtcttacacgaggactagattatgtgctt

SEQ ID NO: 9639 - DNA, 296 bp, Zea mays
  Clone ID: LIB3279-198-Q1-N6-D9
ctcttttgcggtctctttggttcgttctttttttttcggaccggttcctgctggcgttccatctttccctattttgagtcgtatgacagcttggcgttgtcatgggcaccccctgggtttctgttaaaaaaaaacatccggtcacaattcgcgtaatatacgaggcggaaggctatacagccctgccggggggggcaaaagagcgaacttacttgcattagttgcaaaaatctcaccccacaatttgcaggaaaaaaaagagtctttcttgctgcggtttttaatctgacagggcg

SEQ ID NO: 9640 - DNA, 507 bp, Zea mays
  Clone ID: LIB3279-198-Q1-N6-E1
aacccaaacaaagagacccatcaaatatccagtcaaacagcatggaaatacaaagcccaaacgaattggagccaacatacgctaagtcgcccaaaggaattagggagccaacatcacggcagcaacagggtaaaccaggacctagagatagttttgactcctaaataacacaatatattgtacccaataaaacattccaaaatcatagtacaacgttacaaaaatgtgtagtcacaggaaaataactaacaacattttaggtggacatagtaacaacatatttagccttgttcatctaggactcctgcaaattaagctggtcgcccaagaccaaaattcatggcttctttctttccttcttggccgaaacaataacaatcaacactcatctgatctcgcaaaattatacagctcaaaattgtctgttcctcaattccttgacacctaaactatagagagtacacgagaccgtctttcgcaagatacagaatctgaaaaggttgatag

SEQ ID NO: 9641 - DNA, 272 bp, Zea mays
  unsure (1)..(272): unsure at all n locations; Clone ID: LIB3279-198-Q1-N6-E10
ggttgggggggtttttggtgggttttttggtttttgtgtttttggttnnnnggggaggggcaaagggggggttatttttaaaaaggttaaagggttggggggaaaagcgaccaagggaaaaaaaaaatttttttttttggggtaaaaggtaaaaaagggggggggggggttcccccgggatttgtgggggggacactggggggcctccttttttttttttgggggggggtttaaaagctggggaaataaagggaaaaaaaagttttttgggg

SEQ ID NO: 9642 - DNA, 402 bp, Zea mays
  Clone ID: LIB3279-198-Q1-N6-E11
aaaagaatcaccggagcatcgcttaaatggaggaaacgtgatcgcgaacaaagtacatccattaactgtatcggctacagcagctccaaacgacaaagcgaaatggttcatcaatattacaaccgaacaacagaaatttgctcatgataccctcttcttaagcggacgggatctccacctcgccgtcgtcaatctcctgctggaggtccttggggtccttgccgtcgacggtgcagccgacgctgacgcaggtgccgagaatctccttgacgcagccggacatttccttggccatggacctgggcctcatggtcctggcaatctcgatgacgtcgtcgagactgatgttgccgctgtgcttgatgttcttgaccttcttgcggtccctctcccacgcgtccg

SEQ ID NO: 9643 - DNA, 457 bp, Zea mays
  Clone ID: LIB3279-198-Q1-N6-E12
tgcggctgcggctgcggctgcggctgctgcggcggctgggccgggggtgtggctgttgctgccgctgccgctgccgtggtcgaggcgcgtcgggctcgggaagctcgacgacgccgggctggcgtggtaggacggcaccgggctcgggaagctcgaggacggcgcgctcagcagctgcgaggacgagcacgggctcatcatccccggcggcggcttgcatccctttcggtaggtggtgccgtcgtcctcgacgacccaccccgcctcgcggcacagcgccttgagcacctcgttgttgtcgcagtgcttgggcagcttgtagttgccgagcgcgcggaggcccgtgaagatcttggcggcgatggccctccgccggcgctcccggcgcttgttgttctcccgctccttccatgtcggcgtccgcccgaggcctcccaccgccgccgccgctcccgac

SEQ ID NO: 9644 - DNA, 457 bp, Zea mays
  unsure (1)..(457): unsure at all n locations; Clone ID: LIB3279-198-Q1-N6-E3
gaagacccaggataagacagattgataaaaatactatttcgtctcaatacaagttcagcgacacaactactcaaaacttaactaggcctcaaaggccggttcactgcgtcactccgagccacttggtgaagttctcaaactcggtgtagtcactgtccgaaaccatggtcttgtaccacgccttgccggcagccttgaccttggcagtctccgaggtaagcttggtccttttggaatcaagcttttccttccgggccttgactcgggcagcctcagcaagggtggccatcttccgggcagtgccgaggtaggggttgagcttgagcacagcagccatgttcgtgagcgggttcttccttttctccctgcgcttaacctccttgttgagtggcttaaccacagactgcacctngtcagagttgataatcctgcccaggtcagcgttggccatcttggg

SEQ ID NO: 9645 - DNA, 571 bp, Zea mays
  Clone ID: LIB3279-198-Q1-N6-E4
cccgatagtaagttaattcaacaagatgatgaattgcaaaatcagaacaaggaacacaacacggcaaacatgccagtgaacatttcaggagccacaaggcaaagaggaaattaggctggaacacataagttccacagatctaaacacgaacatgctacagcagaacgctagtgaagtgactaatttctaagcctttttcggggacttggctgccttctttggggacttggcggccttcttaggggacttgctctccttgctgccgccgttggacgccttttccgccacctttttgggcaggaaaaccgggttgatgttggggaggacaccgccgtgcgcgatggtgaccccagacagcagcttgccgagctcaacgtcgttacaaatcgccaggagcaagtgtcgcgggacgatgcgcgttttcttgttgtccttggccgcgttcccggccagctccagcacctcgggggggaggtactcaagcacggcggcgagataaacgggggcgccggtgcccacgccttgcgcgtaccgcccctttttgaggtagccgcccatccggccgacgggg

SEQ ID NO: 9646 - DNA, 592 bp, Zea mays
  unsure (1)..(592): unsure at all n locations; Clone ID: LIB3279-198-Q1-N6-E5
acaacgaaaactgcatttattgtactaccaggcactgctgatatacctgcacctccagaaacaccaccactatttttttctctcatgcatgtctgtgcattcgcgtggccttgcccagaaatcaaacactgagtaccatcagacaggcagattgggctggtgaaatgctatagttggacatctactacactactcttcattttagtcatttcgtcaattacactgcggtattagcaacaagcaagagcgatcgaaaactgttacacaggcgctacaccaagtaggtaaaaacaagtttgtggctgcctgccgccataccatgccatactctggccggtatagctgcagcagattgtatacaagggaaaaaaaaagaagatacacatacagtacgaagaaggcaaatgaaatgccgttcgggcggtagcctaggcgtgtacagctgacgcagacagaccccgcctcgggcggtagcctaangcgtgtacagctgacgcgcagacagaccccgncccgccgcacttaaaagcttccttccttgacctcgagggtacacaagcctattgtccgagcaatttggaatcacatgcca

SEQ ID NO: 9647 - DNA, 575 bp, Zea mays
  Clone ID: LIB3279-198-Q1-N6-E6
tcaaccgtcccaaacaaatttattgataattaatactaaacagtagggggcataaaaccatagaaaatacagggtccagaatgtaaccacagataatgcagacacggtgcaacacccagcgatccctgcacttgtgtttgccatagcaaaagccagctcaagccagatggatgtctctgtagcaatccttgatacacttcttttttcgatttaggttttgagatacagtattccaaggcagggaagttacttggggccaacatccttcagcgcgcagatctgctcctcccccatagcagactggacagtcacaacaagatccttgccgctttcgaacccttccttgatctgggccacaagagtctcatcagttgggagtctaagatcatccttagtgttgccatctgaagtaagaaggctcacaaatccatcctctgatatatcaatcagctggtactcagtacggttcacatgcggaatatcacagtttgtgtgacgaaggaacaatatcttcgagctttttcccgttgaatatgtctatggcaacaaagtggcatttggcatggccatgctta

SEQ ID NO: 9648 - DNA, 445 bp, Zea mays
  Clone ID: LIB3279-198-Q1-N6-E7
ggccccccaaaaattttcaattttgggggggtggaaaaaaaaaaccccctttttaaggcccaaaactcagtttaaaaaaaaaatgcttttacaaaaccctttggtttttgggaactcatttcaaggggtctgcaatttttgaacccttcaaaaaactgggaaaaaaaaggggcatcggtggccctataaaaaaaacccggaaaaaccttgtttcccaattggggggaggacccctttttttttaaccccccaatgggggttcccctaccggcaggaaaaaatttttttgtttttttatgccccattggaaagtttttttcctaaaaccctttctgggaaatcggggaaaaaaaagctcttaagggggggtccaagggcccttttttttccaaaacctggaaacgctggctaaaaattcaagccccttttgaaaaacacccaaaaa

SEQ ID NO: 9649 - DNA, 411 bp, Zea mays
  Clone ID: LIB3279-198-Q1-N6-E8
aaccgggagcagggcttgttcatttgccaacaactgaacaccttgttaccatttgccaatcaccaggggtaatctcgaaacaaatttgcaagtaagtattaaggggttcacatatttagagcccatgggcgcccgctgcattccaatcccaatcccaatcccagttaaagtcaaatataaccacacgtttgctgcgcgaaaccaacctgaaacgccgaggtgtcaaaaacgaccctcaggttcttctgctggtagttgcccatgatggaggtctcctcctcggatttcagggaggccacggccaggcacacctgtgaggagtcgctggtgacaaagtagagcacgccggcggagtccaccttcaccttcgggccgccgtggaacacgaaagtcaggctgggcacctggact

SEQ ID NO: 9650 - DNA, 573 bp, Zea mays
  Clone ID: LIB3279-198-Q1-N6-E9
tggaaccccaaaacatgtctccatttccgtgaaagcgaaccagaagaaaaagaaaaaaagatggcaccaaacactccaggacgcttctgctcgtacaggcagccttcatcgtcagagaaacatagtgcattacaatggaaaacggggaagcacaccactctacatacagaacggagcccgcagggacggtcgatgggaactagctttgtttttttttccttcatcgcccgccgtcgatcgtccgtccggacagatcctgtcttgccggccttgccttcctcgtctacggtctacctatcaccaccgccctttctcttgcattggtcaccgcacttgtggtaggggttggacgcgttggcgcaaccagggttggttttggtttctcctcttccctcgacttcagaaacgcccttgcctcgtcttttgtctgactttgctgcacttgtctgcgctgtttcactcagatggtcgaagcagtactgggcgcacatgtggaacggattggacgcgttagggcacctcggatcaaccttcccattggggatcgctgtagcgtttctccccccttttcct

SEQ ID NO: 9651 - DNA, 484 bp, Zea mays
  Clone ID: LIB3279-198-Q1-N6-F1
gcccccaaattgcaaattagatttctgaaatcaagggaatcaccggttcaaccacaatgcacagatctactaaccagttccaataacaacgacgacactacagaagtaaagatctactgaacacgagcattcaacatcacagcggtaaaggcgcccctctatgccttcttgggggacttagcggccttcttgggcgacttggcctccttggccgccgccttctcagcggtcttcttgggcaggagcaccgggttgatgttggggaggacccccccgtgggccatggtgaccccggacagcagcttgccgagctcctcgtcgttgcggatggccaggagcacgtggcgcgggatgatgcgggtcttcttgttgtccttggcagcgttgccggccagctccagcacctcggcggccaggtactcgaggacggcggccaggtagacgggggcgcccgtgccgacgcgctgcgcgtaccggccctttt

SEQ ID NO: 9652 - DNA, 557 bp, Zea mays
  Clone ID: LIB3279-198-Q1-N6-F10
tttttttttttttttttttttttttttttttttttttttttttttttttttttttttttttttttttttttttttttttttttttttttttttttttttttttttttttttttttttttaaaaaaacccccagaaaaaggggaaactgggttccaaaaaaaaaaaaaaaaaaaatgggggaaaagggggaaaaaaaaaatccccggggttttttggggggggaaaaaaaaaacccccccttttaaaggggggggaaaaaaaaaaatttaaaaaaaccccccccctggggggcgggggccaaattttttaaaagggggccccaaaaagctttttttcaaaaaggggggggaaaaaaaaaaaaaaaaggggttggcccttaaaaaaaaaaataggggaaaggtgggggattttttttttttgggccgtaaactcccaggagggaaaaaaaatgggtttgggtaaaaaaaaaccccggggggttaaacacggggccgaaaagccccaaaaccaaaaaaaattacaaaatccggggccccgggaaaaaaaaaagggggggg

SEQ ID NO: 9653 - DNA, 588 bp, Zea mays
  unsure (1)..(588): unsure at all n locations; Clone ID: LIB3279-198-Q1-N6-F11
aatctgggtaaacaaacaagactactcagattatataatccagattatataatcctccaaaaataatccagattatataatccataggggtaaacaaacagaccctaaggcacctgcaaccttcatgcctatgccttacaccgacgaccaatccatattacaaaattctaatcttagacatcaattagctcacgttttgcaatcaaaccggaaccaacatgatctgagaaaccctgcaggtgatccacgcattgtcgttaatgtggaacccagagtacctggatggatgcgaagattatttacaccgcttccctacagtataagtgtggacatcgacacagccaaaaaatgcaatcaaaagaagctattgctgggaccgccaccaagcatttcctcccggtcaatgaagcgctccagaatttccttgtccttggtgacaatgcactcatcatctttgccaaaccagctatagcggttcttcgcaatgtagtcatagaccgtatcccgcagtggggtggggacgatcagcaaggaactcaggaccgagtaaggaggaggcaggtacgatgcgactntcagcgcagccgt

SEQ ID NO: 9654 - DNA, 523 bp, Zea mays
  Clone ID: LIB3279-198-Q1-N6-F12
accttcaagggtaaaaacacaaatatcattgacattgtgcacagagtcttcatcagtatttcactgtcaagtcattgttccatcttcctaggttcatctaaacccccgaagtacagctgatatgcgtaaagatacacagtatattcttacacaacagattggtgtatctaaagattctactgcaaatctacaatggactataccatcatttttgagaaaatagattggatcccgctcatgtttgtttgctcagatcaataagcattagggacagaaaccggttcctcgtcatcggctgatttgtcttttcttcagaaccattacactggcttacaacaacactacaaaactgtgtcgcactaggagccgcaccgaaagaactccccgtcaactttcgttcactagaagtggctgaacaccaagaactgcattttcattctgcgcgttagtcgagcgagctctccacttctggatgatctgaggaatatctgttttcacatgacttgtcaacagcacagcagca

SEQ ID NO: 9655 - DNA, 574 bp, Zea mays
  Clone ID: LIB3279-198-Q1-N6-F2
cgtgcgttaaaagttgtccatggaattcagatcctaatgcaagaggatggaattcagttcctaatgcaagaggatgtcgtttgactgaaaaacgcgtagtatgcaacatttttgttctgcttagcaccgaactaatcccatagcaccaagattacactgggggttgggaaataacattacagctcagaaccgttttgatacaacgctcgttctaaaatgctccttagtctacactgtcctggtgagtcttttctgtctggcacagtgaacaaaggtatgtgcgccaaaggagcttctcagaagtgagccagactgtatactagagtccacgaaagcaggaaaagggtgaatgaagcgaaaagaccctcctgaagaagcgccccatggcctccatattcctcctcgtcaaccttcagcaagtaggtgtagtaccaatagataatgccagtcgagatggccataaatagtgcgatccagaacgcgccgacgagggggacggctccccagagcaggccgcatatgagccccaccgcctggcggatccagtgcaccgcgtccagcagttggtccttgt

SEQ ID NO: 9656 - DNA, 64 bp, Zea mays
  Clone ID: LIB3279-198-Q1-N6-F5
ggcaagaaaaattgcccgactgacaaacgaagggcagactctatgaccataaatgtttttgggg

SEQ ID NO: 9657 - DNA, 434 bp, Zea mays
  unsure (1)..(434): unsure at all n locations; Clone ID: LIB3279-198-Q1-N6-F6
gaggcttgaaacgaggacattccattgattacagcagcgagatattacagcacatggactagaaactagaacgatgcagtacaaccaccacagaaaacagcaccgataaagacaacacagactaactagaccaagaacacaacacgaccgccaccgccaccacgtaattcgccaccgggagaggggcgacctaaccgccgaaaccgtagagggtgcggccctggcgcttgagagcgtagacaacgtccatggcggtcacagtcttgcggcgggcgtgctcggtgtaggtgacggcgtcgcggatgacgttctcgaggaagatcttgagcacgccgcgggtcttctcgtagatgagcccggagatgcgcttgacgccgncccttctcgccaacctgcggatcgncggcttggtgatgccctggatgttgtcacgc

SEQ ID NO: 9658 - DNA, 551 bp, Zea mays
  Clone ID: LIB3279-198-Q1-N6-F7
agtaccaagtacagtcacgatattatcattaaacattactacatgtgttactctctgaggggcgaccacgcggttaaccacttatcaagtcgcagcacagtccagtccttagttctagtatcatacataaacaactatttggtgctattagcagctcggaaaaatacaagtttgctctcagagttcatcaaccatacaaaaactcaagggaaaaaaaagtgcctcgatcttcccatgtggccatcaccgagtgccttcatcgagtgctctagagcgccttgttctcctgtgcctcttcaacgagcgctcttatcatccttgtcattaccctggcctgtggacgacggggagtagcccggtgcagtgggggagtagcttccgctagggctgtaatttggagaggtcgggctgtagtctgggctgggtcctccagaggtgttgaacgggctcgttgggctgtacgatggacttggttgtgaatatgatggtgatgtaggagagtaagtcggtgacgttggactgtagcttggagaagtctgcggacgcgtggg

SEQ ID NO: 9659 - DNA, 528 bp, Zea mays
  Clone ID: LIB3279-198-Q1-N6-F8
ctcttcacccttcctgcggggcctccaccgaatgggcttgacagtgaaaagtcaatgtgcttctcagactccaccctcaccatgaatgatgggacgttgacaatttgcctgccaaccctgatgtgacgctgcttgatcaagacacgagcatggtgaatggacttggccatgccagccttgaagacaagtgtttgaagccgccttgcgaggaagttctcagcggtgagggcaagaacataatcaagcttgttctgaccctcagcaagcagcccatagcggttcatgcggcgaagaagtgcctcaccctcaaagatacgacgggggttcttctcgtcaagggtgagcaagtgccttgcagcattacggatcctgctcagtgcatactggaccctccaaagctcacgcttgcacctcagcccatactcaccaaccagctttagttcagcatcaagacgctccttctcataaagacgccttggttttcttgaacgtcttaccataattgcggtagaagttgacctgcaccat

SEQ ID NO: 9660 - DNA, 575 bp, Zea mays
  Clone ID: LIB3279-198-Q1-N6-G1
aaagaaacagcatcagataacgaaacggtcaggtagaaaccagacacaacggacttcacaaggtaatacatgagttcaacagggcacaatggtcctcaaaagtccattcatacttgcgacttgactggttatttaggtgataacgatttggggtccggcacattcaccagtttggccagcttttagccttgcttctagcccatggcatacttctgtgtccaggagcgtgcggtggactcatacttggccctgtcggtcttgtacatgtgagcaatctcagggacaagaggatcatcagggtttgggtccgtgagcagtgagcagattgacaggagaacctttgagatagttaaagcaggactccactgttccttaagaatgtcaaggcaaatgctgccgttgctgttgatgttcgggtggaataccttggtgcggaaagacacctttggtggcttgaaagggtaatccggtgggaagtgaatgttcaccaagaataccccacctgcaaatgggctgtccgaaggccccatgatggtcgcttgccaatggaacatgtcctcaccaacaggacctgc

SEQ ID NO: 9661 - DNA, 380 bp, Zea mays
  unsure (1)..(380): unsure at all n locations; Clone ID: LIB3279-198-Q1-N6-G10
caaacgaaaccccagacgacacatcaggtaggatgattggcggtaacaagggaaacaaacacacacaatgttcagaagcacagctactgctttctaccatttgctcttcctcaccagagtcccgcaggtagccacccagctcactggcactgctccgacaacggtctacactcaggcgaccttaatctcgatggtcttgggcttcttgggctcctgcgggggcagcttctcgacggtcaccgtgagcacgccgtccctgcacacggnggcgaccttgtccatgtcggcgttgtccggcagcacgaacttgcgcatgaacttgcccatccgccgctccatgcgcaggtacttggcgtnctcgcgctcctcccggngccgct

SEQ ID NO: 9662 - DNA, 421 bp, Zea mays
  Clone ID: LIB3279-198-Q1-N6-G11
aagaagcatgaaacgggaatttcagttctcatagcattatcatgaatctcagaacataacaggtgaaacacgaatcaagcagaggcgccatggggttcacagatccacacctaaaccgctaaattaaactgcgagcgatacatgataaactaagaccaccactcagatcaccaccatcttattcagatccaaaggaacggacgcagggggagtcgacgatgacggagggagggcggccgaacagaccagatcagagagatctaggagagctgtccgcagtcagcgaccttgaccaccttggaggtggagccgttgcgggtgcccaccttctcgatggccttgacgacgtccatgccctcgacgacctggccgaagacgacgtgcttgccgtcgagcccccacgcgtccgcggacgcgtggg

SEQ ID NO: 9663 - DNA, 377 bp, Zea mays
  Clone ID: LIB3279-198-Q1-N6-G12
caaggaagctagaagcgcgcgctttattgccatgagcgcatcacaccagactagttatttacaaaactctgccacacggcggaacagagcgcccgatcgatcgggccggcggagacgacgaccacaacatcatcacgactaccacgctgctagtacttgcaactcctactgctactaccggctagtataatacacggaggcgcgcgcggggggaccaggacggccgccgctaatcaggcgctggccttgttgaccttcttgccggcaccggaagcggcggcgcgggctggcttgggcttgggctgcgcgggcgccggggccaccttcctcgctcgcttcgcgcgcaccttacgtgcctccctcgacggcgccgaggc

SEQ ID NO: 9664 - DNA, 431 bp, Zea mays
  Clone ID: LIB3279-198-Q1-N6-G2
aacacacaagatgaacgctgagaaattttcattggcaattgtcatgttgggcatccatccacaggcccggttcagggggattttaagtctgagttcatcgctttttcaacccgtccgaagctaccaacatcaaagcggtaggggaggcaaattaaccttgggtggcggcatttaaaaggtaggaaaaagttttcgccaaggatcgtaacccccattcctttttatgaactcttaaaaaaccaacgtccccggcatgttgaaaaaaacgcgaatagtctcgctggcgacatccaacagctgtagatacttatttgccccatcaaccaagcacttattagtttccccaaactttttacatatccttgccttttgatcatctggaatatcatccgcgctaacaatcgcatttaaaaactgtgccctcagctgtg

SEQ ID NO: 9665 - DNA, 307 bp, Zea mays
  Clone ID: LIB3279-198-Q1-N6-G3
gaagtcaccattgaaacaggggtgctggtagccgagttatgttgctgtgcaaaagcacgagtccgaagtacaacagggttcactcatagcatttacatcagttttcatgctgggactatatcagctgaaaaataaggattcactgcgacttggcaactggctccagtgcctcgatcatgacaacactgtttcccctgataaccaccattccaatatctgtcttgtcatttccattgacctccacagtgttgtcgatcaccaaattcatgaactggtcgaatccccgaagtgtgccaataacaacacg

SEQ ID NO: 9666 - DNA, 267 bp, Zea mays
  unsure (1)..(267): unsure at all n locations; Clone ID: LIB3279-198-Q1-N6-G4
aaaaaaaggggccatgccggtgcatttgggggttttaaaaaggggaaaaaaacttttgggtttcggtgggatggttaaaaaaaaggcccggttaaaataaaaaggtttggggttaaacttcaaaaccttgaacctccttttggaagggggtttaaaacctgggggggtttctctttaggagggcctgtggggtttcccccttttagacttttggcagggattaaaaaccnggggttttttttttttcccttggaagggggggggggg

SEQ ID NO: 9667 - DNA, 205 bp, Zea mays
  Clone ID: LIB3279-198-Q1-N6-G5
tttgcagcgacgatgatttttattgcagataaaaaaaacgtacatctgatttgagtaggaagtatatgcactaattaattaattaacacggtcatggatccaggccacgggaatagagtagagaaaccgttggtgaggaagcattccattattttgaccggctcacccactggttatgccggggaaggatggtcccttaagaaac

SEQ ID NO: 9668 - DNA, 464 bp, Zea mays
  Clone ID: LIB3279-198-Q1-N6-G6
aaaaaagaatggagagtttttttatgctgctgctttgcacggctcatacatttctgttcgacaggctcaatttattggtgtgctgttacatacgggcgtggctgcacattgggcagcagttagctcacaatcagactttgctgtctccaaaaagcagggcctccttttaaactggcatgatttggtttgcatattaccagcaggcaaatacaatattttgcaaaagctaggaacccttgctgattttctactgaccctgtggttagtttggggtcgtcggcagcagcggcatatgcatatgcgtgcacactctttttggctctcccctcgcccacaggttctgcagctcccctttcttccatccaagcgcgatcaaggtgccaagagtgaagggccccatgtacaaaagggcaggttgtccatgcccatccatcaggttcagcgcaacatatgtgattagaagt

SEQ ID NO: 9669 - DNA, 589 bp, Zea mays
  Clone ID: LIB3279-198-Q1-N6-G7
aagaaaacaataacgccaaacttaataacccagtagcaaagcgggggaataaagtcttacaacgtaagttgtaaaccacacaacgacagatagataagaaccgacagaaacataacacgataggagccactcagggcagatcacaggatagcagtggcacacaagcccgacgacgccgcgccagtagagcgtctagtactcgtcaccctcgtcgccgtcctcaccctcgtcaaactcagcaccgacctcctcgtagtccttctcgagcgcagccagatcctcacgagcctcggagaactcgccctcctccataccctcaccgacgtaccagtgcacgaaggcgcgcttggcgtacatgaggtcgaacttgtggtcaatgcgggagaagacctccacaacactggtggagttggagatcatgcacacggcacgctgcaccttggccaggtcaccgccggggacgacgctgggaggctggtagttgattccgcacttgaagccagtcgggcaccagtccacgaactggatggtgcgcttggtcttgattgtggccacagcagcgttcacgtccttgggaaccacatcacca

SEQ ID NO: 9670 - DNA, 576 bp, Zea mays
  Clone ID: LIB3279-198-Q1-N6-G8
agaggggggcattaaccaaacataatattggctactactagcctacagaaaacatttcccaccttagaaaaaagaatgggcttcaagacacccaaatggcaagaagaaacccggaggggttccgcattatcaatttgggggaaccaaaggtaccggccaaggaggctttacaccctgccctacacatttgggaaacaaatatttcatgttacccaacacaagccaaactggtcccttaataaacagggtcctggcttcacctgcgggttttatttcacactttatttatgggctgaattgacaaagagacccctagatccatcacaaatgtcactacattgagaaccaagtcgctagccctgtgaacacggagcctgccactgtcattgtgggtcaaacggtgtgttgaccttgcctcagttatgcgcagctgccaagttgcggatgacataaaggaggatgcctccatggttgaagtacgccagctccacctcagtgtcaaagcgaacgatgcaagtgaaagatttcccattgtcggtagtaacagtcacatactggccgggacggatctaactg

SEQ ID NO: 9671 - DNA, 281 bp, Zea mays
  Clone ID: LIB3279-198-Q1-N6-G9
acaatacaatcgtacatatagtacgttttattcgacaagcagcctctgcatgcaataatagtacaaccccccgatttaattaattgggactaatgcatgctgagggatgatcaagatggaaatcctgttgggattccccttccggggaactcccggttggaaaaagggttgagccagttgtacgggaccaatcccgggccccaaggggttttgaaggcccaggtggtggttgacttcttgaataaacccttgaatttctttattcttgcggcgaaattttt

SEQ ID NO: 9672 - DNA, 389 bp, Zea mays
  Clone ID: LIB3279-198-Q1-N6-H10
ggaaaaaaaaacaagccctagcaaatgtgcattgggtgcagccattcattctctgatccttacacaacattttcccgtttctagttacagtacagttctattatacatgggaaatccaaactacaaatctaacaaattagtaaacctcacaagcagacatgactacatgacagctggcagccccctttcggtgttcaaaccacgccgttctcatacattgagccatttttggtagtagcattttcggccatgtcaagctcggccatggcagcgtcaacaagagactgcagcctatgttcagctgttttgaccctatcgttgtagtcttggagttgaagaaaatgtttgtacagctgcatttataattggctgtaacagctaattgtcgt

SEQ ID NO: 9673 - DNA, 587 bp, Zea mays
  Clone ID: LIB3279-198-Q1-N6-H11
aaacatacccaaagccaggtcccaaccgtccaactggcctgactgtaccatatgctcctttgagcaagcatgggaagtattcagcattctgacatctattttcttccctgcttacaagggtctcattttcacgtgcactgctagagtgtattatttttctttgtgaagagttgtatgcaaacaatttttttgggggagagaagaaatatataagtactctaacatacaaaattgcacgccgacttttgtgacagctcttgcattactttttattccatttttctacatgcaacaagcttatctactaacagtgcaatcgatctagtactatcaagggatcccattttatctaatcgtcttcaaattgctagtgcgccatccactgtttcgctttcatcatcggagctgatagacttcgatttggacataactctggaaaacccatagccaagagaatttcctgacgtagcacacaactctgtaagctctgacagatgacgattccggaactcgttgatgctttcctgaatctctgacattgggagttttgcttgtgcaagacagcagcagctagctgaagacttggc

SEQ ID NO: 9674 - DNA, 567 bp, Zea mays
  unsure (1)..(567): unsure at all n locations; Clone ID: LIB3279-198-Q1-N6-H12
ggctttcctatctcacttcatgttacaaactctttactctatagacagcagtctatagagatggcttagagggcaaaatcgaagctgtggtttgacccatatgccatcacagcctcacaggcaatacgctcagtgttcagatgctcgaaccacacagtacgatcatataacgcggggttggtcatgtcatgtctccatatcacgcacactaccacaacagacaccatgttttagcaacatctattgaatatctcgctgaagcctattcacgagctggaggcctcaaaagtatctggcttatgcttctccatcagggccgtcagggctgcgtcgtgatccctctccagctccagctccttcttcatgtattggttcttgagcttcatcttcttctcctcgtggcctttgatcagctcatcccgctcagcttcaaactctgccacattcttgacctggcaatcaatgaacttctgtacatgttccttccttagcttacgatcttcttcggtggttccagaatcaacatcaaagcgtctagcctttgagcgctcctnctgcagcaacttc

SEQ ID NO: 9675 - DNA, 594 bp, Zea mays
  Clone ID: LIB3279-198-Q1-N6-H3
aaacacaacgtgacgtggaacaatgttcatcagtcttaacagctcaaatagacgcagatcatatcatccatcactacccctaccagataaattgagccacgtctaccaacaccacccagcctagtactatgagcctaagaagaagtgaacttggtgacggccttggtgccctcggagacggcgtgcttggcaagctcaccggggaggacgaggcgcaccgaggtctggatctcgcgggaggtgacggtgggcttcttgttatagcgcgccagcttggcggactcggccgcgagcttctcgaagatgtcgttgatgaaggagttcatgatggacatggccttggacgagatgccgatgtcggggtgcacctgcttcagcaccttgaagatgtagatcttgtaggtctccacggacttcttcgctttctttttccccttcttgccctcgccgcccttcttaccggcggacttgcccgccgggaggcgcttctcggccttgggcttcttcccgccggagccttctccgccttctctgtcgcgggctcctcctctgcaggcttcttcgccgccggcttcttgtccgccttgggtgcca

SEQ ID NO: 9676 - DNA, 512 bp, Zea mays
  Clone ID: LIB3279-198-Q1-N6-H4
ggtcagagctgatttaacagctaccaagaaactgcatcgggtgcattactttaatcagatggaataagtctcgtcttaagatttacaaaataatatggtcagagctcgaatcaactgatataaatctaggaggtaattagcacaaggccagttacaaaagaaaaccagagatagattacatgtataacataaactgcttgctacttaagtacttgtctaccatcagcaataatccccaaagcatcagggttagctaaggtgccacaacggcataggatactgatacatgagatgcaaatatgcagattaaagctgttcctggggaagatcatcacgatgcttcattcagtcccaaaatgcacagttcattacttgtcattgtcaatcaagaagggcagaacgatcaattactttctttatccatggaagaacttagacttcctgagccactgactgcatcgaagtcaaagtcaatctttcgacaaatgcctgggctcagctttaacgcttta

SEQ ID NO: 9677 - DNA, 396 bp, Zea mays
  Clone ID: LIB3279-198-Q1-N6-H5
ttttcgaacacagaagatcgccacgagtaatcttaattttaaacttgtttcaagacaaaatcttagggccagatgaaaacacgtagccaagacaactcaataagttcacgtcataagcaacctcatgtccagactcgcctagatacagaagtagcaaacaaactactcggcagcagcaacctcctgcccagcctcatctccctcgacaggcctctcaagcttcacaccaacatcctctttgtagtcgccatgaacctccatgagtttcccaagatcgaacttgggggccttgagtatcttcaccttgcggatgaagacgttttgaagtgggaagatgctggaggtagacttctcaatctctttaccaataacttctggaatgaacttcgaaacaag

SEQ ID NO: 9678 - DNA, 325 bp, Zea mays
  Clone ID: LIB3279-198-Q1-N6-H6
gggggggaaggggtttttttttttttggtaaaaaaaattttaaaaggggggggcaaaaaaaaggttaaaaaaaaaaaaaattttcttggaagggggggggggaaaattttttaaaaaaaaggggggtttttttttttcccgggggaaaaaaaaaaaaaaaagggggtttttttttttaaaaggggggggacggggaaaaccccccaaaaattttaagagggaaacccttttttgggggggggccctaaaaaaaatggcgggggggggggggggtttcccaaaagaattttttaaaaaaatttgggaaaaaacccttttttttttt

SEQ ID NO: 9679 - DNA, 588 bp, Zea mays
  unsure (1)..(588): unsure at all n locations; Clone ID: LIB3279-198-Q1-N6-H7
atgtaaatacatttaattctctcatagtatgtaaatactaaatacgcggccaaacatatataaaatgcatacataaatataaaatgcatacataaatattttgttgtcttaatatatataaataatatgttattatatatgattaattatgttaaatatatgtatttatataccgttctactgttggttcgggccagtgtccggcccggtccgttgaggcccaccgggccaacgggccggcccggcacgatttttccctgtgcgtgccgggtttgggcatgtctctaggcacgtgggccagcccgacccggcccgaagcatcaacgggccgtgcctggcccggccctattcgtaccgggccgaaacgggttcgggccgggtccgtgccgggtggcccgtttggacatctatacgtgtcaccgggcgctccacctacgccacctnggccggcggcggcatgttgaggtcgaaccccacgccgaccgccggggaggcgtccaccacggatgacgacgacccggtgtcgctctgctcctcttcacggcaggatgctgcagcatgcttgttggcaccggcgggcgccggcac

SEQ ID NO: 9680 - DNA, 551 bp, Zea mays
  unsure (1)..(551): unsure at all n locations; Clone ID: LIB3279-198-Q1-N6-H8
gcagcaaccgaccatctcggtttatacccggaaggaaagaagtattattgctacaacagcttgtagaacgtttatagaaggctaactacggcagcaaactacagaaggataccagaagtcccttcagttcagtgaaactaggacggaagaacgtgacgtctggatcagtcaactacaaactcgcttcaatctcttccagggtgagtccttttgtctcagggacgatccagaatatgaatgcaagagatgccactgcaatcaccccgaatccagagaagagcgctcccgttccaatcaaatcctccagtggagagaaagcaaaggtgaccagagcgttggacgcaaaattgacaagaacagcaacgcccagtccacgccctcgcagcctcagcgggaaaacctctgagatcataagccagccaataggaccaaatgagagctgataacaaccaacatatagtagaagcgctattacagccacataggaggcatctttcagtaaagtgtagtnggaggacagcaaaaataaggcaacagtaatttcactgaca

SEQ ID NO: 9681 - DNA, 538 bp, Zea mays
  Clone ID: LIB3279-198-Q1-N6-H9
gcccaggaatcatttcaattatcgaacgataagattggattacattcgaaacaacttcaagaatactactaacaatagtccaacacgtcacagacaaggaactaaacgaaataaccctaacaacaaacaggcatccacgacagcaaggagaagaggcatccagcctagcctccgaagccgtagagggttcggccctggcgcttgagcgcgtagacgacgtccatggcggtaacagtcttgcggcgtgcgtgctcggtgtaggtgacggcgtcgcggatgacgttctcgaggaagatcttgaggacgccgcgggtctcctcgtagataagccccgaaatgcgcttcacgccgcccctccgagccagcctacggatcgcgggcttggtgatgccctggatgttgtcacggagcaccttacggtggcgctttgctccgcccttgcccagacctttgccgcccttgccgcgccccgacatcgtcgctgccggtgccctgtctttcacgctctcctcgcctcgaagaaaatgggggatttttt

SEQ ID NO: 9682 - DNA, 671 bp, Zea mays
  Clone ID: LIB3279-199-Q1-K6-A1
ctcaccgccggcctctgctcctcttccgccgccgcaggatctcgtatcgccggagaccatgtaccgcgccgccgggagccacctccgctccctcaagcatcatggtgcttctaggcttgccagtacaagtgttgcgaagcagtcctcaggtggtctgttcagctggcttcttggtggaaaatcaagcgaactccctccccttgatgttccactcccaggcattagcattccctcacctctaccagattttgtagagccatctaagacaaaagtcactactcttccaaatggcgtcaagatcgcctcggagacatcatcgagcccagcagcatctgtgggtctgtacattgactgtggttccatttacgaaacacctgcttcatctggagtatcacatctgttggagagaatggccttcaagagcacagtgaatcggactcacttacggttagttcgtgaggtagaagccattggaggaaatgtctctgcatcagcttcccgtgaacaaatgagctatacctatgatgcattgaagagctatacaccagaaatggttgaagttctcattgacagtgtgaggaatccagcattcctcgattgggaggtcaaagagcagctccagaacataaaatctgaaatagctgatgcgtctgctaatcctcaaggtctac

SEQ ID NO: 9683 - DNA, 631 bp, Zea mays
  unsure (1)..(631): unsure at all n locations; Clone ID: LIB3279-199-Q1-K6-A10
cagtgtttggattacttcctattttcaggtttctgaagctatgtgggtacaagtggcgtctctgcacttggaagggattgctgctcgctggtttcacgtgcatagactgaaacagaggacggggtggaatcattttactcgggatgtgttgaacaagtttggcgcagacgagtatccaaaggcgatgaggagattgatgggtctcaggcagacggggtcactggacgagtttgtgcgggcgttcgaggaagcacggtacatggtatcgctgcataacccaaagttgggtgaggtgctctttgtcactcagtttatttggggtctggagtatgatttgcaaggggcggtgcaatctcagatgcccaccactttggatcgagcagtactaattgccaagttgcaggatgaactgaatgatcaatacaaaggaaggtcgacaaggtcagtgttccagtcgaggtcctcgtccacagcagtcaaggccaaggcgatcagtggtactactggtaaagggtgcatgaaggtgcagggtcttttgaagaacaaagntacgttgctgttgtcaattcattccgggagtcctacttgctttatcaacaagaatctggtggctcgggctcgcttgtctgct

SEQ ID NO: 9684 - DNA, 656 bp, Zea mays
  Clone ID: LIB3279-199-Q1-K6-A11
taacgtcgaccattatgggaccttacagcaccgccgtcgccgtaagcgcatcgccggtcctgcaggcttcctcactcttgacgcgagcccgtggttcttggaggcccacggtggcggcgttgcggctttctgcttccgtgaaatgccgtcggcgggcactcaccgtgacctgtgcgctcccggagaaagaacggccggcggcattcaacatcccgcccactgctctgctgtgccccgtgcccccgccggacggcaaggaacggtgggacatcaaggaggaagatgaccgcgtcacgctgtggctccaggtgccagggctgtcggcgagcgacatcgaggtgaccaccagcgaggacgtcctcgagatcaaacgcagggtcgtcgccccacagcagccggcgcccgtggacgcgcacggcgtcggcgcgttccacatccggctgctgttgaccaaggagtacgacggcagcaacgtcacggccgatctcaaggccggcatgctggaggtcaccgtccacaagaacccgcaacgccccggcgaacgcgccgtgatgatgggggcgaccaagcccccgcccgagccccgtttaaacgaggagagcagttccaaccaaaagtcctcgaccgcagtaaggaaaccggaaccccatggggag

SEQ ID NO: 9685 - DNA, 460 bp, Zea mays
  Clone ID: LIB3279-199-Q1-K6-A12
gcgccagggagcccgtgtgggaccggtaagaggtcaagaacatcaagcacagcggcaacatcggcctcgacgacgttgtcgagatcgccaggtaccatgaggaacaggtccatggccaaggagttggccggcaccgtcaaggagatcctgggctcctgcgtcagcgtcgggtgcaccgccgacggcggggaccccaaggacctgcctcgggagattgatgacggggaggtcgagatcccgtccgcttgaagactagccatccaaggggactgccattggtgctgctgaagtgttgttgtgctgcatgctatcgatgtgcctttttcaagcatcgcgagccatctattttttgtgtctagctatgttagtgatttcttgtgagagacctgaatgttacccgccgttctttgttgtttggagggtggagagatttaagcaccttaccacacctttgttcttt

SEQ ID NO: 9686 - DNA, 663 bp, Zea mays
  unsure (1)..(663): unsure at all n locations; Clone ID: LIB3279-199-Q1-K6-A2
gnagagcgtatcatttcacttattgcttcattgtttggctcacgaaggatgaggctactaggaaaatttgttgagaatgaatgtgaaaagatagaccgccttatggagttatacacaaggtattcagacagagtgaaagaagagactgaaagacttgatagtcttgatttggaagatttagagatggacgatgatgagcggtataaccgaaaactcgaagctgggctttacacactgcagttaattgcgcttattctgggacacatctggcactctgggaattcccagatgagagcaagagtagaattacttcttaagcagaacaaacttacaaagcaagatgtgaagagcatacttgaggagtaccatgacaacattggagatttggatggacctgaagagaaggaaagagcacaagtgcggaccaaggaaattattgacgcgttgtgatgtgcatgggcctagggtagttggttgtggagcaagacagaggctggtagatattttgagtatgttgagtgaatttatatccgcagtcagcaaagctgtgtaacttactaggttgtagatgatggatgtcagaaacaaggtgcattaattagntctgttgtattctaattttgngtaaacttgctagttactatttgccgntatatgctttgg

SEQ ID NO: 9687 - DNA, 645 bp, Zea mays
  unsure (1)..(645): unsure at all n locations; Clone ID: LIB3279-199-Q1-K6-A3
ggnaaattcctctcaacatcaccagaccacgacctccctgccgagctccctccctctccgttggtgatggcatctcagagctccaagaccgcggacaccgccgcgcctccgccggaggttgcagccaccggagaggcggctccgggcgcggcttcttcaacaccggcacaaaaccctaacgctgctgcaaccgcagtggccggggccacggatctagagaagaagatgcgccgcgcggagcggtttgggatgccagtactgatgtcagaggaggaaaagcgcagcagtcgcgccgagagatttgggactggctcttcaagtgtaaaggaggaagagaagaagaagtccagggctgagaggtttggccttgcctcgccctcttcttcagatgaggaagctaagaaaaaggcccgtttggaacgatttggtcagagcgcaaatgtcgacaaggcggaagaagaaaaaagaaaggcccgagctgcccgatttgcagaagcgtctggtggatcagcagctcgggaaaacggcaaagacagctcgaagccggacgcagccgctgttaccggcacagcttngattgagcactctgccttggacgaggtctcagaaatattatctcctaggagactntggtgaagccatagc

SEQ ID NO: 9688 - DNA, 551 bp, Zea mays
  Clone ID: LIB3279-199-Q1-K6-A4
cttggatttatgtaacacttcaatgtggctaatttttttatgctatctccatttcatttgcatatttatttgttatcgactcacaacacgtgattgttgttagaaatataaataagagtcatcggaatatcctagatctaattcaataaggacttttcttgtactccaaatctacatatatgtaaattaattaataggtggtcgaggtggaggcgctcgtgggtaagctagatgcgatcggctgcaacagacaacctgcgatggacggggtctataggtgatcaagcgggtacgatcaagtgtcaacgtcctggtctagaaaggcaagccacatccgactccaccaagtgcatagatcaactccaacaatattaactacaccatctatatcgataaccttgttcaccattagcctacgtttatcatcaccgatgatcttcatcaacatcatgagcagcgagaccaaatgcaacatatcataaggggtatgcataatgattataaaagactagtacgtacttttgataaatctactattacaaattttcctt

SEQ ID NO: 9689 - DNA, 683 bp, Zea mays
  Clone ID: LIB3279-199-Q1-K6-A5
cccacgcgtccggcagcagccaaaacctacctagccgccgccgcaggcggccccccatcgccgccaagatgcagatctttgtgaagactctgacggggaagaccatcactttggaggtggagtcctccgacaccattgacaatgtgaaggccaagatccaggacaaggagggcatccccccggaccagcagcggctcatcttcgccggcaagcagctcgaggacggtcgcaccctcgccgactacaacattcagaaggagtccaccctccacctggtgctccgcctccgcggtggcgccaagaagcgtaagaagaagacgtacaccaagcccaagaagatcaagcacaagcacaagaaggtgaagctctccgtgctgcagttctataaggtggacgacgccactggcaaggtgacccgcctccgcaaggagtgccccaacacagagtgcggcgcgggcgtcttcatggccaaccacttcgaccgccactactgcggcaagtgcggcctcacctatgtctacaaccagaaggcgtaattgcttgccccgatttgctttatccgccaacctatcaagcattcagatgttggttactcaaattgtatctcatttagatctgtctgaggttgaaacttaaatggagcagtagtatctatcatattggtacccctgttactgagtata

SEQ ID NO: 9690 - DNA, 608 bp, Zea mays
  Clone ID: LIB3279-199-Q1-K6-A6
cccagcgtccggcagcagctacgccaagaacaacaacaacaacgccggcatgctggcgttcgacaagatggggagctacggcaacaacggcggcggtaataccaacaacaacagcaacggcgtggaggtgaagagctacttcaacaagtccgccgggagggcggcgagcaacaacaacaacaacagcagccacgccggcggcggcaacaagaagggcggcgccggggagtacggcaggaagaagcacgccaagagcgagggcgcggcggcggcggcggccacggacaagcagcggttcaagacgctgccggcgtcggaggcgctgccgcggggccaggccatcggcgggtacatcttcgtctgcaacaacgacaccatggacgagaacctcaggagggagctgttcgggctgccgtccaggtacagggactctgtgcgtgctatccgcccgggactgcccctcttcctctacaactactccacgcaccagctccacggcatcttcgaggccgcgagcttcggcgggaccaacatcgacccgacggcgtgggaggacaagaagtgccccggcgagtcgcgctttcctgcgcaggtgcgggtggcaacgc

SEQ ID NO: 9691 - DNA, 627 bp, Zea mays
  unsure (1)..(627): unsure at all n locations; Clone ID: LIB3279-199-Q1-K6-A8
tggttgtccaagcagtaaaatacgagtatcgcacgcgcaaggcgattccgtccccattctccacccaatagggagctagagctacgagacggggaaaggggggacgggaataggcgtcgtcggccatgtcgtcgtcgtggaactgggtgggtctggcgatcctgtaccaggtgctgggctgggtggccttcgccgcgtggtccttcagcttctacccgcaggtcctcctcaactacaagcgcaagagtgttgtgggcctgaatttcgattttctggtgttgaacttgacaaagcactcgtcctacctcatatacaatgctgctctcttcttcagcccattcatccagcaacagtatcatgacaaatatggtgataaagagatgattcctgttgctgcaaatgatgttgctttttcactgcatgctgtagcattgacagcctttaccgtttttcaagtattcatatatgagcgaggaacacagaaagtctccaaagtttgcatatcaatttctgctattgtctggatcgccgctcttgtttgcctcattattgcttggccaaaaagtgactggctttggctttttgatgtnttcaattcaatacaagttggcatgaccgcaatcaagt

SEQ ID NO: 9692 - DNA, 665 bp, Zea mays
  unsure (1)..(665): unsure at all n locations; Clone ID: LIB3279-199-Q1-K6-A9
accggtctttttttttttttttcccagcgnccgcggccgcgtgggcgcggcctccctcctccgttcccctttcccgttttcctcctccgcttcccgattcaactcgcaacgccgccgccttcgctgacccatgagcgggcgcgagccgatttaggcccgccgctacagagatttcgagagaatttttgggctagcggggtgtgaacagaaacttggtgccccgctgctctgccttttgtcgtccactgtttcgcgtcaattctcgcgcgaaaagggatgggcactggagaggggtcgccgccggcgaggcggggcatcagcggtaggcgccgtcgatggccggacggtgaggacgacgacgagtatgtgctggatgaggaagaagaagaggattatgtggaggagctctccgtctcgtgcgccggcgaggagggggtggattcagacgccgtgttccaggaggcagaggaggaggacgagatggagacgccgtgcccaaagcgaccggtgaagggcagcacatcgtgcgccggcgaggaggggttggattcagacgccgtattccaggaggcagaggaggaggtggtggacgactaattcgagacgccgcgcccgaagcgaccggtaaagggcagcaacagtattcggtaagggaaaggtgttct

SEQ ID NO: 9693 - DNA, 656 bp, Zea mays
  unsure (1)..(656): unsure at all n locations; Clone ID: LIB3279-199-Q1-K6-B1
gagaagagactgagcgcataagaaggatgatgttctcagcaatgctacgcaatgaaattggatggtttgacaaagaggagaacaatgctgatacactgtcgctccgcctcgcaaatgatgctacatttgtccgtgctgccttcagtaaccggctttccatatttatacaagacactgctgcagtatctgtggctctccttattgggatcttgttgggatggcgggtggcacttgttgcactcgcaactttgccagttcttgtcatatctgctattgcacagaaattgtggcttgctggcttctcaagaggaatccaggaaatgcatagaaaggcttcgctagtgcttgaagatgcagtccggaacatatacaccgtagtagcattctgtgctggggataagataatggaactctacagactacatcttggcaagatactaaaacaaagtcttgtgcaaggactggctattggctttggctttggtctctcgcagttccttctttttgcgtgcaatgctctgcttctttggtacactgctatttcagttgacaaacaacatctgacaatagccacaggactaaaagagtacattctgttntcatttgcatcattcgcattggtggagccatttggactggcaccatacattcttaaa

SEQ ID NO: 9694 - DNA, 589 bp, Zea mays
  Clone ID: LIB3279-199-Q1-K6-B10
cttccaatcgattcttcgtctcgtcctcgtgtaatccccagcttgccctcctcgctcttccctcccaaaaccctacgcctccctgaccaagctccggggacgaatggacggaggagccggcttccctggcacgccggtcccgcgctcgccggaggacgttttccgggactaccgcgcgcgccaggccggcctaatcagggcgctcaccaccgatgttgagaagttctacgtgatgtgcgacccagagaaggataatttatgtttatatggacttcccaatgagacatgggaagtaaacttgcctgctgaggaggttcctcctgaactcccagagccagctctcggaattaattttgctcgtgatgggatgaatgaaaaagattggctatcacttgttgcagtgcatagtgattcttggctaatgtctgttgcattttattttggagcaaggtttggattcgacaaggaatccaggaaacgtctcttcaccatgatcaataatcttcccagcatatatgaggttggcacaggaacagccaagaaagagtccaaagaaaaactcctaaagcaggacaagactaaacaaatt

SEQ ID NO: 9695 - DNA, 387 bp, Zea mays
  Clone ID: LIB3279-199-Q1-K6-B2
agaccattcgtttctcgcgagccatcgcttcggcatccggaagaaatggccaagtcgaagaaccacacggcgcacaaccagtcgttcaaggcgcacaagaacggcattaagaaacccaagcgccaccgccagacctccaccaaggggatggaccccaagttcctgaggaacctgaggtattctaggaagggcaacaaaaagagtggtgaggctgaagctgaggagtaggaaggaaagcatggctttgtttcctctgtttttagctcagttccacctttaggacctggggttttgctaaagatggaacttaagtggtgttactgtatgatggcaaggaccttttgctgccgaaggttatgttttgaagttcatgctaccttttaaagt

SEQ ID NO: 9696 - DNA, 674 bp, Zea mays
  unsure (1)..(674): unsure at all n locations; Clone ID: LIB3279-199-Q1-K6-B3
ccgcagtccgcttggcgtgcgcgacggctagggcgaccgccgccgccctacgccctacgtccagctgcccatgtcttcttcgggccccttgccggcgggaactcaccagaccaggaatcgtgctggcaaccggcgcaagtctggagatagggctgataaagctaattactactacaataatgatggagagaagagcaatgttccttcattaaagaaccttcctccaattgttcatcatgaaacattcttcagcaatgttcagaatgactacaatcaaacaggattagtgcctttggagggatgttctgccagtgaggcttcacagcttctcagtgatcgctggactgctgcaatcaacatgtacaatgaccaaacaattgacccctcagagaaaccggtaatgtattctggatctagcagctcatcatggggtcacctgaagcttcctcatcagatgaacttcctcgaggagttgcgccgtgcagtggacgctcatacagaatttgcgttgcctgtcgacacctggaactaatcgaagtcagcatctgcatcattatgcgttatgactaatttatggaaggcaggctgttcgccaggtctatgtatgatgtatcccatacacggatgatgtgccaaaaggctntcgtctgacctgcagctgcttctggaatctg

SEQ ID NO: 9697 - DNA, 448 bp, Zea mays
  Clone ID: LIB3279-199-Q1-K6-B4
cgcgcagtagtgcttagttcctcttgcacgtgagtcgaatacctgactagcgtaatttatgcaatgatgacataggttagttattaatcctaaatggagcatgtatgtgcatgctgtgttagtgtcgtagatctggacaactgttgctgcccagctgacacagatgcctttcgctgcaatgcttccggtcctgcattttgccgcaactgattttgcaaccaaggctaaacccaacgcgggcagtagtaactgttgcactcaggatccacgtacacaaaaatgagttgaggctaataacgtccctactcggctggtggtatatgttaagagccaatcatgtttaagctattactctgatcgttaaggtgcatcggatcgctaaggtggatctaactgtttgaactagaatgtaaagtgagaactgaaatggaagaagtacctttgcatc

SEQ ID NO: 9698 - DNA, 502 bp, Zea mays
  unsure (1)..(502): unsure at all n locations; Clone ID: LIB3279-199-Q1-K6-B5
ggttcgtggaacggattattggctacagctttgcgaaaaacaccaaagaattcaaaattcaccaacaatcgctgcggggtgatctgatcagggcttcagcgcaagcgccaagccaaacttggggggtctgtccagagccttggtgtcgaattcaccagagatcgtcaagagtgacttgggtttaagctcgtgctgaagaagcgcggcaagcgttccattgttgttgagccttgccttcacggctgtctgagaatcaactgtgtacagtccaccaactgtgagtgtgttctgatttgttgaaagcctccgggttagctcagccacagctgaggccttctgtttctcatccaggtgataaacacctgacactttaatggtgtcacctttgtccgccagaatgaatgcagcatggtagtctggctaggttacaccaattgcagcagtgtacttggtaaattttnccgtagcagtgtcatacccagcttctgcaccaaatgcaact

SEQ ID NO: 9699 - DNA, 641 bp, Zea mays
  Clone ID: LIB3279-199-Q1-K6-B7
ccccgcgtccgcccacgcgtccgcttggaacggtagcaccatgtgtgctctatggtagcaatgttgagaggcttgctgctggacaaggcacatttgcaaacagctgtttgccttacactgggctgtatttgcttgggaactctctctttgggtggaactgccttgccccatggttctctcatcccactcgtactgctattcgacaacgctacaatcttgagggtagctttgaggctttcaccaggcaatgtgggtgccgcggcgatctggtcgaggacgaggagaggcgtgagcacctagaggccgcctgtgaccttgcgacccactacctctgccacccctgcgccctctgccaggagggtcgcgagctgcgccgcagggttccccaccctggattcaacaatgggcactccgtctttgtcatgatgccgcccatggagcagaccatggggcgtggcatgtgagctattccaccaccttccctaccctagttttatctgtgcttcccgtggtttatcatctgctgctgttggccttgatgtgtgatgtgtcgccgtcagtaaatacgagtttgtgatatgaggtcgtgctgggaactttggattgtttgcttcttatcgactgcagtttggattctggac

SEQ ID NO: 9700 - DNA, 612 bp, Zea mays
  Clone ID: LIB3279-199-Q1-K6-B8
ccgaccgatgaggtagtggtgccgtacgataccctcacgtcgcctcctgaagatctcgaggagacgaagaagctgctggacaagctcgttgtgctcaagctcaacggagggctcgggacgaccatgggctgcaccggacccaagtctgtcattgaagtccgcaatggggtcacattccttgaccttattgtgattcaaatcgagtccctgaacaagaagtatggatgtaatgtccctttacttctgatgaactctttcaatacccatgatgacacacagaagatcgttgagaagtattccaactccaacattgaaattcatactttcaatcagagccagtatcctcgcattgttaccgaggacttcttgccacttccaagcaaagggaaatctgggaaggatggctggtatcctccaggccatggtgatgtgttcccctctttgaataacagtggaaaactcgacatcttattggctcagggcaaggagtatgtcttcgttgctaactcagacaacttgggtgctatagtcgacattaagatcctgaaccatctgatcaataaccagaatgaatactgcatggaggttactccaaaaacttggctgatgtta

SEQ ID NO: 9701 - DNA, 644 bp, Zea mays
  Clone ID: LIB3279-199-Q1-K6-B9
cgtagctcgtcgccgtgacgaccccttcatcagcaccgactacatgacctacatgttcaagtacgacactgtgcacggacagtggaagcaccatgaagtcaaggtgaaggactccaaaacccttctctttggtgagaaggaggttgctgtgtttggctgcaggaaccctgaggagatcccgtggggttcggttggtgctgaatatgttgttgagtctactggtgttttcactgaccaggagaaggctgcagctcacttgaagggtggtgccaagaaggttgtcatctctgctcctagcaaggatgcccccatgtttgtcgttggtgtcaacgagaaggagtacaagtctgacattaacattgtctccaatgctagctgcacaaccaactgccttgctcctcttgctaaggtcatcaatgacaagttcggtatcgttgagggtctgatgaccactgtccatgccatcactgctacccagaagactgttgatgggccctcgtctaaggactggaggggtggaagggctgctagtttcaacatcattcccagcagcactggagctgctaaggctgttggcaaagtgcttcctgtcctttaacggaagttgactggaaatgtttttcgtgtcccaaccgtcgatgttt

SEQ ID NO: 9702 - DNA, 641 bp, Zea mays
  unsure (1)..(641): unsure at all n locations; Clone ID: LIB3279-199-Q1-K6-C1
cgacgattttgtggctagtcatccagagctgtttgtgattgagggagacttcattcaccttcgtgatggagcacagcagattatttctgccactacagctgctgcaaaaatagctgctgcgacagcatcttctgcctcttactcatccttactgccttctgttgccgttactcctgtggcacaaaatactcggcaaaagaggaggcccgcagttgattccagatcatcaaatgcaattccctctggaaacggcttcacagatcaatttaacatcattcagggtgtcagcgacgtaacaatttcaggcaaagtaagaaatatccaagataatggcttcatagatgaagttcgcactgggcagccatccgagctcacagctgctactgccaacggagcaagacatgacaaatgtgcaaataataccagacatggttatggtggaaaacaacaggggaggaccactgggacgacatacctttccagaagatgaaccaactttcactgggcgatgatgctgttggaattggaaaccatgcgagtggcgatgatgcggttggggaaaccatacgagtgacgatgctntggcttcgaaatgatggtgaagatgacctggattaanagtattctagattcatttttta

SEQ ID NO: 9703 - DNA, 654 bp, Zea mays
  Clone ID: LIB3279-199-Q1-K6-C10
gtcaaacaggttggcacactcagaagccaaactacttcatgagaagatccatcacaaggcttacagtgatgatgagatcatcagaatcctcaccactaggagcaaacctcagctgattgctacattcaatcattacaatgatgcatttggccaccgtaatcaacaaggatctgaaggctgacccccaggacgagtaccttataacgctgtgggcgatcatccggtgcttcagttgccctgacaggtactttgagaaggtggctaggcaggccatagcggggctaggcacagatgagaactccctgaccagggtcatcaccacccgcgctgaggtggacctcaaactgattaaggaggcgtaccagaagaggaacagcgtgccgctggagcgggccgtcgcgggggacacctccggcgactacgagagcatgctcctcgcgctcctggggcaggagtgatgagccgtactggtgcgctggtgcctttctgaccggcgccgtggtgtttgttcgtgatcgtaataaacctgattgcctagctgtacgtgaggctgtttcttcggtcctggtactgtcgctgcagcatgcatagcagtggaccagtggtgataaataagttactgtgctttcgacgaatgaacccttttttgtgtct

SEQ ID NO: 9704 - DNA, 251 bp, Zea mays
  unsure (1)..(251): unsure at all n locations; Clone ID: LIB3279-199-Q1-K6-C12
cggccgcgtgggcgcacgcgcgggcactgggcccggcgatactgcttagggctgggcatagcggggacgatccgactggtcntaaccgcagcggctggaggcgtaacgtgccgacttgtggagactcaaactagggtatggccagctgctgtgccatcaggctcccttaccagccagagcggggggggggtatntggtacacgaaggcggggaggcagtgcttaggaatgacaatgtgactggggtgtctg

SEQ ID NO: 9705 - DNA, 674 bp, Zea mays
  Clone ID: LIB3279-199-Q1-K6-C2
gcaaaccatggcttcaagtgcatcatggcggagtctgatctgttgtgcatgttgctgatgtgtgggactggaatgatatcccaagtcaacatttgctccaggattcgaaaggtggccttcagatttatgacctacaaaggacctggatgttttgctgctgctgccaccatgatggccaccacaaaggaggccaagttgatgagtggactgctgaggaacagatgtagggaaaataatggtccattttcaaggagtgtctttatcaggaaatggaccattgcagctatgttcagaatatgtgaggaatgttctcctgtggaagagtctacagggggctacactgctactaaattgatacttgatggatctgatgacaagaatccttgtgataaggaactagttaataaggacaacctgctgcagaggaacaagataaatcaaaaataccaaggactgttcaaaggaaaaacaactaaatgccgacaccctgtacaaaagcaagaaccaggagatggagcaacgcccgcatcacccagtccggccaatcccatctcaactgtggtgcaaaaactttggtaagaaggaatactgaaggaccttccaaactagcatgaagtgcgggcaccttgcttttcttttgccttctttttgtgaaacgtgtgcttagcgacatg

SEQ ID NO: 9706 - DNA, 630 bp, Zea mays
  unsure (1)..(630): unsure at all n locations; Clone ID: LIB3279-199-Q1-K6-C4
accgcctccgccgccgacaacagcgtagtgtagtgtagttccggagagggttggggagagtagtagtgatccgcaatgtcgacggaggaggctgttgtggctgaggtcccggtgaccgaggtgccagcggaggtcccggcggcccaggtggccgaggcgcccaaggcgaagaaggcgcccaaggagaagaaggcgcctaaggagaagaagctttccgcggcgaagaagccggcggcgcaccctccctacgctgagatgattgtagaggcgatcgctgccctcaaggagaggaaggggtcgagctcggtggccatcagcaagtacgtcgaggggaagcatggcggcaagctccccaccaacttccgcaagcagctcactgtgcagctgaagaagctcgctgccgccggcaagctgacgagggtgaagaactccttcaagctgccggccaccgacgccaagcccaaggccgccaagcccaaggcacccaaggccgcgcccaagcccaagccctcgccgaaggcgaaggccaagaccgctgcgaagcccaaggcggcgtcgcccaaacccanagccaaggccaaggccaagcctgtcgctcctgccgccgcgtcgcccaagccccgcgggcgc

SEQ ID NO: 9707 - DNA, 659 bp, Zea mays
  Clone ID: LIB3279-199-Q1-K6-C5
cccacgcgtccgcggagtccaggcagcacgctagtcggggggcgcgggggaggagatatggatcggtcgtatctccccgtggcggcggcggccgtcgccctggtcctcgtgtgctgctccggcctctgccgcggcgagcggctcggggcgagggagtgcgaggacctggggttcaccggcctcgctctctgctccgactgcaacgcgctctccgagttcgtcaaggaccaagagctggtggaggattgccataaatgttgcaccgaggattcagatgattctatcagcaagctcacattttctggtgcaattattgaggtgtgcatgaggaaactggtattttatccagaagttgttggcttcctcgaagaagataaagacgacttcccatatgtggaaacccgttattcttatggttcgccaccaaagctcataatgcttgacaacaagggtgaacagaaggagaccataaggattgataactggaagcgagagcacattcggcagtttctcaaggagaaagtgaagccagtgaaattagacagctgagttcttgcgataagtgcctgaatatttccagtttgacgttccaatagaacctacgtaacctgtaccttgctaccaaaatcgtagctgatgtatgagattggcgttctcat

SEQ ID NO: 9708 - DNA, 505 bp, Zea mays
  unsure (1)..(505): unsure at all n locations; Clone ID: LIB3279-199-Q1-K6-C6
cccacgcgtccagattgagaaagaaaggcactacttggtttcctccaattttctcatgttcgggtgatcggatgtgtaggtggcagtgcaccaagatgagacctgtctgaagaattgggaagctgaaggtgagcgttggcggaaaccaagtctccaactgcacgcaaagcacaagatttagttgggtgcaatgtctcatcttcaaatgtctcaaatcaatgcaaatctcgaggcgttagtaggatcattattatcctccaaatacggtgttcctagttaagcaaagtaatgggctctttgtttgcaccaatttggcgtttcgtgttagacaatttcatatcgggtgaacatttccaaattcactactgacaatgtcatatatttgtggtttcnannnnnngttgtgttggtttgtgtgtgttgttcgtggttcgtataaaaaaaaaggaaaaaaaaaaggggggcccctttgtaggtccaagtttcgtccccgtgcttgcgacgt

SEQ ID NO: 9709 - DNA, 606 bp, Zea mays
  unsure (1)..(606): unsure at all n locations; Clone ID: LIB3279-199-Q1-K6-C7
ccccgcgtccngagatgcaacaggtggtcggcaaggcactcatgctcgatgagatcataaactacgtccagtcgctgcagcagcaagttgagttcctgtccatgaagctcgccactgtgaacccagagcttgatttcagcaacctgtcgacactcctgcacaaagacatgtaccaacagccatgtggtggcccttcggcaagttcggtctttccactggaaagcgccggcgcagcttttccattctgcgagcaggcggatcttttccacagctttggctcgggtggtagtggtatggaggatctaagcctgctagacacggctctgccccacgcggccagcccacagtttgcttttcaaaagcagcaaagggagttctgggaggatggcctacagcatgctttgcctacccctactaccggtagcgagcaaaggcaggaggaggatgggcttttagtacccgacctttgatggccagttacaagctgatcatgcgaaggctgagttctagtccgtccctggtgatctccaagggctggtatttttgtacatataggtggtggtggtaccaagacctgtgtgtgggctgggtctgtgtgggcaagca

SEQ ID NO: 9710 - DNA, 660 bp, Zea mays
  unsure (1)..(660): unsure at all n locations; Clone ID: LIB3279-199-Q1-K6-C8
gnggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggcgggtacggtggtggccgtggaggcggcggctacggcggtggcgggcgccgtgatggcggcggcggctacggcggtggcggcggctacggtggtggcggcggcggctacggtggtggtggcggcggctacggcggtggcaaccgtggcggcggctacggcaactccgacgggaactggaggaactgagcggtggggcccgcgcggccaagttatcctgttcgctaccgtgttgtttaccctagtccagagtgtttatcttcgttcgtctcgtgtttgttgttgcccatctgtgtttttgattggagggcgctttgtgtcagttggtagtgct

SEQ ID NO: 9711 - DNA, 609 bp, Zea mays
  unsure (1)..(609): unsure at all n locations; Clone ID: LIB3279-199-Q1-K6-C9
cagcgtccggncgtcttgcagccccgcaacagtcgttagcttagagcatcgcacctcatcgttccaccgtccgtccgtccgctcgttcgcgtgatctgtttgagagttggggaatggaggcctacgtcctgttcgcgcccgccaaggaggtgatcaggttcgaggagcaggaggaggacatcggctgcccgtccgagtcgtccgcggcgcgttcaacgtcgtcgtcctcctccttgttagacggggtggaccttgtcgtcgacgccagtttgttcgggttcagttgttactttgtgatggccttccttatgacgtcatttccgttcaagttcgttcgcctttcgcacgttctttccgttgggctggtcattgttgttgtgcttctttctgttttcagtatattgttcctggtgggtgtgctgtggtctgtcgccgttctgtttttttttgggtgtgcaggtaggggccttttcaagttctttgtcggcaagttctagttgtttgtgtttttggcggcggtgggcggtcttctagacctgtccaagccgtcggcgatacggtttaagacgtctcggtgctgtctgtttggtctctagtcgcgcaccgtcg

SEQ ID NO: 9712 - DNA, 491 bp, Zea mays
  Clone ID: LIB3279-199-Q1-K6-D1
cgacgatgatgatgctgaggaggaattctctggagaagaagagggggtgatgacgatgatgaagatgatgatcctgaagctaatggtgaaggaggaagtgacaacgacaatgatgacgacgaagatggtgatgatgatggcgatgaggacgacgaaggtgatgaggacgacgaagacgaggacgatgatgaagatgacgaagaccagccaccttccaagaagaagaaatgatttgctcatccatggatttacctcagcttctccatgctgttagttgtgttgtttagatcatggacagctttgggatcaatgtagcttgttgcttgtcatggtatcgtagtgtaggaaaatttgacatctgatgttaaatcactatcctgctttcccctctgtgcatgtagtcttaaatcttgatttttactctattggagctgcgattgtgtcatgccattcaattttgttctgccgaggcctatcatgccagcctgccc

SEQ ID NO: 9713 - DNA, 623 bp, Zea mays
  Clone ID: LIB3279-199-Q1-K6-D10
ccccgcgtccggccagcttcctcgacaatctacccaaagcatggtttatttatttgtttattggtattggcaccatcgtcttcttcgtgtctctgtttggctgcattggagcagggacaagaaacacctgctgtttgtgtttctatgctttcttggtcatattgttgatccttgctgaagctgcagctgctgcattcattttctttgaccatggctggaaagatgtaattccagtggacaaaacacataactttgatgttatgtatgactttctgaaggaaaactgggagattgcaagatgggtcgctctgggcgttgttgtttttgaggcagtgctcttgctgttagctctggctgtcagggcaatgaacaaacctgctgagtatgacagtgatgacgaaattatagcaattggccgaagccctaccatccggcagccattgatccatacccaaaatgtcgctgccactggtgttcctgtcccaacacttgatcaacgtgcaagtagaaatgatgcctggagtcaaaggatgcggggagaagtatggtcctggacacgatccagttcacatacaacccttcagacccaagcaggttccagcaaaatggcacgccacgggcta

SEQ ID NO: 9714 - DNA, 645 bp, Zea mays
  unsure (1)..(645): unsure at all n locations; Clone ID: LIB3279-199-Q1-K6-D11
tcgccttccgggggaaactcaccagcccaccacagacccgagcggaagaagccatgtccgggcgcggtaagggtggcaaggggctcggcaagggcggcgcgaagcgtcaccggaaggtgctgcgcgacaacatccagggcatcaccaagccggcgatccggcggctggcgaggaggggcggcgtcaagcgcatctcgggnctcatctacgaggagacccgcggcgtgctcaagatcttcctcgagaacgtcatccgcgacgccgtcacctacactgagcacgcccgccgcaagaccgtcaccgccatggacgtcgtctacgcgctcaagcgccaaggccgcaccctctacgggttcggcggctaggctgatgggctcctcgcgatgttctccccttctgcagatgcgacgttttctgggcgtgcccacaagtcttgcggtcaaagaaatttcaggaactcttgttagttcatctctagcctgtggtaggtttatctgaattcgtgaaactagtaggtttatctggaatcgcgaggctagcaggcttacctgaatcatgaagcagtgatgaaaatatgtgtgcatcgnnaggtggaaatcgaacttgtattgcattttgttactctttatagcaaggaaatggctg

SEQ ID NO: 9715 - DNA, 616 bp, Zea mays
  unsure (1)..(616): unsure at all n locations; Clone ID: LIB3279-199-Q1-K6-D2
ccgcatccccggctgaggcagcagcggcggcgccggcaccggcaccggctcaccagcgataccgggaagaatggggaggtacagtcccgcgtacagccccccgaggagaggacatggcggcaggggaaggagcccacctcccaggagaggatatggcggtggccgtggtgaccatggctctgtcagcctcctggtccgcaacattccattgagatgcaggcctgaggaactacgtgtccctttcgaacggttcggccctgttcgggatgtttacctgccaagagattatcacactggggagccaagaggatttgggttcgtggagttcgttgatgcttatgacgcttctgaggcacagtaccacatgaatcgccagatgtttgctgggcgtgaaataactgttgtacttgctgcggatacacggaaaaggcctgaggacatgcgtagacgaactggaccaagaggttattctggtcatgaagggcgtcgtccgaatcgtcatggtgcaggacggtcccgatctcgttcatactcgcgttcccgctcaccgcgccctcgtggtcgtggtagatcacagtcatactcccctgncccgaaaagcgtgatgactactctg

SEQ ID NO: 9716 - DNA, 685 bp, Zea mays
  unsure (1)..(685): unsure at all n locations; Clone ID: LIB3279-199-Q1-K6-D3
gaaaaaaacagttatgcaggcccagatactgctgtacagaacaaagagaacgagttagtccagaacagccgcaatgagtaccttaaactgaaagcaaaggtggataatttacagaggactcagaggaatttgcttggtgaagatctgggttcacttggtgtcaaagagcttgatcagcttgagaagcaaattgattcatccttaagtcacataagatccacaaggacacagcatatgcttgatcagctcactgatcttcagaggagggagcaaatgatgtgtgaagcaaataagtgccttagaagaaagctggaggagaccagcaaccaggtgcatggccaagtgtgggagcacggtgccaacttattactcggctacgagcggcactcctcgccacagcaagccccatcacatgttggcaatggattattctttcatcccctggaagctgcagcagagccaaccctgcagatcgggttcgctcccgagcatatgaataacttcatgccggcatggctaccctgaagatggatctttgaggcaaagggaataaataaagatgcgatggcagaatcatattgtactgcaagagtgacaattgtgtgttccactcacatatatgacctagttttgtgtgtctatatgtcgaaaccatatgtctgngatttatatatatgtatgtaag

SEQ ID NO: 9717 - DNA, 471 bp, Zea mays
  unsure (1)..(471): unsure at all n locations; Clone ID: LIB3279-199-Q1-K6-D4
cacagnagggaagtatagagagagggagtagcggcaccggagcctggaggggagatttcatttggcgcactagggagtggagagcgatagagttggaaggtggaatcagaaatccacggcgaatacagggactagggggatctggagctcctgaggaggaggagtaggtaggagctgtaattgtaacggttggcagagggggatcctctcgatctgttcttgagctggaagactcccatcttttgagccgcggagccggagaaacttggatctcgaggccctccaagagaaaccgtttctcgctgctagcctcctgcattgctgcctctcccccctcacacccgacctgcccacaaggagaagggtggaatctctgctcgccttccccactaatcggctcagaatctgggttccttgacctgttcttgggagcgctgtgcctcaaatcttgggggggggggggnggggggg

SEQ ID NO: 9718 - DNA, 640 bp, Zea mays
  Clone ID: LIB3279-199-Q1-K6-D5
cttcggcatcgacgagggcgaaccctagcgccggagtcccgctccctcctcccacgacccatggcgtcggatatggcgtacgcgccgccgatgaaggcgggcaaggccgggttcgaagctggcatgatggatccgcagcacaggatccgcatcacgctctcctccaagagcgtcaagtacctcgagaaagtctgcggggatctggtgaagggcgccaagggtaaggagctcaaggtcaagggccccgtgcggatgcctaccaaggtgctccacatcaccaccaggaagtctccctgtggcgaaggtaccaacacctgggatcgctttgagatgaggattcacaagagggtgatcgatctcgtcagtacaccagacgttgtcaagcagatcacctcaatcaccattgaaccaggtgtcgaggttgaggtgactatcagtgacgcttaatatggtagccttatcatttcaaaaggcttctagtgaacaggatattttcaattcctagtgagaacttgtgtaacagaggaatccaagtatttcatatcaaagtttaaaagtcttatacagggttcgcggtatggatgtatcctgtttcaaatgattcctcctaatgtatgaatgaaaacggttaatgaatgcc

SEQ ID NO: 9719 - DNA, 428 bp, Zea mays
  unsure (1)..(428): unsure at all n locations; Clone ID: LIB3279-199-Q1-K6-D6
tccgcttatatcccttcaagcaagggaccgactgtgnattaccgggcgctnngtctcctaaagnaaaactacacagnatnncctgcagtacgaacgtcggtggcttgatnntaatcggctagctaagctggnnttcagatcggtcgcttgatcagggttgtttacgtggngatctgcgtagttttcatttagattccatagagcgtgggtggaaccacacttatgacgacgacggagtatgttcttgggccttttcttttactgttttctagccttttctcccaagtaaagcttgggggtacgtagtagatccgcttgtgcaagttgcatgttgtgtggaaaaataattgactccagtaatcctatgtcacatacatgtcataaattgtatcgctatctctaacatagcagatattttaagttcccaa

SEQ ID NO: 9720 - DNA, 218 bp, Zea mays
  unsure (1)..(218): unsure at all n locations; Clone ID: LIB3279-199-Q1-K6-D7
gcgttcggttcgatgtatgtaaggctgcgagnagatagttcagaattggtatgtgtggtcatggactcatggtacttactgnttccttctttctttctgatgtttctggttctagtgacctttttccagtgacatctgtaagactgataacatatagattctgttgtgaagcacgtatcggttactgatgattatatttactgtttactttcgagttc

SEQ ID NO: 9721 - DNA, 630 bp, Zea mays
  unsure (1)..(630): unsure at all n locations; Clone ID: LIB3279-199-Q1-K6-D8
cgtccgccccgcgnccggctgctcgntgccggctgcccccgcccactccaccgctgatatttgtcatcgtctcgttcctgccctcggccctcccctcgctcgctccccaactctagcaggcagatcagatacatccattcgcggaccggaagtaatcatcaggaaaggaaggggcgttgaactatgagcgccgtggcggtttcgtcgtcgctgaacccggacgcgccgctcttcatcccggcggcgctactacaggtggaggacttctcgccgcagtggtgggacctcatcaccaccactgcctggttccgcgaccactggtcccgcgagcgcgcccacctggacgagatggccgagcagatcgacgcggccggcctcctccccgacgacgaggacctcttctacgacgaccagctcgagcagggccccgtcgccgccgcccttaagacagattcggtgctcaaggcgctgaacatgacctccccggagggcggcggcgacgccccgcggtggttccgggagaaacccaggaacgccgggaagccgaccaagtacgccggctgccccaagagcagcgccccccgcgtgatccaccagcctcgcctgggtcgctggggggactcatcagga

SEQ ID NO: 9722 - DNA, 654 bp, Zea mays
  Clone ID: LIB3279-199-Q1-K6-D9
gctttccgtaaagctccgcgcctcctcctcgtctcttcactccaaatccaccgaggccatcgcctgggccccggggtaaacccctcgcgctcgtggccctgtgagcagccgcagccatggcgcagccgctcgtcgtgaagaaagacgacgatcatcgacgaggtaagagtactactcgccattcctgggcatagagaaggaccgcattgctgcaggaggcccgagtcttccatgaccctcagcttgacgcgcggcgatgctgccaggttatcaccaagcttctgtacctgctcaaccagggtgacacctttaccaaggttgaggctacagaggtcttctttgcaacgaccaagctgttccagtctaaagatgcgggccttaggaggatggtgtacctcatgatcaaggaactctcaccttcagccgatgaggtcatcatagtaacaagctctttgatgaaggacatgaatagcaaaactgatatgtaccgtgcaaatgctattagagttctttgtcgtattattgactcaacccttctcacccaaatcgagaggtatttgaagcaagccattggtgacaagaatcctgttgttgccagtgcggcccttggtagtggcatctacttgcttcaaaccagtcctgaagttgtaaaaa

SEQ ID NO: 9723 - DNA, 489 bp, Zea mays
  Clone ID: LIB3279-199-Q1-K6-E1
caccgccataccagcgcgacagcgattccgtcgagttagaccaagcgagagagtagtctcagacgagaagaggtgaatatgagttccggcggcggcaggggcaagcccaaggggtccaaggctgtgtcgcggtcgaccaaggctgggctgcagttccccgtcggccgcatcgcgcgctacctcaaggccggcaagtacgccgagcgcgtcggcggtggtgcgcccgtctacctctccgccgtcctcgagtatctcgcggcagaggtgttggaactggcgggcaacgcggcgcgcgacaacaagaagaaccgcatcgtgccgcgtcacatccagctcgccgtgcgcaacgacgaggaactcagcaagctgctcggagctgtcaccatcgccgccggaggtgtgttgcccaacattcatcagacgctgctgcccaagaaggccggtgggaagggcaaggccgacatcggttccgcatcccaggagttctaa

SEQ ID NO: 9724 - DNA, 633 bp, Zea mays
  unsure (1)..(633): unsure at all n locations; Clone ID: LIB3279-199-Q1-K6-E10
cggngnatggggaattcgttcaggcgttgaggatcacaggccacaacggatttccagtggtcgatgagccacctctatcagaggctccagaacttgttgggcttgtgctcagatcccatctgctggtcctgctgaaaggtaagggctttatgaaagagaagatgaaaaccagcggtagcttcgtgctggaaagtatttggtgcctttgtattttgccaagccaggctcagggaaaggcctgtagattgaggacctggatttcactgttgaggaaatggacttgtatgtcgatctccatccaattacaaatacatcaccgttcacggtggtagagaccatgtcacttgcgaaggctgccgtccttttccgggcactgggactcaggcacatgctcgttgtgccaaagaccccagggagacctccaattgttggaattctgacgaggcacgatttcataccggagcatattcatgggctgttcccaaatatacacaagtcacactaatggaacactcaatcagtccatatcttttcttttcttttttgccgtcgccttgtaggttgtagctagcttgtcgaaaacgaagctacttttgtccaatatttgctatcggccatctggccttttctttt

SEQ ID NO: 9725 - DNA, 486 bp, Zea mays
  Clone ID: LIB3279-199-Q1-K6-E11
agtacgtgaggagggtccgtgttcgtggtggtaatgtgaaatggagggctcttccccttgatactggtaactactcatggggaagtgaatctggtgcccgcaagacccgtttcctcgacgtggtctacaatgcatcaaacaatgagcttgtgaggacacaaacccttgtaaagagtgccattgtgcaagttgatgctgccccattcaagcagtggtacctcactcactatggagttgacattggtaggaagaagaaaacccctgctgtgaagaaggattatgctgagggacaagaggttgcggcagcagctggggaaacgaaaaagagctccatgtcctgaggtatcttgtgaagctcagggagggacgtccccttgaccaacactttgaggagcaatttggcaggggacggtttcttggcctgcattgcttcccgccctggacatgttttccttgctgttgggatcatccttgtgggttaagagc

SEQ ID NO: 9726 - DNA, 559 bp, Zea mays
  unsure (1)..(559): unsure at all n locations; Clone ID: LIB3279-199-Q1-K6-E12
ctcgncgacacctgcagngccaagntgcatcgactcctccccggtcctccaccgcccgccgccgatggatgtggatgtggacgaggccaccgccacccctgccttcgcctctgccaagcccgcttccaactgcgaggccccctccggcgcccgcgaggtggatgtcngctaggagtacacggtcgccggcgttctgcgcagcttcgtcgacggggtctgggtcccggactagccgctgctccggcggctccgggcggcgtccctcgaggccgcgccgcggctgcagggggcgtctcggaactcgtgcgggatctgcncgagtggacaaggcaggcagcggcctccgcgccatnntcntcatctcggtgggcacgcgcctagtggatccgntacataagcacgggtttngtctgccctgtttactgaatcaatctttaacaatctacgacctcgaacaggtaaaacagggaaataggattggtacttgatcgggggcgtctaatacgtggccattgtagtgtcggagattcttatcggtgtttttttcaaaacttattta

SEQ ID NO: 9727 - DNA, 622 bp, Zea mays
  Clone ID: LIB3279-199-Q1-K6-E2
ctcatttctcccgagcgccgccgcgagcctctgttccagcttcgttcatggcttccctcaccggatccgctctctcctttgcgaggcccgtcaaggcaatcagcattaagtctgtctctttctctggtctaaggaaggataatgtagccttccgcttgcagccagtgccacaaagattcgctgtctgctgtcctgctaaaaaggagactgtggatcgggtttgtgatattgtcaagaagcagcttgcacttcctgagggcactgaggtctgtggctcctctaagtttcaagacctcggtgctgattcgttggacactgttgagattgttatgggccttgaggaggctttcaagatcactgtagaggagtcgagcgcgcagtcaatcgcaactgtggaagatgctgctaatctcatcgacgaacttgttgcaggagcagcaaaatcgtgttaaactcgtggtcgtattgcgttgggtgctgtaccagggcatcacttgttgttctatgcccccttccctactagattttcttttctaccctgggcctggagagatgtttctgtcatgactgtcattgtggatctcgcgatattgttatattgaagcttttgtgcttgttcaag

SEQ ID NO: 9728 - DNA, 679 bp, Zea mays
  unsure (1)..(679): unsure at all n locations; Clone ID: LIB3279-199-Q1-K6-E3
caacattcagcatccttatagaccacttcttgatgccatgcaaaatcttggcatcaatcaaaaagaagtgaaacaagtagcatggaactttgtgaatgactggcttaaaacaacattgtgtctacagtataaaccccagtacatagctgctggttccctttatctggctgcaaagcttcacaatatcaagcttcccttgcatggagcgcatgtttggtggcaccaatttgatgttgcaccaaagcctctggaagccgtcattcatcaaatgatggagcttgcggctttgaaaaagttgatgcctgctcgacccaatccggttaagctgaaggaaactttatgtgaagctaaactgagcttatctaatagcccagactctgtgttgaatcaatcaagcttgttaataagcagctcaagtcctgatattggcgagcccagtgacaaagtgcaggtggattcctgccaatacttgataagcagtcacatgggtgattgtagggtctcaggtcctgacagcagttcgttgaatacttgtgctaatagaaatgtctcttgtaaagcacatgatgaagagagcttggatcaggccttaataatcaaacatgacagtgggatgatgccttctagtaatcagacatcattatatgctactgntagcactgagggcagtgctgaactg

SEQ ID NO: 9729 - DNA, 468 bp, Zea mays
  Clone ID: LIB3279-199-Q1-K6-E4
aaacagtgaaatgcctgacttagacattgttcatgttgtagattccgtttcaatatccttaatgcattatatgtatatgaactttcatatttgacattatctatttgttcatcccttgatggtagtcccattatagtactccaatactctttttttaagaacaagaagggccaaagccctataatactctaatctgactatctgtagttgcaattaaatcattttagcacacaactagatacactgcaatatttattttggatgataacccaattagatatgacgtctaagactatatatattatcgctttgtaactaggtacaatacatgtatatatagttaacctttacatctatctgcttcctaaagataacttatcattacgatttacaacacatattttttatgatgtacaacttgaacaggtaccaaaattgtatatataccattaacaaaaaagaaacatc

SEQ ID NO: 9730 - DNA, 581 bp, Zea mays
  unsure (1)..(581): unsure at all n locations; Clone ID: LIB3279-199-Q1-K6-E5
gctcttgattcatccttaaggcacataagatccacaagnacacaacatatgcttgatcagctcactgatcttcagaggagggagcaaatgctgtgtgaagcaaataagtgccttagaagaaagctggaggagaccagcaaccaggtgcatggccaagtgtgggagcacggtgccaacttactcggctacgagaggcactctcctcaacagcaggccccatcacatgttggcaatggtttgttctttcatcccctggaagctgcagcagagccaaccctgcagatcgggttcgctcctgagcatatgaataacttcatgccaacatggctaccctgaagatggatcttgaggcaaaggaaataaataaagatgcggtggcagcatcatactctatgcaagctaagagtgacagctgtgtttcagtcacatatatgatctagtctgtgtgtcaatgtgtcgaaaaacatgtctgtgattttgttatatgaatgtaacgcgcaatgaaacatacaggactagctgcttgcttgacgatgcgtttgcgtgtatccgtataaattaaaggctataagccacatcgt

SEQ ID NO: 9731 - DNA, 413 bp, Zea mays
  Clone ID: LIB3279-199-Q1-K6-E7
gcgttcgcccacgcgtccgcggtcgcgtgggcgaggatgagctacgtgatgctgtgctgcttgttttcgccaacaagcaagatcttcctaatgccatgaatgctgctgagatcactgacaagcttggattacactccctgcggcagcgacactggtacatccagagcacttgtgccacaactggcgagggtctgtacgagggcctggactggctgtccagcaacattgcgagcaaggcttgaatatcaaatgcgaactgactaggagctccggatgtatcatggaaacttaggacagaatcgcctctacaacctgttaggtgtcttctaccggcacaatatattttttgtttggaatatgtaatgatgttacggttcaacgtttattctaccctactatactgttggatgttc

SEQ ID NO: 9732 - DNA, 644 bp, Zea mays
  Clone ID: LIB3279-199-Q1-K6-E8
gctggcatcattgtcatctgtttggatgaacttctccagaaggttatggtttgggatctggtatttctctgttcattgctaccaatatctgtgagtaatatcatctggaaggcatttagccccacaaccatcaacagtggtcgtggtgctgaattcgaaggggctgtcattgcactgttccatctgttgattacgagaaccgataaagtccgtgctcttcgtgaggctttctaccgccagaaccttccaaatgtgaccaatttgcttgccactgtcttggtattcctcatagttatctatttccaaggcttccgtgttgtgcttccagtgagatcaaagaatgctcgtggccagcaaggctcatatccaattaagctgttctacacttcaaacatgcccatcattcttcactctgcgctgattaccaacctctattttatatcccagcttctctacaggaagtacagtggaaacttccttgttaaccttcttgggaagtggaaggagtctgaatactctggccattctattcctgttggtggtcttgcttactatgtaactgccccatcaagtttggctgatgtccttgcaaatccattccatgcactgttttatgtggtcttcatgctgtcagcctgtgctct

SEQ ID NO: 9733 - DNA, 619 bp, Zea mays
  unsure (1)..(619): unsure at all n locations; Clone ID: LIB3279-199-Q1-K6-E9
tgctttcanaaaactgttgcatgctgctgtacggaggaagtctgttaacatggttagatttctgctgagatacaaaccaaataaaaactcgaagggaactgcacaggcatacttatttagacctgatgctctgggcccttcaaagattacccccctccatatagcagctgccactagtgatgcagaggatgtgttggacgcgcttacccatgatcctggactgattggaattagtgcttggagcaatgcacggtacgaaacaggttttaccccataagactatgcttggttgagaggcaatgacgtttacctgaatttggttcaaaagaagattgacaagcattttggtgaaggccatgttgttcttggtgttccgagcagtttatgccctgttataaccgttggcgtttagcctggcgatgttagccttgtgtatctgcagggcaatgtctgcatcagtgccgggttgcctcctctgcagccgttaggcacggttgtattcaaattctacggtgaggacctttctttataggccagcaatgttaactgtgatgggagtcgctgtggtttgtgtctgcgtgggcatacttctccacaccttttccaggtttatgccgct

SEQ ID NO: 9734 - DNA, 635 bp, Zea mays
  unsure (1)..(635): unsure at all n locations; Clone ID: LIB3279-199-Q1-K6-F1
ctccgctcaccttgcctcgatcgttccaggagtaataaaacactaaaatggcgatggcggcggcgaggagagcgctcctggcccacctccgcgtgccggtggtccaccctgcagcggcggcagcgaccatccccgcggcagggcggctcctgtcgtcgacgacggagagaaagggctcgttcctcgacaagggcgaggtcgctgaccgtgtcgtctccgtcgtcaagaacttccagaaggtcgaaccctcaaaggtgacacctagtgctcattttcagaaggaccttggacttgatagcttggacactgtggagatcgtgatggcgtttgaggaagaattttcctttgagattcctgacaacgaagcagagaagattgactccatcaagacagcggttgatttcattgcttcgcatcctcaagcaaaataagaggatttcttttttttcgtatttcaaagtgtgttttgcatccagaacttatgcgacacgggactagttttctctagcttgccgcagtagataggaagtcatttctttacctttctgaatccgcgtgtaccaaacgattgttgtgttcttgtgacctcattggtacgctaatccataaatccatttgggcttnctttctgcttc

SEQ ID NO: 9735 - DNA, 418 bp, Zea mays
  Clone ID: LIB3279-199-Q1-K6-F10
cccagcgtccgcgtgaacccgccgccgacgcagcagcaggagacgcgccaaggagagcccgcaggaggcgactatgagggccaagtggaagaagaagcgcatgaggaggctgaagaggaagcgccgaaagagaggcagagatccaagtaggctgatggggattgtggatggtggtgtcggcatagttgtgttacgtttcttcgatgcgtgagttcatggagagatgtcacatcctagttcgtcgtcaccgtttgccatgggtccaatggctcgtcttggaaacctgcacttcagtaggccatctatcgtggtttctagctatatccagagttttgtgctaagacaaatcagtcagtcgttttgtgaacctattatgatggagctttatttgctgctaatatcgacctacctattaagt

SEQ ID NO: 9736 - DNA, 55 bp, Zea mays
  unsure (1)..(55): unsure at all n locations; Clone ID: LIB3279-199-Q1-K6-F12
aaaaaaaaaaaaaaaaaaaaaanaaaaaaaaaaaaaaaaaaaaaaagaagagaga

SEQ ID NO: 9737 - DNA, 641 bp, Zea mays
  Clone ID: LIB3279-199-Q1-K6-F2
attcgcgaaggtgatccagtgaatgaaatgctcttcatcatgagaggaacactagagagtaccacaacaaatggtgggcaaactggtttcttcaactctaatgttctaaaaggtggagacttctgtggtgaagagctcctcacgtgggcccttgaccccacttcagcttcaaatcttcctggctcaactaggacagtgaagacgttgtctgaagtcgaagcttttgctctgagggctgacgacttgaagtttgttgccacacaatttaggaggctccacagcaaacaacttcagcataccttccggttttactcacagcaatggaggacctgggctgcttgcttcatacaggcagcttggcacagatactgtaggaagaagctggaagaggctttatatgagaaggagaagaggttacaagcagcaattgtaagtgatggcactacttcgctcagtctcggtgcagcgctctatgcttcacgttttgctggcaacatgatgcggatcttacggagaaatgccaccagaaaggcccgtttgcaggaaagagtacctgcaagactgttgcaaaagccagcagaacccaacttcttcgctgaagatagctgaacttgtaccctgtagcaagcagggattcatgg

SEQ ID NO: 9738 - DNA, 648 bp, Zea mays
  Clone ID: LIB3279-199-Q1-K6-F3
cggacgcgtgggtggcttctcctccccctcttaccaagtcctcttcgggttagggttacttagggttttgtggaggggcgatggcggcggctgatgtggagtaccgttgcttcgtcggcgggcttgcctgggccaccagcaacgagtcgctggagaatgccttcgcctcctacggcgagatcctcgactccaaggtcatcaccgaccgggagacggggaggtctcgcggcttcggcttcgttaccttctcctccgagaactccatgctcgacgctatcgagaacatgaacggcaaggagctcgacggccgtaacatcaccgttaaccaggcccagtcccgtggcggtggcggtggcggcggtggctacggcggcggtcgcggcggcggcggctatggtggcgggcgccgtgacggcggttatggcggcggtggcggctacggcggtcggcgcgagggtggtggcggcggctacggaggcggtggcggctacggcggtcggcgcgagggtggtggtggcggctacggcggcggcggcggcggctggagggactgatgtgtgggcccatcctggcttcggccgagttatcttatctatctatagtatcgtgttaccgttcgcttctgtcaccgtgttagtgtccgttcta

SEQ ID NO: 9739 - DNA, 322 bp, Zea mays
  unsure (1)..(322): unsure at all n locations; Clone ID: LIB3279-199-Q1-K6-F4
ttatctacctcgttgcgagcccgtcgaagagcagctcaaaaggaagcaagaagagacgttgatctacttatagttcggcgcagttgaagttgtagctggtggtttttgcctggaggaactcttggtagtttgagctgagcgaaagctttaaattttacatttactcaccacaccatgaactgcaacgaagtgagcatctgttagaaaagtggaccagtaattttggttggttatttatttcctgtttctctgtcagactcttaactcggaggacctgtaactaggaaagttacttttgcttgaaagaacattttggtnaaaa

SEQ ID NO: 9740 - DNA, 582 bp, Zea mays
  unsure (1)..(582): unsure at all n locations; Clone ID: LIB3279-199-Q1-K6-F5
gtggtaggtgaggaaacctttgcttggctttgattagaaaacggattgatactcagactgggaataaaagagttcaagctgagctagtgtaaactacgcatctggaggtgaaagctatagcttcaggatctcattcagagtagcagagtggagcctgagctttggattgctggaatggaaataacctctgctgtggactgctgggatctacctgcaagcctacgtggccatactccagaaccctgatacccccacttccttttagagcttgttaatttgagatttttgagttactcttttgtctagatcgtagtttatttttgcttaatcttttgtttggtcagttgtttgttagggctgttgatttgtatagattcagactacatctcttcgggcttgtggatttcgatagacttgttgtacattgacatatgctggtctcaaatgaggatgataggttcttggtcctaacttgtgactagttgattgtgcttcttgtgaattccatctgatgtccagaaaaaaaagtccttgggttntgttgtctaccgaacgtttgtaatgtctgcgattctggagcca

SEQ ID NO: 9741 - DNA, 597 bp, Zea mays
  unsure (1)..(597): unsure at all n locations; Clone ID: LIB3279-199-Q1-K6-F8
agctgnccatgcggcaaagcctgtgttcgaccggttttctgtgattttcacaattgcgattgtatggctgtatgcgtacattctcacggttagcggtgcctacaagagtgcccgaacaaagacacaactccattgccgtgttgaccgctctgggcttgttggtggagctccttggattagtgtcccatatcctttccaatggggggccccaacatttgatgctggtgaatcatttgcaatgatggtggccgcatttgttgctcttgttgagtcatctggggccttcattgctgtgtcaagatatgcaagcgcgactatgatacctccttcagttcttggtcgtggcattggttggcagggcatcggtactttactgggtgcgttttttgggacagctaatggaactgcagtgtcagttgaaaatgctggtctgcttgctttgacacatgttggcagccggagagtagtccagatatctgcaggcttcatgatcttcttctctgtccttgggaaattcggggcgatctttgcttcaatcccactgccgatattcgctgccctgtattgcattctctttgcatacattggtgcttgtgg

SEQ ID NO: 9742 - DNA, 71 bp, Zea mays
  Clone ID: LIB3279-199-Q1-K6-F9
cccacgcgtccgccccgcgtccgcccacgcgtccgcccacgcgtccgaataatgcatatttgcaaaactag

SEQ ID NO: 9743 - DNA, 393 bp, Zea mays
  Clone ID: LIB3279-199-Q1-K6-G1
cggtcgcgtgggcggacgcgtgggcaagcatttaggatacacggatgtaaactagaggccagtatacattgaacactcaccggaaccaaaagaaaagggagtactactagtcgatcacagtcaatatctgaacatgtagtttgtatatctctgcactcaattaatcctcatacacaaagaggacatgaagtattacatatttatgaagcgaacctctacaaatcgcccgtgtggataaatatgaacctagacatttgaaattagaattttgtttttagatagaatatctcatggatacgtaacccactaaatttccgtcgtgtgcatcaatataggatacgtattgaattgaatacgtgatacaatacctacccggggtatcggggtaacact

SEQ ID NO: 9744 - DNA, 507 bp, Zea mays
  Clone ID: LIB3279-199-Q1-K6-G10
cctgccgtgccgcagcattagaggtcctgtgtctcgtaggtggacatattctccgcgtgacttcaggtgtcgtcgccgagttgtctccggccgagggcggcggcgcgaccggtaaccagcgtcagcgtgagtgtgacaggcgacatgactcgcggtaaccagcgtgaccgtgatcgtgagcgcgcggtggcgcgtgaagcccaacggcaaggggccccaggacgggctcaccccggagcagcgccgtgagagggacaagaaagcgctggaggagaaggcggcgaagaaggcgcagcaggcagcggccggcggcaccgggacctccacggacaacaagaataaggcaggtggcaagaagtaggccgcagcggcgagcggcgccacctctgtacgattatcgatccatgcctttagcttgtaacctgttcgcatcctcgtagatgcgatgcttgttgggtcataaactcgttttctgttactctgatatcaaaatttggtgatgaaaat

SEQ ID NO: 9745 - DNA, 457 bp, Zea mays
  Clone ID: LIB3279-199-Q1-K6-G11
ccggtccggatctcgggtcgcccagcgtccgcaggtgcccgcggggcccggtagatggtagacataagccagtggcactattggcctcgagacggcgtagaaaagtcaggaccttgagaacatggctagctcaatgatatgacggtgccggcggggagacacttggacctgtgtagagttggcgcactgccaacggtgaggaccctaggaccggcgccctgagaagacgtccgagaggcttagagcccgtatctcttgcatactacagctttcgcgggactctcattgtttgtttgttcagcgtagtctcacttactgctatacacgccaaccttccatagccacagaacttacttatattatatcgggtgcctcggcccgtgatgggttgtgagaaaactgaaggcttcttccttttgtcggttgtttgagtgtcccatgagagctattcacctcg

SEQ ID NO: 9746 - DNA, 458 bp, Zea mays
  Clone ID: LIB3279-199-Q1-K6-G3
ggcgatccagaacgtcctggtgatccttgagatggtggtgttctccgtcatccagcagtacgcataccacgtcgccccctacagcggcgctgacagggccaagtttgagaagaagaacgaatgaaccaggtttccaaaaagaatgaaagaaggaaaaaaactctctgctttctggtcgctcggagatggagcaccagtatttcctcacggatggacgacatacacaagttcatcgagtctcgcgagtagcgtatttggtagcgagttgtcgcgctgtaaaattacactgtccttgcgcgctgaataattttgctggctttgtcgttttggttttttgaacgttgtcgccgaggctatatagccaggactgttcgtcttgtacgagcgcgcgcgctctctctctctctctctgcggacttggcgaatccttttatgaataaaagctactgtcctgttct

SEQ ID NO: 9747 - DNA, 649 bp, Zea mays
  Clone ID: LIB3279-199-Q1-K6-G4
ggatgacattaaggtcttcgccgcggtgccgtcgaagcctggcgctgagtttcctaatgccgcccgctggtacgagaccgtctctgcggctgtagcctcaagattccctggtaaggctgttggtgtaaatctgcctgcgggatcagctcctgcggcagctgctcctgcggatgaggctgaggatgatgatgaccttgatctttttggtgatgaaactgaggaggacaagaaggcagctgatgagcgtgccgccgctgccaaggcctcttctaaaaagaaagaaagtggtaaatcctccgtccttatggatgtcaaaccatgggacgatgagactgatatgaagaagctggaggaggctgtccgcagtgtccagatggagggtctgacttggggagcatcaaagcttgtgcctgttggatacggcatcaagaagatgactatcatgttgacaattgtcgacgatcttgtgtccatcgacactctaattgaggaccaccttacgcaagagcccatcaatgagtacgtccagagttgcgacattgtggctttcaacaagatctagagttcagtttctgagattgggcaacggcagcggctcagctcgtcaagtttgtgctgggatgccagtttatcccttctagtctattac

SEQ ID NO: 9748 - DNA, 649 bp, Zea mays
  unsure (1)..(649): unsure at all n locations; Clone ID: LIB3279-199-Q1-K6-G5
cggtcgcgtggngaaagatggtgttgtccttgctgttgagaacgtgtgacctcgccactgctggaaccaagcagtgtggaaaaaatatggaaattgatgagcacataggctgtgccatgagtgggcttattgctgatgctagaacactagtcgagcatgctcgtgttgaaactcagaatcataggttctcatacggggagccaatgaccgtagaatcttcgacacaagctatctgtgacttagctctgcgctttggcgaaggtgacgaagagtcaatgtcacggccatttggagtctctctcctaattgctggacacgatgagaacggacctagcctgtactacaccgacccatctggcactttttggcaatgcaacgcgaaggcaattggatctggctctgaaggagctgatagctccttgcatgagcagtacaacaaggagctggcccttgaggaggcggagaccatagccctttctatcctgaagcaggttatggaggagaaggtgaccccaaacaacgtcgatattgccaaggttgctcccaagtaccacctctacacccctgccgaggtcgaagccgtgatcgcgaggctgtgaaacgctttcggagctcgtgttattcatgtcatcaatcggtaatagacgat

SEQ ID NO: 9749 - DNA, 343 bp, Zea mays
  Clone ID: LIB3279-199-Q1-K6-G6
tttgtctacctgcgcaggcgctctagttgcccccggtgttgctctactttacgtctccacgggactcgccgtatggtccctagtggtgtacatgagaaagattggcgtatactgctaaaatagtattagcacaatatatatatatatatagtgtaatagaagaaacaagcaaggcgagggtgcggtcgtgatcgtacaacttttggaaggctgtttagttgattgggtggcctgagccctagagctggttgggatcctcattcctctgtaacttgtgcgtcagtttttggtggatttgccgctaaatttgctgaggcatgccaggatcctattagatttttag

SEQ ID NO: 9750 - DNA, 631 bp, Zea mays
  Clone ID: LIB3279-199-Q1-K6-G8
gcatcaccacactcaccgcaccaccgaccactgcctccgtacgcgtccctctggcggaaaatcggtcctagtgccgagctcgttttgtttggatcttctgtatatctattaaggaggcttctccatctcctcggagcagcaaggctgtgcagcaatggagaagtataacagcaacactcaatttgcaccattgagagagactccgtttgccctccgtggtgctcttggtagttcaagctcatatcttgagcaagccaggggctacacatcttcccctgtagcagctctgcgcccaaagatgtctacacctggaaatcgactcctgcatacgagctgccccctgtcatctgctgtagcaaaccgcccgctgtcgccccatcttcctctgaagaagccacagttcagcgctactttctctatctcgcaccgtatcttcggtgtcgcgctgggagttgccatcatatccgtccccctcgccaccaagttcagcctgatgtttggcgtttgagagcgatttgctgcatcttatgaggaactgcatttccccgttcctgtgactgtttcatcgttcgtctgggttaccttgcaacacaactttgggtgcaattggaataacatcttttgtctgctg

SEQ ID NO: 9751 - DNA, 631 bp, Zea mays
  Clone ID: LIB3279-199-Q1-K6-G9
ccccgcgtccggccaccacagccgccagcagtccatcaccggttccgttcgaatgggccgcaagggacgcaaggctagggtttcgcgcgacgccgacgtcgacggcagcgaggatgagatggccgccgctcctgccgccgctgcgggcaggagcctctacgagatcttgggagttgagaagactgcttcacaacaagaaataaagaaggcatatcacaaattggctctgcgcctccatccagataagaatcctggggatgaggaagccaaagagaagtttcagcagctgcagaaggttatatccattcttggagatgcagagaaaagagctttatatgatgagactggcattactgatgatgatgcactggtgggagaagctgcaaatgatcttcaggagtacttcagaacaatgtacaagaaggtcactgaggctgacattgaagaatttgaagctaaatacagagggtcagattctgagaaaacggacttgaaggaactctacacaaaatataagggcaacatgaacaggcttttctgcacaatgatttgctcagaaccaaagcttgattcccaccgcttcaaggatataatcgatggggcgattgctgaaggtgagctgaagtcaact

SEQ ID NO: 9752 - DNA, 689 bp, Zea mays
  unsure (1)..(689): unsure at all n locations; Clone ID: LIB3279-199-Q1-K6-H1
ccccgcgtccggaacttgctgaagagctcctgttgccactcgctgcagttaaatactcccgtggaacgttcatattccctgaagcacagccttccccacacaagaacttcgctgacgaggttgccttcctgaatcgcttcttcggtggcctcaagtccggtggcaatgcttatgtgattggtgactctgcgaagcccgggcagaagtggcacgtctactacgccgctgagcaccctgaggagcctgtcgttactctggagatgtgcatgactgggctggacaagaagaaagcttctgtcttcttcaagaccactgctgatggttactcgctgtgcgccaaggagatgaccaagctctctggtatctcggacatcatcccagagatggagatctgtgacttcgacttcgagccctgtggctactccatgaatgctgttcatggccctgctttgtcgaccattcatgtgaccccagaggacggcttcagctatgcaagctacgaggtcatgggcttcaacccgggctctttctcttatggtgacctggttaagagggtgctgaggtgctttggtccaactgagttctctgttgccgtgaccatcttcggtgatcgggacaatgcgaagacctgggggacgaaactggatgctngagcctatgctttgcagcacatggttgagcaggtgctg

SEQ ID NO: 9753 - DNA, 603 bp, Zea mays
  unsure (1)..(603): unsure at all n locations; Clone ID: LIB3279-199-Q1-K6-H10
ngaccgattccctgcgattcctctcccctcgcctcctcgtctccccctaggggatcgtcggagaggaatcgcaaagaggccgtctcatccgagttaaggaagccatggagcacaaggaggctgggtgccaggcccccgagggacccatcctctgcatcaataactgtggcttcttcggcagcgcggcgaccatgaacatgtgctctaagtgccacaaggagatgataacgaagcaggatcaggccaagctggctgcctcctctatcgacagcatcgtgaacggcagcgacgccgtcatggagccggttgttgctggcagcaacacggtagtagctgttgcccaagtcgagttgcaaacaatgaacgtgcagcagcccgctgatgttgccggacccagcgagggggtggcggcgatctccaaaggggggaaggtagggccgaaccggtgcagcgcctgcaggaagagggttgggctcacgggattcaactgccgnggtgggaacttggactgcgcgctccaccgctactccgacagcacgactggaagttcgactaccggactgctgccagggacgccattggcaaggctaatcccgggggtga

SEQ ID NO: 9754 - DNA, 184 bp, Zea mays
  unsure (1)..(184): unsure at all n locations; Clone ID: LIB3279-199-Q1-K6-H12
aacgagaaaaaaaaaaaaaannannnaaaaaaaaaaaaaacccccacaaannaaaaaaaaaaaaaaccaaaaaaagggtggtaaattttgtgttttttctctctcttttttttttttttttttgttttttttttctatttccaccaccccaaaaaaaaaaaaaaaaaaacaaaaaanacaacac

SEQ ID NO: 9755 - DNA, 553 bp, Zea mays
  Clone ID: LIB3279-199-Q1-K6-H2
ggcggtgcgggcggtacaaggagcaggcggaggaggagctgtgccaagccacaatgggtatctcgcgtgactcgatgcacaagcgccgggccaccggtggaaagcagaaggcctggaggaagaagcgaaagtatgagcttggtcgccagccagccaacaccaagttgtcaagcaataagacagtgaggagggtccgtgttcgtggaggtaatgtgaaatggagggctcttcgccttgatactggtaactactcatggggaagtgaagctgttacccgcaagacccgtatcctcgacgtggtctacaatgcatcaaacaatgagcttgtgaggacacaaacccttgtgaagagtgccattgtgcaagttgatgctgccccattcaagcagtggtacctcactcactatggagttgacattggtaggaagaagaaaacccctgctgcaaagaaggataatgctgagggacaagaggttgaggcagcagctgaggaaacgaaaaagagcaaccatgtcacgaggaagcttgagaagcgcaaggagggacgtaccct

SEQ ID NO: 9756 - DNA, 611 bp, Zea mays
  Clone ID: LIB3279-199-Q1-K6-H4
gggcaaccgttgccgctgtcgaggtgcccaggtcttcatcggtccctcgtcagttcttctccggcccttcgccgccgacaagctcccccagctactgaagagacaggagcaaagagttaacaggagatgaatgcccctgaccgttatgagcgtttcgtcgtgccagagggcaccaagaaagtgtcctatgagagggatacaaagattgtgaatgctgcatcattcactgtcgaacgcgaggatcacactgtaggcaatatcctccgcatgcagttgcacagagacccaaatgttctctttgccgggtataagctccctcacccactccagtacaagatcattgttaggatccacacaacgagccagtcctccccgacgcaggcctacacccaggctatcaatgatctagacaaagagcttgagtaccttaagcaagcttttgaggatgagaagaacaggtacgaggacaggatgaagcaggggttctagatgaatggaatagtgtgggagataaacttcctgtgttagttttatcctaggcgagtcaacaatgaaacgaacgcccaaggattgtgaatgtctgatccctgaactaaggttgcttgctgtca

SEQ ID NO: 9757 - DNA, 546 bp, Zea mays
  Clone ID: LIB3279-199-Q1-K6-H5
gtgggctggcttctcctccccctcttaccaagtcctcttcgggttagggttacttagggttttgtggaggggcgatggcggcggctgatgtggagtaccgttgcttcgtcggcgggcttgcctgggccaccagcaacgagtcgctggagaatgccttcgcctcctacggcgagatcctcgactccaaggtcatcaccgaccgggagacggggaggtctcgcggcttcggcttcgttaccttctcctccgagaactccatgctcgacgctatcgagaacatgaacggcaaggagctcgacggccgtaacatcaccgttaaccaggcccagtcccgtggcggtggcggtggcggcggtggctacggcggcggtcgcggcggcggcggctatggtggcgggcgccgtgacggcggttatggcggcggtggcggctactgcggtcggcgcgagggtggtggcggcggctactgaggcgggggcggctacggcggtcttttctagggtgtggtggcggctactgcggcggctgcggctgctggagggactg

SEQ ID NO: 9758 - DNA, 514 bp, Zea mays
  unsure (1)..(514): unsure at all n locations; Clone ID: LIB3279-199-Q1-K6-H6
ttggnggaaaggtgcgtatggntgtngttaggtgttgttttagatcccagatataaattnaggtttnttnttgtttgntttaaggaagnntttggtagtnatgnnaaatggttcatttttgaagtgtgaggaggggggggggagttttttnttnagtantnttgtnatgttgatnaanaaaatagtgaaagttttgattagagaannaatgatttanagttggatananatggtagnanannagtgnatggganaagtnaaaatttnattgagnaagnagnaaatgaggaaatgggagaagtnattagatannttgaagnagaggttattntttaaaatgnnaattttgatattttgaaatggtggaaggaaaatgnttttgaatatttagtttttgnnaggntggnttgnganatnttagnaattnntggatntgnggtttttgttgaatntgnatttgatgaaanttgatgaagggtgggagtttttaatttgaagttgagtnntgaattag

SEQ ID NO: 9759 - DNA, 619 bp, Zea mays
  unsure (1)..(619): unsure at all n locations; Clone ID: LIB3279-199-Q1-K6-H7
cacgcgtccgcatagggnggatgatgctcttgggttcatgactgcatcggggcttacagtcgaccacccgataatgacgactactgacttctggacctcgcacgagtgccttctcttaccctacgagcaggctcttacccgtgaggattccaccagtggccttttctatgattgttcggcccacatgttgtgggttggtgagcgcactcgacaactcgatggagctcatgttgaattcctccgtggtgttgccaaccctctgggcataaaggtgagcgacaaaatgaaccccagtgagttggtgaagctgattgatattctgaacccttcaaacaaacctggaaggatcaccataattacaaggatgggggcagagaacatgagggtgaagttgcctcatctcatccgtgctgttcgcaatgctggactgattgtcacatggattactgatcctatgcatggaaacaccatcaaggccccttgtggcctgaagactcgtccatttgactccattctggctgaagtgcgtgccttcttcgatgtgcatgaccaagaaggaagccaccctgggggcgtccaccttgaaatgactgggcagaacgtgaccgagtgcatcggt

SEQ ID NO: 9760 - DNA, 580 bp, Zea mays
  Clone ID: LIB3279-199-Q1-K6-H9
gaagaagcaaagagagacaaaaagaaggcgcagcaccagcagattcgagcgccattggtgacagccatgctgctgcttcggctacagcagatactgacagtaatgcatcagacaacccaagggaagctgacgtttctcaaccagcggtggctcccaggaggccggctagaccagcggcggcaatcaagcaactgaacaggttgcagcccatgccagcgcccctgcgtaacaggggcaggaggaaactgcggcagtacatcctgatcgcagcggcggtgctaacggtgctggcgctgttcgtggcaggcaactacattcccaggctgaggtcgcactcctaattttatcgttaggaaaggagtgccagttctgtcgcggtgaacctggtggtggttctacctagaggattcttcttttttcgactgttcgggttggtttgtatttagcttcccttattataggtttgtgataaaagttattaccggatggtggtgaaatattcgttagaacatgataataatgactatagattcttttttgtacataggtctctggtgctaaccttagcgtatatgatttt

SEQ ID NO: 9761 - DNA, 428 bp, Zea mays
  Clone ID: LIB3279-199-Q1-N6-A10
agaagcaacatatcgatcaggaatgatgagctgagtttctggactaccaaccattattaaacgataacagagcagcacgacaaggaacagagtacgtaccctaattccattctttgggttggagggtggtccataaactatgagctgagggaaccttccattaacgacttggtggacgcacgggttgttcgggacaatatgcgcctaaagaccccaacccaactggaaaacgtaaaatagaaaacgccctatgacacttcgccattacttcttataaagttcacttgtccaacgcttaactcttaacatgccccccacccagacacacacagacctttagatactgtttgtaccgaaacaacggcattaggataccgcttaaccatatagtaatcttcccgagtcgacgagtccaccgatagattgga

SEQ ID NO: 9762 - DNA, 579 bp, Zea mays
  Clone ID: LIB3279-199-Q1-N6-A11
aaagaaacaaagaagggtttttttaaggaaacacacatgatactacaagcagcgtaagctctctccaggcaattgatataacagaaggcgattgctggtttgagtccatccgcagctagaaatgggaagcttattcaaagcagggtccgagccctcaaccagctagactccatttggattttgtctccccatgggggttccggtttcctttcttgcggtcgaggacctttggttggtactgctctcctcgttttgacggggctcgggcgggggcttggtcgcccccatcatcacggcgcgttcgccggggcgttgcgggttcttgtggacggtgacctccagcatgccggccttgagatcggccgtgacgttgctgccgtcgtactccttggtcaacagcagccggatgtggaacgcgccgacgccgtgcgcgtccacgggcgccggctgctgtggggcgacgaccctgcgtttgatctcgaggacgtcctcgctggtggtcacctcgatgtcgctcgccgacagccctggcacctggagccacagcgtgacgcggtcatcttcctccttgatgtccca

SEQ ID NO: 9763 - DNA, 459 bp, Zea mays
  Clone ID: LIB3279-199-Q1-N6-A12
ccaacaaagaacaaaggtgtggggaggtgcttaaatctctccatccaacaaagacaaagatacgggggtaacattgaggtctctcacaagatttcactaacatagctggacaaaaaaaatagatggctcgcgttgcttgaaaaaggtacatcgatagcatgcaaaacaacaacacttcagcagcaccaatggaagtccccttggatggctagtcttcaagcggacgggatctcgacctttccgtcataaatctcctgctgcaggtccttggggtccttgccgtcaacggtgcacccgaccctgacccaggtgccgaggatctccttgacggtgccggccaactccttggccatggacctgttcctcatggtcctggcgatctcaacaacttcttcaaggccgatgttgccgctgtgcttgatgttcttgaccttcttccggtccctctcgggctccttg

SEQ ID NO: 9764 - DNA, 542 bp, Zea mays
  Clone ID: LIB3279-199-Q1-N6-A2
aaaaggtattctaactccaaacctttggagaattttactaaattcccaagttaagtttttgaggtgttacaaattccttcccaaagcatataacgacaaatagtaactagcaagtttacacaaaaatagaatacaacagaactaattaatgcacccttgtttctgacatccatcatctacaacctagtaagttacacagctttgctgactgcggatataaattcactcaacatactcaaaatatctaccagcctttgtcttgctccacaaccaactaccctaggcccatgcacatcacaacgcgtcaataatttccttggtccgcacttgtgctctttccttctcttcaggtccatccaaatctccaatgttgtcatggtactcctcaagtatgctcttcacatcttgctttgtaagtttgttctgcttaagaagtaattctactcttgctctcatctgggaattcccagagtgccagatgtgtcccagaataagcgcaattaactgcagtgtgtaaagcccagcttcgagttttcggttat

SEQ ID NO: 9765 - DNA, 465 bp, Zea mays
  Clone ID: LIB3279-199-Q1-N6-A3
gggtttaaacaccctgtcgcgtagcattctagcaacaaaaacacggggtacaaacacgagggcgaccttgtgtcttctaacagttataaagtagtccaactgggggtacatggaaacgaaatcatcgtcaccaaatagagggcaaccgaaggtacatgaccatccacaaaccaggcagcaaatctagctacactgccagtgtgcccagcaactaataaagtcatacgcggtaaacatcactgaacatgactgggaaacacaggacgcccccgtccatgcggttagtggtgtacaaaagctatggcttcaccaaagtctcctaggagataatatttctgagacctcgtccaaggcagagtgctcaaatcaagctgtgccggtaacagcggctgcgtccggcttcgagctgtctttgccgttttcccgagctgctgatccaccagacgcttctgcaaatcgggcagc

SEQ ID NO: 9766 - DNA, 339 bp, Zea mays
  Clone ID: LIB3279-199-Q1-N6-A4
aaggccgacgcgtccctcggcgtgctcggcggggcttcgattctcccgacgcggcagcagccgttccccgtgggcggcgacctcgacgacgcgcacgactggctcgtcgccctcaacgacgacctgctcgagcggttcggcgcctccaccgacgaggtcaagaccctgcggcagaaggaggagacttccgggcggagggcggcgccgcaggctggggacgggttccaagtggtgtgcgggaagaagaaaaagaaggtgggcgatggtggcgaggaacgcgtcggcagagttgaggctttcggaggttttggctctgtgaggatggtcaccaaggacaag

SEQ ID NO: 9767 - DNA, 505 bp, Zea mays
  unsure (1)..(505): unsure at all n locations; Clone ID: LIB3279-199-Q1-N6-A5
gaaacgggcaaaaagtgcaatcgtctgtaaggatagatatgaaaacaaaattatactcagtaacaggggtaccaatatgatagatactactgctccatttaagtttcaacctcagacagatctaaatgagatacaatttgagtaaccaacatctgaatgcttgataggttggcggataaagcaaatcggggcaagcaattacgccttctggttgtagacataggtgaggccgcacttgccgcagtagtggcggtcgaagtggttggccatgaagacgcccgcgccgcactctgtgttggggcactccttgcggaggcgggtcaccttgccagtggcgtcgtccaccttatagaactgcagcacggagagcttcaccttcttgngcttgtgcttgatcttcttgggcttggtgtacgtcttcttcttacgcttcttggcgccaccgcggaggcggagcaccaggtggagggtggactccttctgaatgttgtagtcggcgagggtg

SEQ ID NO: 9768 - DNA, 356 bp, Zea mays
  unsure (1)..(356): unsure at all n locations; Clone ID: LIB3279-199-Q1-N6-A6
aggagtatcaaacaaagggggacatactatattaattattaatataatactactacaccggggtatactcccgtctcgtcgtgggacatgcgcctgaccatatacatgcccatccattcgttattattggttggtcattcattcgggcatcccagcttcgagtggccccaccacagatcccatggggatcaagcgtcntccttttcggcaaaaatttccaggagggccagggcctctgtgaccgaaagctccagcccgaacttgggcccctcttattggtgcaagatggggccgaaggcctcctcctccaacgggtcgtaaatcttccgcgttgccacccccacctgcccaagaaa

SEQ ID NO: 9769 - DNA, 590 bp, Zea mays
  Clone ID: LIB3279-199-Q1-N6-A7
cctgtaaaattagattaacaagaccaacatttaaggttggctctacaacagtaagatcatcagcagaatgcagaaacttctccatctctttggccgtcactgtgtctgacgagggagtggaagaggatcacgagcacaacgacccacgaggcgacaacgagagaggcggctgcgcgtgctgaccgaccgctcgtgcacaggtcgaagacgcagcctcgcctgcttcgctggttcaccctcgtacgtagcgtcacccccactcgtgtagtcgcgcgtcacctcgcttctgggcacgtggtgtgtacactgcacaccccgtgacgccatggccagaaactggatatggtggggaagagtcgattggaagccgtagaacggacatgatgtcgtggagaagaaagattgtagagttgcgcaacaggaaggctaccctaatgtgaggcccatgcagattccatttgggcaacatccgcccctgctcgagatcatcgccttccccacacaggcttcatccacgcctagccgcatccaccgaccaagccccagtcggtgcccctttacggtgccgagcacgaagcggacgcgtgggt

SEQ ID NO: 9770 - DNA, 519 bp, Zea mays
  Clone ID: LIB3279-199-Q1-N6-A8
atgaaaccatagaaatgtaatgcaaccaaatatttacatgagcattgatcgtaaatgttggccgagatgatatctaataaccttcacaaatcacgatagtaaaaacggggccacttgaaaccgcaacctggtatatgagacatctctcaccagtgcaccaagtagtaaaagttataagcagtaatataatcaagacgcgccagcaattccttttgaacaaataattcgcatgcgtgtgtggcctgtgtgcaaacagcgcgtgaatgcaatgcgcgcaatataactacagctagatcatacgttatcttcttcaggcttgtccgaaggcctgataaggggggctaccctttcagaaatgattgccttaccattctcgtccttcttgacagggtacaacacgtagtgttggataatgaacaggacatcaaagaaaaccgtctccaatgaaagaagggttttcccaatgtttccatagaaattcaccaaagtatgttgatctatagactgcacacccatctg

SEQ ID NO: 9771 - DNA, 489 bp, Zea mays
  Clone ID: LIB3279-199-Q1-N6-A9
ggtgttcgcctctttgaaatggactttcgcttcaccggattctttacagttacctttctggcacgggcaggaaccagttcctcttcctcctcgtcttgatactcatcctcctcgtcaccatcgacatcgggatcaaaatcaatatcctcatctatctcgacctcctcgtcatccaactctgggtcaaaatccatgtcctcatcatcttcctgcttccgctgatgagatcgcttcgctgccagagacagcttcacattccggccacgggcaccgcatttcacaatgctcttcggccgttgtggtgccacttcttcctcctcatcggcctcctcaaggtcatcatggtactcctcctccacctcgtcgtcttcgtcaacctcctcctcgtagtcctcgtcctcctcatacttccggcgtcgagatcgtgcggcggccagatcaacctttcctttccgtactctggtgctgccctttgccggtcgcttcggg

SEQ ID NO: 9772 - DNA, 563 bp, Zea mays
  Clone ID: LIB3279-199-Q1-N6-B1
gtcggtgcaacactaatattacagaggcgagagacaccacaagcacgagcctctgaaagaatgtttcagctcatatattacaacaattacaatgccctccaaacttgctaactatttccagaattacttggatctgcaagctattttttttatttttttgtcaagaagaccaggtcggcttactcggaacagcaacagggcggcaactcccagcatttttcatgtgccgaaaagggcccctgactgagtggccgcacaaggaaacctgatcatcccctaggataatttacacctaaacaaactcaaaagaataattacattagccgatgctggcgaaggcccttgccaaaatggggttgcatcaatctaacatatagaccgttctggtccatcagagagtcatgtgtgccctgctcaactatcctaccgccattcaagacgacgatgttatcaacatgcttcatcattgccgccctgtgcgcaatgagaatcgttgtcttgttacccatgaccagagtgtctagagcttcttgcaccactctactcgattcagactcgatcgc

SEQ ID NO: 9773 - DNA, 557 bp, Zea mays
  Clone ID: LIB3279-199-Q1-N6-B10
aaaacgactgcttcatcacaaatggcatagacggtatctaaaccaccacacagtagactacagaacatagatgcctgagggccccacaaactacaacagttaacagttgatcaggactgacactatattttgaggcatctcaagcaccaatgccgacagtatccacacgaagtattcaaatctattagctgccctacccggaagattcatcttacaactctcgtcaaaggctcctcggttcttggagcattgtccgcaattcatatctatatcgtagatagatagaatcaagccttggccctcttgcttcctgtgcacgaggggcacttatactgcttgatgtgctccgctttatttggggtgatcttgacacacttgccgtggaaccatgtctcgcataagtcgcaacagatccagaagtcgtcataacctaggccacatgcgccgcacagcgcactctcatggtcttcctgtggttcaccttcctccccttcactctcctcgtcctttggaggtggcatctttgggaccctggagttgggttctacctggcgtga

SEQ ID NO: 9774 - DNA, 455 bp, Zea mays
  Clone ID: LIB3279-199-Q1-N6-B11
gggaaaaaaaaaggttcctttttttttttccaaaaaggggaaaaaaatggcaaattttttttttaaaaaaaaattttgaaaaaaaaaaaaaaatttttttttaataaaaaaagggttaaaaaaaggggaaaaatccttttttttgttttaaaaaaaaaaaccccttttaaaatttttttttttttttttttttaaaaaaaaaaaaggggaaaaaaaaaaaaaaaatttttacccaaaaaaaaaaaaacctttttttttttgaaagggaaaccccttttaaaaaaaacaccttttttttggggggaaaggtttttaaaaaaaaaatttttttaaaaaaacaaattttgtgaaaaaaaaaaaaaaacactttgtcaagttgttttttttaataaaaaaatttcggaaaaaaaaaaaaaaaagggcaaaattttttgttttaaaattggggggggggg

SEQ ID NO: 9775 - DNA, 387 bp, Zea mays
  Clone ID: LIB3279-199-Q1-N6-B2
actttaaaaggtagcatgaacttcaaaacataaccttcggcagcaaaaggtccttgccatcatacagtaacaccacttaagttccatctttagcaaaaccccaggtcctaaaggtggaactgagctaaaaacagaggaaacaaagccatgctttccttcctactcctcagcttcagcctcaccactctttttgttgcccttcctagaatacctcaggttcctcaggaacttggggtccatccccttggtggaggtctggcggtggcgcttgggtttcttaatgccgttcttgtgcgccttgaacgactggttgtgcgccgtgtggttcttcgacttggccatttcttccggatgccgaagcgatggctcgcgagaaacgaatggtct

SEQ ID NO: 9776 - DNA, 303 bp, Zea mays
  unsure (1)..(303): unsure at all n locations; Clone ID: LIB3279-199-Q1-N6-B3
gagaaaatgcgcacattataatcaccaagtcttggaactaccatacaacaaccaagctgtttcaaactttcgatggcgtgaggatccggcgcctcatttaattgttacaacaaactggtttgcagctacaaggccaggggtaacaatggtacaattgtacagatgcagattccaaaagcagctgcaggtcaaacgaaagccttttggcacatcatccgtgtatgggatacatcatacatagacctggcgaacagcctgccttccataaattagncataacgcataatgatgcagatgctgact

SEQ ID NO: 9777 - DNA, 448 bp, Zea mays
  Clone ID: LIB3279-199-Q1-N6-B4
gatgcaaaggtacttcttccatttcagttctcactttacattctagttcaaacagttagatccaccttagcgatccgatgcaccttaacgatcagagtaatagcttaaacatgattggctcttaacatataccaccaggcgagtagggacgttattagcctcaactcatttttgtgtacgtggatcctgagtgcaacagttactactgcccgcgttgggtttagccttggttgcaaaatcagttgcggcaaaatgcaggaccggaagcattgcagcgaaaggcatctgtgtcagctgggcagcaacagttgtccagatctacgacactaacacagcatgcacatacatgctccatttaggattaataactaacctatgtcatcattgcataaattacgctagtcaggtattcgactcacgtgcaagaggaactaagcactactgcgcg

SEQ ID NO: 9778 - DNA, 617 bp, Zea mays
  unsure (1)..(617): unsure at all n locations; Clone ID: LIB3279-199-Q1-N6-B5
tccttcctccacttccgtcccttcaccgagccgccgccgccactatgaagggacccggcctcttctccgacatcggcaagaaggccaaggatctactcagtaaggactacacttacgaccagaagctgaccatctccaccgccagcgcctctggactgggcctgacttccacagctgtgaagaaaggagggctttattctcttgatgtcagttcagtttacaagtacaagaataccactgttgatgttaaagtggacactgaatcaaatatctctactacattgaccgtgttggacgccttgccatgcacaaagcttgtcacttctgtgaagctgcctgactacaattatggaaaggtggagctgcaatacttccatgagaatgcaacttttgccactgttgttggcacgaagccttctccagtgattgatctttctgggacagtaggtgctcaaggagttgcatntggtgcagaagctgngtatgacactgctacgggaaaatttaccaagtacactgctgcaattggtgtaaccaagccagactaccatgctgcattcattctggcggacaaaggtgacaccattaaagtgtcaggtgtttatcacctggatgaa

SEQ ID NO: 9779 - DNA, 602 bp, Zea mays
  Clone ID: LIB3279-199-Q1-N6-B7
gtccagaatccaaactgcagtcgataagaagcaaacaatccaaagttcccagcacgacctcatatcacaaactcgtatttactgacggcgacacatcacacatcaaggccaacagcagcagatgataaaccacgggaagcgcagataaaactagggtagggaaggtggtggaatagctcacatgccacgccccatggtctgctccatgggcggcatcatgacaaagacggagtgcccattgttgaatccagggtggggaaccctgcggcgcagctcgcgaccctcctggcagagggcgcaggggtggcagaggtagtgggtcgcaaggtcacaggcggcctctaggtgctcacgcctctcctcgtcctcgaccagatcgccgcggcacccacattgcctggtgaaagcctcaaagctaccctcaagattgtagcgttgtcgaatagcagtacgagtgggatgagagaaccatggggcaaggcagttccacccaaagagagagttcccaagcaaatacagcccagtgtaaggcaaacagctgtttgcaaatgtgccttgtccagcagcaagcctctcaacattgctaccatagagcacacatg

SEQ ID NO: 9780 - DNA, 579 bp, Zea mays
  Clone ID: LIB3279-199-Q1-N6-B8
ttttagcacctccggcacgcaaagctatggtagtatcatttcagcaaaatatacgtccctggcgcacaaaaacagaagggcagacgcaccaaagaagattacagtcatattctctagcgggctcacaggaccctgacagcgggagcggaatggcacgagaattacaaaaggtagagctcagtgggagtgatttgggttggctgctcctattgacaaatccttgggaaaaactggtgacggcaagcatagcttaaagatcctcagggccattgacatccttgttttcaaatacagctccatctggaacctccaacttcactccagacttggcggtgattgtcaccttgcccttgagcgtaattccagaaccaaaccagacatcaccagaaaccttcaagctgtcaagctcgacgatgctggggatggacttgaaccgagcaaggaaattggcaaccttcttgaactcaggtccaagctcaatcgaagggttagctggattcgctctggatggattgcggatgacaaagccatcaaccaagggtgtaagatcagactgcacaagcaataaatcagatgtag

SEQ ID NO: 9781 - DNA, 229 bp, Zea mays
  Clone ID: LIB3279-199-Q1-N6-B9
agagtgaactgatttgattaaaagtttcacggcgacacatagacctgacaaaatatgagccattaatgctcaaccaaccactaggatacacccaacatagtttcagacatttcgatggaaaaaaattgattggtgggaggcctttttctccgggggggaaaaaaacactggttcgtttaaccaaacctggagtttttaatttaagtgggggctgtcattgggggggtta

SEQ ID NO: 9782 - DNA, 396 bp, Zea mays
  Clone ID: LIB3279-199-Q1-N6-C1
gtgggggggaaaaaaaaaaggaaaaaaaaaaaggcaaaaaaaaaaaaggggccaaaaggggaaaaagagaaaaaaaataggaggggtgggaaaaagagggggaggaaaaaaaaaaaaaaagaagggaaaaaaaagggccaaaaaaaaaagggggtttgggaaaaaaaaaaaaaaaaaaaaaaaaaaaatttaaaaaaaacaaaaaaaaggcttttttccaacataaaaaaaaaaaaaaaagtttggattggggggggcaccccaaacccaaaaatgggcttgaggggggtcaaaaacatcaacaaaataacccccaaaaaaaaggggaaaaaatttgggaaaaggaagatcccccgggggggccccccgggggatcccaaaaaaaaaagagggggg

SEQ ID NO: 9783 - DNA, 594 bp, Zea mays
  Clone ID: LIB3279-199-Q1-N6-C10
agacacaaaaaaagggttcattcgtcgaaagcacagtaacttatttatcaccactggtccactgctatgcatgctgcagcgacagtaccaggaccgaagaaacagcctcacgtacagctaggcaatcaggtttattacgaggacgaacaaacaccacggcgccggtcagaaaggcaccagcgcaccagtacggctcatcactcctgccccaggagcgcgaggagcatgctctcgtagtcgccggaggtgtcccccgcgacggcccgctccagcggcacgctgttcctcttctggtacgcctccttaatcagtttgaggtccacctcagcgcgggtggtgatgaccctggtcagggagttctcatctgtgcctagccccgctatggcctgcctagccaccttctcaaagtacctgtcagggcaactgaagcaccggatgatcgcccgcagcgttctgaggtactcgtcctgggggtcagccttcagatccttgttgattcggtggccaaatgcatcattgtaatgattgaatgtagcaatcagctgaggtttgctcctagtggtgaggattctgatgatctcatcatcactgtaa

SEQ ID NO: 9784 - DNA, 496 bp, Zea mays
  Clone ID: LIB3279-199-Q1-N6-C12
aaaccgggttgtttgtttcccctttcttcccaggttttttttggttttttttgggaattaacgcttttttccacaaaatttggttcccggtggtcttttttctcccccttccggggggggaaccaacccccccttgttttgggggttttttttttttgagaaaatttttttttcccgtgggcaaccagttaaatggggccatggttttgttaccttttcccggggttaagggcctccttttttgaccccccccaggtgttttttgggtccgggggtttcccccctttggaattagctttttttccctggggccttccttccccccccgtttcgggccaagattttttttcctttcctttttttaaagaaagggttttatctttggggctcccccttttttcttttttggaccccccctttttttgtcttaagcttccccccctttttccgggtcccttttttttttcctcttttctcaaaggtcttgttttttttt

SEQ ID NO: 9785 - DNA, 410 bp, Zea mays
  unsure (1)..(410): unsure at all n locations; Clone ID: LIB3279-199-Q1-N6-C2
aagatccaaaccctcaaatagattcatcagaggcttttggtttttgaatcaccggttcattatttgagtccatcaggcatttctcatgtaacatgattgagacgacaaaagaaaagagagtcaaaagatactacacgaagcattccagagatgcttctaacacttagccagcattgtcgctaagcacacgttttcacaaaaagaaggcaaaagaaaagcaaggtgcccccacttcatgctagtttggaagggccttcagtattccttcttaccaaagtttttgcaccacagttgagatgggattggccggactgggtgatgccggcgttgctccatctcctggttcttgcttttgtacagggtgtcggcatttagttgtttttcctttgaacagnccttggtatttttga

SEQ ID NO: 9786 - DNA, 551 bp, Zea mays
  Clone ID: LIB3279-199-Q1-N6-C4
aggatagcaaaatactattatagcttagcttgttcatagagactggaggagcatgacggctgatcacacgcgatcaactatcccaagtttttacaggcacagaactaccaccgacactcatgctggagctaccgacgaatctagagctactgacaatattacgattggatcaaaatccatgaaagaggggaatctataggcggaattgagggggggatctcgccagcgacaaggcaggcagactacttcttggccttcctggccacgcccttcctggccggggcggcagcagcagcagccttcttcggggttgccaccttcttaggagccgccgctgcctttcccttcttggcaggagcagccgccttcttggctgccttggcgggggaggccttggcggaggtcttggcgaccttgggagggcgcccgcggggcttgggcgacgcggcggcaggagcgacaggcttggccttggccttggccttgggtttgggcgacgccgccttgggcttcgcagcggtcttggccttcgccttcggcgagggcttggg

SEQ ID NO: 9787 - DNA, 523 bp, Zea mays
  Clone ID: LIB3279-199-Q1-N6-C5
agccaggaaacaactcgcacatcaactactcttcacggatcatagtgccagatacttactacctgactgtaagagtaacaaacaggttacaaagtatgccgcacacacaggctggtggtacgatcattttgaggggtaaatatgagaacgccaatctcatacatcagctacgattttggtagcaaggtacaggttacgtaggttctattggaacgtcaaactggaaatattcaggcacttatcgcaagaactcagctgtctaatttcactggcttcactttctccttgagaaactgccgaatgtgctctcgcttccagttatcaatccttatggtctccttctgttcacccttgttgtcaagcattatgagctttggtggcgaaccataagaataacgggtttccacatatgggaagtcgtctttatcttcttcgaggaagccaacaacttctggataaaataccagtttcctcatgcacacctcaataattgcaccagaaaatgtgagcttgctgatagaat

SEQ ID NO: 9788 - DNA, 376 bp, Zea mays
  Clone ID: LIB3279-199-Q1-N6-C6
gggaaccacaaatttttggcattggcggggggggatttgggaatgttcacccggtttggaattggtttacacggaacgggggggtgtgggaaaaaaaggggccattactttggttaaatggggacaccggttttggggggtaataatggtccttcttacgcctcgggatttggattggtttgggaaatttggagatgggacattgggggggactaaattttggggtttggggggaggtggggacttggttttcggcaacggttaactttaggtttcaaaatttttagaaagggtttattttggtggagtggcccctacacattcggtcaaccgaacatgggaaaattggggggaaacaaggtttggcttttttttt

SEQ ID NO: 9789 - DNA, 539 bp, Zea mays
  unsure (1)..(539): unsure at all n locations; Clone ID: LIB3279-199-Q1-N6-C7
atacttgcactttcgtcataatcgtaagatcaaaaaaaaagcaacaaacaggacacagtatcgctccagtaccagccaccagcggtcttacataggagtaataatcagtacagctttagaagatggcgcatgtaatattggggccatatctatctagcacacgacctactccaatttttcacgagatgggtcgcacgaactctatggggggcaagaatcgagtcgccatgtgccatacgtgcagcagtatcacggaatgaattccagctcgcagtcgcagtcgcaggcctaaactctaatgatggtcagcttagcagaggagagctctgcttgcccacacagacacagcccacacacaggtcttggtaccaccaccacctatatgtacaaaaataccagcccttggagatcaccagggacggactagaactcagccttcgcctgatcagcttgtaactggccatcaaaggtcgggtactaaaagcccatcctnctcctgcctttgctcgctaccggtagtaggggtaggcaaagcatgc

SEQ ID NO: 9790 - DNA, 272 bp, Zea mays
  Clone ID: LIB3279-199-Q1-N6-C8
gcagcaccaagaagcaccatttttttccttaggatttaacttagaataaagcctgacgggggtaacagcacccatcgatccgcagtccatgctggttgatgcatgggtctgctggagccgaggatgaacacagcactaacaactgacacagagcgaccttcaatcaaaaacacagatgggcaacaacaaacacgagacgaacgaagataaacactctggactagggtaaacaacacggtagcgaacaggataacttggccgcgcgggcccca

SEQ ID NO: 9791 - DNA, 179 bp, Zea mays
  unsure (1)..(179): unsure at all n locations; Clone ID: LIB3279-199-Q1-N6-C9
gcacgcaccagccttctcggcgccgaggcgagcgccggcggcgtcagccgagccctggacgcctgcttcctgccggtcgcggagggagggccacggcggtgcgcgtnctnnaggccgacgccgnagcttcgcgacgtcttgagccgcttcgcggtcgtctggggcaggtcctcnaggcc

SEQ ID NO: 9792 - DNA, 433 bp, Zea mays
  unsure (1)..(433): unsure at all n locations; Clone ID: LIB3279-199-Q1-N6-D1
gggcaggctggcatgataggcctcggcagaacaaaattgaatggcatgacacaatcgcagctccaatagagtaaaaatcaagatttaagactacatgcacagaggggaaagcaggatagtgatttaacatcagatgtcaaattttcctacactacgataccatgacaagcaacaagctacattgatcccaaagctgtccatgatctaaacaacacaactaacagcatggagaagctgaggtaaatccatggatgaacaaatcatttcttcttcttggaagggggctggtcttcgtcatcttcatcatcggcctcgtcttcgtcgtcctcatcaccttcgtcgtcctcatcgccatcatcatcaccatcttcgtcgtcatcattgncgttgtcacttcctccttcaccattagcttcaggatcatcatcttcat

SEQ ID NO: 9793 - DNA, 585 bp, Zea mays
  unsure (1)..(585): unsure at all n locations; Clone ID: LIB3279-199-Q1-N6-D10
gttttactcttttagacatcttgattcttattgaaagcaaaatagattctcccattcccatctcacttcacgtcacaaccaaatcttacacacatttgagtaaagcatctaaatcaaacggagtgacaatctggaacttacgtagaaggatgaaaggggggctgattgccaacaagaaacaaacccccaaaaaattcaaaatagatgatgccaacggctagcagttcctcattcacagtaaaattaggtgcatagagcatttgctgagaagtcatatcgagcgtgacaaacaatatggtcgggattcttctattccacacaccgctgtgaagtctgaacaacactggtaacaccaaactacagtagccgccttcaagaaagtctattatctcgtaggacctcatgaagaattcttcacattatagtgcatcgactcctttcttcagcccgtggcgtgccattttgctggtacctgcttgggtctgaagggttgtatgtgaactggctcgtgtccagaccatacttctnccgcatcctttgactncaggcatcatttctacttgcacgttgatcaagtgttgggac

SEQ ID NO: 9794 - DNA, 379 bp, Zea mays
  Clone ID: LIB3279-199-Q1-N6-D11
gattcagttgcctgagaaacgcaacaatcaccagtttaaaatcgtaacttccgaagttacgacccgacccttcacttgccttaaagagtaacaaattgggtttcaaggtcgatttccaacattcgatgcccacataatttcatcactggttcatgattcagggaagcctgcttgccttgcgatttaaataaacctacttgtcttaccattcaaataaaccttccacagcttgagatgaacttaccagagtttcttaaactttttttaccgcaagacttttgggcacggccagaaaacgttgcatttgcagaaggggagaacattgcgaggaggccattatcctaaccgccgaagccctaaagggtgcggcccttgggct

SEQ ID NO: 9795 - DNA, 576 bp, Zea mays
  unsure (1)..(576): unsure at all n locations; Clone ID: LIB3279-199-Q1-N6-D12
aacagacaggggaacaacatatcaatatcattggacaaaaatagctgcgaacaaaaaccttgctcattcttctctcgtctcgtttcatagcgggagcaaccaaagggaacaacaggggtaccaacacctaatccaaaggtagaacggacactaacacggtgacagaagcgaacggtaacacgatactatagatagataagataactcggccgaagccaggatgggcccacacatcagtccctccagccgccgccgccgccgccgtagccgccaccaccaccctcgcgccgaccgccgtagccgccaccgcctccgtagccgccgccaccaccctcgcgccgaccgccgtagccgccaccgccgccataaccgccgtcacggcgcccgccaccatagccgccgccgccgcgaccgccgccgtagccaccgncgncaccgncaccgncacgggactgggcctggttaacggtgatgttacggccgtcgagctccttgccgttcatgttctcgatagcgtcgagcatggagttctcggaggagaaggtaacgaagccgaagccgcgagacctccccgtc

SEQ ID NO: 9796 - DNA, 555 bp, Zea mays
  Clone ID: LIB3279-199-Q1-N6-D2
ataatttaaaaccagacaaagctttatgatttgaaacgggaatagtaataaatgtgcacaatgattacggtcattatcatcatcataaaacagcagcaacaaatggcactaataccataccaggttacaagcagagtctccaccgacaaacgaaccacccactcatttcattccgagcaaaccaaccaccggacttagccccacatacacaaacaatccacggaggaaaatcaaaacagagcctagcagcagatataacaagagtctgacaaaccgccccaatcatggggccaacagttccatcgccgccacattcatcagtcgctgataacaggcgacgccgaccttgaccgtgacccaggaggtgacatggacgctggccggggtgacctatgatgaccgcgccgaggctcctcatcctcctcgcctgctggggacctcttcctctcatcacgaccattgtctgcaccacggcgatcatttatatcatcaggagtataggatctcctcctatccctgttattttctttaggctgttttgatgacctcgggtgc

SEQ ID NO: 9797 - DNA, 595 bp, Zea mays
  Clone ID: LIB3279-199-Q1-N6-D4
agtcacaacgaccattatcgatacgatgccgcagtgatatttcacagccagacatcccaacaacgatacatataacagtccagttcgttcaaatctgttcctatggtacaaatgccatagctcatcttcacaccccccatcacaagcgaccatttcgcctgggcacaggcccccatggcaagatcaagaaattcacgtcgctcaggacgaacatacccaccccagcttttatgctaccttcagttattcgcacgctggcttggtgtcgaagctggtcaggcagatcgcgaaggcctggaacgccgagagcgggtaccggtagtccatggtgaatatatccttcccgatcttcccgaactggaggatcaccttctcctgctccgctgcggggacgtttagggaagggtcaaccgacgcgacgagctggaagttcttcaccgacgcgacggtgacgcgcccccggaagttgaggcaccagcactgcagctgctcgtgccagcgcggggctttgttcttcagaactagaggcgcttcattcccagaaaccggtccagacagatcggcgctgaggctcgtcgaagaaattgtacaccca

SEQ ID NO: 9798 - DNA, 441 bp, Zea mays
  Clone ID: LIB3279-199-Q1-N6-D5
gataacatctgaaacagaatctatatttctcacgtcatgaaaagcaatgcatactggggcattcattaaccggtttcattcatacattaggagaaatcatttgaaacaggatacattcataccgcgaaccctcgattagacgtttaaactttgatatgaaatacttggattcctctggtacacaaggtcttacttggaattgaaaatatcctggtcactagaagccctttgaaatgataagggttccatattaagcgtcactgataggcacctcaaccttgacacctggttcaatggtgattgaggtgatctgcttgacaacatctggtgtactgacaagatcgatcaccctcttgtgaatcctcatctcaaagcgatcccaggtgttggtaccttcgccacacggagacttcctggtggtgatgtggagcaccttggtag

SEQ ID NO: 9799 - DNA, 324 bp, Zea mays
  Clone ID: LIB3279-199-Q1-N6-D6
gggggaccaaaaaaatctgcggggtgtggggaagcgaacccatttaagacctgtttgggaaaaagggttccgggggaaaattttttttcccaaaaaaaagcaatttggaaaagggggttttcttcgcccccccaagttttttttgggggaaaagggttaaaaacaataaaaaaaaaggcccaaaaacataccccccgggggaaaaaaaggggggtttccttattttcttgggaaataaaaaaaaaacccccgaaatcccccgtaaaaaacctgttaaagcgccccttttaaaccacttttttttgccctttaaaaaaccccccc

SEQ ID NO: 9800 - DNA, 602 bp, Zea mays
  unsure (1)..(602): unsure at all n locations; Clone ID: LIB3279-199-Q1-N6-D8
caccaagaagagctagttgtaacatttagactgccggccggccattgtacatcatacatttgcttacagaagaagtgcatccttaattatgacactgggatgggattccaccttcaccatttttatggggtttccctagactggacacactggatgactgaacacgacttagagagcagcagtaaacttacagctgcattttgttatattttttggtcatttttttttttacttgcttgctatacaaaaggaacttctacagttgagccacactatccactagctcgaaccaccgttacttcgacttgaaagagcagaccacgagtccacgacagcggcggcagccaggagcaaggctgcaagaggggcagcagccttcctgatgagttcccccagcgaacctagcgaggctggtggatcacgcggggggcgctgctcttggggctgccggcgtacttggtcggcttctcggcgttcctgggtttctcccggaacccggngggggggttcgcgcngcccttggggaggtcatgttcagcgccttgagcaccgaatctgtcttaagggcggcggngacggggccctgctcgagctggtcgtcg

SEQ ID NO: 9801 - DNA, 582 bp, Zea mays
  Clone ID: LIB3279-199-Q1-N6-D9
actgtgtcaaggaagaatgatggtgcaacgaatgatagattcgactggaaaccaaacttacatatactctaattaattgaatcccctcaaacttcccgtagcatgaaagccaaaataaaaggagtaaaaaaaaaggtgctaccattgtttttagccattagcgacaatttcgtggatcctgtcactgatctctggatcatcagatctaactgccagcttcatggccacctccttcggtgcactaattccaaatgacagtctcaccaagactttcacgttgccaataaacacaccagagagcagacaagtgtgcgaccttgaattgcttgggaccacgtcagttccctcacaaggctgcatgccaaggatgcttataacagcacttacagcctcagccaagctctcccttactccaagcccatactcgtcaactcgctcagtctctggatccatgttttcccaggcatttcggaagttagatactcccaccttcaacatataatcagcagaaacgatttcaagatcttcaagctggtactcatcctcgacaccatcatcttcagcttcacccgtggatggatc

SEQ ID NO: 9802 - DNA, 490 bp, Zea mays
  Clone ID: LIB3279-199-Q1-N6-E1
ttagaactcctgggatgcggaaccgatgtcggccttgcccttcccaccggccttcttgggcagcagcgtctgatgaatgttgggcaacacacctccggcggcgatggtgacagctccgagcagcttgctgagttcctcgtcgttgcgcacggcgagctggatgtgacgcggcacgatgcggttcttcttgttgtcgcgcgccgcgttgcccgccagttccaacacctctgccgcgagatactcgaggacggcggagaggtagacgggcgcaccaccgccgacgcgctcggcgtacttgccggccttgaggtagcgcgcgatgcggccgacggggaactgcagcccagccttggtcgaccgcgacacagccttggaccccttgggcttgcccctgccgccgccggaactcatattcacctcttctcgtctgagactactctctcgcttggtctaactcgacggaatcgctgtcgcgctggtatggcggtgc

SEQ ID NO: 9803 - DNA, 312 bp, Zea mays
  Clone ID: LIB3279-199-Q1-N6-E10
ataaaaaattgatacgtagattttttgggtttttgagaaaaagaaagaaatattacttatggggtgttttggcagggaaccaggtggggaaaaaataaaatatttttcagggattatttgattttggagtactcctgaaaaaaaaaaatggaaaaaaaaaaggcagatgggcgatagcaaatattggaaaaaaataggtttgtttttgtacaagttggttaaaactaaaaggggaagggaaaaaaaaaaaaaaaaaatatggactgattgagtgttccattaaggggaattgggtatatttgggaaaaagcc

SEQ ID NO: 9804 - DNA, 563 bp, Zea mays
  Clone ID: LIB3279-199-Q1-N6-E11
aatcatacccgcttctgtgtttatgctttaaacaaattcatcaacaaataatcataccctgctcagtgctcaaataggaactattgcagctagcgaacagggcaaataaacatcaccgcaataggacaacagcaggggttatcaatacattggactagagctcaatcgcttttagaaaacagtgtactaatcaggactgaaaacatggcataacgctctgaacttgagacgactaaccaaaaaaagtgtactcatcaggacacacatttcggtgcaagacaatccatgagaatgctctaagctacagcgctcttgcccttcttcctctgtagcttcttcatgtagaactcaagctctttaccctcaaggatgtacccatcagctcggccacactgtccagggcgggaagaaatgcatgccagcaaccgtccactgccaaattgctcctcaatgtgtgggtcaagggtacgtccctccttgcgcttctcaagcttcctcgtgacatggttgctctttttcgtttcctcagctgctgcctcaacctcttgtccctcagcattatc

SEQ ID NO: 9805 - DNA, 591 bp, Zea mays
  unsure (1)..(591): unsure at all n locations; Clone ID: LIB3279-199-Q1-N6-E12
gcgaaattgtttcattgaatagttcggcagagcatataccaactagagtaaagtataaagtctaataagatattctcatccacattatggagcatgaacatatcagcaggacgggactatataagcgaccgagaatatgtcacaaacaacgctatcgacttacaaaggaaaatactaaaaagttttggcaataaggtaatgacagcatctagtccctttcacttcaggagaggcataaatagtcaccagcactcatggtcatcttgggcgatcccttccagagctaccaaccaacgtagagaactgctatgtattctgcacaagatattgacggaagaaaacaggactattgaaatatattatttcccatgtccagtgaaaccatggttacatatacatataccgatgtcaacaactgtgctgcagaaaccctaaacatgaagcttcagtatagatcacactatggttgtaatgaaaaagcagcactgtgcaactgaattacagaaaaattttacagttatacactattgtcacattgacattctatgcactggctcctgcctttntgttccaaaaacattctatgcactg

SEQ ID NO: 9806 - DNA, 558 bp, Zea mays
  Clone ID: LIB3279-199-Q1-N6-E2
gaacaagcacaaaagcttcaatttaacaatatcgcgagatccacaatgacagtcatgacagaaacatttttccaggcccagggtagaaaagaaaatttagtagggaagggggcataaaacaacaagtgatgccctggtacagcacccaacgcaatacgaccacgagtttaacacgattttgctgctcctgcaacaagttcgtcgatgagattagcagcattttccacagttgcgattgactgcgcgctcgactcctttacagtgatcttgaaagcctcctcaaggcccataacaatttcaacagtgtccaacgaatcagcaccgaggtcttgaaacttagaggagccacagacctcagtgccctcaggaagtgcaagctgtttcttgacaatatcacaaacccgatccacagtctcctttttagcaggacagcagacagcgaatctttgtggcactggctgcaagcggaaggctacattatccttccttagaccagagaaagagacagacttaatgctgattgccttgacgggcctcgcaaaggagagagcggatccg

SEQ ID NO: 9807 - DNA, 542 bp, Zea mays
  Clone ID: LIB3279-199-Q1-N6-E3
aaccataaatctacactgaataacttctttccttacagtaacagttacactgaatcattttctcgttgggcttaacaccagataatccctgctacagttacacctacaatctaaaaccgaacttgggacacgctagatttacactcacgacaagaaggaacaaatacaacggatacggttctgcattcaagaaactggggagatcccactgtgaacacaccccttgtgtcaaagtactccaaggtgtttggttataaagaaataaaaaaaaggataatattgatcctcccatctgtgcgacatgtatctcttggcttcgatgtggtcctactcgcaaccatctgttattattcacctgcttggaatctggccttcgaatgcagagctaacagcttgactccagcttccgcttcttggtagcaggtgctggctcaacgatgatcccagactccagctctctcttgatccaatcatcttcactcaaaccatcaaaagtgatcgcttgctcatttcttggtccgaccacaatccctgactcgagt

SEQ ID NO: 9808 - DNA, 341 bp, Zea mays
  Clone ID: LIB3279-199-Q1-N6-E4
gttaaagggatattaacaaatttgggccccgttcaagttgtccaaaagaaaaaaattgtgttgaaaaacgtaatgaaaagttttttttaggaagcaaataaatgtaaagggtaactttttttacatgtattggccccagttacaaagcgataatatttatagtcttaaacctcatatttaattgggttatcatccaaaaaaaatattgcagggtatttagttgggtgccaaaatgatttaattgcacctccccatagccagattagagttttatagggctttggcccttcttgttcttaaaaaaaaagttttggagtcccttaatgggccccccttcaagg

SEQ ID NO: 9809 - DNA, 534 bp, Zea mays
  Clone ID: LIB3279-199-Q1-N6-E5
acgatgtggcttatagcctttaatttatacggatacacgcaaacgcatcgtcaagcaagcagctagtcctgtatgtttcattgcgcgttacattcatataacaaaatcacagacatgtttttcgacacattgacacacagagtagatcatatatgtgactgaaacacagctgtcactcttagcttgcatagagtatgatgctgccaccgcatctttatttatttcctttgcctcaagatccatcttcagggtagccatgttggcatgaagttattcatatgctcaggagcgaacccgatctgcagggttggctctgctgcagcttccaggggatgaaagaacaaaccattgccaacatgtgatggggcctgctgttgaggagagtgcctctcgtagccgagtaagttggcaccgtgctcccacacttggccatgcacctggttgctggtctcctccagctttcttctaaggcacttatttgcttcacacagcatttgctccctcctctgaagatcagtgagctgatcaagcata

SEQ ID NO: 9810 - DNA, 597 bp, Zea mays
  unsure (1)..(597): unsure at all n locations; Clone ID: LIB3279-199-Q1-N6-E6
cgtccacaatcaaagcacctctcatacattaatggaagggtaagagcacattacaaggtatgaacagaattcattaagaacaagtttagtcatatttacaaaagttatctcaaaagtttcttgagtctgtctacagtctagtcctatttgatcttcatggggcctcagcttcggcgtcattctctttaagcttcggtctcggcttcgtcatctggttcaagatgactccgagcttcgtttccagccttttctcgcccgccttttgtccatatcatttttacaaatctattagaaatgcttcgggcgagatcaggaatgtcatctagaattgatggggatagagtaaaattgggcctattgacaatttttccatgatcgcagccagcttttaggaaagctgcagcagtgccccgagaagctacccaggcgcagaagtcaccgtgcccggctataacttcgtcaagctcatcaatttcaccttcaatatgttcgaaggtctttgataaatcttcaactgacggngtgaatttctcactgctagctccaactgagtggaagatttttctcagtcgttgaatacatttgttgctaaattcc

SEQ ID NO: 9811 - DNA, 406 bp, Zea mays
  Clone ID: LIB3279-199-Q1-N6-E7
gaacatccaacagtatagtagggtagaataaacgttgaaccgtaacatcattacatattccaaacaaaaaatatattgtgccggtagaagacacctaacaggttgtagaggcgattctgtcctaagtttccatgatacatgcggagctcctagtcagttcgcatttgatattcaagccttgctcgcaatgttgctggacagccagtccaggccctcgtacagaccctcgccagttgtggcacaagtgctctggatgtaccagtgtcgctgccgcagggagtgtaatccaagcttgtcagtgatctcagcagcattcatggcattaggaagatcttgcttgttggcgaaaacaagcagcacagcatcacgtagctcatcctcgcccacgcgtccgcggacgcgtggg

SEQ ID NO: 9812 - DNA, 600 bp, Zea mays
  unsure (1)..(600): unsure at all n locations; Clone ID: LIB3279-199-Q1-N6-E8
cagttcgaagtaactgaaattgataacaaaatatccggttgccaaattgcagactctctttggacagatgcacatacccccacgctaacctgaaacacacgcacattctgctacatgattgtggccgcaagaaggcgggcggtaaacagaactctttaagttacaactggctaagcactacagggacttacaagaaaattcagctatagccaagttaaggttccacagctactaatcaaaaaccaaagaaaccaagctcagtcgccctttccttctcaaaggtttcgaagtattggtatatgattgtcacagcgagcaatataccagttcctgaaccaatcgcacccatgaaatcagccaggacggtcaatgcgccaatgcatacaccaccaaatgcagcggcagtggggatgtatcggttaagttccttctgcaagtttgactcacgatggcctggcatcaccatttgttgttccttgagctgcttagcaacatcctttgctgatgaaccaganacttcaatccatgtctttgagaacagagcacaggctgacagcatgaagaccacataaaacagtgcatggaatggatttgcaagga

SEQ ID NO: 9813 - DNA, 580 bp, Zea mays
  Clone ID: LIB3279-199-Q1-N6-E9
ttgaatggaatcgaagcatgttaggctgtaaatatagttgatattgacgatatataagcttacaacagcaaccggatcttgctgcaaatgcaaaggaacttcttcacacggtaattatgttcctttgatctggcgggttagtaaccactctagagctctcaagttacaaaactgctaggtttatttcatcctaaaatttacatgggtccacgctccagcagctcccatctgaatgtgggagcggcataaaccctgggaaaggtgtggaggagtatgcccacgcagacacaaaccacagcgactcccatcacagttaacattgctggcctataaaggaaggtcctcgccgtagaatttggatacatccgtgcctgacggctgcagaggaggcaacccggcactgatgcagacattgccctgcagatctcgaggctaacatcgccaggcttaacgccatcggttattacagggcatatactgctcgggacaccgaggacaacatggccttcgccaagatgcttgtcaatcttcttttggaccagattcaggtaagcgtcattgcctctctgccgagcatagt

SEQ ID NO: 9814 - DNA, 511 bp, Zea mays
  unsure (1)..(511): unsure at all n locations; Clone ID: LIB3279-199-Q1-N6-F1
gaagcagaaaggaagcccaaatggatttatggattagcgtaccaatgaggtcacaagaacacaacaatcgtttggtacaccgcggattcagaaaggtaaagaaatgacttcctatctactggggcaagctagagaaaactagtcccgtgtcgcataagttctggatgcaaaacacactttgaaatacgaaaaaaaagaaatcctcttattttgcttgaggatgcgaagcaatgaaatcaaccgctgtcttgatggagtcaatcttctctgcttcgttgtcaggaatctcaaaggaaaattcttcctcaaacgccatcacgatctccacagtgtccaagctatcaagtccaaggtccttctgaaaatgagcactaggtgtcacctttgagggttcgaccttctggaagttcttgacgacggagacgacacggtcagcgacctcgcccttgtcgaggaacgagccctttctctccgtcgtngacgacaggagccgccctgccgnggggatggt

SEQ ID NO: 9815 - DNA, 421 bp, Zea mays
  Clone ID: LIB3279-199-Q1-N6-F10
acttaataggtaggtcgatattagcagcaaataaagctccatcataataggttcacaaaacgactgactgatttgtcttagcacaaaactctggatatagctagaaaccacgatagatggcctactgaagtgcaggtttccaagacgagccattggacccatggcaaacggtgacgacgaactaggatgtgacatctctccatgaactcacgcatcgaagaaacgtaacacaactatgccgacaccaccatccacaatccccatcagcctacttggatctctgcctcatctttcggcgcttcctcttcagcctcctcatgcgcttcttcttccacttggccctcatagtcgcctccttgcgggctctccttggcgcgtctcctgctgctgcgtcggcggcgggttcacgcggacgcgtggg

SEQ ID NO: 9816 - DNA, 590 bp, Zea mays
  Clone ID: LIB3279-199-Q1-N6-F11
atcagcaacctttttatgcatcaacatcacagagaatgagagaaataaacatgagttgtacaagaactcagtgcactggacagctgattccacactcggttttttgttagggtagatagggattagaccacatccctagattgcaagtccaaaccgtcacctccaaaacagcgtttccacggattctgttagcatctactactagttacctatggcctactcctgggcagctacttacaccatgtatgaagcatcctcttcaccgttgcctgtggcatgccacccatcactgacctggtgcttgcagattgggcatgtaccctgttggcgcagccatgggtcgatgcagtttacgtgaaactgatgcaagcatggtaggcttctcaacagatcacccaccatgacttgttctaagcaaacactacatgtcagttcattctgtggagttttgccagttccatctgcttttaaaccatcctgctttttctccacgcaggaacaatgataaaattggctccaatctccaaagccccacgcagcagcgaatttggccgtgaacccgaggcacccgataatagaaatgagataag

SEQ ID NO: 9817 - DNA, 384 bp, Zea mays
  Clone ID: LIB3279-199-Q1-N6-F12
gcagcagcaaaagctttcaagccatgtcagatgtcaaggtagtgacagacattggatacttaacataacccgtgttctaatttcctatacaaaagctagcgctaaacccacttcttcagggttttactgcacgctacttcaggggacacatgttcagtcaggcggtcgagtcaccatcctaactcctgattgctactgcaatgcaggcagatagctaatggtgccaaaaggggtggggcgcctccacaaccgtagttaacatgccatgccaaggcaggaaaagcagagctcatcttcacagcttgacatgcttatcattggctgttaccagtctctggagctgtgggacatgtcccagaaccggagcatgaccgttgcagcgca

SEQ ID NO: 9818 - DNA, 518 bp, Zea mays
  Clone ID: LIB3279-199-Q1-N6-F2
ttatattcacagcatcttctctcttttttcaaatgcacaaggtaaattagagtgtttataatacatgaaacctgtatacaatcgaaatatacgtgttttttttaaaataacctacagaggataagacagccttgagatattacgttacagaaaatcttttcacacagatctaaaaaatctcaatacccttatctcagcaccctagtccgaccactatggaagccagaatttaacgtggagcaaaagcggatttttttttaacgtcagcttcaaatttatttcaacggagaatctaactcggaccaggccttttcgcgaattaggtgatttaaaccagacggctttagagcacctgatctgtctatctacagcatccaatcttaacttctgcacaaacttcaccggttggaccatgaatccctgcttgctacagggtacaagttcagctatcttcagcgaagaagttgggttctgctggcttttcaacagtcttgcaggtactctttcctgcaaacggg

SEQ ID NO: 9819 - DNA, 475 bp, Zea mays
  unsure (1)..(475): unsure at all n locations; Clone ID: LIB3279-199-Q1-N6-F3
gctcattcttctctcgtctcgtttcatagcgggagcaaccaaagggaacaacaggggtaccaacacctaatccaaaggtagaacggacactaacacggtgacagaagcgaacggtaacacgatactgtggatagataagataactcggccgaagccaggatgggcccacacattagtcccttcagccgccgccgccgccgccgtagccgccaccaccaccctcgcgccgaccgccgtagccgccaccgccttcgtagccggcgccaccaccctcgcgccgaccgccgtagccgccaccgccgccataaccgccgtcacggngcccgccaccatagncgccgccgccgcgaccgccgncgtagccaccgncgncaccgncaccgncacgggactgggcctggttaacggtgatgttacggccgtcgagcttcttgccgttcatgttctcgatagcgtcgagcatggagttctcgga

SEQ ID NO: 9820 - DNA, 322 bp, Zea mays
  Clone ID: LIB3279-199-Q1-N6-F4
tttttaccaaaatgttctttcaagcaaaagtaactttcctagttacaggtcctccgagttaagagtctgacagagaaacaggaaataaataaccaaccaaaattactggtccacttttctaacagatgctcacttgggtgcagttcatggtgtggtgagtaaatgtaaaatttaaagctttcgctcagctcaaactaccaagagttcctccaggcaaaaaccaccagctacaacttcaactgcgccgaactataagtagatcaacgtctcttcttgcttccttttgagctgctcttcgacgggctcgcaacgaggtagataa

SEQ ID NO: 9821 - DNA, 337 bp, Zea mays
  Clone ID: LIB3279-199-Q1-N6-F5
ttggctccagaatcgcagacattacaaacgttcggtagacaacaaaacccaaggacattttttttctggacatcagatggaattcacaagaagcacaatcaactagtcacaagttaggacccagaaccctattatcggtggtttgggacccgcatttgttaatgttcaacaaggtttttgaaattcaaaagccccaaaagatggagtctggatttattcaaattaacaggccttacaaacaactggcccaaccaaagatttagccaaaattaacttccatcttaacaaaagaataacttaaaaattttaaattaacaagcttttaaaggaaatgggg

SEQ ID NO: 9822 - DNA, 359 bp, Zea mays
  Clone ID: LIB3279-199-Q1-N6-F7
actgaaagcatccggcatggttcatacgaaaccgaagcccatacatcagataggaattggtagacagacaccgcgaccgaaggaagcaaacacgcacaccagaagcacccccactacagactacgattattcctcgccacattgcacacaggtagaggtcctcacaactcgctggcactgctcccacatcttcagagccacgatcggtcgacctagtcccacctcaggcgaccttgacctcgatggtcttgggcttcttgggctcgggcgggggcagcttctcgacggtcacggtgagcacgccgtccctgcacaccgccgagatcttgtccatgtcggcgttgtccggcagcacgaac

SEQ ID NO: 9823 - DNA, 484 bp, Zea mays
  Clone ID: LIB3279-199-Q1-N6-F8
caaggtaaatctatgcttacggttgagttccatgttttccaatctaaacaacagtagcactaggagacgtaatcatgctagtgtttgcagaagtttaacaggcggccttttcaatttcggttactagggaatactgatgctgcccagagcactatcccctgcaacctgcacagttcagttcacccctgaatgtacaaaacgccatcagtccatgctccagcatcatctgcataggatcatttcttgcctgactccagtcagggctactgcggctgcgaggaagagtgtgcagaccctgcaggatcagacggaagggaaaaacttgttgaggttgaagggcagcgagtagaactcctcgctgcggctgtccgtcttgaagctccggaacttgtcccaccagtggtagcccctgtccctcctcacgccgctgtcacgcacctggatcgtgttgtccagtaagaaggccaccagcacagccacgaac

SEQ ID NO: 9824 - DNA, 543 bp, Zea mays
  Clone ID: LIB3279-199-Q1-N6-F9
ctgcaaaatatcttgagctccacatattccatgcattatatctgatttccccattccgtgggtgaaggtgggctgctgagtacgtttgtactcacccttgcttatttgttgtttttcagaaaaaaggagatcgagtaagaggtgcgactgttcccaaccttgcctgtggctgttggaccgctgatttgcttcgctgcgtatatcgagctgcttcagccccactctgatgatatgtcccgagttgtggaccaactcttaaagttgatcgccacctttataggtttgtctcgtttaagcagatctgaaatcatctgatgtataaatgtgtttactagcctcctgagactagtaattgtatcacatttgagtcccagaggattggggacgcttcagcaacaaagcgaagtcaaacaagatgtttggtggtgataacagtacgaattccttcgggatccaagtcaaacaagatgtttggggtcgataatagcacggagaggttaatgatcttatttgagtctcagctcagctcaagcttcgtgtgtc

SEQ ID NO: 9825 - DNA, 393 bp, Zea mays
  unsure (1)..(393): unsure at all n locations; Clone ID: LIB3279-199-Q1-N6-G1
agtgttaccccgataccccgggtaggtattgtatcacgtattcaattcaatacgtatcctatattgatgcacacgacggaaatttagtgggttacgtatccatgagatattctatctaaaaacaaaattctaatttcaaatgtctaggttcatatttatccacacgggcgatttgtagaggttcgcttcataaatatgtaatacttcatgtcctctttgtgtatgaggattaattgagtgcagagatatacaaactacatgttcagatattgactgtgatcgactagtagtactcccttttcttttggttccggtgagtgttcaatgtatactggcctctagtttacatccgtgtatcctaaatgcttgcccacgcgtccgcccacgcgtncg

SEQ ID NO: 9826 - DNA, 522 bp, Zea mays
  unsure (1)..(522): unsure at all n locations; Clone ID: LIB3279-199-Q1-N6-G10
attttcatcaccaaattttgatatcagagtaacagaaaacgagtttatgacccaacaagcatcgcatctacgaggatgcgaacaggttacaagctaaaggcatggatcgataatcgtacagaggtggcgcccctcggcggtgcggcctacttcttgccacctgccttattcttgttgtccgtggaggtcccggtgccgccggccgctgcctgctgcgccttcttcgccgccttcttctccagcgctttcttgtccctctcacggcgctgttccggggtgagcccgtcctggggccccttgccgttgggcttccgcgccgccgcgcgctcacgatagcggtcacgctggttgccgcgagtcatgtcgcctgtcacactcacgctgacgctggttaccggtcgcgccgccgccctctggcggagacaactcggcgacgacacctgaagtcacgcggagaatatgtncacctaccagacacaggacctctaatgctgcggcacggcaggcggacgcctgggtcga

SEQ ID NO: 9827 - DNA, 443 bp, Zea mays
  Clone ID: LIB3279-199-Q1-N6-G11
aaaggtcagattgaacaaatgtcattaatgacccgttatatcgctcagtttggcgggaggcattagtcaccccaccaatacaacattggtggtcgtgggcaacaatacatattttggtcatcaccattcatgaaaaccacccattaaccatagctgtttacactctttctgcaatgtgccaagggtgcacggcactatcattgtcgttggcctgattattgcaacaaagcatgagagcaagtttctcaaggaaaagtgaaatgaaaggagctgaaactgaaactcccgagggaaaaagccttcatgggagaggaacacaaacggcaaaaggaagaagtccgcagtcttttcactacccctcaagggccgatgcaccaaatataatctcaataagctctgtggtgatggatgcttggcgtgtcctgttgtaagtgagagtgaga

SEQ ID NO: 9828 - DNA, 592 bp, Zea mays
  Clone ID: LIB3279-199-Q1-N6-G12
attatcaactcatgaatcggcatgtacatactgcatacctgcacaatgtacaatcatctgatcactataccatacagaacagcattggccgccgtgacaaacgtacacgctgccgaagttcagagctagtatttatgcaccagtgtccgagaaaaacagaactgccaaaacaagcatgtcgtctaccgtaattcacacagatcgacccgaggacgcaagacgcaaccaactagcctcagtcgacatgcttctgcttcacttggcgggacgcggaataggattggactgccgagctcgtcatgctgatggaatgcttcgtcaggtccatgctcttccttgcggtgaaccagatcatccagaagaacccaacccaaccagtagtaatcataactccaacaactgatgagatgacaatggcagaaatggcaaagatagcaactcctactgctccaatatacactgcaaccaagcaagcaaagaagatagccaagaatccgccagcagcggccagtgacatcagggctgagacgatgatcgcattagcagtggcaattagcagaaagaacatgaagattaaaaggccagtcaatgc

SEQ ID NO: 9829 - DNA, 564 bp, Zea mays
  unsure (1)..(564): unsure at all n locations; Clone ID: LIB3279-199-Q1-N6-G4
agactcagaaccattgcaaactcattaactttagacaaaaaaacatcagtacctgctgtttttaagataaatgtatattgaaaaaaactggcaccactcaacaataaactcagaccaagatgtttataatagactcagctgcgaacaacatttctgtaatagactagaagggataaactggcatcccagcacaaacttgacgagctgagccgctgccgttgcccaatctcagaaactgaactctagatcttgttgaaagccacaatgtcgcaactctggacgtactcattgatgggctcttgcgtaaggtggtcctcaattagagtgtcgatggacacaagatcgtcgacaattgtcaacatgatagtcatcttcttgatgccgtatccaacaggcacaagctttgatgctccccaagtcagaccctccatctggacactgcggacagnctcctncagcttcttcatatcagtctcattcgcccatggtttgacatccataaggacggaggatttaccactttctttctttntagaagaggcccttgcagcggcggcacgctca

SEQ ID NO: 9830 - DNA, 131 bp, Zea mays
  Clone ID: LIB3279-199-Q1-N6-G5
gagatgtgaatcaaagtaccatcgactgtccttgtggagttaacaacagagtacgatgacagccataatcaagaacaaaagatgtccacgcttcgtacaaggatcgtctattaccgattgatgacatgaat

SEQ ID NO: 9831 - DNA, 345 bp, Zea mays
  Clone ID: LIB3279-199-Q1-N6-G6
ctaaaaatctaataggatcctggcatgcctcagcaaatttagcggcaaatccaccaaaaactgacgcacaagttacagaggaatgaggatcccaaccagctctagggctcaggccacccaatcaactaaacaggcttccaaaagttgtacgatcacgaacggatgctcgccttgcttgtttcttctattacactatatatatatatatattgtgctaatactattttagcagtatacgccatatctttctcatgtacaccactagggaccatacggcgagtcccgtggagacgtaaagtagagcaacaccgggggcaactagagcgccttgcgcaggtagacttg

SEQ ID NO: 9832 - DNA, 458 bp, Zea mays
  unsure (1)..(458): unsure at all n locations; Clone ID: LIB3279-199-Q1-N6-G7
gggacgcagcagcctttgcaattgatgcccatcgccgacaagagtcacaatttcctctcaccattacatgacgggggaattttggtttcaaccaagcgttgcagcgatgggggggggtagtacacgtaagcattaatctcaaattgggcttacccttttcaatttactccatggaaaatcccatcaccgcacgacggggctaccctgtgctcgctgagggcgggtgtccgcgcgacaccgggggtgtaccctcgcaggagctgcgtccgtgccgccgaggccaccctgtggccgggctggggggactgcgcgacgacgggaccgcaccgggccaccgtgctttgggtccccttgcgccgttggggctgggcaccggcgaaccttgcgcccacctgcgcaaggaggcctcccccgctcgccccatgggggccggggtcgctgcacccncgccgtagcca

SEQ ID NO: 9833 - DNA, 399 bp, Zea mays
  Clone ID: LIB3279-199-Q1-N6-G8
ggggcaaaccttcttgcactgatattttatagttttacttattactggattacaaaagtttgtcaacatgacaaaaattttttttcaactggaccttaagttttgtttcaagggtacccgggacaaccattaaacaattacaggaaccgggaaatgccatttcttattaaatacaagaaattggttttaaaacccaaacattaaggttaaatttgtggggaaggggaccgattttattggaaattccaacgcgacaccgaaaataccgtgcgagataaaaaaaataacgcttaactgtgggttttttaaaagaagatggggcgacagcgggcggtttgcttcaccagataacagggggcagctcttatgcaggagtcgattttcaggtgtagacatctt

SEQ ID NO: 9834 - DNA, 335 bp, Zea mays
  Clone ID: LIB3279-199-Q1-N6-G9
ttcttcaaagaacataatcggatagctgctggcacgattacattatatatataaccacacacacactaaactacaactgcatagccattaccccacttttcctgggtttgaaagtcagagaaaggttccctttggggaaggggattacccccccacccactggcccaaagggcaccagatttggttccaatccctgcacgcttaaacttggttttaaaaacattaattgggtgctgggaaaatcagaacacaccccaaggttaaaaacaaggtcgggcttaacccctaaggaaagaaaggtggcaacaagcattatttgcgcctcttgggcattt

SEQ ID NO: 9835 - DNA, 566 bp, Zea mays
  Clone ID: LIB3279-199-Q1-N6-H1
atcgaacaagactttatttagatccaaacaattcaaaaccacaatatcgatacactgctcattgcggcagacaaagctgaccacctagagctgtttattgcaaatataagcatgtgacacattacaatagcacaggttatgtggcataaataattaggcttggctgcttcacaagataaccagtggcagcaactctgaatctgatctatcgtcgaccacatcagcatttcatcttctttacatctctttcctcgctctcatccacagcatcagcttcccagggagcatcactctctgagcgattcttgacaatgccaccagcgaagtcatgcaggactgacctcggcgacccatgggtcgtttcggccgtaacagtgaagctctgatagatgagcaagccaccaaacggcagcacctgctcaaccatgttgctgcaagcataggcctcagcatccagtttcgtcccccaggtcttcgcattgtcccgatcaccgaagatggtcaccgcaacagagaactcagttggaccaaagcacctcagcaccctcttaaccagtcaccataag

SEQ ID NO: 9836 - DNA, 504 bp, Zea mays
  Clone ID: LIB3279-199-Q1-N6-H10
atgtgcaaacaagagagatactttgtataggaaaacgacggaccatttaacgcacagttgcagattactattactggctgcagtgtaccatataatacccagggacaagacaacagtacatcacatagctagataactgcgaagccaaatacccgtctcagcgagaccaccataaatagagcttacacaacatagccaacatgcaaatcatttttgaactgaccagatgcagaggcaggagaattctcggaggcgggctacacaagtgtgcaccgtgcactgcaatgcccaacaacaagattgtagcagcaaacatggaagagaaaggcgcggggggcaaggcagcagttccccatgacgagttaccgcggtttacaatcttcctgacaccaaccgtagggaaccccccctagatcttgtcgagcttgtctgccttcaccaccggattagccttggcaatggcgtccctggcagcagtccggtagtcgaacttgcagtcgtgct

SEQ ID NO: 9837 - DNA, 592 bp, Zea mays
  Clone ID: LIB3279-199-Q1-N6-H11
ggaaaatacattattcttcgtctcgatttattagtgccgcatgttcacaagatgcatcatcgtacgattccggctcaaatgcagggaaatagttcaacatttgcatacgcctgtgattgctacaaggtttccagagctggacttttttggtgtatctgcatacttccaggaggtatgtgcataggaattgtattgtcttccaccagccacatcttctgcacgtatctggctgccaatttccttcaggtcctcagctgtgagcttcaccttcaaggagtcaacgttggcatctaggttcttcgtttttgttgtccctggtataggaaccacatcatccccttgatgcagaacccaggctagagctagctgagctgggctgcactggtacttcttggccaaatcttctattttcaggtaaatctgcttgttcttctccaagctttctgttgtaaatcttggatgcctttgcagactagattcagaagaaacttgctgtgtcactcctcttccaccaaaaaatccacggccaattggactgtaagccacaattccaatccccaattctctgcagagtggcacgatctcgggctcg

SEQ ID NO: 9838 - DNA, 488 bp, Zea mays
  Clone ID: LIB3279-199-Q1-N6-H12
aacgggaatttcagttctcatagcattatcatgaatctcagaacataacaggtgaaacacgaatcaagccgaggcgccatggggttcacagatccacacctaaaccgctaaattaaactgcgagcgatacatgataaactaagaccaccactcagatcaccaccatcttattcagatccaaaggaacggacgcagggggagtcgaccatgacggagggagggcggccgaacagaccagatcagagagatctaggagagctgtccgcagtcagcgaccttgaccaccttggaggtggagccgttgcgggtgcccaccttctcgatggccttgacgacgtccatgccctcgacgacctggccgaagacgacgtgcttgccgtcgagccaaggggtcgcgacggtgcagatgaagaactgggagccgttggtgttgggcccggcgttggccatggagagcacaccgggggcggtgtgcttgcgcacgaact

SEQ ID NO: 9839 - DNA, 332 bp, Zea mays
  Clone ID: LIB3279-199-Q1-N6-H2
ggacttgagctcaatcgcttttagaaaacagggtgctaatcaggtctgaaaacatggcataacgctctgaacttgggacgattaaccaaaaaaagggtgctcatcaggacacacatttcggggcaagacaatccatgagaatgctctaagctacagcgctcttgccctttttcctctgtagcttcttcatgtagaactcaagctctttaccctcaaggatgtacccatcagctcggccacactgtccagggcgggaagaaatgcatgccagcaaccggccactggcaaattgctcctcaatgggtgggtcaagggtacctccctccttgcgc

SEQ ID NO: 9840 - DNA, 537 bp, Zea mays
  unsure (1)..(537): unsure at all n locations; Clone ID: LIB3279-199-Q1-N6-H4
ttttgacagcaagcaaccttagttcagggatcagacattcacaatccttgggcgttcgtttcattgttgactcgcctaggataaaactaacacaggaagtttatctcccacactattccattcatctagaacccctgcttcatcctgtcctcgtacctgttcttctcatcctcaaaagcttgcttaaggtactcaagctctttgtctagatcattgatagcctgggtgtaggcctgcgtcggggaggactggctcgttgtgtggatcctaacaatgatcttgtactggagtgggtgagggagcttatacccggcaaagagaacatttgggtctctgtgcaactgcatgcggaggatattgcctacagtgtgatcctcgcgttcgacagtgaatgatgcagcattcacaatctttgtatccctctcataggacactttcttggtgccctctggcacgacgaaacgctcataacggtcaggggcattcatctcctgttaactctttgctcctgtctcttcantagctgggggagcttgt

SEQ ID NO: 9841 - DNA, 567 bp, Zea mays
  unsure (1)..(567): unsure at all n locations; Clone ID: LIB3279-199-Q1-N6-H5
agctgcgaacaaaaaccttgctcattcttctctcgtctcgtttcatagcgggagcaaccaaagggaacaacaggggtaccaacacctaatccaaaggtagaacggacactaacacggtgacagaagcgaacggtaacacgatactatagatagataagataactcggccgaagccaggatgggcccacacatcagtccctccagccgccgccgccgccgccgtagccgccaccaccaccctcgcgccgaccgccgtagccgccaccgcctccgtagccgccgccaccaccctcgcgccgaccgccgtagccgccaccgccgccataaccgccgtcacggcgcccgccaccatagccgncgccgccgcgaccgccgccgtagccaccgncgccaccgccaccgtcacgggactgggcctggttaacggtgatgttacggccgtcgagctccttgccgttcatgttctcgatagcgtcgagcatggagttctcggaggagaaggtaacgaagccgaagccgcgagacctccccgtctcccggtcggtgatgacctttgagtcgaggatc

SEQ ID NO: 9842 - DNA, 587 bp, Zea mays
  Clone ID: LIB3279-199-Q1-N6-H6
ttttgggttttgaagttttttttaatatatttcagccattcacatagtcatcacatagtacacattccatatttcagccatgtactgcacaattgacttaataaaagactaatattgttcatattttgcacgggggggagcacaacaaaacaagcattgccaattagactccgtcacgcattatactgagaaggtctaaagggctcttcatttttttattgaaccaatgaaacggccgagggagcttgctgtgcactaggcaggcatatttatatttccaccaacttcgtcagaaattatttctgaagatttgatccaatcctgggtgcagacgagggcctcaactaattcaggactcagcttcagattgaaaagtcccacccgttcatcagtttcatcaaatgcagattcagcagagaccgcagatccaggaattgctaagatgtcgcaagccagcctggcaagagctggatatgtcaaagcattttccttccaccatttcaaaatatcaaaattggcattttgaggaataagctctgcttaaggtatctaatgacttctcccagttcctcatgtgctgcttgctc

SEQ ID NO: 9843 - DNA, 592 bp, Zea mays
  Clone ID: LIB3279-199-Q1-N6-H7
aaaatagaggcatcaagggatcaatttattgagcaccagttcagcaagcattgcactccgattatctttttattctttccttaccgaggtgaaaaccccagaagcagctagaaagtcggcaagtcacgcacccaaacaggaaaccaaggcatacggttgctagctactgtcttacacacctcaacaggtacctcctatagctatccccagcatgtaacttgtgccaagaacacccaccaccaccaccaccaggtcaccacactaagcatcaacaaaacaaggcgtcgactgtctctttctcttccgagtcaccacagctattcctaccctcctttgtgtttggctccggctactcagaaagccagtggcggcagtggcaggctgctgttgagccccgatcgcatcctcctcttcctcagcctctctgcgatgataaaggcgagctccagggactgggaggcattcagccttgggtcgcagtgggtgtggtagcggtcgctcagatcgtcgaaggtcacggtccgtgatccaccgatgcactcggtcacgttctgcccagtcatttcaaggtggacgccccccaggtggcttc

SEQ ID NO: 9844 - DNA, 552 bp, Zea mays
  Clone ID: LIB3279-199-Q1-N6-H8
gacaatattattattatttattattattataaccacgaaagaacatcaatctcgatacaaaaaaaaggttaatctaacccgttagatacaaagaaacacgcccacgacgatgcccaaaacaccaaacgcctctcctatagacatttgtatacgggaagagttcacatgcaccacaaaattaaaacgtctcagcaaccgcgttgcacccttacaagcctcgcaccagaaccacattgggaggatgatctgaaaagcatcagtgcgtttcattgacagcatcacctgttttaggctgtcaccggttcctgcacaagaccagcgattattcctttgctcaactgtttccctagcctctcctgtatccgatccttgatcgcagtttccatattgtggcagtgttgctcaaacttctctaggaaaccagcaacccagcgatccgcattagcaagccattcttcatgattcaaaccagcagtctttgccactgtttgcaacttttcctgatgtgccttcacagtctcccgcagtttattgatcttcatattaacttgc

SEQ ID NO: 9845 - DNA, 483 bp, Zea mays
  Clone ID: LIB3279-199-Q1-N6-H9
aaatatcatatacgctaagggtagcaccagagacctatgtacaaaaaagaatctataggcattattatcatgttctaacgaatatttcaccaccatgcggtaataacttttatcacaaacctataataagggaagctaaatacaaaccaacccgaacagtcgaaaaaagaagaatcctttaggtagaaccaccaccaggttcaccgggacagaactggcacttctttcctaacgataaaattaggagtgcgacctcagcctgggaatgtagttgcctgccacaaacagggccagcaccgttagcaccgccgctgcgatcaggatgtactgccgcagtttcctcctgcccctgttacccaggggcgctggcatgggctgcaacctgttcaattgcttgattgccgccgctggtctaaccggcctcctgggagccaccgctggttgagaaacgtcagcttcccttgggttgtctgatgcattact

SEQ ID NO: 9846 - DNA, 507 bp, Zea mays
  Clone ID: LIB3279-201-Q1-K6-A1
gatcttactaatcggcatgttgtcttgatcacgaatgtgaagcctggaaagctgcgagatgtaatgtctgctggattggtcctttgtgcttcaactgaagatcatgctgctgtggagcctttgattcctccagaaggagccaagattggagaacgcatttcatttgctgggtttgatgggaagcctgaagatgttctaaatccaaagaaaaagcagctggacaagattaccccgcatcttcgtaccgacgagaatggaattgcaatgttcaaaggtgttccctttactacatcagctggcccatgtagatcttcgattcacaacggaaatgttaagtgagcagctcattagacatggttgcatagattgacatcaaacttatgcaggctgtctgtgtaccattttgtcatacatcatgttttgcccatatttagcgttgcaaaatttgaacagagttacactatctgtaagcaattttctactaatggttggcccagagtttgcttt

SEQ ID NO: 9847 - DNA, 586 bp, Zea mays
  Clone ID: LIB3279-201-Q1-K6-A10
cgccgccgctgcccagtgcccactgctcgccgctagaggaatctgagagagagaggggaaagggcgaaggaggcgcaggcaggcatgggctccccttcctccctccccgccgcggcggggctcgtgcttctggccctgctcgcccgagcccaatgccccgaggcccaattcgaccccccggacgcccgcgcggagaacttcaacaccagcgaggcccccctgtactggggcccctggcagaagggccgggccacctggtaccggcaggccaacggggccgggccggaccacaaccgtggtgcgtgcgggttcaagcacaccaaccagtaccccttcatgttcatgggctcctgcggaaaccaccccttgttcaaagaccgcaagggatgcggctcctgctacaagattcggtgcaagaaggacccgtcctgctccgggcggacggagaccgtgatcatcaccgacatgaactactacccggtgtgcaagtaccactttgacctcatcggcacagcgttcggcaggctggccaagccccgcctcacgacaagctccgccactcgggcatcatcgacatcgagttcac

SEQ ID NO: 9848 - DNA, 284 bp, Zea mays
  Clone ID: LIB3279-201-Q1-K6-A11
ccgaaattatggcgcgcttcaatcgtggctacgctgatggggacctgatccgttatggtgtgcttgaatcgtggctgtggagatgtgtggaactcattggttaaagtgtgctttattaataatggtgatgctgatggaactgattttgctcccgttggacggcctgattggttactttgccctgttgactgtttgagaacgtaccgcccaggtttacttatacttactgctttttgacggtactgtacatacagttcgacaatttatttattggcagttcaatt

SEQ ID NO: 9849 - DNA, 630 bp, Zea mays
  Clone ID: LIB3279-201-Q1-K6-A12
cccacgcgtccgccctgaggagatcccgtggggttcggttggtgctgaatatgttgttgagtctactggtgttttcactgaccaggagaaggctgcagctcacttgaagggtggtgccaagaaggttgtcatctctgctcctagcaaggatgcccccatgtttgtcgttggtgtcaacgagaaggagtacaagtctgacattaacattgtctccaatgctagctgcacaaccaactgccttgctcctcttgctaaggtcatcaatgacaagttcggtatcgttgagggtctgatgaccactgtccatgccatcactgctacccagaagactgttgatgggccctcgtctaaggactggaggggtggaagggctgctagtttcaacatcattcccagcagcactggagctgctaaggctgttggcaaagtgcttcctgtccttaacggaaagttgactggaatgtctttccgtgtcccaaccgtcgatgtttctgttgttgatttgactgttaggcttgagaagtcagcaacctatgatgagatcaaggctgcggtcaaggccgaggcagaaggtagcctcaagggcatcctgggttacgttgaggaggaccttgtttccaccgatttcca

SEQ ID NO: 9850 - DNA, 649 bp, Zea mays
  unsure (1)..(649): unsure at all n locations; Clone ID: LIB3279-201-Q1-K6-A2
cggacgcgtgggcagctgcagcggcggcggcggcggcggcagcaggcagcagccgaggtcgaggtaccacacgatgatgtcgttcctgagcaagcacgtcaggcggtaccagtccctcgacgacaagatcgttgacctctgcgctagaatggaggagagcaagaggagcgcggggcggggcgcgggagaggagagccagagccagagcgcggcgctgggccagttcctggaggagacgttccagctgcagcgattcatggtggccacggggcagaagctgctggagacgcagtccaggatcgcggctggcctcgcgcgcgatcgctgctgctgtggcgacggagaagacggcgtggatatgaagaggctcatggaggtggctggggcgctgctgagggacgtgcagcgagggctggaggtgcggatcgcgcggatcatcggcgacctcgagggcacgctcaccttccacggcatcctccgaagcacgcgctgatatatatacacacacgcacaggcacacacacccgacgctgtcctccagacacagtaaggccccctttgggagggctcctggacggctccggctctagctctntgctggagccctcccaaacgcagcgtccaaaaacagctccggaggaggagctgg

SEQ ID NO: 9851 - DNA, 161 bp, Zea mays
  Clone ID: LIB3279-201-Q1-K6-A3
ccgcattcgttccaactcctgagcactttgtgctcgttccagacaagccaatcgaagccgagatacgaccatggactccaccggcaccggagcagggggtcaggggaagaagggagcgggcgggcgcaaggtctgcgggccaaggaagaagtcggtgtcga

SEQ ID NO: 9852 - DNA, 590 bp, Zea mays
  Clone ID: LIB3279-201-Q1-K6-A4
aatatcagatcgacaaatccacgatctagaagtaatcaattccacagttaaaacttacgtcagtttcgcagcagcatcacagtaacattttaaacaccagatgaagagcaacaataataacacaaccccacaatgtgcacaaccccacaatgtgccggtggatcaggcagccacctcatctccctcctcgtactcctcctcctcttccgccgtcgcgtcctggtactgctggtactcggccaccaggtcgttcatgttgctctcggcctcggtgaactccatctcgtccatgccctccccggtgtaccagtgcaggaaggccttgcgccggaacatggccgtgaactgctcgctgacgcgccggaacatctcctggatcgaggtggagttgccgacgaacgtggacgccatcgccaggcccgtgggggggatgtcgcacacgctcgacttcacgttgttcgggatccactccacgaagtaggacgagttcttgttctgcacgttcagcatctgctcgtccacctccttggtgctcatcttcccgcggaacatggccgacgccgtcaggtagcgcccgtgccgcgggtcag

SEQ ID NO: 9853 - DNA, 633 bp, Zea mays
  Clone ID: LIB3279-201-Q1-K6-A5
gccaccaccattccttccccaactctgcaggctgctcgtcgccctccctccacgccggacgcgccccgatccagatccaggggcgtaacatggcatcaaaacgtatcctcaaggaattaaaggacctgcaaaaggaccctccaacgtcatgcagtgctggtcctgctggtgaggatatgttccactggcaggcaaccatcatgggtcctcctgatagtccatatgctggaggtgttttcttagtgaacattcatttccccccggactaccctttcaagcctccaaaggtatcttttaagacgaaggtcttccatccaaacatcaatagtaatggaagcatatgtctcgacattcttaaggagcagtggagccctgctttgacaatctctaaggttttgctttctatctgctccctgcttactgatcccaacccagacgatcctcttgtccctgagattgctcacatgtacaagacggatcggcctaagtacgaggcaacagcccgcagctggacccagaaatatgccatgggatgaaaatgaaatgaagtcgaaactccatattcggcattactgcttaaatgcagacgattgtggtgttgccccatgaaactttttgtggggacgtatgttc

SEQ ID NO: 9854 - DNA, 653 bp, Zea mays
  unsure (1)..(653): unsure at all n locations; Clone ID: LIB3279-201-Q1-K6-A6
gccaggcctcctggcaggctcatctcctgcatcgagcaaaatgaggaaggccgtgggaacgaggcgcacgccagaatccatccgcgcctaccgctccaagatcgaggccgagctcgcccgaatctgcgacggcatcctcgcgctactcgactaccaccatagtaccatccgccggcggggccgagtccaaagtcttctacctcaagatgaagggagactaccacaggtacctcgctgagttcaagtcatgtgcatagaggaaggatgctgcggagagcaccatgaatgcctacaaagctgctcaggatattgctcttgctgatctggctccaacccaccccatcaagctcgggcttgctctcaacttctcagcgttctactacgagatcctcaactaccctgaccgtgcttgcaaccttgcaaagcaggcctttgatgaggcaatcttcgagctagacagcctgggagaggagtcctacanagacagcactctgatcatgcagctactgcgtgacaactcgaccttatggacttccgacaccaacgaggacggcggggatgagatcaaggaagcagctgctgcccccaaagaatccggccccgagggccagtaagacagatacgatcttccgacctgatgcgtgtctgctgat

SEQ ID NO: 9855 - DNA, 528 bp, Zea mays
  unsure (1)..(528): unsure at all n locations; Clone ID: LIB3279-201-Q1-K6-A7
cgatttgtctttgcagacaataagctaacttcattcaatatcgcacctgacaatttgagcaagaaatttacaagtggttgcgtgattgaaagaattatagtcctcggtttacgatccggagtgaagaaggctattattgagcctggaaaccaagaagtagaaattgaatcagggccaattagtttaaggagtggttccagcccagttgtgccaacaatccggaggcccaatgttcgcatcgcagacagttggacaatatggatagcgtaagaggttgtccattcacgtctggagcctgatgtctcttttgtttgctgtcaggttgcgaagttaggccaatctttagaagtttagttgtggcctcgatcattgcgcatatcattatggttttgtggcctcaaaatatttacatgtaactggtacttaagctgttccaactgccaattttgacagaaatactgagagagattgttgatgtatatttgtagctttcatacatgagtatttgagtttattatcttgcnnaan

SEQ ID NO: 9856 - DNA, 601 bp, Zea mays
  Clone ID: LIB3279-201-Q1-K6-A8
caaaggcaaaggcaattaataagcaaccattacgcagccacaacagcaacgcagcaagctaagctagagggagtgagtgggagagagagagagagacacatgaggccggaaagagttggaggtgtggcgccgacgacgacggtgctattggctggcggcggcgggcggccgagcctgtggaggacgccgacgccatatctcttcctggggttcgcgacgatgatggtcctcatcgcggtggcgctgctcgcgctcatgtgcgcgcgccgcaaggcctcttcgtcgtcgtcgtcggccaacggcggcgacgagaagccggcgtcggtgcgggtcctggtgccgctcgaccgggagccccccaaggtcgtggtcgtcatggccggcgacgccctgccgtccttcatcgcggtcgccagcgcgaggaagccgctcgccttcgccgccacaccggccgcggccgaggccgaggacttgtaggcgcatatgcaggggcgggcgagaagagaacccgcgcatcgcgagttcgcgacgcgcgcgggggccaattttgtcgagaggtttttgtttgttcttttgctttggagctcggtggcgtagcgta

SEQ ID NO: 9857 - DNA, 515 bp, Zea mays
  Clone ID: LIB3279-201-Q1-K6-A9
ggcaaagctcccgcgtctacgctgtccgtttgccgcgctcgcgctcgtgtgcatcttcccgctctttgcgccgcggcccgccctgtcctcccgcgccgcgccgaaggacggtgtctccttcgccggcgcaggcaacacgatacatcaactccttaaagatcacggccttcccggaggactgctcccgcgcggcgtggagtcgtacaccctggacgaatcgagcggtctgctgcaggcgcggctgtcggcgccgtgctacgccaagtacgacaacggcgacctggcctacttcgacaacgtggtccgcggcaacctgagcaagggtgcgctccgcggcgtggagggcctctcccaggaggagctcttcgtctggctccccgtcaagggcatactcgtccaggaccaggagcccggggtcatcctgttcgacatcggcttcgcccacaagagcctctcgaggtcgctcttcgaggacccgccggactgcaagccgtcggccgccagcgggatgagcg

SEQ ID NO: 9858 - DNA, 631 bp, Zea mays
  unsure (1)..(631): unsure at all n locations; Clone ID: LIB3279-201-Q1-K6-B1
cccacgcgtccggctgtactctctcacctccttcgccgttgtctaccagatcatcccatggcgtcggagaagaagcagtcgaacccgatgcgggagatgaaggtccagaagctcgtgctcaacatctccgtcggcgagagcggtgatcgcctcacccgcgccgccaaggtactggagcagctgagcggccagtcaccggtattctccaaggcaaggtacactgtgaggtcgtttgggatccggcgcaatgagaagatcgcatgctatgtgacggtgcggggtgagaaggcaatgcagctgctggagagtggcttgaaggtgaaggagtacgagctgctgaggaggaacttcagtgacactggctgctttggatttggcatccaagagcacattgatcttggcatcaagtatgatccatctactggtatctacggcatggacttctacgtcgtccttgagcgtgctgggtaccgtgtcgcccgtcgccgcaggtgcaagtcccgtgttgggatccagcacagggtcactaaggaagacgccatgaagtggttccaggtcaagtacgagggtgtgatcctcaacaggcccaagccaacacctnctaagcctaagcgtcaccataagatattag

SEQ ID NO: 9859 - DNA, 632 bp, Zea mays
  Clone ID: LIB3279-201-Q1-K6-B10
cttttgctcttcgctatcatgtctgctgcgtttctaacactcctatacacaccatctgtgtatgaacatcagttgcagtcaagttctcggcttgtcaatgggtggatatgggataagaggagttctgatccccgatatgtatcttctgccagcattcaatgggaggatgtatataaaagtatccaaaatctgaatgttggcgaacaaaagctcagtgttggactcttgaattttaacaggactgagtttggtgcttggacacatatgctcccagaaagtgatttttcagtcataaggctagagcatgccaatgaaagcatcacctggcaaactctgtatcctgaatggatagatgaggaggaagaaacagagataccatcttgcccttcgcttccagatcctagtttttcaagagcgacacattttgatgttgttgctgttaagcttccctgtactcgtgtggctggttggtcgagagatgttgcaaggctgcatctgcagttgtcagcagcaaaattagcagcagccacagcaagaggcaatagaggaattcatgtgctgtttctgactgattgcttcccaattccaaacctcttctcttgcaggacctagtgaaacgtgaaggcaatgct

SEQ ID NO: 9860 - DNA, 340 bp, Zea mays
  Clone ID: LIB3279-201-Q1-K6-B11
ggattacgctaagacagacggtttggaatacatctgcccccactgtagcttagcaaactacaagaagccaccactaccaccaaaagtagctaatggtttctcaaatacagcatatgtaccacgaagtgtttaatttcttgtttttttcttttcctttggtcccgtgtttgtgggaagaagtcattagagtagggaatagcctgatggaaagatgggcaaggccttcagggtaggtatcgaaggtatcatctcgctaatttagtggctatgagttttttatagatgtacaattgataacacattcaagttcctaagtagttttttagtggttatgaggttt

SEQ ID NO: 9861 - DNA, 619 bp, Zea mays
  Clone ID: LIB3279-201-Q1-K6-B12
agaatggcgtgctccaccaatctctgcttctcggcgttgattcctcctcttccagcctcttcttcttctggctcctcccccttcctcacgatgaagcgtgtgtcctctgttccgtcgttgtccaggtggacaatccgatacaagcaattgggacatgcattatatcagagaagccacgttctggcctttgctagtgcagatgcatcacaaggcaaaagaagctcaggtgagaatgttgtgatggttgatccactggaagctaagcgtctagctgctaaacaaatgcaagaaattagggccaaagaaaagctgaaggtgcattgctgctgtattggagtgtatcattccttagattaaatcaatcttatatgctaaaggaagaaaacttcatgataaggaaaggaggaaaacatctatcttttttttttgtttggaccaatagttggtgatgaatcattgtttcagataactggagacagaactaggcttttacctgttcatgttgtcctgcgagttctccaattctaatttatttatttactaggtaaatacccgtgcgttgctacggattgaacatattatgataagatatattgaaattaaaaaaattctaattttc

SEQ ID NO: 9862 - DNA, 598 bp, Zea mays
  Clone ID: LIB3279-201-Q1-K6-B2
cacctgagtcctcccccgaacgtggggatgccacatggatgcaggagcttaacattcagcggccacctactccaaccagagggcggccacaagctgccggtgataggaattctcttgcttacatatgatacttgacacgacagagccacctccatctgctggatatgtttgtttgtaatcagaaatttctttaccagtttcaaggtacatatggtatagccaagaagaacaatcaaccaacaggacatcatggatacacttgtgatcagttccctggtaatcctttgtgatgcatcggttttaactgtagttgtgtgctaccgtgacttcagctcctaactggggagctgcataatcagcatttcagatctcaagcaacattgtatgattgcgataccagtggacaataatcaagtctgatgtagttgtaatagctaatctgtaatttcagtgtacatggatagattgttctttcgtcagagtaggaaggtttccaaatgtttgcatactatgcatgctgcagcctgggacgcggtttaaacaggacagctatacaagttgccagatctgagctagattgggcagagaagatttgaac

SEQ ID NO: 9863 - DNA, 573 bp, Zea mays
  Clone ID: LIB3279-201-Q1-K6-B3
tccgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggaagagggttttgggggtttaaggtttacagtcttgggttgggggggtggggagtttttttttgggggggggggggtcaatttattggggggtgggtttaaaattttgggcgggggaaaaggggggggtcccggattttattggttttggggcttttgcctttttccccttttggcttattgggaaaggggccaggagggtgggcctttcccatttttccaaaattttgatgggttatggggacacgggcttgtcggggtgttttaggcctttgggggggggggggtttggggtttcgggcccgtttaattgtcaagtttcttggggccttgcctttgggttttttgctttttttttttggcttggtccgcgggtttcccgggttgggctttaaagggggggttcggtttggggtttggtgtttgggttttagggtttctgggccccaaa

SEQ ID NO: 9864 - DNA, 597 bp, Zea mays
  Clone ID: LIB3279-201-Q1-K6-B4
gaggagttcaagctcgagatcccagacatggaggctgacaagatcgactcactccctctggccatcgagtacgtcgccaaccaccccatggctggctgagcctctgctcgcccgagaggaggcgagttgaggtgaggcttcgcttggttttgtttccgagggcaaataatctgctggaggggcacagaaaaacttgttcttggtgctctgcattgcttcacggtgacggatgatgatgtcgaaatggaacattaacattttcagcgttagattgttgtttttgtgtgcgtgttatatctatatatactggttgacaaactagtttggttgattgagtctgatcgttgttgggttatttgaattgggtttgtgatagtttcccatgatattttatctgttttccatgtgcttttgggaacctaaattgataagaacggcttacaaggattgatgtaggttaaaagtctcagggttcatgacagctgttagtgtggcctcttgttgtccaactcttgttcctgttaatgaggcttgagtctgttttatttgtcaacattatggttttgttggttggaagtattccacctattgcatgag

SEQ ID NO: 9865 - DNA, 639 bp, Zea mays
  unsure (1)..(639): unsure at all n locations; Clone ID: LIB3279-201-Q1-K6-B5
ggagtcggagggaaccgaaaactcagggtctcgaatttcctaggagcggaggcgatggctgggaagggaggaaaaggattgctcgccgcgaagacgacggcggccaagtcggcggagaaggacaaggggaagaaggcccccatctcacggtcctcccgcgcgggcctccagtttcctgttggacgaatccaccgtcagctgaagcaaaggactcaggcaaatggccgcgttggtgccactgcagccgtctactctgccgccatcctggagtacttgactgccgaggttttggagctggccgggaacgctagcaaggatctgaaggtgaagcgtatcacccctcgccacctacagttggccattcgcggagacgaggagctggacaccctcatcaagggcaccatcgcaggtggaggcgtcatcccgcacatccacaagtccctgatcaacaagtcctccaaggagtgaagactagggaatgcacattgttagtttaaactggacatttctgtgtgctcctctgcgagtccttgtcgtcgtgtaggttttagttgagctgtcaggttggagtgacccttctnctgtgtaacgcttgcctggtactgcttcagttatttggacactgtttgtgttgagttg

SEQ ID NO: 9866 - DNA, 616 bp, Zea mays
  Clone ID: LIB3279-201-Q1-K6-B6
atactagctagaagttagagcctagatgatggttgcttccgttggcgtgcaagctcgagtgctcctaaatggtcgtcgtattagcttatacgacaacgacccggtgcaagagataatattgtttacacgtgcgagtccaaaattgttggctttgggccggagcagttaacacgagaagtgtattttatcacttccgcctcttgcatatgttgtagattctcgccgagaagggagtagtagtattacctgatacctatgctaattcaggtggcgtggtcgttagctacttcgagtgggtacaggtaaaatgcctgttcgtcgctgcttcattgctcgattgtttccttgatctaatctactttcttgtgccatgttgattgatcgtgtagaacattcaaggtttcatgtgggctgaggagaaagtgaacgatgaactagaaaagtacatgagcagtgcttttcaacacatgaaggccatgtgcaaatctttggtgctgccgaagtgtgccatgacattggaattgcgggtctagaaaacaagctcattagatttctaaaaaaatattgggagttccagacattgtagagtgctcttttgtgcaatcaactgtgacag

SEQ ID NO: 9867 - DNA, 646 bp, Zea mays
  Clone ID: LIB3279-201-Q1-K6-B7
cccaaaccctaccggcggcgcagcagcatcacaaccaccgcccgaagatggtgaagtttctcaagcccggcaaggccgtaatcctcctccagggcaggttcgccggccggaaggcggtgatcgtgcgcgtgttcgaggagggtacccgcgaccgtccctatgggcactgcctcgtcgccggcctggccaagtaccccaagaaggtgatccgcaaggactccgccaagaagacggccaagaagtcccgcgtcaagtgtttcatcaagctcgtcaatttcactcacctcatgcccacccgctacaccctcgacgtcgatttcaaagacgtcgcctcgggcgggcccgacgcgctctccacccgggacaagaaggtcgaagcctgcaaggccgccaaggcgcgcctcgaggagaggttcaagaccggcaagaacaggtggttctttaccaagctccgcttctaggcgccgggcaccccgcatagtgactactttagttgtcaatttgttgtatcggaaaccatttaagctatttctgttttggtattgcgcttgttatggatctcggagaagattttgttaaaaacatgtcgatgatgtgttaaatgatgcccaaaggaaacgtctcgttgaacttttgctgagaaaaa

SEQ ID NO: 9868 - DNA, 480 bp, Zea mays
  Clone ID: LIB3279-201-Q1-K6-B8
aaactgaaacctcattgtttattctttaacaaagcacaaaagaactaaaacttgcgaattcgttacaggacggcagcagataagttaaacacaaaaagacagcgtgtccaaaaccagcatggatccagcgtccaggggcaccggtcacatttattctcagcatagacaagcagcaaagatggtctgcgaccaaaggccattggggacgacccacgatagggaggcagaaatctatctctctactagcctactgggtcttgaacatgtggcggatcaggtcgacgacgcggttgctgtagccccactcgttgtcgtaccacgagacgagcttgatgaagtggtcgttcagggcaatcccggccttggcgtcgaagatgctcgacctgctgtcaccggtgaagtcggtggaaaccagatcctcctccacgtagcccatgatacccttgagtgggccctcagaagcggccttaatagctttcc

SEQ ID NO: 9869 - DNA, 377 bp, Zea mays
  unsure (1)..(377): unsure at all n locations; Clone ID: LIB3279-201-Q1-K6-B9
aggagagcaagcgaggaagcgaccatgagggccaagtggaagaagaagcgcatgaggaggctcaagaggaagcgcagaaagatgaggcagagatccaagtaggcagatcgagatggattgtggacctgatgacatgcgtgggtacatacatttcttcggatgcgttggtgtgcctgtggagagatgtcaacctgccatggtgtcagggtccgcatcagttgacgttttgcttgactttaagtaggccatttttaatggttttagtggaattgaaatccaccgttggcaattaaaataaataaacatttcgtttgggaaaccattattaatgaaccttatttggttattatatcttaaanaaaaaaaaaaaannaaaa

SEQ ID NO: 9870 - DNA, 637 bp, Zea mays
  Clone ID: LIB3279-201-Q1-K6-C1
ctctcctcccttgcttctctctcacacatgcgcccagccactagaacctctgtcccgcacgcgcaccaggaagtcgaccaagccaccctcgcccgcgacccgcgacaccgacgccggccgagcaccgccaggaagccgacccggtgctctgcaccgaccacgccgcagcagcatgcgcccaggcgcgccgcgccctgcaccgagcgcctacccccgcgacgagcctcgaagcgccgaggccctgcccgaccaagccacgaccgcaccgcgccctgcaccgagcgcccaccccgagcagaccgcgagtccgatgccgaccgcgccatggccgagctcgaccaagccgccagccgcacgccatttcgtcttaaccgcattaaggatcttcagtgcttccgtttcttcctctcccattattttctttggtaaccgacgccattgaaggcctccatgaatacccgccggcgcccccatgacctccctggccgacccttcccctctccctcctgctccctataaaaccgagctcctcctctctcctctctccctcgcctacccgagctctctctcattcctcgcactctctccctcgccgttcgtcgccggagttcgccgttcatcaccggagctagccacc

SEQ ID NO: 9871 - DNA, 639 bp, Zea mays
  Clone ID: LIB3279-201-Q1-K6-C10
cccacgcgtccgctgggcgcgccgggccgcgccgagccgagcgagtcgtccactctccactccgcccgccacgcccacgccccgtcctcgcttccgtctcccacaatccaaggacaccgagcagcaggcggcggaagcaacccgctgtgggggcggcgtggagtccagttttgctcggctcgccgctgggatccgccggccggcgaagcggggaagggaagaggggcggagattggagagtacaagcaggggaagatgtcagacgcgctgatcaacggcctcgccggcgccggcggcgggatcatcgcccagctccttacctatccgctccagaccgtgaacgcgcggcaacagacggagcgcgacccctccaagccggcgttcaaggacggcgccgctcgccagttgtatctggttgtgaagaacgaggggtgggagcgcctgtatggcgggcttatgccctctctcgtcggcaccgctgcctcccagggtgtctactactacttctaccaaatattccggaacagggccgaggcaagggcccttgagcgatccaggagagggcttggcgatgggtctgtcgggatgctccagtctctcactgtcgctgccctgtctggctgtgtcaatgtactgctc

SEQ ID NO: 9872 - DNA, 640 bp, Zea mays
  Clone ID: LIB3279-201-Q1-K6-C11
cggacgcgtgggcttccgcctacccacgcaaacggcacacgaactaacagccacctctcacgtcccccaccctctggttcatgtcctgctgctccccatgtcgcctccactcgagctcgactacataggcctctcgccgccggcggcagccgccgccgctgaaaacgacgaactgaagggtactgagctccgcctcgggctgccagggtccgggtcgccggaccgccgtgtcgtggctgccaccgcgaccaccctggacctgctcccggccaagggcgccaagcgcgggttttctgacgaggcgcccccgccatcgcctgttgccactgccggaaagggaaagaaggtggcagaagaggagtacgacgagaagaaggtggcagcgaccccgcagccggccgccaaagcacaggtggtgggatggccaccagtctgcaactaccgcaagaacacgatgactaccacccagctggagggcagcaaggaggatggtgatgccaagcagggtcaggggttcctgtacgtcaaggtcagcatggatggcgcgccgtacctcaggaagatcgacctcaagacttacaagaactacaaggacctgtcgaccgcgcttgaggagatgttcagtggcttcagtactggc

SEQ ID NO: 9873 - DNA, 546 bp, Zea mays
  unsure (1)..(546): unsure at all n locations; Clone ID: LIB3279-201-Q1-K6-C12
cccacgcgtccggtaccatgctttcttggcatcagaggccatcatcaagcagattccccgtctccttggtcctggtctcaacaaggcaggcaagttcccgaccctggttactcaccaggaatccctcgaatccaaggtgaacgagactaaggcaaccgtcaagttccagctcaagaagggcctttgcatgggcgtcgccgtcggcaacttggcgatggaggagaagcagatccagcagaacatccagatgagcgtgaacttccttgtttcccttctgaagaagaactggcagaatgtgagatgcctctacgtcaagagcaccatggggaagccatacagggtgttctaagtatgctcttttgtgaagtctgctaggttctggcaccgaggttttattgaattaaactcttgttaaggatatgtttttggacgatcctatatttcgtcctggcgctactatgtttcagaatggtggtactactataagtatcctggcgctctaagtattgcttgaaaggatcaatataatttgcgtgtcatacccna

SEQ ID NO: 9874 - DNA, 598 bp, Zea mays
  Clone ID: LIB3279-201-Q1-K6-C2
tggtttgtacaagaaaaaagttgtaagatattgactgctataatcagtgcacgaccaaagcttcggaatggcacacttccaaatggagatgcttcgaatttgaagagcaagcttacttcaacacatgatgtattgagaggtttggtcaattggctctgttcacagctgaggaatcctacacacccgagctgctctatttctacttccatccattgcctctccacttcgctaagagaaccatatgttaggacattatttgttcaagctgatggcatcaagctgctcattccattaatttccccagctgccacacaacagtcaattcagctcctttatgaaacttgcctctgcatctggcttttatcattttatgatgctgcagttgattatttgtccaccacaagagttataccaagacttgttgaggttgtcaagggatctactaaagagaaggtggtcagagttgctgtgttgtctttctgtaatttgctggcaaagggtgcatttgctgcccagatgatcgatcttggattgccgcaaatagtacaaaacttgaaagctcaagcatggactgatgaggatctgttagatgctttga

SEQ ID NO: 9875 - DNA, 602 bp, Zea mays
  Clone ID: LIB3279-201-Q1-K6-C3
cttgaaaactgcaattgagaaggctggatacactggcaaggttgtcatcggaatggatgttgctgcttcggagttttacagtgacaaggaccaaacatatgacctcaactttaaggaggagaataatgatggttcacagaagatatctggcgatagcttaaagaatgtatacaaatcttttgtgagcgaataccccattgtttcgattgaagatccttttgaccaggatgactgggttcactatgctaagatgactgaagaaattggagagcaagtgcagattgttggtgatgaccttctcgtcaccaaccccactagggttgctaaggctatcaaggagaaatcatgcaatgcccttctgctcaaggttaaccaaatcggatctgtgactgagagtattgaggctgtgaagatgtcaaagcgtgcgggctggggtgtgatgactagtcataggagtggtgagactgaggacactttcattgctgatctggcagttggtttgtccacgggtcagattaagactggagcaccctgcagatcagagcgtcttgccaaatacaaccagcttcttaggattgaagaagagcttggcgctattgctg

SEQ ID NO: 9876 - DNA, 636 bp, Zea mays
  Clone ID: LIB3279-201-Q1-K6-C5
cggacgcgtgggtataaatggacttaaatcacactgtaatagtcagttaatatgcatgccactactttgttaaagcgaagatgcatgccacttcttctagagcaagtgaatgggggtatgagttggatgttttaggtctctgtttgatgtgggatggagaccatcagaagagatttgatcaccatcgaggtatggaggggaagcagtaggagttcccgggggagagtagggtacaaacagaagagcatcgacaggtattacctaagtggtcatttcctgtctatctgggaggggatccagtggtgtggcttgatcggtgtatggagtattttaccatctatagtgttccaaagttgatgtgggtttctgcagcatcaatgcattccgatccaaatgttgctcaatggtggagatgtcataagctgtgtcatggcatgagtatttggcaagggtttgtttctgctgcgacacagaaatatggtgttgatgcttattcgaaagctctgagaagacttatgaatctaaggcaaactagaaatatcaaatgtgtatattattcatcatatttgttggagattattaatgtcatgcttagtgttcgtgccaatagataagtctgggggtgatgataatatg

SEQ ID NO: 9877 - DNA, 582 bp, Zea mays
  Clone ID: LIB3279-201-Q1-K6-C6
ctagccgccatatctcacgatccactcgagcaccaagccgagggaaggtgaggagcgatggcgcgcggcgtggtgtcggcgaagggcggcgcggtcgcgggcaagaagaaggggtcggtttccttcacgatcgactgcaccaagccagtggaggacaagatcatggaggtcgcctcgctcgagaagttcctgcaggagcgcatcaaggtcgccggcggcaaggctggcaacctcggcgactccgtcaccatctctcgcgagaagaccaaggtcaccgtcacctctgacggacccttctccaagaggtacctgaagtacttgaccaagaagtacttgaagaagcacaacgtgcgggattggctacgcgtggttgctgccaacaaggaccgaaacgtctatgagctccgctacttcaacattgctgagaacgagggcgaggaagaagattagattgcactacgcttatattttagtattgaactcgttgcattttgatacctgtacccgtagtttcgcaaatgtcccatgttatggtgtggtatgggtaatttgaagaatccttatgtactgaatctctgcaaa

SEQ ID NO: 9878 - DNA, 243 bp, Zea mays
  Clone ID: LIB3279-201-Q1-K6-C7
tcattggccagtgcaggcccctatcaaaaactgtgaggttcaatgtcgtcaaagtcattccagctggatctgctgctgccggcaagaaggctttcaccgcagcctgagtttaagactatgttccatgagtagtttatatagtgatgtctttttttgttaaaaaaactgccttctaggcttgtgcctttcgactatggtttggagattgttcccatcttaatgaagtccaatcatctgaacaaa

SEQ ID NO: 9879 - DNA, 427 bp, Zea mays
  unsure (1)..(427): unsure at all n locations; Clone ID: LIB3279-201-Q1-K6-C8
ctgccccatttggtgggcttgggagtgttccaccaggtggtcgctatgatccaattggcccacctgacgtcccagggtttgagccatctagctttgttaggcgtccaaggcggcctccaggcgggagcacccacccagacctcgagttcttccagcaaggcccagacttctgagaatcgcgcagaggccggccagagcctcgccctaccctcacgaaataacttcaaaatgctgagccctcgagctagatatcccgctcgcttggtgtgattgcaactgctgtatcgagtatagtcctagtgcgctttggctgtaaagatggatgtgaacatcgtcctagtgtatttactcttaattccaaaccatcgtctgtcgtagcctaatatactcttttgtgtataatatcgggtgtaccggagctgnnnaa

SEQ ID NO: 9880 - DNA, 637 bp, Zea mays
  unsure (1)..(637): unsure at all n locations; Clone ID: LIB3279-201-Q1-K6-C9
cggacgcgtgggcggacgcgtgggtgtctcttggcaaggttgaatcggctctagcaacaagcaactatgtggagaacatcatggtttatgccgatccatttcataactactgtgttgccctggttgttccagcgcaccaggccttggagaagtgggctcagaattccgggataaactatgaaggctttgcagagctttgccaaaacgaccgagcaattaaggaggttcagcaatcgctatcaaaggccgcaaaagcagcgaggctcgagaaattcgaggtgccagcgaagatcgtgctgttgcctgaaccgtggacgccggagtccgggctggtgaccgcagcgcttaaactgaagagggagcaaataaaggccaaattcaaagacgatctggacaagctctaccactgaagaagcgacagaggacggtttaatttgcacctaccgcttccagacgcttgcggtgccaaaagctgcctggatggaacttttactgacctgcacgagtggtgtgtgtgtgtgtgtgtgtctnccagctgccgatacacaggactacaggagcttcgttcttctgtgatgactgangaaaaataaacccagtgttggaatgatcttgatttgaatagcttcacgtcatg

SEQ ID NO: 9881 - DNA, 594 bp, Zea mays
  Clone ID: LIB3279-201-Q1-K6-D1
gtcgcccagcgtccgcccgcgtccggcaagcccaagcccgcggttcgccgcgccgacgccgcgactccgcgcaccgccgactccgccgacgccgccgacaccgccgacgccgccgacgccgccgacgccgccgacgctgccgacgccgccgacgccgctgacgccgccgacgccgccgacgcccgaggcgaggaaggggttcatgcgccgcatcttccctttcctcctagccgccaacctctttgttggagcttatgtcctcgtgcgggccaaccaaaaggactcagcaaagaaggacccaacgactgatcctgctactgcaactgctgggaagcctgctgagccagtctctatccccagaaaggagctcccaccaatccctgaagatgaccagcgcaagctctacaaatggatgctggaagagaagcggaagatcaagccacgcaatgctgccgagaagaagaaactcgatgaggagaaggcccttctaaaagagttcatccgagcaggatccctcccaagcttatgagctcacccatttgggtctcttgtgcctgatgttcagccaagaagatgattgggcctgattggatt

SEQ ID NO: 9882 - DNA, 633 bp, Zea mays
  Clone ID: LIB3279-201-Q1-K6-D10
tcatcatcgatcttcctgcgtctctgaactttttctgctgtgtctgttggccgggagcagaggttgctacacgtatatattctgaagaagagatcgagatgaccagcgtgtggaagaccaaggttctgcctggcctcaacaagatctttgacaaggatggcaagaaggctgcagctgcaggcttcttgaagtccttcaacaaggaggagattgacaaggagattgaggacaagaagacagagctggagcccaaggtcgtggaggcctacgaagcatctcctcctgaggtcaaggctctgttcaaggataagaagccagtcaaggtcagcaagaagaactcggctgcagtcaccaagttcctcgatgagctggctaagattgacttccctggagccaaggtggtgagcgaggcggtggccaagtccggcacctcgcccctgcttccggcgatcaccttcatcttggacaaggtcgcaccgtttatccccaaggaggagcccaaggcggagccggcggcggaggccacctcccgggaagtcgccgtggaggagaagaaggaggaggccgagccagctgcagcgacggaggcggcaccggcgccggcagagacaccgtcggaggcggcggtggtag

SEQ ID NO: 9883 - DNA, 599 bp, Zea mays
  Clone ID: LIB3279-201-Q1-K6-D11
aacgatatgtggagtgaagtgagtgctaaactttccaaagccttacaagcacatgttcaagatgccattttggatagccgagaggatggactcatgagtgataggaaaaactatcctttgagtatgcttgccattcatgctggtcccagattgcggcttcttctgatcacattccagcttctggaaatggaggtaagaaatatctctggaagttctgaacttgatggaatcaggtggttgcaagtatcaactaccttgatagatagtttaattcaaccagtatttatgaaatggattgaagaagaacatgccttggaaaatggacaaatcaacgaaaaacttatgaagacgataagcagcaaactaaaggaggacaataagatcttgaggaggtttaacagatttgggaaatctgagctctatttggatatgctctttttcctaagatttggttctgcaaggtgtgacagctattttgacgtcaaatttcttgctgaacatggagaaagaattttagaggaccttgttatttccttagctgatgtgattgctagtatttatctggagcttatgtcagtggatggtgatatgtctgctga

SEQ ID NO: 9884 - DNA, 631 bp, Zea mays
  Clone ID: LIB3279-201-Q1-K6-D12
ggaacatcttgtgaggatgagatgtggttctctgaccgttgccgtgtacggagacgaggacaagccggcgcttataacgtacccggatgtagctctgaactgtaagtgctgtcgatcgaagatttttttctgattcactgccaagacttaacattgtttatatctcgctgcttcctattggcttgggcagacatgtcctatttccaaggatttttcttctgcccggaagtggcgtctttgctgctacacaacttatgtgtctaccacatcaatccccaggggcacggggtcagtgatgctggttcaatacctgtgacaaggtgtgatgcgtctgtattttgagttggttacttacatgatctttattgtgtggcttttgttaagagtcctacagatgggagcagctccaatgtcgtcagatgtgtcggtgccatctgttgctgatctaacgtaaaaattttattactagatatttgaaagcaatgatgtaaaggcttggacatcaatgtaaaggaagaacacctgttctgttttcttctcattttctattgatgtaggaactcactaccattgacaaattccatttatgcattgacaacttttgtacaatctttagactacaatctacact

SEQ ID NO: 9885 - DNA, 587 bp, Zea mays
  Clone ID: LIB3279-201-Q1-K6-D2
ctctctttctctctcctgccccaaccaaccaatggaggctctcgcgggcgccgcatcctcctccgttctccccgcgcgccacccgccctcccgcgtggccgcgcagtccctcgcgctccgccctagccgctgcggtcccctccgcgcggttggcgccggcggtgtcagtggcaaggacgaggcccaggccgcccacgccgccaacgggtctcccgtcctcaagctgaatagcgattccagtctaaatggagtcctaccgattgcagctgacaagtcacagaaggcttcatcaactaacgttagtactgactctagtggatctagagctggcctgtttagaacacccatatcaggtggtgtgcagagtgcaactttcgcccacggtctacccccgccggctttggctgttcgcaatttgatggaacaggcgcggtttgcccacctgtgctctgtcatgtctggcatgcaccaccgccgtactggatatccgtttggttcacttgtcgactttgcctacgattaatgggccacccaattttttcgctgtcacccttggccatccatacgaggaacttactcgctgaccc

SEQ ID NO: 9886 - DNA, 668 bp, Zea mays
  unsure (1)..(668): unsure at all n locations; Clone ID: LIB3279-201-Q1-K6-D3
cgcacgcacccctcactttccttgtcaatcgactcgcgatcgaatccgccccgaggttccaaaccctagctttctctcatcctccacgaaccctagatccaaaatctaacacacgtcatcctcttattatcgccgtgcttgacgcttctctctgcagtcgattccgccgcggaccgcccggttcacttcccttttctcccgagatctcgactctcgagcaagtatgggtgaggcgaaggacaacgaggtgtacgaggaggacctagtcgactatgaggaggaggtggagaatgtcattgatggcgcccccaccaacggctcctcagatgtcgtcaagaaggggtacgtagggatccacagctcggggttcagagacttcctgctcaagccagagcttcttcgcgccattcaggattgcgggtttgagcatccttctgaagtgcaacatgagtgcatccctcaagctattcttggaatggatgtcatctgtcaagcaaaatctggaatgggtaagactgcagtttttgtcctgtcaactcttcagcagattgatcctgttgctggccaagtagctgcacttgtgttgtgccacacaagagaattagcttaccagatttgccatgaatntgagaggtttagcanatacctgcctgaattaagagtagctg

SEQ ID NO: 9887 - DNA, 574 bp, Zea mays
  Clone ID: LIB3279-201-Q1-K6-D5
ggcgagatgactctaaggggccttgtattgccagttggtggtgttaaagacaaggtacttgcggcacatcgttatggaatcaagagagtaattttacctgaaaggaacttgaaggacttatcagaggttccattaccaattctctccgacatggagattctgcttgtgaagcgcatcgaggaagtactcgaccatgctttcgaaggcggatgcccacttagatcacgctccaagttgtagcacccaactcgcgtttggtatggatgtttgcttgagaggatcatcgtcacagtaccacgaatggtcaacagtgtgagattccctgctggtcttgccacgcccttttcggtttggcttcgcgtctggaatgtgtatacaggattactggtcagaattctgagaataacgagaagattctctgctgggatagtgggattccctgcatatttatgtgaaaccagctgtcggtctttatgcacagatgcaacagcaacacaaatctggtaggaacactggtgggtttctgtcgataatttgagtgtatatgtaatattatgtaatctattccaccggg

SEQ ID NO: 9888 - DNA, 646 bp, Zea mays
  Clone ID: LIB3279-201-Q1-K6-D6
attcggacatgtaaaaaaaatttatcctccaatgtcactagcacatagaattttctcttgttcctgttgaatacagtatgtatactacacgtcctcgagaattcgcgcagctgagccgagttccatgccttctcgggaaacaaagcagtagatggatgaggcacatcgcgtcagcggcaaccgcctgcggtacgcgccagaaataataattaggggatcctgataagtgttggcacaagtagcttgccagcacccaactccaagcaagccataactgcaagaaagcaacggcagcaagaaaccttgtaaacatcggagcatagatcgcggcggtgatggcggccaaggtgaggacggagctggacgtgggcgccgacggcgtggccgtaatcaccatctacaatccgcccgtcaactccctctccatcgacgtcttacatagcttaaaagaaagctatgaagaagcacttcggagaaacgatgttaaagctattgtcgttacagggaaaggagggaaattttctggaggatttgatattagttcctttggtggtgttcaaggaggccaaacaatgcaaccaaaggttggctacatagcaatagatattctcacagatactgtagaagctgcgacaaagccatcaga

SEQ ID NO: 9889 - DNA, 386 bp, Zea mays
  unsure (1)..(386): unsure at all n locations; Clone ID: LIB3279-201-Q1-K6-D7
cgaggccatcgctgatcctcccacgtgcctcctcgcactcgcactcccaacccagcgccggcgggctcacctcttaccgngtnaccgnctnccaccgncggggcggggatttcgttttcgtcgtcaaccccttgggtacgcttcgcacccctactccttttcacctccgctcccgctagaggacgtgcgaatcttctctaaacgccgttattttcgcggcgcaggcgccaatggccgcacgggaaagcagtggaagcagttgctgccgctttttcgcacccgccttgctgaccagtgcaacatttgcgagtgatcactttgggcccatcccatgccatagatgtcacaaggaggctataaaagatgggggtgatgccgtgatagct

SEQ ID NO: 9890 - DNA, 635 bp, Zea mays
  unsure (1)..(635): unsure at all n locations; Clone ID: LIB3279-201-Q1-K6-D8
gaggacggctactctggcgtggaggtgcgcgtcacgccgatgcgcacggagatcatcatccgcgccacgcgcacgcagaacgtgctcggcgagaagggccgtaggatcagggagctcacctccgtcgtccagaagaggttcaacttccctgagaatggcgtagagctttacgccgagaaggtcgtcaaccgtggcctctgtgccatcgcgcaggccgagtccctccgttacaagctcctcggaggccttgccgtccgcagggcttgctatggtgttcttcgttatgttatggagagtggtgccaagggttgtgaggtgattgtgagtggaaagctcagggcccaaagagccaagtccatgaagttcaaggatggctacatgatctcatctggtcagccagtgaacgagtacattgactcggctgtgagacacgttcttctcagacagggtgttcttggcatcaaggtgaagatcatgcttgactgggacccgaagggcaaggttggcccgatcactcctcttccggacctggtgaccatccacaccccgaaggacgaggacgagccgcgccctccggtcttggcacctnctgagggtgtaggtcccaactgtgtnncttgaatggcagtttgatc

SEQ ID NO: 9891 - DNA, 630 bp, Zea mays
  unsure (1)..(630): unsure at all n locations; Clone ID: LIB3279-201-Q1-K6-D9
cccaaatcgaccgagcgaattcaccacagncttctcnaccaccgctaccttcgatggcacccaaggcggacaagaagccggcggcgaagaagcctgcagaggaggagcccgcgacagagaaggcggagaaggctccggcggggaagaagcccaaggccgagaagcgcctcccggcgggcaagtccgccggtaaggagggcggcgagggcaagaaggggaaaaagaaagcgaagaagtccgtggagacctacaagatctacatcttcaaggtgctgaagcaggtgcaccccgacatcggcatctcgtccaaggccatgtccatcatgaactccttcatcaacgacatcttcgagaagctcgcggccgagtccgccaagctggcgcgctataacaagaagcccaccgtcacctcccgcgagatccagacctcggtgcgcctcgtcctccccggtgagcttgccaagcacgccgtctccgagggcaccaaggccgtcaccaagttcacttcttcttaggctcatagtactaggctgggtggtgttggtagacgtggctcaatttatctggtaggggtagtgatggatgatatgatctgcgtctatttgagctgttaagactgatgaacattgt

SEQ ID NO: 9892 - DNA, 598 bp, Zea mays
  Clone ID: LIB3279-201-Q1-K6-E1
cttatgttcctatatgactactagctagaagttagagcctagatgatggctgcttctgttggcgtgaaagctcgagtgctcctaaatggtcgtcgtattagctgatacgacatcgacccgatgcaatagataatattgtttacacgcgcgagtccaaaattgttggctttgggtcggagcagttaacgcgagaagtgtattttatcacttctgagtgcaaccttttttttattatttttccgagcttctgcctcttgcatatgttgtagattctcgtcgagaagggagtagtagtattacctgatatctatgctaattcaggtggtgtggtcgttagctactttaattgagtgagttcagaacattcaaggtttcatgtgggccgaggagaaagtggacgatgaactagaaaaggacatgagcagtgcttttcaacacatgaaggccatgtgcaaatctttggtgctgccgaagtgtgccgtgacattggaattgcgggtctagaaaagcaagctcattagatttctaaaaaaaacattaggagttattagattggtagcatttttttaagaattaaaattttatagaagtcatcatt

SEQ ID NO: 9893 - DNA, 555 bp, Zea mays
  Clone ID: LIB3279-201-Q1-K6-E10
cccacgcgtccgatagaatggacctgcttagagctgtcattatgggaccagctggtactccttaccatgacgggctcttcttctttgacatttacttccctcctcagtatccaaatataccaccgatggtgaattaccgtgctggtggtttgcggcttaatccaaacttgtatgcttgcgggaaggtgtgccttagcctcctaaacacgtggactggcagtggatgtgagaagtggaacccggccaattcaactatgctgcaggtcctggtctctattcaagctttggttttgaatgcaaagccttatttcaatgagcctggctacgctatgcatgctaacacagcccacggggagaagaaatccctgacatataatgaagacacgttcctgcactcctgcaggacgatgctgtattctcttcgaaatccaccaaagaatttcgaggattttgttgctggccatttccgcaagtatgggcgcaacatcctcgtggcttgcagagcctacctggagggtgcccaggttggatgcctctccggtgaccgagtgcaag

SEQ ID NO: 9894 - DNA, 613 bp, Zea mays
  Clone ID: LIB3279-201-Q1-K6-E11
actctctctcctccaagcctaccccagccgccgccgccgccaccgccacctgccccagcgcgccgccgccgcagccaccatgggtcgcgtccgcaccaagaccgtgaagaagacctccaggcaggtgatcgagaagtactactcccgcatgaccctcgacttccacaccaacaagaaggtgctcgaggaggtctcgattctgccctcgaagcgcctccgcaacaaggtggctggcttcagtacccacctgatgcgccgcatccagcgcggcccagtccgcggcatctcgctcaagctgcaggaggaggagcgcgagcgccgcatggacttcgtgccggagaagtccgcgctcgaggtcgaagagatccgcgtcgacaaggagaccatggagatgctcgctgccctcggcatggccgacctgcccggcgttgagcgccaggctgaggtctccaacgcccccgcctacggccgcccgcagtacggtggtccccgccgtgaccgcgtttagacttcgcggtggttgcctcttgatcgcactgctattcgtagttgttgtcctactatgctaaacttcttttagatctttggttgcatctgtggcggttaagttttg

SEQ ID NO: 9895 - DNA, 607 bp, Zea mays
  Clone ID: LIB3279-201-Q1-K6-E12
caagtggctggacctggccgtgctcttcagcatgatcgtcatctaccgcctgctcttcttcctcatgatcaaggccagcgaggacgtcaccccctggctgcgccgctacgtcgcgcggcgccgggtgcggaaccgtcgccaccgcaagccggacctgcccgcccggacgccgtcgctccgcgggtacgtcgtcgacgcggccagcctgccggacgaccacccgtgacgaaagagcgcgagagaaaacgtacgggcagggatgtcatttcatatcatatcacacagaggctaaaccggatcgagctgataataacacactcactcactagtactgcaataatatgatgttaagttggtatagcaaccgcttaagtgcccgttcggttcttcctgaatgctttactggattggttccggattggaatagttcacaaatttgtattagcttgatgagttggaatgattccggccttcaatctggactaaacgaacagagctgtaatggagtgttgcttgatgcactgctaagatgtacacgtatatgaagagcatgtgaccatcagttctacacatcttgggttggactttgacaccctagggttaagtg

SEQ ID NO: 9896 - DNA, 651 bp, Zea mays
  unsure (1)..(651): unsure at all n locations; Clone ID: LIB3279-201-Q1-K6-E2
gcaaggtcaaggcctcagcctctcactcgccaacggcagcgacagcggcaggtctggaatgttgccgatgtcgaacccttcagctaatcccacacagcttacaattttctatggtggatcagtatgtgtgtatgactcggtgccaccagaaaaggctcaggcaatcatgcttatagctgcggctgcagcagctgcggcagccaccaaaggcagtgctgccactgcttttaatcctccaatggtacatacagccactgtcgccccagcagcagtcttctctcctgtgcttacacggtctccatcactgcagagcacttctgtagcagctggacaagctcaggttgttgctgaccctagctcaataagcaagcttcaggctgatctccccattgccaggaggcactctctccagcgcttccttgagaaacgtcgtgacagggtcgtgagcaaagctccgtacagccccgccaagtcgttcgatggcatggagtcagcgggaatggagatgactgcggacggcaagcagggcgcaaggcccagtatcttgaaaggttggggagccgcgaagtctgaagtctgaacggtgaaaggctggctgacgcttgtgggaggaaggggcagggacgtgctgttggttntattatattggta

SEQ ID NO: 9897 - DNA, 527 bp, Zea mays
  unsure (1)..(527): unsure at all n locations; Clone ID: LIB3279-201-Q1-K6-E3
agcaaaggcatccaagatttacaacagaaagcttggagaagaacaagcagatttacctgaaaatagaagatttggccaagaagtaccagtgcagcccagctcagctagctctagcctgggttctgcatcaaggggatgatgtggttcctataccaggtgtgaccttataaacctgtcctcgttcaatggntagcnnngcacaatgtgcactgctgatattcatactattcccaagataaacaagaatatcagatgaatggtaaaaagcttcatgtatatactttctgacaaaagtgaaatgtgcaaaatgattcataggtaaccgtaaccgaaccgcaaatagctntgcctaatgttaaaattaccctctntgatcattgctgcttcactagaggagcagtgaggttacagatcatttgcgtatatcctataataaagcggctttctctgaatatgtatacatagtattttgtacaacctgttgagggttttttgtgatattattggtttttacttagctgaatata

SEQ ID NO: 9898 - DNA, 653 bp, Zea mays
  unsure (1)..(653): unsure at all n locations; Clone ID: LIB3279-201-Q1-K6-E4
cagtttccctcacattactgccactgacgttcattccgtttccttgcttgctccaggtactcccatcgctatcgaccgggtcctcgagcgcgggagatggcggatcaggagaccccagttgcagttgaggcccctaccccggtccttggggagccgatggacctgatgactgctctgcagcttgtcatgaagaagtcgggtgctcatgatggccttgttaagggtcttcgtgaggctgccaaagccattgagaagcatgctgctcagctttgcgtgcttgcggaggactgtgaccagcctgattatgtcaagctggtgaaggctctttgctctgagcacaacgttcacctggttactgtgcctagcgctaaaactcttggcgaatggtctgggctttgcaagattgattctgagggcaaggcgaggaaggttgtgggttgctcctgtgttgtcgtcaaggactatggcgaagaatctgagggccttaacatagttcaggagtacgtcaagtcacactagatacagtgcatcggtatctggaacttgtgctctacactagctttaagacctgaatntaaatttgtgctggttcttgggcttttctaggagattatctcaattcttgttttaagtgatgtcatctggtgttaata

SEQ ID NO: 9899 - DNA, 656 bp, Zea mays
  unsure (1)..(656): unsure at all n locations; Clone ID: LIB3279-201-Q1-K6-E5
cccacgcgtccgcccacgcgtccggggcacctgaaaacatattgtctcctacctcagcaccggtggatgaggaagtaaaaaacgaagttggcgagcgtattcttactaaagctaatatagatcaaactgtagaaggagtaagcgctgaagagattgacccagatagagtggaggtttgaagcttcaacttatttgcatgaatatcatttttatttgtatgcttggccctcatacctctttactacacgcatatggtagggtttcatatgacaaaaacttgtgttcccaagtatgcagctatttttgcatgtgaattgtagcattccaagattgcttaaaattatttagttgcttcacattggaaccaatttctattcttaaaatgtaccatcattcattgcagtcacgatctgtgtttgtcaagaacttaaatttcaagacaacagatgaatcattgaagcagcatttcagtacaaagctaaagagtggcagtcttaaaagtgcaacggtgaagaagcatgttaagaagggcaagaatgtttcaatgggatttggttntgttgagtttgactctgttgaaactgctaccggtgtgtgcaaggatctacagggaacggttctggatggacatgncttgatcttgcaactgtgtcatg

SEQ ID NO: 9900 - DNA, 637 bp, Zea mays
  Clone ID: LIB3279-201-Q1-K6-E6
tggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggcgggtacggtggtggccgtggaggcggcggctacggcggtggcgggcgccgtgatggcggcggcggctacggcggtggcggcggctacggtggtggcggcggcggctacggtggtggtggcggcggctacggcggtggcaaccgtggcggcggctacggcaactccgacgggaactggaggaactgagcggtggggcccgcgcggccaagttatcctgttcgctaccgtgttgtttaccctagtccagagtgtttatcttcgttcgtctcg

SEQ ID NO: 9901 - DNA, 622 bp, Zea mays
  Clone ID: LIB3279-201-Q1-K6-E7
cgaggaggagggggaggcatcgcctgcggttgctgccactcctgaggtcgcagcgaccgaggaggaagcggcggtccctgctcccgaggccgccgtcgctgccgtcgagaagtccgtcgagtgagtccagcgccggacggcggccgatctagctcgctgcgtcagcctgtcacctggcgtgcgccgctctggtgccactgccacggcaacagcacggcatggcgccggcataggtcgctaggaaaaacctgcttttgtgttcgggttcacgtcgtgtcctacgtggcgcggcgggccccgcctagtaaaggagcgtaggagcgtcgttttgtgttgtggtcgaataaataatgtgtctgtgtgccgatcccgtgtcgggttagtgggcccactgtcggtgctgatgtggcctgcctttacagcacatcggtggggctgggccgtagagctcctgtgtcgtttaaatatatgtgtactctgtactgtaccaactagtatgtgtttcgagtgtgtagtaagcatatttgtgtcccatccatctttcgaaactttctttttttaagctcttgaagcgtgaactctgttacgagctgctcgccctattataaattataaaattagt

SEQ ID NO: 9902 - DNA, 641 bp, Zea mays
  Clone ID: LIB3279-201-Q1-K6-E8
ctcgtgtggccgtcgtctcccgttcggaacgccaagccccccctccggcgaaatggcccccaagcgaggtggcagggcgccggtgccggccaagaagaagacggataaagtgacgaaccctctattcgagaagaggccgaagcagttcggcatcggcggcgcgttgccgcccaagaaggacctgcaccggttcgtcaagtggcccaaggtcgtgcgtatccagcggcagcgccgcatcctcaagcagcgcctcaaggtaccaccggcgctcaaccagttcacccgcaccctcgacaagaacctcgctacgaacctttttaagatgcttctcaagtaccggcctgaagacaaggctgccaagaaggagaggcttctgaagagggcccaagctgagaatgaaggaaaaactgttgagtcgaagaaaccaattgttgtgaagtatggccttaaccatgtgacttacctcattgagcagaacaaggctcagcttgttgtcatcgctcatgacgtggatccgattgaactggttgtgtggcttccagccctgtgtaggaagatggaggtcccttactgcattgttaaaggaaaggctcgtcttggatcgattgttcacaagaagaatgcatcagtcttgtgtctta

SEQ ID NO: 9903 - DNA, 449 bp, Zea mays
  Clone ID: LIB3279-201-Q1-K6-F1
acctaaggcaaggcatcggtgtgggtggctttcagaagatctacggtggccgccagaggaatggctcccgcccaccacacttctgcaagagcagtggtgctgttgcacgcaacatcctgcagcagctgcagattatgggcatcatcgatgtcgatcccaagggtggacgcctcatcaccaaccagggaaggcgtgatctggaccaagtggctggaagggtcgctgttgaagcgtgagcagtgtcatctttggtttcaatggtgtcatgtttgatggttgagaagactgcgctctatttgctcttttgggttaggattttcgagttcagaggactttaaggtttattgcatctagctatggcgccacactatgttccccgagtacctaatgtgatatcaagactcaattctcgaatctaagatatatgtttgcaaagtgtctgaccaggt

SEQ ID NO: 9904 - DNA, 621 bp, Zea mays
  Clone ID: LIB3279-201-Q1-K6-F10
gacgacttcgacgaggacgacttctccaccgccccggcgcccaacgtcgcccgccagccgcgcgctgcgcgtggtgatgcggcgtccccagtgttcgccaaaatcaccgtatcggatcccaagaagcacgcggagcccagcggcgggggtgccgccggtgtgatcccggggtccggtagctacttctcttacctcatcaccacccgtcttgcgggcggcggcggggaggtccgcgtgcggcggcgcttccgcgacgtggtgaccctcgcggaccgccttgccgcagcccaccgtggcctcttcgtcccggcccgacccgacaagagcgtcctcgaggggcaggtcatgcagcgccacgacttcgtgagccagcggtgcgctgcgctccagcgctacctccgccgccttgccgtgcaccccatcgtcggccacagccctgacctccgcacgttcctcacggagcctggtgccgtccctgcctttcagggtgagcccccgcggtactggactaccacgctgaatgctgctgctccgctggtgccaacgaaagctaggagggacttgtttgggatgtttaagggtctcaagcagacggtggtgaatggactggttgcaacaaag

SEQ ID NO: 9905 - DNA, 639 bp, Zea mays
  Clone ID: LIB3279-201-Q1-K6-F11
agctattcagctatcacaaacccaagaaagaaaagaaaaaaaaggccgcgacgagccgacgagagcaacgacgaccatggcgacgatggtcgcttcttcctgccacgggcaacttctcctgtttctcctcgtggccgtcgcgtcggcctgcctcggctccgcggcagcgcatcaagccggatctggagagggctacacgatagctggccgcgtcaagatcgatggcatgagcgtgaagggctttggtcttgcaacaaagacatcaaacacaaaagtgatacttaatggcggccagagggttacatttgccaggccagacggctactttgcattccacaacgtgccagctggaactcatctgattgaggtctcctcaattggttacttcttttccccagttcgagtagatatcagtgcaaggaatcctggttatattcaagcagcattgactgaaactagaagagttctaaatgagcttgtcctggaacctctgaaagaagagcagtactatgaggttagggagcctttctccgtcatgtcacttttgaagagtcccatggggttgatggttggttttatggtcttaatggtctttgtgatgcccaagatgatggagaacatagatcctgaggagatgaa

SEQ ID NO: 9906 - DNA, 633 bp, Zea mays
  Clone ID: LIB3279-201-Q1-K6-F12
caggataagattatcggtcatataattggaactactggtgctgaggttctgcagtcaatgttaccttgggttacatcagcacttagtttagaggaacagaacatgatgctggatacatggaagcaagcaaccaaaaacaccatgtttgatgaatggctaaatgaatggtggaagggaccttcaacttcatctgacccatcagacaaggcttctactccttcaaaagaaagtcattttcaggagaatcttgaacaaaatgaccagatgtttaggcctggttggaaggacattttccgaatgaatcaaagtgagctcgaggctgagattcgaaaggtctctcgagattctactcttgatccaaggaggaaggcctatctgatccaaaatctcatgaccagccgttggatagctgctcagcagaaatcaccacaaccaagcgtcgaaggacataatggatgtacacgacgacctggatgtgttgcttcgttccgagacccagggaaacaaatatttggctgtgagcattacaaaagaaactgcaagcttgttgctgcatgctgcgataagttattcacttgcagattctgtcacgataaagttagtgaccatacaatggacaggaaatcagtgatg

SEQ ID NO: 9907 - DNA, 670 bp, Zea mays
  unsure (1)..(670): unsure at all n locations; Clone ID: LIB3279-201-Q1-K6-F2
cctgcgtccgcgtgtgctgtctccctctttctctctctgcgacgactgggtgggctaccgccgccgccgccctacgttagataccgaggccttcgccggcgacgaacacccgccagggatggcgaccacagcactgctccgggctctccggcggccctcatccgaagccgcgctgcgattggctacaaaggcaaatgtgcaaacaactaatggatatagacatctgaataacaggaacctaagcgttttcaatgagttttctaagcaactaaagggtgaggccaagagcaatcctgaattccagaaatccatgaaggagttcagcgagaaacttgatgtggtgaaggaagatctcaaagtaagaactaagaaaacgactgagacaatatacaagcgtgttgatgatgtttggagtgaagctgaggagacatctaaaaaggttactgcaaatatcaaagaaaaaatgtttgctgctaaagaagaggtaaaggaaagttttggagttggaaaagaagagagtacaagttgcagggatggtttgcctgaaggttcaaaacatgagaaaactgaggcatnctcacattcagatggcacgactgaagatgccacagacagccatacattgnttactaatttgaagtcaacaatctcatctgcttcaccagtagta

SEQ ID NO: 9908 - DNA, 617 bp, Zea mays
  unsure (1)..(617): unsure at all n locations; Clone ID: LIB3279-201-Q1-K6-F3
cccacgcgtccggcagcagccaaaacctacctagccgccgccgcaggcggccccccatcgccgccaagatgcagatctttgtgaagactctgacggggaagaccatcactttggaggtggagtcctccgacaccattgacaatgtgaaggccaagatccaggacaaggagggcatccccccggaccagcagcggctcatcttcgccggcaagcagctcgaggacggtcgcaccctcgccgactacaacattcagaaggagtccaccctccacctggtgctccgcctccgcggtggcgccaagaagcgtaagaagaagacgtacaccaagcccaagaagatcaagcacaagcacaagaaggtgaagctctccgtgctgcagttctataaggtggacgacgccactggcaaggtgacccgcctccgcaaggagtgccccaacacagagtgcggcgcgggcgtcttcatggccaaccacttcgaccgccactactgcnggcagtgcggcctcacctatgtctacaaccagaaggcgtaattgcttgccccgatttgctttatccgccaacctatcaagcattcagatgttgggtactcaaattgtatctcatttagatct

SEQ ID NO: 9909 - DNA, 663 bp, Zea mays
  Clone ID: LIB3279-201-Q1-K6-F4
gtaatgctgccgtggagtttgttaaatttcttgataatgagctcaagggtattgcagataaacttcctgttgacgttgccgacagcttgaaagctttgcaaatgcgaacacagtcactactgagggaacaatcaggtcaccccttagagctcgtgaatccaatggaacgtgatcatcttcacctgtccagtggtggaagtggaagatatgatttggtcactcataagtcaggaggtgtaggttacctgacaatgtctcaagatggcagttctgccagtggctcagccatgtccatcacgagtgaatccccatcccatcgtttcatggaaaacagttcaaaggcccatggtgattttgccccgaagcagggtacccatggagaggtccagttaattgagcagtttgaacctggcgtatatgtgacacttatccaactaaaggacggtaccaaagtattcaagcgggtccgattcagcaagaggagattcgcagagaatcaggctgaagaatggtggagggaaaaccaagagcgggtcttcaagaaatacagccacccaactcatgcaccacatggaaacacaacttctcacgaggaagagcatcattcatgatctccaaatcaggtccacacaggtcgtcatgtaggaggtttatcacgcgaaa

SEQ ID NO: 9910 - DNA, 463 bp, Zea mays
  Clone ID: LIB3279-201-Q1-K6-F5
cggacgcgtgggcggacgcgtgggtgatcgacaaggcatttgttatgttgagactgctgctttggatggtgaaactgacttgaaaacaagaaccattcctccaatttctgctaacttgtcagtagagcagctaggaaaagtcaagggtgtaattgagtgccccaacccagacaatgacatacggaggtttgatgctaacatgcgcttggtccttccttttattgacaatgaaaaaaggcctttgactattaacaatacacttctttaatcatgttaccttcgatacactgaatgggcttggggagttgcagtttacacaagccatggaacaaaatctggaataagtaggggagctggggagcccaagttcactggtgctgatgtaataatagacaagctcacttttgcaatattcatgttccaaggtggtggtgtacttggtctggggtattttgggaatact

SEQ ID NO: 9911 - DNA, 640 bp, Zea mays
  Clone ID: LIB3279-201-Q1-K6-F7
cgactctcctctctcgcatccgcagcctctcgagctctactccatcccctcgatctcgaagcgcagcagcagcagtcaggcggccatggacgccagcgcagcaggagccggcgggaaggcgaagaagggcgcggccgggcgcaaggccggcgggccgaggaagaagtcggtgacgaggtccgtcaaggccgggctgcagttccccgtcggccgcatcgggcggtatctgaagaagggccggtacgcgcagcgcgtcggcacgggcgcccccgtctacctggccgccgtcctcgagtacctggccgccgaggtgctggagctggccggcaacgctgccaaggacaacaagaagacccgcatcatcccgcgccacgtgctcctggccatccgcaacgacgaggagctcggcaagctgctgtccggcgtcaccatcgcccacggcggcgtcctccccaacatcaacccggtgctcctgcccaagaagaccgctgagaaggcggcggccaaggaggccaagtcgcccaagaaggccgctaagtcccccaagaaggcatagaggggcgcctttaccgctgtgatgttgaatgctcgtgttcagtagatctttacttctgtagtgtcgtcgttgttattggaactg

SEQ ID NO: 9912 - DNA, 604 bp, Zea mays
  Clone ID: LIB3279-201-Q1-K6-F8
ccccgcgtccggagagagagaagagagagagaagagagagagagagagaggagtgggagacccgcgagaggctgccgtgtagggaccgtagactcagcgactgcgaaggagggataaggggatggccgggatcggaccgatcaggcaggactgggagccggtcgttgtgcggaagaaggcacccaccgccgccgccaagaaggttgagaaggccgtcaacgccgcgcgccgcgccggtgcggagatcgataccatgaagaagtacaacgctggtacgaacaaggcggcatccagcggtacatccctcaacaccaagcgcctcgacgacgacaccgaaaacctcgcccatgagcgagttccaagtgatctgaagaagaatctcatgcaagcaaggctcgataagaagctgacacaggcacaacttgctcagatgataaatgagaagccacaggtgattcaggagtatgaatcaggcaaggcaatccccaaccagcagatcattagcaagctcgagagggccctgggaaccaagttgcgtggcaagaaatagctttcctacgagtttgtgtcccggagcatcataataaggggaagacaggcaagc

SEQ ID NO: 9913 - DNA, 644 bp, Zea mays
  Clone ID: LIB3279-201-Q1-K6-F9
caacaacagaagcaaacataattaagcagttggtggtcattagcgtactgcacagagtgcctacagaaaagctagagaagtaaacaaaatggctgcgtcctcgtacttccttcttgctgcttttctagcggtggttgcttcccatgccaccgcttccgatcctagcccgctccaggatttctgtgttgcggacatgcactctcctgtgaaggtgaatggatttgtttgcaaggactccatggccgtgaccgcagatgacttcttcaaagcagccaatcttgataaggctagagacaccatgaagagcaaggtgggatccaatgtcactttgatcaacgtcatccagctccctggcctcaacactcttggcatctccctggcacgtatcgactacgcgccattgggcgagaacccgccgcacacccacccacgtgccacggagatcctcacggttcttgaggggacactctacgtcgggtttgtcacctccaacccaaacaagctatttgccaaggtgctcaacaagggtgatgtgttcgtattcccccaaggtctcatccatttccaattcaacccggtctataacaagccggccgttgctatcgcggcgctcagcagccagaacccctgggttattaccatcg

SEQ ID NO: 9914 - DNA, 604 bp, Zea mays
  Clone ID: LIB3279-201-Q1-K6-G1
gtaccctgtggaccatttctgtgcaatcattaatcctccacagtctggcattctcgcagtgggtagaggaaacaaggttgttgaacctgttgtggacagcgatggaaccgagaaggctgctgcagttacaaagatgagcctgacactatctgctgaccatcgtgtatttgatgggcaagtaggaggcaagtttttcacggagctggcgctgaatttcagcgacatcaggaggctgctattgtaaatgaaaggaggcaattaccgtgttttgacgaattctttgggagcgaaaaccgctctggaaaagagaacatttggatgcaacccgtggtctgctgcttgatcggcatcccgtacaaaagtaaccaattttgtaataaatttataataagaatgcactggcaccttcacggttttttaacccgtttttcattagttgggaggaggcatgtcctgagaatttagcaggtacggtgccattcaagttcgtggttccgcaacaatgaccacccttagattatgcaatctgagcggttctggatggacgcccattttgttgatgaccttgtgatacatggaagtaataacagaatgcttttgttac

SEQ ID NO: 9915 - DNA, 624 bp, Zea mays
  Clone ID: LIB3279-201-Q1-K6-G10
gcctgatttgcctgctatacaaaatgttgctgttttacaatctgtggatacagctgcaactgatgcaaatgctagtgaaactggtactcgattactcaccaagagaagtatacatgaattagttgcacagattgatcctaatgaaaagctggatcctgaagttgaagatgttcttattgacatcgcagaagattttgttgagtctgtcacaacttttgcttgttctttagcaaagcataggaagtcaagcacattagaagcaaaagatgtactcctacatgcagaaagaagctggaatatcaccttgccaggcttcagtggtgatgaaatcaaactgtgcaagaaacagcacataaatgatattcacagggagaggcttgctctgataaagaagtccatggcgactgacacgagaaactctgctgcccaagctgcagctaaccagaaaaatcagactccgaaaccacctgcgccagctttcccgtgaaacatgttcacaggccctgcaaacacagtatcagtgtaccacgcatcacatctgtggtgttcggacagctgtcggttgtatgttggtagtgttgcaatgagtacatgtatagattattctgtcgttactcgttacta

SEQ ID NO: 9916 - DNA, 632 bp, Zea mays
  Clone ID: LIB3279-201-Q1-K6-G11
cccacgcgtccggttgcgctcgtgctcccctctcgtccgccgccagcacccccgcgccgccatggccacggactcctccgccggctcgttccagaagatccagatccagcgcgaggacaccacttttgatgcttatgttgttggcaaagaaaatgctcctggaattgtggttttgcaagagtggtggggagttgactatgagataaagaaccatgcgatccacatttcccaacttggtggaggatacaaagcactcattccagatttataccgtggaaaagttgctctggatgttgctgaggcacaacatctgatggagggtcttgactggcagggtgcagtcaaggatatccaggcttcagttaaatggctgaagtcaaatggatcacccaaggttggtgttactggctattgcatgggaggtgctttatcaattgcaagtggagttttagtcccagaggttgatgctgttgttgctttctatgggacaccatcttctgagcttgctgatccttctaaggctaaggctcctatacaggctcatttcggggagcatgacagttttgttggtttttcagatgtcactgcagccaagtccctggaggagaagctcaaatcttccgggataccat

SEQ ID NO: 9917 - DNA, 500 bp, Zea mays
  unsure (1)..(500): unsure at all n locations; Clone ID: LIB3279-201-Q1-K6-G12
atttgatagtgaagattctgttgaaagggtcatatcagaggggagaatgcgtgatcttggtgggaagcaggttgaaataaagaaggctgaaccaaagaaacatggatctgaccacagcagtaatgggagatcaaaccacggaggtggagcttaccgcaattcttaccgtagtggtggtggagctggtagtggcagcagtggaggcggcggtggttatgggtatggtggtgcttatcgatctgctgcagcaggttatggatatgatggtggcgcacgagcaggatatggctatggtagagggtatggctatggaggcaatgctggctttgggtctagttttggtggtggttatggtggatccatgtatggaggtgctgnctatggtgcatatggtgcctatggtggtggcgcctatggaggaggtgcctacggagggggtgcctatggaggtggtgctgtctctggttgtcccttagtttgtttttgttttttgttcttct

SEQ ID NO: 9918 - DNA, 649 bp, Zea mays
  unsure (1)..(649): unsure at all n locations; Clone ID: LIB3279-201-Q1-K6-G4
cgaacctatcaatgggaactgaaatgttctggcttggtcaccaaaggaagtctggaattggttttgcctctcgctataacacagacaaaatggtgggcactctacaggtcgcaagcactggaatagttgccttaagttatgtccagaagatttccgagaaggtttcccttgcgtctgacttcatgtataaccatatgtcaagagatgtaactgccagctttggttatgattacttgcttaggcagtgccgcctaagaggcaaaatagactcgaatggtgttgttgccgcatacttggaagagaggttgaacatgggtgtcaacttccttctatctgctgagattgaccattgtaagaagaactacaagtttggttttggaatgaccgtaggagagtaattctgccaaaacaattgctgtgagcgcacatgagatacttatgcagtcggcttcgcgcgtatgttgacttgttaaagatatttcaggtctcagttttgactgatcaggttttgccattgcgccgtggaaaaacacaggccgttgctgctttacagggttttgtatttcagtgtttnttcagctacttgagcatgggggccatgattctttgttcatcttggatgtaactagctgattggtgttccaacaat

SEQ ID NO: 9919 - DNA, 139 bp, Zea mays
  Clone ID: LIB3279-201-Q1-K6-G5
gacgaactcgaagcttgcgttcttgtagtagaggtcggcagcaagcggtggtagagcgagaggtcgagaagatgaagagcagcactctgttggcgatcctagttctccaggcccttctggtctctgcggccgtggccaa

SEQ ID NO: 9920 - DNA, 468 bp, Zea mays
  unsure (1)..(468): unsure at all n locations; Clone ID: LIB3279-201-Q1-K6-G6
ggaaagctgccgaatttggacagctgaaagatggttatatgttcgacacatcaactggcatgtcacgaatgttgttaagttccccaacatgtccagttctggaggtccttgggaaaaaactgtcgtttgagattgctgttggactcaatggtcgagtctgggtgaatgctcctgcagcaagtactatcattcttgtatcaaatgcaattatgaggtcagaatctttgagcggcataaaacaaagagctatggtagaaaatctattggagagattgtcatgatgacaagtcagcaaggattagtctaaggtaaaatggaggagtttccattgtgtcatttcaaagtaaaagtaggaaagtttgagatcaaagtgactatcccatcaaaagattattatgtatcacgtgtcgtagtatacagtacactatactcttttttttattaaattatcaatgtatttatcanana

SEQ ID NO: 9921 - DNA, 634 bp, Zea mays
  Clone ID: LIB3279-201-Q1-K6-G7
cccacgcgtccgcggacgcgtgggagcgccggcgcctccatttcgttttcctcactctctcctccagctcagggtccggcggcgaagggaaggcaagatgtacaccgcgaggaagaagatccagaaggagaagggtcttgaagccctccgagttcgaggactccgttgcccaggctttctttgatctggagaacgggaaccaggagctcaagagcgacctcaaggacctgtacatcaacaatgctatccagatggatgttaccgggagtaggaaggctgttgtcattcacgtcccataccgcctgcgcaaggccttcaggaagatccatgtcagactcgtcagggagctggagaagaaattcagcggcaaggatgtggtaattgttgctacacggaggattgtgaggccacccaagaagggttcagctgttctgcgccctcgcaccaggactctgactgctgttcacgatggcatcttggaggatgttgtctacccagctgagattgtggggaagcgtgtcagataccgtctggatggttccaagattatcaagattttcttggacccaaaggagaggaacaacactgaatacaagctggagacctgcactgcggtctaccgcaggctgtgtgg

SEQ ID NO: 9922 - DNA, 622 bp, Zea mays
  Clone ID: LIB3279-201-Q1-K6-G8
gtccctccatctgccgtcctctatgcgtgcggcatgcgcaatgctaagctgcctctacgtgtagcggcagaccgagacgcgcgcatgtcgcggtcgatcggaacccaacccaccatcgaatcgccttgccatgatgactagctagctagcaagctagagcgtcgtcgtcgtcgcgaggaaataagaaggagcagcagatagcgaccacctacgtacctaccaaacgttctcggggaggccgtatttgatgagctcctcgttctcgttcttggcggcgcccatgtagatggtgtagtcgccggcgtccggacgcgccttgaagtagagcaccatcgccgtcgtcgctcaacagctgacagatctatcttattcttcaatcgggccgggccggcctcttctacctctagctagctagctagctagcctgcagagtagtacagaatctctctagcttctagagtagagtaccgaccgaccggccggctgccagctagagactccaccggcggcggctactgtatatactcgtgtatattctctgtcgccgcgcgcggcagatacataaagcggccagagcaattagagggagggccgggagcagcactactgcaggcggcagcgg

SEQ ID NO: 9923 - DNA, 241 bp, Zea mays
  Clone ID: LIB3279-201-Q1-K6-G9
ctcctatataggaagatgcaatgcaagagctgtggtgtacttttaattgtaggtgatgtagtagtgtatggtagtatcagcattttctgcattcaggaaatgcacacgcaggtggtgggaaatgtgggcatggatcgagagtcgcttcgctggttaatagcaattaattttaaaggtcaagggcttgcttgtatttggtgggaatgaaattactgggcatttttacccttgttggtttatt

SEQ ID NO: 9924 - DNA, 606 bp, Zea mays
  Clone ID: LIB3279-201-Q1-K6-H1
tcgcccacgcgtccgcccacgcgtccggatgagtcaactggcaccattggcaagcgcctttccagcatcaatgtcgagaacgtggaggagaaccggcgggctctccgtgagctcctgttctgctgccctggtgccctccagtacatcagcggtgtgatcctcttcgaggagaccctctaccagaagaccaaggatggcaagccttttgtcgatgtcctcaaggagggaggcgtcctccctggcatcaaggtcgacaagggcaccattgaggttgttggcaccgacaaggagaccaccacccagggccacgatgacctcggcaagcgctgcgctaagtactacgaggccggtgcccgctttgccaagtggcgtgctgttctcaagattggccccaacgagccgtcacagcttgccattgacctgaatgctcagggtctggctcgctacgccatcatctgccaggagaacggtctggtgccaattgttgagcctgagatccttgttgatggccctcatgacattgatcgctgcgcttacgtcactgagacagtccttgctgcctgctacaaggctctcaacgagcaccatgtcctcctggagggtacc

SEQ ID NO: 9925 - DNA, 427 bp, Zea mays
  unsure (1)..(427): unsure at all n locations; Clone ID: LIB3279-201-Q1-K6-H10
gaatctgcggagggtcagtaagatggattcagtctcacgacctgctgctgctgatgttgaggagtgaccagaaccagaaccgtcgtcctcgattctgatagattatcttctagtataccttgtgttgtcgttgtcgtcggcgcgacgatcgtcgtcgtcgtcgcgccggtgtatgcgatgaagctgccattgctgctgttttaattaagcattctagatgttataccgcatgctttgtttcggtttctatgtcgataaatggtggccggatgctggttttcgtgctccgagccggccaccaggaagaagacctgcctgcccttgtgggtgcagcgttgttagaatgacctacggtgtatttgactttgacaggcctgctgcctagnggactgatgttctgttgtgcgcaaagctattggtcttgttg

SEQ ID NO: 9926 - DNA, 562 bp, Zea mays
  Clone ID: LIB3279-201-Q1-K6-H12
gcacccaatcatcccttgctgctctctttcctttttgtttctgtcaatcaaccaagcagaagcacccccacagatacattaatcaacacccctctaaatctggctgctaactctgttctcgaatattggggggtcgctagttcatttttgaactaaaacacaacaactaaaaaagaattgtgcataaaacatggaatgatatgagcacttcgccgttgcccatcgaatggaaccacaacctgggcactggtgcaccaaacatttggtcccctttgattaccggacacaacttttaccatcgccactgctttttttcaagattgaaccttgcagaaaataaaaagccttgtttcgggcctttggagcatagaatctccagtccgtgcacccaatttgggtggaacagttgcgcagataatttcgccaagcatcaaccatcccagtcttatctctaaatgcatcacttgagaagagcaagttgtccatcaatactagatacacataaagcctgaagaagtcacattctttctccttcacgttgatggatgtgactagcttcaaa

SEQ ID NO: 9927 - DNA, 620 bp, Zea mays
  Clone ID: LIB3279-201-Q1-K6-H3
ggcacgaggaaggacggctccgtcggtggcgaggccagcggcgaggaagccgatagcaaggcgtcatctgccgggcatgatgatgcatctatcccaacaggggatacctctgctgggttgaaccaaccgcatgacgagccaaaaacaagcaagccgattaatgtttctagcagcaactactggcgagatgtcagggcaaaccttgtgcgtcgggaacaggagctattagtggatccaagtactccaacagagtcgaaggcgtcctcaggagatccattacagctccctcaaaagtgggctcatgctattacgatgccagaggcaggatgcgttctggttgctaccgaagcgctagacgacgacagcatcttcgaaagaaccgtcatcttcctcctcaggctcggtacaaggggcacgttcgatggcccgttcggagtcatcatgaaccgtccgctctacacaaagatcaagcacgtgaacccgatgtttcgagaccaagcgacgcccttcggcgactcccctctcttcttcggaggccccgtcgacatgagcatgttcctggtgaggactgacgacagcgcgcgcctcaggggttcgaggaggtggtgccaggcatctgc

SEQ ID NO: 9928 - DNA, 533 bp, Zea mays
  Clone ID: LIB3279-201-Q1-K6-H4
ggctagcggagaggtgggggatggcgaagccgacgccggtggcctcggcagaggaggcggcggcgatgcggcgccggctgaggcgcctggtggccgcggtggcggccgggagcgccgacgccgaggccttcgacgaggctgcagaggcgctcgccaagctcagggacgccgagcttggcccccgcaaggacaggaccggcgacggccgggagaacaagcgcagcacggaggccgccgtgccggagcacttcctttgccccatctcctcagagatcatgagggatcccgtcgtcctcgcctccggccaggtagtccacaaatcataggcatagagggtataatagcaaagtgtcaacacttgggtggcgagattgcaaatatttccgccacatcgccttcccttgccttctccgtggcttggtccttgctttttgctcgctgggtttttttattttaccagcgtgaaattgccgtttctcagcctgttggtaactgcgacgtttgtggaagcacaagctgagttttagcctgcc

SEQ ID NO: 9929 - DNA, 568 bp, Zea mays
  Clone ID: LIB3279-201-Q1-K6-H5
gatgccttgagggaagaagtccagcggcttaagatagccgcagggcaggtccccaacatgaacgggaatcccttcaatggaggactatcacagcagcagcagatgccaagctatttctcacaaccacagcagatgcaatacttcagcggccaccagggccagcatcaccatccgaagcatgacccccagaattcttcaaacggcggtggccagcccttgagtgactccatggatttcatgtgaggactcaggggagacagctcaggagtgttgcctgagatcacataccaacttcaactaaagtaatgtaaatgtagctgatgtataccatattcagtgttatgatatgaaccattgtagtttagctagctgttccttgtaccattaatcaaaagttcattcatggtgacaaacctatcatcgcttttgttctggcgttaaagtaaattggcttgactggttgacgagctgtcgttgtaaagttgttcatgtaacagtgaaggaatggtttgcggttggaacgtggttttcacgctgctgaaagccgttgcatttcgtgattggcgtt

SEQ ID NO: 9930 - DNA, 574 bp, Zea mays
  Clone ID: LIB3279-201-Q1-K6-H6
ggaggcccatccacgagactagcagctagctctgtttccgctctgcgcggcgtcccggccgacgacgacacgatgcctctctcggcagcttcttccatcctcctcctcctccatgccctggtctccctcacccttctcctcggcgacatgacgagcacgacacctgccgccgctgtcccggccgcggtggacgtgaacacgacggcgttcaccatgcatgactctgctgcgtcggcgtctccccatggtgccgaaaaccttgagatgtactactgcttcctcacctgcggcggcggggagctgggcgacaaagttgctgccggtgccatgggaaccacggcgtcggcgagcgcggtccagctccaggggaacgctctgcctttcgagctgtgcggcacacagcaggtcaaggctctcctccaccattagttagcaggagtgttagcactcacatgaaggaactcacgatctaggatttgcgatgtgggcagatgttatccaagtcttgttccgatttgttcaacagccaaatttgttcaacttgcgatgtaagtctcgagacattgattcactc

SEQ ID NO: 9931 - DNA, 505 bp, Zea mays
  Clone ID: LIB3279-201-Q1-K6-H7
cctgcggttccgggccggacttcgggtcgaccagcgtccgccgacgcgtgggctccgctttcgcatcaatgaacaacgtacgcaaatgctataccttgtgtgaattgaagaatgcagcaaaccatcataccttttgaacgcatgttgagcccgaagacttatggcggagggcacgtctgtctgggcgtcacgccaaaagacactgggaacaccctcctggggggcgagggacgtgacagttggacacccgcgccgcacggcgaggtgggccgaatctggggctgcgcggcgaaccgcgcaggtggcacgaagtggggggtgacatcaaaccgttgctctcgcagcacgttgcgggcgagctgacggtcattctgtcctaacgacccatcgagcgaccgaccttgatctgggactgaggacccatgtaacgagcgacttcgcgctgaatctaagcatataaataagcggaggatacgaaacttattaggatttctctattaacggc

SEQ ID NO: 9932 - DNA, 335 bp, Zea mays
  Clone ID: LIB3279-201-Q1-K6-H8
cgtttgtgtacctgtaccacaaataaaggactcatgggagcgcacaagtctctggaggctgacgtgaccaagatctgtgggcactgaatgttgtgctataagccaagagttacccggcgccaattttatggaaccatgtttttgtactgccaacttagataacatttgacgaccgtgaccggactcatgggaaatttactcgtgctaggatgttcgatctgcccccacttcttttttttcttggaccctttctgatcagcacttgtcagaacgtttacagtctatagcactgaaacgtgattttggaagtactacacccccagtaattttgcact

SEQ ID NO: 9933 - DNA, 640 bp, Zea mays
  Clone ID: LIB3279-201-Q1-K6-H9
gtcgccgccacggaccaggatcgaccggtgccgatgaagccagcggaggacgcggatgcgccggcgccggagacggcggcagcgcagacggtctggtacgaccccatgacttcgccgcaggcgccggcgccgcagcagcagccggcgatagaggctgcgatgcggggggcctcgccgtcggtgagctcgaacgcgcggcctctcagggtgtacgccgacggcatctatgatctcttccacttcggccatgcgcgcgcgctcgaacaggccaagaagtcatttcccaacacctacttgctggtaggttgctgcagcgacgagatcacccacatgtacaaaggaaagaccgtcatgaccgaggacgagcgctacgaatcgcttcggcattgcaagtgggtcgacgaggtcataccggacgctccatgggtgatcaaccaggaattcatcgacaagcacgacatcgactacgtcgctcacgacgcgctcccatacgctgacacgagtggagctgccaatgatgtctatgaatttgtgaaagccatcgggaagttcaaggagacgaagcgcaccgagggcatctcgacgtcggacatcatcatgaggatcttgaaggactacaaccagtacatcatgcggaaca

SEQ ID NO: 9934 - DNA, 507 bp, Zea mays
  Clone ID: LIB3279-201-Q1-N6-A1
aaagcaaactctgggccaaccattagtagaaaattgcttacagatagtgtaactctgttcaaattttgcaacgctaaatatgggcaaaacatgatgtatgacaaaatggtacacagacagcctgcataagtttgatgtcaatctatgcaaccatgtctaatgagctgctcacttaacatttccgttgtgaatcgaagatctacatgggccagctgatgtagtaaagggaacacctttgaacattgcaattccattctcgtcggtacgaagatgcggggtaatcttgtccagctgctttttctttggatttagaacatcttcaggcttcccatcaaacccagcaaatgaaatgcgttctccaatcttggctccttctggaggaatcaaaggctccacagcagcatgatcttcagttgaagcacaaaggaccaatccagcagacattacatctcgcagctttccaggcttcacattcgtgatcaagacaacatgccgattagtaagatc

SEQ ID NO: 9935 - DNA, 531 bp, Zea mays
  Clone ID: LIB3279-201-Q1-N6-A10
acattacaatatacttttcgattaatcaccgatcggaatggagaagaagaagatgatgatgatatagagattataaagcaacagtgggcgggagagcgtacattgtacgcctgcctcctccattttcccacacggctttgttgttgttttttccccccttgccggcttgcaatcagggtagcaacgactccaaggaccatgacaacggcaacgatacggatgaccaagagacgcctcaacctttccaaggacgacggcggcggcaaccagccgttccgttccgccgtagtatttggtagcagaagcagtagtctagtgggtggtggtggtagtagtggtgaccgagcggccccgagtagtagaaagaactaggggcgcagaccagctagctagctgtactggacgaaggagcggtagaaggtgttgggcctccagttggccgggatgacgttcctggcgacgagcgtcttgccggactcgttgcggatgcggatggagaaaggcggctgcatgcggtggttggtgtccatg

SEQ ID NO: 9936 - DNA, 284 bp, Zea mays
  Clone ID: LIB3279-201-Q1-N6-A11
aattgaactgccaataaataaattgtcgaactgtatgtacagtaccgtcaaaaagcagtaagtataagtaaacctgggcggtacgttctcaaacagtcaacagggcaaagtaaccaatcaggccgtccaacgggagcaaaatcagttccatcagcatcaccattattaataaagcacactttaaccaatgagttccacacatttccacagccacgattcaagcacaccataacggatcaggtccccatcagcgtagccacgattgaagcgcgccataatttcgg

SEQ ID NO: 9937 - DNA, 508 bp, Zea mays
  Clone ID: LIB3279-201-Q1-N6-A2
atggaataaaaaatattttatggaaatatttgatacggagttcaaactgcattcaaactacttgctaactacactaaagaaacttggtagatgaacagactacgcgaagtgtcgaacggagccgtgcagagccaaaatttccggctccggctcctgcccgtttcctggctccagctcctcctccggagctgtttttggacgctgcgtttgggagggctccagcaaagagctagagccggagccgtccaggagccctcccaaagggggccttactgtgtctggaggacagcgtcgggtgtgtgtgcctgtgcgtgtgtgtatatatatcagcgcgtgcttcggaggatgccgtggaaggtgagcgtgccctcgaggtcgccgatgatccgcgcgatccgcacctccagccctcgctgcacgtccctcagcagcgccccagccacctccatgagcctcttcatatccacgccgtcttctccgtcgccacagcagcagcgatcgcgcgcga

SEQ ID NO: 9938 - DNA, 506 bp, Zea mays
  Clone ID: LIB3279-201-Q1-N6-A3
cttccattctaaatagcaaaggacaacttgcagcaggacacatacacatacaagcacattcgtcccatctgcagcctacgcatcaccgcatactggtaacaaggtactgctaaacatcagatcactccggacagtcagtctatgccttcttaggggacttggcggccttcttgggcgactttgcctccttgctcccgccactggacgccttctacgccgtcttcttgggcaccaaaacagggttgatattggggagcacaccgccgtgagcgatggtcacaccgcccaacagcttcccaagctcctcgttgttccggatcgccagaagcacgtggcgcggaataatgcaagtcttcttgttgtccctggcagcattaccggcgagctccagaacctcagcggcgaggtattcgaggacagcggcgaggtacacgggggctccggtgccgacactctgcgcgtagcggcccttcttcaatagcgcccgatgcggcctacggggaact

SEQ ID NO: 9939 - DNA, 594 bp, Zea mays
  Clone ID: LIB3279-201-Q1-N6-A5
aacagaaagcacaagtcatctcattatcgacggcaatggtaggttgatgttggactagcactcgatccttagatggatcagaatgcatacgggcgacaaggaatggaagaacatacgtccccacaaaaagtttcatggggcaacaccacaatcgtctgcatttaagcagtaatgccgaatatggagtttcgacttcatttcattttcatcccatggcatatttctgggtccagctgcgggctgttgcctcgtacttaggccgatccgtcttgtacatgtgagcaatctcagggacaagaggatcgtctgggttgggatcagtaagcagggagcagatagaaagcaaaaccttagagattgtcaaagcagggctccactgctccttaagaatgtcgagacatatgcttccattactattgatgtttggatggaagaccttcgtcttaaaagatacctttggaggcttgaaagggtagtccggggggaaatgaatgttcactaagaaaacacctccagcatatggactatcaggaggacccatgatggttgcctgccagtggaacatatcctcaccagcaggaccagcactgcatg

SEQ ID NO: 9940 - DNA, 529 bp, Zea mays
  Clone ID: LIB3279-201-Q1-N6-A6
ccctggaagaagcagcaggcttggagcacgaaaaccagcatccagccatcatttatcaacttgagaatcgaatcatagcatgcgggcataacatctagagtgggtgcttaattaaaaacagcggcaaaggcaatggcaatggcaggcaggttcagcgcacgcgcaccggcgccgtgacgaagagaacaacacgaggtgtactagaaagataagctatcagcaaatcaagaacggcacaggcctggtaaactccccgacatcagcagacacgcatcaggtcgggagatcggatccgacttactggccctagggggcggattctttgggggcagcagctgcttacttgatctcatgcccgccgtcctagctggtgtcggaagtccataaggacaagttgtcacgcaggatctgcatgatcagagtgctgcccttgtatgactactctcccaggctgtctagctcggagattgccttataaaaggcctgctatgcaaggttgcaagcacggtcagcgagagttgaggatctc

SEQ ID NO: 9941 - DNA, 516 bp, Zea mays
  Clone ID: LIB3279-201-Q1-N6-A7
tttttgcaagataataaactcaaatactcatgtatgaaagctacaaatatacatcaacaatctctctcagtatttctgtcaaaattggcagttggaacagcttaagtaccagttacatgtaaatattttgaggccacaaaaccataatgatatgcgcaatgatcgaggccacaactaaacttctaaagattggcctaacttcgcaacctgacagcaaacaaaagagacatcaggctccagacgtgaatggacaacctcttacgctatccatattgtccaactgtctgcgatgcgaacattgggcctccggattgttggcacaactgggctggaaccactccttaaactaattggccctgattcaatttctacttcttggtttccaggctcaataatagccttcttcactccggatcgtaaaccgaggactataattctttcaatcacgcaaccacttgtaaatttcttgctcaaattgtcaggtgcgatattgaatgaagttagcttattgtctgc

SEQ ID NO: 9942 - DNA, 404 bp, Zea mays
  Clone ID: LIB3279-201-Q1-N6-A8
agcgaaaagaaagccgggcgcgttttattcaagctggaagcttttcccgaaacagaccaaaaccagctgccggccgggggcggggcgtgggccccctagctcacagttcaccgttcacctacgctacgccaccgagctccaaaggaaaagaacaaacaaaaacctttcgacaaaattggcccccgcgcgcgtcgggaactcgcgatgcgcgggtttttttttcgcccgcccctgcatatgcccctacaagtccttggcctcggccgcggccggtgtggcggcaaaggcaaacggtttccttgcgctggcgaccgcgatgaaggacgggagggcgtttccggccatgacgaccacaaccttggggggctcccggtcgagcgggaccaggacccgcaccgacgccg

SEQ ID NO: 9943 - DNA, 441 bp, Zea mays
  Clone ID: LIB3279-201-Q1-N6-A9
aaaagggacccatattttagtagatacgtagcacattccaacctttgcaggaagttgcagttgttgtaatttttttttttgggtgggggagcactttttttttttttttcactcactcaccacaggattttacaaagggggaaaccggaattcggggtcgtctcggggggttgcataatctccctccctcacctttgctcctgatgctcgtcgctgtttggtgctacctttcgcctaaaccttaaaccaaaaataacaccttgcctaaccttccacctgggggggggggggggggcgctcatcccgctggcggccgacggtttgcaatccggggggtcctcgaaaagcgacctcgaaaggctcttgtgggccaagccgatgtcaaacaggatgaccccgggctcctggtcctggacgagtatgcccttgacggggagccaa

SEQ ID NO: 9944 - DNA, 489 bp, Zea mays
  Clone ID: LIB3279-201-Q1-N6-B1
ttttgtcgaggtagaacagtaataacatcaatgtattcgacacacaaaaacatggatccaactaactccagtaggaccagtacaggcaaaaatgataatgcatccggttttcttctaatacaaatcccaccgccagatatactccattaactcgaagcactagaagagaccaagagggtctaatatcttatggtgacgcttaggcttaggaggtgttggcttgggccttgttgaggatcacaccctcgtacttgacctggaaccacttcatggcgtcttccttagtgaccctgtgctggatcccaacacgggacttgcacctgcggcgacgggcgacacggtacccagcacgctcaaggacgacgtagaagtccatgccgtagataccagtagatggatcatacttgatgccaagatcaatgtgctcttggatgccaaatccaaagcagccagtgtcactgaagttcctcctcagcagctcgtactcct

SEQ ID NO: 9945 - DNA, 372 bp, Zea mays
  Clone ID: LIB3279-201-Q1-N6-B10
gaaaaacagcctatactgatgaattattggcaaaaaccaaaagaattgtcagccatcaggaagcagcaggagggggcgctgcagccgtgacggcgagcaagagtatagtcattcgggggggaaaaggcctacatagctacctttacagagctgttgctatgtatgtatggaggagcttcaaaagtttcgtatctggtatactactactctcaacaaagctgtatttacacaacaggcctcacgagctcgacaggctcgtcgcggcaggtgttgccggcaccgcgctgctttgcgtcgagttgttcttgttctcgccccagtgccatagcatgctctcccagaagcagaacttctcgaagcaagtcttcagcc

SEQ ID NO: 9946 - DNA, 340 bp, Zea mays
  Clone ID: LIB3279-201-Q1-N6-B11
aaacctcataaccactaaaaaactacttaggaacttgaatgggttatcaattggccatttataaaaaactcatagccactaaattagcgagatgataccttcgatacctaccctgaaggccttgcccatctttccatcaggctattccctactttaatgactttttcccacaaacacgggaccaaaggaaaagaaaaaaacaagaaattaaacccttcggggtacatatgctgtatttgaaaaaccattagctacttttgggggtagggggggcttcttgtagtttgctaagctacagggggggcagatgtattccaaaccgtctgtcttaacgtaatcc

SEQ ID NO: 9947 - DNA, 568 bp, Zea mays
  Clone ID: LIB3279-201-Q1-N6-B12
gaaaattagaatttttttaatttcaatatatcttatcataatatgttcaatccgtagcaacgcacgggtatttacctagtaaataaataaattagaattggagaactcgcaggacaacatgaacaggtaaaagcctagttctgtctccagttatctgaaacaatgattcatcaccaactattggtccaaacaaaaaaaaaagatagatgttttcctcctttccttatcatgaagttttcttcctttagcatataagattgatttaatctaaggaatgatacactccaatacagcagcaatgcaccttcagcttttctttggccctaatttcttgcatttgtttagcagctagacgcttagcttccagtggatcaaccatcacaacattctcacctgagcttcttttgccttgtgatgcatctgcactagcaaaggccagaacgtggcttctctgatataatgcatgtcccaattgcttgtatcggattgtccacctggacaacgacggaacagaggacacacgcttcatcgtgaggaagggggaggagccagaagaagaagagctgga

SEQ ID NO: 9948 - DNA, 402 bp, Zea mays
  Clone ID: LIB3279-201-Q1-N6-B2
aagcaaaacttaataaattgcaacaaaatcctttgaccaattccctattacaaaacacaacacaacctataaaattcacgctccgaggtgagcgcttcaaggggagcaaataaaatgggccaaatctagcttagacatggcaacttggataggggaactggtaaaaccgcgttccataaagcaggatgcatagtgtgcaaacctttggaaacctacctactgtaaccaaagaacaatgtatacatgaacactgaaacttcagaactgcaattacaactacattataccagattcttgaccactggttttggaacaatacaatggtaattgaacaatgaaatgctgaatatgcaactccccatatgggagctcaaatcacggaagcacacaactgctggtaaa

SEQ ID NO: 9949 - DNA, 514 bp, Zea mays
  unsure (1)..(514): unsure at all n locations; Clone ID: LIB3279-201-Q1-N6-B3
ggccccgccctctttttttttntttnntttttttttttttttttatttttttnttttttnttttttttttnttttttttttttttttttttttttttttttttttttttttttttttttttttttttttttttttcggccccgggggcccccccggaaaccccgaacccgcccccgggggccccccaccctccccaaaggggagataaaaaaaagcagggaaaaaaaaagaaaaaaagggaaacccggggaaaaggggaaaacggtaaaaagcccaaaaaaaaaaaaaaccgaaaaccaaaaagaaaaaaccgggggccccaaagggccaaacaaaccaaaaaaaaaaccgaagggccaacggcccccctccccgccgaaaaaccggaaaacccccccccaaaaaaaaaaaaaaaaaccccccaaaaaaggggaaaagggaattggcccccagggggcctttttttttccccattaaaacgggaaaaagggaaaaaccccaaaccccccgcccc

SEQ ID NO: 9950 - DNA, 493 bp, Zea mays
  Clone ID: LIB3279-201-Q1-N6-B4
tctcatgcaataggtggaatacttccaaccaacaaaaccataatgttgacaaataaaacagactcaagcctcattaacaggaacaagagttggacaacaagaggccacactaacagctgtcatgaaccctgagacttttaacctacatcaatccttgtaagccgttcttatcaatttaggttcccaaaagcacatggaaaacagataaaatatcatgggaaactatcacaaacccaattcaaataacccaacaacgatcagactcaatcaaccaaactagtttgtcaaccagtatatatagatataacacgcacacaaaaacaacaatctaacgctgaaaatgttaatgttccatttcgacatcatcatccgtcaccgtgaagcaatgcagagcaccaagaacaagtttttctgtgccactccagcagattatttgccctcggaaacaaaaccaagcgaagcctcacctcaactcgcctcctctcgggcgagc

SEQ ID NO: 9951 - DNA, 498 bp, Zea mays
  Clone ID: LIB3279-201-Q1-N6-B5
aataactaaataattatccaggtttgcacccttgaagttaacaactcaacacaaacagtgtccaaataactgaagcagtaccaggcaagcgttacacaggagaagggtcactccaacctgacagctcaactaaaacctacacgacgacaaggactcgcagaggagcacacagaaatgtccagtttaaactaacaatgtgcattccctagtcttcactccttggaggacttgttgatcagggacttgtggatgtgcgggatgacgcctccacctgcgatggtgcccttgatgagggtgtccagctcctcgtctccgcgaatggccaactgtaggtggcgaggggtgatacgcttcaccttcagatccttgctagcgttcccggccagctccaaaacctcggcagtcaagtactccaggatggcggcagagtagacggctgcagtggcaccaacgcggccatttgcctgagtcctttgcttcagctgacggtggattcgt

SEQ ID NO: 9952 - DNA, 515 bp, Zea mays
  Clone ID: LIB3279-201-Q1-N6-B6
aaaaggcaccggtgtttgcaaacagtttctggtacacgttttctttgttccgctgggttttattatcgaccactacgcctcattgccccaaccatacggggggcaggaaaaataggcagtcaaacaaaaatgcaaggggcatcaattgttagaagccgggcaaggtgcctagttcccgtgggcaaacttgatacccttgtcgatggaagacttgagctcgcccttgaggttttccagacccttcttctcgaactcgttgagctcacccagaccaagcacttcctccactccattcttgccgagccgaaccttggaggcaaagaatggcaactctgtcacagttgattgcacaaaagagcactctacaatgtctggaactcccaatatttttttagaaatctaatgagcttgtttttctagacccgcaattccaatgtcatggcacacttcggcagcaccaaagatttgcacatggccttcatgtgttgaaaagcactgctcatgtacttttctag

SEQ ID NO: 9953 - DNA, 503 bp, Zea mays
  Clone ID: LIB3279-201-Q1-N6-B7
ctcagcaaaagttcaacgagacgtttcctttgggcatcatttaacacatcatcgacatgtttttaacaaaatcttctccgagatccataacaggcgcaataccaaaacagaaatagcttaaatggtttccgatacaacaaattgacaactaaagtagtcactatgcggggtgcccggcgcctagaagcggagcttggtaaagaaccacctgttcttgccggtcttgaacctctcctcgaggcgcgccttggcggccttgcaggcttcgaccttcttgtcccgggtggagagcgcgtcgggcccgcccgaggcgacgtctttgaaatcgacgtcgagggtgtagcgggtgggcatgaggtgagtgaaattgacgagcttgatgaaacacttgacgcgggacttcttggccgtcttcttggcggagtccttgcggatcaccttcttggggtacttggccaggccggcgacgaggcagtgcccatagggacggtcgcgggtaccct

SEQ ID NO: 9954 - DNA, 480 bp, Zea mays
  Clone ID: LIB3279-201-Q1-N6-B8
ggaaagctattaaggccgcttctgagggcccactcaagggtatcatgggctacgtggaggaggatctggtttccaccgacttcaccggtgacagcaggtcgagcatcttcgacgccaaggccgggattgccctgaacgaccacttcatcaagctcgtctcgtggtacgacaacgagtggggctacagcaaccgcgtcgtcgacctgatccgccacatgttcaagacccagtaggctagtagagagatagatttctgcctccctatcgtgggtcgtccccaatggcctttggtcgcagaccatctttgctgcttgtctatgctgagaataaatgtgaacggtgcccctggacgctggatccatgctggttttggacacgctgtctttttgtgtttaacttatctgctgccgtcctgtaacgaattcgcaagttttagttcttttgtgctttgttaaagaataaacaatgaggtttcagttt

SEQ ID NO: 9955 - DNA, 361 bp, Zea mays
  Clone ID: LIB3279-201-Q1-N6-B9
ttttagatattatcagcaaataaagctccatcataataggttcacaaaacgaatgtctgatttatcttagtggcaaacgctggattcaaatacaactagaaccatgaaaaatggcctactgaagtgcaggcaagacgttcaactgatggcggaccgtgacaccatggcaggttgacatctctccacaggcacaccaacgcatccgaagaaatgtatgtacccacgcatgtcatcaggtccacaatccatctcgatctgcctacttggatctctgcctcatctttctgcgcttcctcttgagcctcctcatgcgcttcttcttccacttggccctcatggtcgcttcctcgcttgctctcct

SEQ ID NO: 9956 - DNA, 572 bp, Zea mays
  Clone ID: LIB3279-201-Q1-N6-C1
atcaaattcatgaatcaaatcaaaagaatttcgaaaatacacaaattaatttgggtcgtcttcaaccttaggttcgtacgtgtgacggggagggctcgacggggtatcggccgggtggaagagcaggggctcaactttggggtggcttagctccggtgatgaacggcgaactccggcgacgaacggcgagggagagagtgcgaggaatgagagagagctcgggtaggcgagggagagaggagagaggaggagctcggttttatagggagcaggagggagaggggaagggtcggccagggaggtcatgggggcgccggcgggtattcatggaggccttcaatggcgtcggttaccaaagaaaataatgggagaggaagaaacggaagcactgaagatccttaatgcggttaagacgaaatggcgtgcggctggcggcttggtcgagctcggccatggcgcggtcggcatcggactcgcggtctgctcggggtgggcgctcggtgcagggcgcggtgcggtcgtggcttggtcgggcagggcctcggcgcttcgaggctcgtcgcgggggtagg

SEQ ID NO: 9957 - DNA, 617 bp, Zea mays
  unsure (1)..(617): unsure at all n locations; Clone ID: LIB3279-201-Q1-N6-C10
caaattatcatacttatttattttcttctgtttcaatcttccacatacattttacatgaatgatacaaatatctatccaacatagtctttggtccctacgtgaatcatactggctattgtgtaacctacagttgacatctccaaagcagaggcgagctctatagcttgtcgaccttgttttactgtttatgcggataataaatggctttttgggaacatatactaacgcttgcgatgcccgtagttcatcttgatgactttgatggtagtttcttaaccagactagtgttaccagttaccaatagtcgagcacccttcaccagctcctccttaatcataaaaagcaaagcagaagcaaaaacactttgcacaatttttgtgcccattcctttgtacatccctgacagaccctcatatcgtaccatctttgtgaacgcatcaagtgtacctttgtagcgatgcctcttgtcatcgttaatcatgtgctttgcctgaagtcttgccttaacaactagaaggggatacgtaacgacggttgcaccaagtttcgcaacagcaccaagaagaaaaatnntcagagcagtcaatccatcagctcccttgaaatagaggctcgt

SEQ ID NO: 9958 - DNA, 359 bp, Zea mays
  Clone ID: LIB3279-201-Q1-N6-C11
caaaataaaaattttaagggggggctaaatcgtagaaacaggggggggggggagcagcacacgaggccccaaaccttttaaataaatggccctcgcccccccccaggggttaattaaaaacaattaatcgaatggggggttttgcccatagacaatgtcccaagccttttttgggcggaccaatcccataagccaaaatttttttaaaaagaaaaagctgtaaaaaaactttttgggttttgggacaaacccctaaaagtaattgattttcctcccttgacccggactgggaaaggatagaaaacccccgttttattgggggttttgggcacttatggggggccctgggggggggtcca

SEQ ID NO: 9959 - DNA, 515 bp, Zea mays
  Clone ID: LIB3279-201-Q1-N6-C12
gggtatgacacgcaaattatattgatcctttcaagcaatacttagagcgccaggatacttatagtagtaccaccattctgaaacatagtagcgccaggacgaaatataggatcgtccaaaaacatatccttaacaagagtttaattcaataaaacctcggtgccagaacctagcagacttcacaaaagagcatacttagaacaccctgtatggcttccccatggtgctcttgacgtagaggcatttcacattctgccagttcttcttcaaaagggaaacaaggaagttcacgctcatctggatgttctgctggatctgcttctcctccatcgccaagttgccgacggcgacgcccatgcaaaggaccttcttgagctggaacttgacggttgccttagtctcgttcaccttggattcgagggattcctggtgagtaaccagggtcgggaacttgcctgccttgttgagaccaggaccaaggagacggggaatctgcttgatgatggcctctgatg

SEQ ID NO: 9960 - DNA, 534 bp, Zea mays
  Clone ID: LIB3279-201-Q1-N6-C2
acagacaaaaaaaaagaggattgctaaagttggagatcagaatttacataaatgaatcaacaagcccatggacactttattacatcgagcatggtacggctctaattatttattatacatcggtctcagaaataaaataacaataggatataatggacaagaattttcaaggttttcttaacagccattttgaaaaatggccaggagttctctggatctaaatacaaaaaaggctcggtttctctcaggcccgcagaaaactggcatactttgcgccaaggaagagcctctgcacacagagcagcgcatttttctgcacttcagtgttttcatgattcatgagcttcatgactcggtccttggccttgaggtctgccaccacgattcggccagatggatggtactggaggaactgtgagaggtcgtagcaggccacggcaagagcggtggtgtcacttgatgtgtcaatgattgtcatgagaactcgtagaatctggaaatcattctcttcaaaattgttaatgttctcacgcc

SEQ ID NO: 9961 - DNA, 561 bp, Zea mays
  Clone ID: LIB3279-201-Q1-N6-C3
aaacgtcaagcatggagcacattaactaaaactggatcacgtttgggtacatgtccgtaacatgttacatgttggatattattgctaaaatctactcagggcactccaagagtaaaatctgcaggtcgcagtaaacagtttcacaggacttgtgcagacataaaagcacttgcatcccgcccgtttagtagggctccacaggtgcacggaatttggcacctgcgtagacagcaatagcgccaagctcttcttcaatcctaagaagctggttgtatttggcaagacgctctgatctgcagggtgctccagtcttaatctgacccgtggacaaaccaactgccagatcagcaatgaaagtgtcctcagtctcaccactcctatgactagtcatcacaccccagcccgcacgctttgacatcttcacagcctcaatactctcagtcacagatccgatttggttaaccttgagcagaagggcattgcatgatttctccttgatagccttagcaaccctagtggggttggtgacgagaaagtcatcaccaacaatctgcacttgct

SEQ ID NO: 9962 - DNA, 530 bp, Zea mays
  Clone ID: LIB3279-201-Q1-N6-C5
ggtatatgcccgtgcgttgctacgacatacaaattatttgatccaaagttagtatataatgattacatgaaaacaaacaatacatattatcatcaactacaaacttatctattggcacgaacactaagcatgacattaataatctcaaacaaatatgatgaataatatacacatttgatatttctagtttgccttagattcataagtcttctcagagctttcgaataagcatcaacaccatatttctgtgtcgcagcagaaacaaacccttgccaaatactcatgccatgacacagcttatgacatctccaccattgagcaacatttggatcggaatgcattgatgctgcagaaacccacatcaactttggaacactatagatggtaaaatactccatacaccgatcaagccacaccactggatcccctcccagatagacaggaaatgaccacttaggtaatacctgtcgatgctcttctgtttgtaccctactctcccccgggaactcctactgcttcccctccatacc

SEQ ID NO: 9963 - DNA, 441 bp, Zea mays
  Clone ID: LIB3279-201-Q1-N6-C6
cacttaaaaataaaaaccccttaagaaaatagggttctcaaaatagccctaagaaatgcaagaaatccggcacgttacacttttgtccacaacatagctttttgcagagattcagtacataaggattcttcaaattaaccatcccacaccataacatgggacatttgcgaaactacgggtccaggtttcaaaatgcaacgagttcaatactaaaatataagcgtagtgcaatctaatttttttcctcgccctcgttctcagcaatgttgaagtagcggagctcataaacgtttcggtccttgttggcagcaaccacgcgtagccaatcccgcacgttgtgcttcttcaagtacttcttggtcaagtacttcaggtacctcttggagaagggtccgtcagaggtgacggtgaccttggtcttctcgcgagagatggtgacgg

SEQ ID NO: 9964 - DNA, 243 bp, Zea mays
  Clone ID: LIB3279-201-Q1-N6-C7
tttgttcagatgattggacttcattaagatgggaacaatctccaaaccatagtcgaaaggcacaagcctagaaggcagtttttttaacaaaaaaagacatcactatataaactactcatggaacatagtcttaaactcaggctgcggtgaaagccttcttgccggcagcagcagatccagctggaatgactttgacgacattgaacctcacagtttttgataggggcctgcactggccaatga

SEQ ID NO: 9965 - DNA, 427 bp, Zea mays; identical to SEQ ID NO: 8731
  Clone ID: LIB3279-201-Q1-N6-C8

SEQ ID NO: 9966 - DNA, 555 bp, Zea mays
  Clone ID: LIB3279-201-Q1-N6-C9
agagtaccattaggtgatgtgcccagggcctatttattgtgtgtctatataaaaaaacatcatttacaatatgcttagtgtcataactgacccgtaacggacgtgaaattgagcatcctctgtgctataacaaaattaaaatcccatgacgtgaagctattacaaatcaagatcattccaacactgggtttatttttcctcagtcatcacagaagaacgaagctcctgtagtcctgtgtatcggcagctgggagacacacacacacacacacaccactcgtgcaggtcagtaaaagttccatccaggcagcttttggcaccgcaagcgtctggaagcggtaggtgcaaattaaaccgtcctctgtcgcttcttcagtggtagagcttgtccagatcgtctttgaatttggcctttatttgctccctcttcagtttaagcgctgcggtcaccagcccggactccggcgtccacggttcaggcaacagcacgatcttcgctggcacctcgaatttctcgagcctcgctgcttttgcggcctttgatagcgattgctg

SEQ ID NO: 9967 - DNA, 515 bp, Zea mays
  Clone ID: LIB3279-201-Q1-N6-D1
ggaatggaacagaagaatttgacacactgaagtttttttagccttgaagaatctctagaaccaatgcacacaacactagtttgcatccacacaacctttgaactcgaggaggctacatcatggagacatcagtttacaagatagcacagtactgtgtttgtacacaatccaatcaggcccaatcatcttcttggctgaacatcaggcacaagagacccaaatgggtgagctcataagcttgggagggatcctgctcggatgaactcttttagaagggccttctcctcatcgagtttcttcttctcggcagcattgcgtggcttgatcttccgcttctcttccagcatccatttgtagagcttgcgctggtcatcttcagggattggtgggagctcctttctggggatagagactggctcagcaggcttcccagcagttgcagtagcaggatcagtcgttgggtccttctttgctgagtccttttggttggcccgcacgaggacataagctccaac

SEQ ID NO: 9968 - DNA, 563 bp, Zea mays
  Clone ID: LIB3279-201-Q1-N6-D10
ataacaattggattatccactttaatcctttgaaaataacaagaaattatatacacaaaagagttgtcttcttaaatatgtccgtccatcatcaacaaacatacatatgaacataaataattacacattcttgtaatgaccacccccaaatcgaaaacaaagaaaaccccacactacaaatgtacacgcggttcatcgagacgacgacggtacaaagaataacaaattaatgtccatgcatgccaagtgtttgtctgcttttacttaataacttttcactccgtgcggctacgcttaagtatcacggcaacttaatttaatttaccagcagcaagcaagcaagcaagcaagggagcgaggagggagagctttgcatgctcgatccgtcaacaggatcacttctcctcagcagcagctgctgcttctgctggcggcgccgcctcttcggcagccggcttatcctcctcttccttcttctcttcttccttcttctcctctaccaccgccgcctccgacggtgtctctgccggcgccggtgccgcctccgtcgctgcagctggctc

SEQ ID NO: 9969 - DNA, 539 bp, Zea mays
  Clone ID: LIB3279-201-Q1-N6-D11
gagaaaaatggatgtggatggatttcagtaatccacagattaacatattccgtccacgaaatcaatggactttcttacacactaagggctattttgaaaacctcatttttccaagagatttccattttccaatgaaaattagtttattttcacttgggaaaataggaatcacttggagaatcgagctcccaaactagccttaagatgaaaaagaaaacagagaaaaatgaccgccatctcaaagatttacaatgcataacctaacagacattcattcagtcgcagaagtcagactcaaaactcaacaggtatgaccgtataagcttatttccagcctagtgattgtctaatccctgagaaaatcagcccaagagaccttccaatcattgacacccagaagtaggacaccgcagagctcactttgctgatagcaacccttatgaagggcatggcaatatctgacaactctaagaatagctgaagtaatacctccatccaatcaaagctcttaattcctttgtccttcttgctgggaggga

SEQ ID NO: 9970 - DNA, 546 bp, Zea mays
  Clone ID: LIB3279-201-Q1-N6-D12
gaaataacaaacatcaatatgatatgtaaaatctgtgtgacaaaatattagttatgtccaagcctttacatcattctggtagaagaatattaattatgtccaatgctaacctgaaaaggatgtgctgcaaatatctcaatactcaacttctattgttggggttatcgttctggtagaagaatatctgctttgttttctgctcattttagcttctgcttcaccttggagttctttttggcgcatcatcaactatgtttctatgactttatgttcttcctgcaatatgttatacataagctacaataagtgtagattgtagtctaaagattgtacaaaagttgtcaatgcataaatggaatttgtcaatggtagtgagttcctacatcaatagaaaatgagaagaaaacagaacaggtgttcttcctttacattgatgtccaagcctttacatcattgctttcaaatatctagtaataaaatttttacgttagatcagcaacagatggcaccgacacatctgacgacattggagctgctcccatctgt

SEQ ID NO: 9971 - DNA, 546 bp, Zea mays
  Clone ID: LIB3279-201-Q1-N6-D2
ttcctcaagaagcaaccgcacaataataattattaatatggcaacacgagcatatatacaatcttcaccacagctggagagcgagactctcattattttaaaaaaaaacagccatcgttttcacttgtatcatgctacctgctaccattacgtaatccttggtccggttgcaatgaaaccttacaccaccagaaaaatgggtagagccagctcctgcaacttcactttatttgctgcttgtctttgattatcttgtggagtgctttcttggcttcctccagagtctcaaccttatgagggacatcaaatgctagcctctgaatattgaactgtgcaccctgtcgaacccgtatatctatccctttgctatctactgatataagcgcagcatcatcaacctccccttctgatgataggacctcccgaagtggtttagagaaaatagcgttcaactcctttaaactttgcaagtcaccaccatcaactgctatcttgtcaggttgaatcgtttcatactccttaacatctatccatgcgacagttccg

SEQ ID NO: 9972 - DNA, 509 bp, Zea mays
  Clone ID: LIB3279-201-Q1-N6-D3
aacacacaactgatgttcaatatatttttctcctatttgtagcaactcttttaaatatgtaaacacatgctccgaagactcgcgcatggtgcgagtaatttactagtaaaacatgcacccagagggcagtctcaaacagaacaattagcagtcggagcatagaaaacattacagagttgcaaataaaatcctaggtagcatgtaacagctgttgcgacgcctactgcttaatccactagactgctggttaagtacagatggaacatctttcaaacaaggtgctaaggttgtccaacagcgatctaaggtgtatatttcaaacaagctctcctttccagctcaaactaaacactggttcacctcgatcatcaagatggcatgtatgtcgacgtgtcaatctgctcaggcagctcctttatgtcaacctcaaacctctcctgcacttgattgagaacatcagaatcagatgaagaagaaacaaatgttattgcaagtcccttggtaccaaa

SEQ ID NO: 9973 - DNA, 556 bp, Zea mays
  Clone ID: LIB3279-201-Q1-N6-D5
ccctggaatagattacataatattacatatacactcaaattatcgacagaaacccaccagtgttcctaccagatttgtgttgctgttgcatctgtgcataaagaccgacagctggtttcacataaatatgcagggaatcccactatcccagcagagaatcttctcgttattctcagaattctgaccagtaatcctgtatacacattccagacgcgaagccaaaccgaaaagggcgtggcaagaccagcagggaatctcacactgttgaccattcgtggtactgtgacgatgatcctctcaagcaaacatccataccaaacgcgagttgggtgctacaacttggagcgtgatctaagtgggcatccgccttcgaaagcatggtcgagtacttcctcgatgcgcttcacaagcagaatctccatgtcggagagaattggtaatggaacctctgataagtccttcaagttcctttcaggtaaaattactctcttgattccataacgatgtgccgcaagtaccttgtctttaacaccaccaactggcaatacaaaggccc

SEQ ID NO: 9974 - DNA, 404 bp, Zea mays
  Clone ID: LIB3279-201-Q1-N6-D6
gggcaggaaaaaaacccgggttttttttaaaaaaaaaccgccgggccgggcccttttttttcacaggggtttttggggttccctgcctgggaaagggggggcccacagttttacccattccaaaggcttcaccggaatccattttgggcccccccctccacaaggaaatcattttttagccgggcctgaactttttttgggggggcccccaggggaatcccttttgcagctttttcagcgggggaaaaacagggcttgaaaaaccccccatcccggtttggccacccccccaactttccaggggtgtcctttgccccgagggaatttgcccagggcatgaccccccccctttagggggggacccccatgccaaaaattgaagcgatgtttaggtaaaaagcctt

SEQ ID NO: 9975 - DNA, 420 bp, Zea mays
  Clone ID: LIB3279-201-Q1-N6-D7
gggacatatcactccggacgttcatccattgcaatatctatgatggggtaacaaaagctcatcaaagattggaatccattagggattattcatcgataagatacatcattataatatgtctttctggcacaatagggatattttgccagtaacacttaaaccttataggagtacatattccattgtatacccgtgctggagttttcaacaacacgggaaaacttgtcttatgcccaggggatgaatgcaacccacttggtgatctaacaaaaaaaataaactgcacggggaaggactgaaaacttggtcggcaaaaagcccaaatgctctccgtcagattgcacaaagaccccaccgctagccaccacctctgctacttcaattgattggaccctcattgaccaaacaccattcactgat

SEQ ID NO: 9976 - DNA, 529 bp, Zea mays
  Clone ID: LIB3279-201-Q1-N6-D8
tttgccacagaagcaacacatagcatctgtccataaagattaaggtaaccaactgccttagcattgtccttatcgtaagatagaaacctatctaggacccgatcaaactgccatttcaaggacacagttgggaccttacacctcaggaggtgccaagaccggagggcgcggctcgtcctcgtccttcggggtgtggatggtcaccaggtccggaagaggagtgatcgggccaaccttgcccttcgggtcccagtcaagcatgatcttcaccttgatgccaagaacaccctgtctgagaagaacgtgtctcacagccgagtcaatgtactcgttcactggctgaccagatgagatcatgtagccatccttgaacttcatggacttggctctttgggccctgagctttccactcacaatcacctcacaacccttggcaccactctccataacataacgaagaacaccatagcaagccctgcggacggcaaggcctccgaggagcttgtaacggagggactcggcctgcgcg

SEQ ID NO: 9977 - DNA, 438 bp, Zea mays
  Clone ID: LIB3279-201-Q1-N6-D9
gacgtggaacaatgttcatcagtcttaacagctcaaatagacgcagatcatatcatccatcactacccctaccagataaattgagccacgtctaccaacaccacccagcctagtactatgagcctaagaagaagtgaacttggtgacggccttggtgccctcggagacggcgtgcttggcaagctcaccggggaggacgaggcgcaccgaggtctggatctcgcgggaggtgacggtgggcttcttgttatagcgcgccagcttggcggactcggccgcgagcttctcgaagatgtcgttgatgaaggagttcatgatggacatggccttggacgagatgccgatgtcggggtgcacctgcttcagcaccttgaagatgtagatcttgtaggtctccacggacttcttcgctttctttttccccttcttgccctcgcc

SEQ ID NO: 9978 - DNA, 606 bp, Zea mays
  Clone ID: LIB3279-201-Q1-N6-E1
ccaaaatatttcttccaataaacgaaaatgatgacttctataaaattttaaatcttaaaaaaatgctaccaatctaataactcctaatgttttttttagaaatctaatgagcttgcttttctagacccgcaattccaatgtcacggcacacttcggcagcaccaaagatttgcacatggccttcatgtgttgaaaagcactgctcatgtccttttctagttcatcgtccactttctcctcggcccacatgaaaccttgaatgttctgaactcactcaattaaagtagctaacgaccacaccacctgaattagcatagatatcaggtaatactactactcccttctcgacgagaatctacaacatatgcaagaggcagaagctcggaaaaataataaaaaaaagttgcactcagaagtgataaaatacacttctcgcgttaactgctccgacccaaagccaacaattttggactcgcgcgtgtaaacaatattatctattgcatcgggtcgatgtcgtatcagctaatacgacgaccatttaggagcactcgagctttcacgccaacagaagcagccatcatctaggctctaacttctagctagtag

SEQ ID NO: 9979 - DNA, 576 bp, Zea mays
  unsure (1)..(576): unsure at all n locations; Clone ID: LIB3279-201-Q1-N6-E10
agaccaacatcattttgatatccaaatggtgggtcccaatcatatcagcacaagctgaggacgaggtcacagcccaacacagctgccggggctgcggccagcagttataaacacgtaaatacctacggtataatggtgtccctaaacgcccaatatgtctcgcttatgtctttaccagaagagctagacaggtatatacatagactacctacagaaagcagttagatgatcggcagctcaggcatcaaacttgctgtgttgaggatagcttgaatggcagatttatttccaacagcaagcccgactccgccttacagcctcaacgtggtgtccgctgccgatgtggaagctccggaccttgccttctcgctgaggaacttgccacagtccgcgcccttcgcggtgaactccgccagaagttcctcgtgaagcctcttcagtgactgcttgaacctcaccgagcagctcttgtcgccttcgtcaacgtcttgcactccgtcaccggagaggcatccaacctggngcaccctccagtaggctctgcaagccacgaggatgttgcgcccatacttgcgg

SEQ ID NO: 9980 - DNA, 523 bp, Zea mays
  Clone ID: LIB3279-201-Q1-N6-E11
aaaaaaattgagcatctcatagtaacttataaagcgcaagaatataaattatcatgttcatcacacgcagaaccaaacacttcagaatttataccataacaggcaagttcaaaacttaaccgccacagatgcaaccaaagatctaaaagaagtttagcatagtaggacaacaactacgaatagcagtgcgatcaagaggcaaccaccgcgaagtctaaacgcggtcacggcggggaccaccgtactgcgggcggccgtaggcgggggcgttggagacctcagcctggcgctcaacgccgggcaggtcggccatgccgagggcagcgagcatctccatggtctccttgtcgacgcggatctcttcgacctcgagcgcggacttctccggcacgaagtccatgcggcgctcgcgctcctcctcctgcagcttgagcgagatgccgcggactgggccgcgctggatgcggcgcatcaggtgggtactgaagccagccaccttgttgcggaggcgcttcgaggcaga

SEQ ID NO: 9981 - DNA, 546 bp, Zea mays
  unsure (1)..(546): unsure at all n locations; Clone ID: LIB3279-201-Q1-N6-E2
gcggtattgaggaatccacttcagaatacaacctagcacgcgacaacaaagcaacgacagtaaaatagaggtgttaaggtccccattattagtgcggttccacgctgctgctacgacatatataatcacataaataccaatataataaaaccaacagcacgtccctgccccttcctccccacagcgtcagccagcctttcaccgttcagacttcagacttcgcggctccccaacctttcaagatactgggccttgcgccctgcttgccgtccgcagtcatctccattcccgctgactccatgccatcgaacgacttggcggggctgtacggagctttgctcacgaccctgtcacgacgtttctcaaggaagcgctggagagagtgcctcctggcaatggggagatcagcctgaagcttgcttattgagctagggtcagcaacaacctgagcttgtccagctgctacagaagtgctctgcagtgatggagaccgtgtaagcacaggagaagagactgctgcntgggcgacagtggctgtatgtacca

SEQ ID NO: 9982 - DNA, 533 bp, Zea mays
  Clone ID: LIB3279-201-Q1-N6-E3
aagcacggataaaaatcatcatctgctcataatcactgatggaaaatacattattcttcgtctcgatttattagtgccgcatgttcacaagatgcatcatcgtacgattccggctcaaatgcagggaaatagttcaacatttgcatacgcctgtgattgctacaaggtttccagagcttcacttttttggtgtatctgcatacttccaggaggtatgtgcataggaattgtattgtcttccaccagccacatcttctgcacgtatctggctgccaatttccttcaggtcctcagctgtgagcttcaccttcaaggagtcaacgttggcatctaggttcttcgtttttgttgtccctgagcaattaacgaacacatctcagcaaccaaatgcaggacgatttgactataaaaaaaaattcatgtccgcgatgacttgcttcaaactttggagtgaataacaagcacagatcaattgacataagtttgaaagtgaactatattacagctaagtaaaaaacaaatatatcacaaaa

SEQ ID NO: 9983 - DNA, 484 bp, Zea mays
  Clone ID: LIB3279-201-Q1-N6-E4
gaagcagaataccaccgcttaatgatttgtattaacaccagatgacatcacttaaaacaagaattgagataatctcctagaaaagcccaagaaccagcacaaatttaaattcaggtcttaaagctagtgtagagcacaagttccagataccgatgcactgtatctagtgtgacttgacgtactcctgaactatgttaaggccctcagattcttcgccatagtccttgacgacaacacaggagcaacccacaaccttcctcgccttgccctcagaatcaatcttgcaaagcccagaccattcgccaagagttttagcgctaggcacagtaaccaggtgaacgttgtgctcagagcaaagagccttcaccagcttgacataatcaggctggtcacagtcctccgcaagcacgcaaagctgagcagcatgcttctcaatggctttggcagcctcacgaagacccttaacaaggccatcatgagcacc

SEQ ID NO: 9984 - DNA, 525 bp, Zea mays
  unsure (1)..(525): unsure at all n locations; Clone ID: LIB3279-201-Q1-N6-E5
ttttcttttcagcatttcttttcctcagctctaaaacagcacacaaacattaaacaacctaagataacccattttcccccctaacgaactggtactattgcataacattggtcaaaaatttcaggtgctcgctcaagataatcactctgctattcttgaaactttaacggagccttcgtccacgagactgctccgtttcctcttactggacaagctctggaaaccgctgctttcgtccacaaactgtgcggcagttctctcccgcagttcttcgagagtctctccttcctttgctcgctcaatcaccaggtgtcgaccatagagatgagtgcttgcgagggcttgtagagcgttctgggcctcttgttttgtgacgtattccacaaacgcaaaacctctgtggctaccaaacttcataggcaacctgaggctntttgatctggccaaacggactaaataactgcctcaagtccttctcagttgcttcaaatgctacatttcgcacaagcagttttgttgaacttt

SEQ ID NO: 9985 - DNA, 462 bp, Zea mays
  unsure (1)..(462): unsure at all n locations; Clone ID: LIB3279-201-Q1-N6-E6
gcagcaccaagaagcaccatttttttccttaggatttaacttagaataaagcctgacgggggtaacagcacccatcgatccgcagtccatgctggttgatgcatgggtctgctggagccgaggatgaacacagcactaacaactgacacagagcgaccttcaatcaaaaacacagatgggcaacaacaaacacgagacgaacgaagataaacactctggactagggtaaacaacacggtagcgaacaggataacttggccgcgcgggccccaccgctcagttcctccagttcccgtcggagttgccgtagccgccgccacggttgccaccgccgtagccgccgccaccaccaccgtagccgccgccgccaccaccgtagccgccgccaccgccgtagccgccgccgccatcacggcgcccgccaccgccgtagccgccgcctccacggncaccaccgtaccc

SEQ ID NO: 9986 - DNA, 506 bp, Zea mays
  unsure (1)..(506): unsure at all n locations; Clone ID: LIB3279-201-Q1-N6-E7
atatgcncgaaaatactaattttataatttataatagggcgagcagctcgtaacagagttcacgcttcaagagcttaaaaaaagaaagtttcgaaagatggatgggacacaaatatgcttactacacactcgaaacacatactagttggtacagtacagagtacacatatatttaaacgacacaggagctctacggcccagccccaccgatgtgctgtaaaggcaggccacatcagcaccgacagtgggcccactaacccgacacgggatcggcacacagacacattatttattcgaccacaacacaaaacgacgctcctacgctcctttactaggcggggcccgccgcgccacgtaggacacgacgtgaacccgaacacaaaagcaggtttttcctagcgacctatgccggcgccatgccgtgctgttgccgtggcagtggcaccagagcggcgcacgccaggtgacaggctgacgcacgagctagatcggccgccgtccggcgc

SEQ ID NO: 9987 - DNA, 531 bp, Zea mays
  Clone ID: LIB3279-201-Q1-N6-E8
aacactgtaaactctgtcttgcaaagcttctaaacatggtctggtggacagaaacatatgaaactagattcggaaaaccacaatacgagttcatcagttcttccccgtcaaactacagggcagacacagcagtagacaatctaggtcatccgctgcgcagcctccttggcgagcagcttttcccgggccttggtcttggcctgcgacttggatcccatgatgccacctccccacttcttcctgacctcatcgaacttgtcgttgaagtttgccttaatagcctccaagatcttgctgaactcaagcttatcctcgttcttgacagtggtaagacacaagactgatgcattcttcttgtgaacaatcgatccaagacgagcctttcctttaacaatgcagtaagggacctccatcttcctacacagggctggaagccacacaaccagttcaatcggatccacgtcatgagcgatgacaacaagctgagccttgttctgctaatgagggtagtcacatggttaaggccatact

SEQ ID NO: 9988 - DNA, 513 bp, Zea mays
  Clone ID: LIB3279-201-Q1-N6-E9
tttaacatacaagtatatggtgtattaacatataagtatatggtgtattgctgtattacaatggaagcttaaaaacagattcacagcaggtctggtgtccattacaggcgaactgactccaagtacacaagttatatgttcgtcacaacctgggcatacatccttccaggcacaacaaatttgtgaatccgagcaaagtccgtccttatttcagataagacaggtaggtcgagtgcaaagaaacgtagcaagcgagcaacagcagaagcatgcttcacttggtccaccagtgaaggaaatccttacgcctgttgatcttcttttggagctgaagaacaccgtacagcagtgcctcagcagttggtgggcacccagggacgtagatgtccacggggactatacggtcacatccacgtacaacagagtaggagtaatggtagtatccaccaccgttggcacagctgcccattgaaataacccatctaggctcaggcatttggtcataaaccttgc

SEQ ID NO: 9989 - DNA, 449 bp, Zea mays
  Clone ID: LIB3279-201-Q1-N6-F1
acctggtcagacactttgcaaacatatatcttagattcgagaattgagtcttgatatcacattaggtactcggggaacatagtgtggcgccatagctagatgcaataaaccttaaagtcctctgaactcgaaaatcctaacccaaaagagcaaatagagcgcagtcttctcaaccatcaaacatgacaccattgaaaccaaagatgacactgctcacgcttcaacagcgacccttccagccacttggtccagatcacgccttccctggttggtgatgaggcgtccacccttgggatcgacatcgatgatgcccataatctgcagctgctgcaggatgttgcgtgcaacagcaccactgctcttgcagaagtgtggtgggcgggagccattcctctggcggccaccgtagatcttctgaaagccacccacaccgatgccttgccttaggt

SEQ ID NO: 9990 - DNA, 522 bp, Zea mays
  Clone ID: LIB3279-201-Q1-N6-F10
agtagtagttatcaccgagaaaaatcttgcgtatggttctcacatatgccagttctcgtggagccaatttgctcatctgccgggacccaatttcacaactgcacataactcatgcattacaaccaacccaaaagtgaaaaaactggagaagaataagaatgggtgttgtcgctcgatgttgcagcaatttaaatagatcaaaaccaacaactctacactctctatacgtacatcagttgctcctgttggcatatacttctgtttcctctgttacctttgtccacatattagcaaaatggtctgaataagacacctgagttaccacaaaacctttcagcatctcaatgaaatcatgacgtctttccttgtcaaatctttttatttcaatcatgttgttttccttaatgctttcatattctctaacggcatcacttttggctgcttccgcagatcttattgcttctttcaacccctctaccttctgatatgttgaccactcatgccccatatctcttgctgatg

SEQ ID NO: 9991 - DNA, 556 bp, Zea mays
  Clone ID: LIB3279-201-Q1-N6-F11
gactaatcaatgtgttagattcagctgattcatacaatacaaattgaacaagaatatctcaatgtgtggtatatgacgtgccaaatgactagctcagctagaggtttcagaaggttctacataacagaaaaactgcaagttaaaatacagtaaaaacaggggaaagagtttccaccttgtccccaggaaattactccgagtgacatggcatgtcaagcacttcagtactgcccttaaacacataatagaatctagacccttgcagcatcctcatgtgctacttctagccctgcgctctggctagcaagccagacaatgatacggggttgttcctcatttgctcttgagcttgcttcatctcctcaggatctatgttctccatcatcttgggcatcacaaagaccattaagaccataaaaccaaccatcaaccccatgggactcttcaaaagtgacatgacggagaaaggctccctaacctcatagtactgctcttctttcagaggttccaggacaagctcatttagaactcttctagtttcagtcaatgctgcttg

SEQ ID NO: 9992 - DNA, 551 bp, Zea mays
  Clone ID: LIB3279-201-Q1-N6-F12
ttatatgagcgaatatatttcaaatcgtagaaatacagttagtttgggacgggagcgagtaattctcagactcctcatgtgcacagtcactttttcctcataatacatccaggtggggttcctcccccagttcactctataaaaaaactatcacacctacggtcacaaggtttctaccccgtcgatatatatatacaaatggattgcataaaagaaattatagagggcgagaacactctgccgtatcagtcttgataactctggtgttgtaagaaccacagaaaccacacttgtggtagagccaatgaaaccgtgacctgccttttctctcgcagtcgttacacagtatatcctggcaccggtcctggtattcctcaggaagctgttctgcagccagcaaaccatcaagcatgccaaaatacaccgtcatatctcccaaggatttgcagcagattggacaagtgtagtgggtacaagtatatgcctgaaaaaagccgaatcatgaagtggccacaaggaaggcctttaactggtgcactcgatgtaaacaa

SEQ ID NO: 9993 - DNA, 589 bp, Zea mays
  unsure (1)..(589): unsure at all n locations; Clone ID: LIB3279-201-Q1-N6-F2
acgtaagnncttggcnatcctctanaagcggccnngccctttttttttttttttntttttttttttttttnttttttttttttttttttttttttttttttttttttttttttttttttttttttttttttttttttttttttttttttttttttttttttttttttttttttttttttttttgggaaaaaaaggggggggggggggggggggaaaaaaaagggccctggggggggaaggggggggaaaggggaaaaaaaaaaaccaaggggagggggcaaacccccccaccgggtttttttttccggggaaaaacccccctgggaaaaaaaaaagggggggggggtaaaagggggaaaaaaaaaagcccccccccaaaggggttaaaaaaaaacccgggaaaaaacaaaccgggggggggggggccccaaaccccccaaaaaaaaaaaaaaaaaaaaaaaacgtttttggcggcccgggaaaaaaattttttttaaaaagctttttgccccccttggggcctccccccccccccccaaaaggggaaaaaagattttttttgggggcccccggggggggccaagggggg

SEQ ID NO: 9994 - DNA, 479 bp, Zea mays
  Clone ID: LIB3279-201-Q1-N6-F3
gtaaggatagatatgaaaacaaaattatactcagtaacaggggtaccaatatgatagatactactgctccatttaagtttcaacctcagacagatctaaatgagatacaatttgagtaaccaacatctgaatgcttgataggttggcggataaagcaaatcggggcaagcaattacgccttctggttgtagacataggtgaggccgcacttgccgcagtagtggcggtcgaagtggttggccatgaagacgcccgcgccgcactctgtgttggggcactccttgcggaggcgggtcaccttgccagtggcgtcgtccaccttatagaactgcagcacggagagcttcaccttcttgtgcttgtgcttgatcttcttgggcttggtgtacgtcttcttcttacgcttcttggcgccaccgcggaggcggagcaccaggtggagggtggactccttctgaatgttgtagtcggcgagggtg

SEQ ID NO: 9995 - DNA, 504 bp, Zea mays
  Clone ID: LIB3279-201-Q1-N6-F4
gaacctcaatttagttggctttggaaatgaatacctttgtcagaagggggttgaacagggtaaaaggaacaaaaaaaagggcaacagtaatctacaatttacaagaaaataatgaacaaaacaatagtaagtcctgtgttaccctatttcgcgtgataaacctcctacatgacgacctgtgtggacctgatttggagatcatgaatgatgctcttcctcgtgagaagttgtgtttccatgtggtgcatgagttgggtggctgtatttcttgaagacccgctcttggttttccctccaccattcttcagcctgattctctgcgaatctcctcttgctgaatcggacccgcttgaatactttggtaccgtcctttagttggataagtgtcacatatacgccaggttcaaactgctcaattaactggacctctccatgggtaccctgcttcggggcaaaatcaccatgggcctttgaactgttttccatgaaacgatgggatgggga

SEQ ID NO: 9996 - DNA, 532 bp, Zea mays
  Clone ID: LIB3279-201-Q1-N6-F5
attgtacaaagctttgtacagtatgaatttcgactaccattttcaatagtacatgaaaactgttaggtataattgccgactacaaaaagtgatatcattatactataagaggaaaaggggaaatacaacaatagtgggatccaaattgcaatgaagtgtgcacttcccgtctctaagaatttccggtcaccaagtctatctctagcagattacccatccccatagcatattcaaactccactctgcgaacagtgcagtcttctttttcggaaacttatcttggagtagttggagtgttacaactgctcacttgcagaaatagaaccatgggtgttgacgtgttgtattacgcccagctcagtctcctccatttagagggctgatgtacccttatcccccaattccacctccgcaatttctcataattcatacacataacaagcatgccttaatagagaaaagaaaaggatgaacattgtcccttaataggatgtaaagaacataatgagttagtagacaaccgtttaatgca

SEQ ID NO: 9997 - DNA, 503 bp, Zea mays
  Clone ID: LIB3279-201-Q1-N6-F7
gaaatcagggaatcacgtttcaaccacaatgcacagatctactaaccagttccaataacaacgacgacactacagaagtaaagatctactgaacacgagcattcaacatcacagcggtaaaggcgcccctctatgccttcttgggggacttagcggccttcttgggcgacttggcctccttggccgccgccttctcagcggtcttcttgggcaggagcaccgggttgatgttggggaggacgccgccgtgggcgatggtgacgccggacagcagcttgccgagctcctcgtcgttgcggatggccaggagcacgtggcgcgggatgatgcgggtcttcttgttgtccttggcagcgttgccggccagctccagcacctcggcggccaggtactcgaggacggcggccaggtagacgggggcgcccgtgccgacgcgctgcgcgtaccggcccttcttcagataccgcccgatgcggccgacggggaactgcagcccggccttg

SEQ ID NO: 9998 - DNA, 507 bp, Zea mays
  Clone ID: LIB3279-201-Q1-N6-F8
agagaaaattattaccttgacagcttcatcacaaatgtttagagcaaggtcatatgacaaggagcaagcattacaggtccgtgaacacatttattccctcttgtgccaacagaaacagtccgcaggacttgagataccaaacatagacaaataagcagacagcttgccttgtcttccccctattatgatgctccgggacacaaactcgtaggaaagctatttcttgccacgcaacttggttcccagggccctctcgagcttgctaatgatctgctggttggggattgccttgcctgattcatactcctgaatcacctgtggcttctcatttatcatctgagcaagttgtgcctgtgtcagcttcttatcgagccttgcttgcatgagattcttcttcagatcacttggaactcgctcatgggcgaggttttcggtgtcgtcgtcgaggcgcttggtgttgagggatgtaccgctggatgccgccttgttcgaccaacgttgtacttc

SEQ ID NO: 9999 - DNA, 472 bp, Zea mays
  Clone ID: LIB3279-201-Q1-N6-F9
cgaacttccatagaggtcattgcaccaagaagcatgcgatacaaaatagcacccaaaacactcgaaattctaccttcttattttagggcctattttaccatgaaaactcaaatcatgtagttgtattactcaaagtgcatatttaaaagcattctttgatacgataagctatatgtgatttatttagtagtggttgttctcccagaattgagcctggagccaatcaattgtccccttctccacctggaaagcctttgccaagacatcatccgaaatcggtggctttgatccgaagaccgcattggcgatggtaataaccccagggttctggctgctgagcgccgcgatagcaacggccggcttgttatagaccgggttgaattggaaatggatgagaccttgggggaatacgaacacatcacccttgttgagcaccttggcaaatagcttgtttgggttggaggtgacaaac

SEQ ID NO: 10000 - DNA, 582 bp, Zea mays
  unsure (1)..(582): unsure at all n locations; Clone ID: LIB3279-201-Q1-N6-G1
gtaacaaaagcattctgttattacttccatgtatcacaaggtcatcaacaaaatgggcgtccatccagaaccgctcagattgcataatctaagggtggtcattgttgcggaaccacgaacttgaatggcaccgtacctgctaaattctcaggacatgcctcctcccaactaatgaaaaacgggttaaaaaaccgtgaaggtgccagtgcattcttattataaatttattacaaaattggttacttttgtacgggatgccgatcaagcagcagaccacgggttgcatccaaatgttctcttttccagagcggttttcgctcccaaagaattcgtcaaaacacggtaattgcctcctttcatttacaatagcagcctcctgatgtcgctgaaattcagcgccagctccgtgaaaaacttgcctcctacttgcccatcaaatacacgatggtcagcagatagtgtcaggctcatctttgtaactgcagcagccttctcggttccatcgctgtccacaacaggttcaacaaccttgtttnctctacccactgcgagaatgccagactgtggaggattaatgattgc

SEQ ID NO: 10001 - DNA, 569 bp, Zea mays
  Clone ID: LIB3279-201-Q1-N6-G10
tttaaaaaaaactattcttatttaaaattgaatgggaggattttagccccttcaatccactcaggttttgtggcccccagactagccctaaatgatttatagtttagaacagaagtgatatacaataatagaaaccatgcattggattaactaaacaacattctaaccagatcctagtaacgagtaacgacagaataatctatacatgtactcattgcaacactaccaacatacaaccgacaactgtccgaacaccacagatgtgatgcgtggtacactgatactgtgtttgcagggcctgtggacatgtttcacggggaagctggcgcaggtggtttcggagtctgatttttctggttagctgcagcttgggcagcagagtttctcgtgtcagtcgccatggacttctttatcagagcaagcctctccctgtgaatatcatttatgtgctgtttcttgtacagtttgatttcatcaccactgaagcctggcaagttgatattccagcttctttctgcatgtaggagtacatcttttgcttctatgtgcttgacttcctatgctttgct

SEQ ID NO: 10002 - DNA, 558 bp, Zea mays
  Clone ID: LIB3279-201-Q1-N6-G11
gcatggttcctgaatctgaacattttattttattctattttattcatgggacctgactccacacatcatcacgcggcacataatcaagcagatccgaggaaccggcccatccaagaagagaagcgagaccaggccaggtcgacggcttcctggttctcatcagtcagacccatccccttcttcctcttgagtgcctcaggcgaagtgttcatgaaggcatgcgaacatccagggtatatgtgaacttcatatggtatcccggaagatttgagcttctcctccagggacttggctgcagtgacatctgaaaaaccaacaaaactgtcatgctccccgaaatgagcctgtataggagccttagccttagaaggatcagcaagctcagaagatggtgtcccatagaaagcaacaacagcatcaacctctgggactaaaactccacttgcaattgataaagcacctcccatgcaatagccagtaacaccaaccttgggtgatccatttgacttcagccatttaactgaagcctggatatccttgactgcaccctgccagtca

SEQ ID NO: 10003 - DNA, 593 bp, Zea mays
  Clone ID: LIB3279-201-Q1-N6-G12
acgccatagcccaggtcgcatccctgagttcatttccatttgtagaatgtaaatcaagtcataaaatgtaaccaaatcctctaatgggtccctagttgtaatcaccacatgtggcaacagttaatcttgcaatggcaatgttagagcacggaatatagttctaccgcaccaaatactgttcctaccataaaatgctcgatctcagggttctaaactctgcatataccaaactaaagaatacaacacaggttttatgtgtagcttgtactgcaaacaaggcaggcagggaggctcagctgcagcaattacacagttctcacggtgacttaattagacccaactacgttccaatgcccactgtttagatggacatgccatgaaatctgaacttctaggagaagaggaacacctgagacccagaaaaatagtttaaactcgtcgcttattttccgtatggatgatacctgctagaaccccgagcacctgtgctcccaccaccagtactacctgctccgccataactgccgtatccgccagtgccataaccacctggggcgccaccataggcagcaccacctccataggcaccccct

SEQ ID NO: 10004 - DNA, 546 bp, Zea mays
  Clone ID: LIB3279-201-Q1-N6-G2
caccgttaatccatatggattgggtggtactgaatcaatttaaatccataaaagtcaaaatacatcctaatccattccaatacactctaatccacataaaattgaaatcaccaaacaaggcctaaagattcaaagttgatttgccgttgcttgatacagctgctacaaaaatccttcaggttacacagtaaccttgcacatgcatagcagcattcacagctcgaagtacaatactgaaagtactgtatgccggaaagcactgcagacatcattaccagagaaccaagaactgatggtaccgttactctcgtgaactccatttatccatttgtccacaagcctgaaaccctgggacgttgcattagaaaggatggagtcctcatcaactcgtcgctggatgtagcaaagaatgagagcagggaccgagtcctcgttagctttctcagaaatcactcccctagcagtcttgaagagagggagtatagcatcgggattgtatgtcacgtcggtgcctattatgcaatcaaaacccgcgccgttaccatg

SEQ ID NO: 10005 - DNA, 573 bp, Zea mays
  Clone ID: LIB3279-201-Q1-N6-G3
ttaaaagctaatctcaggtcccatattagcgagcggatctgtcacagatggtagcaggaagggaaacaaaagtgcaaaacatgtccagactcagcatgaacctggcgacccagaggcacgcgccatccacatttattctcggcatacacaagcagcaaccatccatgagaagcaggggggaaaaacccctactgggtcttgaacatgtggcggatcaggtcgacgacgcggttgctgtagccccactcgttgtcgtaccacgagacgagcttgacgaagtggtcgttcagagcgatcccggccttggcgtcgaagatgctcgacctgctgtcaccaaggaagtcggtagaaaccagatcctcttccacataacccatgatacccttgagtggaccctcggaagcagccttaatagctttcttgatatcctcataggaggcccccttctcgattctgacggtgaggtcaacaaccgagacatccacagtaggaacacggaaggacataccagtgagcttgccattcagatcaggaagaactttaccaacagccttggcagcaccggtgctgcta

SEQ ID NO: 10006 - DNA, 364 bp, Zea mays
  Clone ID: LIB3279-201-Q1-N6-G4
gggaaaaaacgattggaacttttttacttggaaggggggaacaaaagcccatggcaggttcaaatttgtcaagggctaaagggggatatgctttgaaaaccgccgggtcgggtttgatgttacaaaaaaggcctagggggggggattgggggggatttaaaaagggaaaaattggtcccccaatacaacattgggggaaccccaatcagcttgttccctccaaaatgaacaaaaaataatggcccccatgctcaagggggggaaaaacactgaaaacaaaaccctggaaaaaccaacggcctgtgtttttccacggcgcaaggggaaaacctggtcaggcaaaactgggacctgaaatttttta

SEQ ID NO: 10007 - DNA, 545 bp, Zea mays
  Clone ID: LIB3279-201-Q1-N6-G5
ggcgcctgatgatttattttattccatctcgactgggaagggacacccaatcaaacatacaaaacaacaacaagagctagcttattggtgtggctgcctgcttgtagcaaggcggacggacggaggaacatggaaggatccatcggctgtgccgctgtggcgcgcggccatggtggaattggatgagtctctagtggatcttgcagccgcagttttcggggaggaagtcgcggcacctgtacttgatggcccccttgtccgtggacacggggacgcagttcttgcaggtggcggcgcacttggtgaggaggtcgtcgcaggtccacacgcccgaccagctggtgcactcgccgcaccagcactgcttcttcgtcgtcggccctgcaggtcctttggccacggccgcagagaccagaagggcctggagaactaggatcgccaacagagtgctgctcttcatcttctcgacctctcgctctaccaccgcttgctgccgacctctactacaagaacgcaagcttcgagttcgtccggacgcgtgggtc

SEQ ID NO: 10008 - DNA, 353 bp, Zea mays
  Clone ID: LIB3279-201-Q1-N6-G6
gtggtgtatggtgtttggggggcgggggaagggaagggggggggggaaaactcgggggggggggggggacggaagggggggcgagcaggggggggaggggggggggaggaacggtaagaaaaaccggggcccgggggggcagggagagggcaacaaaaggaagaacgggggagggggaggaggcccggggaagaggtgaccggatccgtaaaacgaaaaaaaaaaaaagaaagcgggtcaggtggagggaggggaaagaggggggcagaagaacggggaacgggacgaagaaaggcccgaaccccggcgcagggctaaaaggccgaggacaaaaagaggaaacacaagggggt

SEQ ID NO: 10009 - DNA, 367 bp, Zea mays
  Clone ID: LIB3279-201-Q1-N6-G7
accagggccaagggttaattaaaaggcccaaaactaaacattggtcacgtcccctgccccttcaccggcccaaattcctaggcaactttagcaacaaaacttttttttttgaagtccctggggggcccccccctacccttcaaaatcaacgaaatagagggggaatttcccgagggcctcatatttatcccttttcgggcataggggccccaaaaaccccatttttcccacccaacctggggtaaaccccagggcaggtccccagcttgtattcaagggtgtcccccccctttgggccccaaaaaatcttgataatcttggaaccatccaaacgggatttgacacccttccccacaattttaggtgg

SEQ ID NO: 10010 - DNA, 579 bp, Zea mays
  Clone ID: LIB3279-201-Q1-N6-G8
aacgacaaaaatgacaggactgttgtattcatctcatgaagtgtacatatatatacatagtgaagggacaccacaacgggtcgcaccccttggaattagatcacataaaatattttctaacaggtatcagccgctcgtaggcgctgccgcgtcggacgggtgtagatagcggccgacccggcgccgcggcgcgccccgcgtctatccccccaccacgtttcgtggcgctgaagcgctgctgccctcctgccgtgctgagtcagggttgatgagggttacaacttacaacccccaacggcttctcgtggccactcgcttttcacgcaagacggcagaacctgcacccccgtcccccgccggctcgtgtcgtggtgggtggccacccctcctccgctccgctccatttgggcggaaaccgaatcactcgggtcagtggccacttgaccccctgagctttccttccactttgcaggctcgagatcaccggtcacaaacggcagtggtcgtcgtatcgtaccatggtaatcatgggatcactatgaacggacccgacggacccgcgagagttgtgcggcaaaa

SEQ ID NO: 10011 - DNA, 240 bp, Zea mays
  Clone ID: LIB3279-201-Q1-N6-G9
ataaaacaacgagggtacagatgcccagtaatttcattcccaacaaataacagcgagtcactgaaccttaacatttattgctacttaacagcgcagcgactctcgatccatgcccacatttcccaccacctgcgtgtgcatttcctgaatgcagaaaatgctgatactaccatacactactacatcacctacaattaaaagtacaccacagctcttgcattgcatcttcctatataggag

SEQ ID NO: 10012 - DNA, 529 bp, Zea mays
  Clone ID: LIB3279-201-Q1-N6-H1
aaagataaccatcatccacataggaagcatgtttttttcatgtccgaatataaaagctctaacaagcaaacaacactcagcaacctactcgcaggcaggagttccaaaacaacgggatcgcaaagagaagcaactcagtacttgtagtccttgacgtgaaggctctcggtgtcggcggcagcatcacccttgtaggtgccgagggtagcctcggagttggccttgcacctggcgaggaaggccgctctagccttctccacgttctccaccttgccagcccaggccttgagggtgctcgcctggagggcacggccgaaggagaaggacagggcccatggcttcttggtgctgagcttgttcatggcattgagattcagggtggcctcctcctcgctctgtccaccggagaggaagacaacagcaggcacagcagcagggacggtcctctggagggtacggacggtgtactgggcgatcacctcaggtgtcaccttcttagagtcggagccaggagtcaccatgttgggct

SEQ ID NO: 10013 - DNA, 448 bp, Zea mays
  Clone ID: LIB3279-201-Q1-N6-H11
ccctagatctccatgtcatttaatatttggagtccattcagatgacacgatcttccactcaccatggaattcagtacaaaagattaaccactctctggatccccatcttccccacggccactgcttgcaagattcaccttaaccagctttctctggtcctcatcatctgatggtgcttcaagatgagcctccagcaataggatcttccagtcgtgatgccgcagaaacgaaagcagaccatcctctccatctcgggttgccttaatctggagaaatcctgacccatgtggcccaaatacagggaatgtgcatgacacaaaccgccgtcgatggcccacctcaagagaagcatcataccacggtcctctgactataggcactccaattgcttccacaacagcagggttgtcagcagcatgctcaattgccttcgttgtgcatccattga

SEQ ID NO: 10014 - DNA, 555 bp, Zea mays
  Clone ID: LIB3279-201-Q1-N6-H2
cagaaatcttatgagcttgtttttctagacccgcaattccaatgtcacgacacacttcggcagcaccaaagatttgcacatggccttcatgtgttgaaaagcactgctcatgtccttttctagttcatcgttcctttctcctcagctcacatgaaaccttgaatgttctgcacgatcaatcaacatggcacaagaaagcagattagagaaaggaaccaatcgagcaatgaagcagcgacgaacaggcattttacctgaacccactcaaagtagctaacgaccacaccacctgaattagcatagatatcaggtaatactactactcccttctcggcgagaatctacaacatatgcaagaggcagaagctcggaaaaataaaaaaggttgcactcagaagtgataaaatacacttctctcgttaactgctccgacccaaagccaacaattttggactcgcgcgtgtaaaaaatattatctattgcatcgggtcgatgtcgtatcagctaatacgacgaccatttaggagcactcgagcttgcacgccaacagaagca

SEQ ID NO: 10015 - DNA, 401 bp, Zea mays
  Clone ID: LIB3279-201-Q1-N6-H3
gcatgaaaggcgccatcttcacattcgccaattggtgacaaacataggcgggcaggctttatatacaccctgtttcagtacattccacgcacagaacttgctacacgggggttggggtaactaacaagcgagacaccctattccaattttgtacagactggaccacaaccttacccataacaaattattacatctaaaatgagagaaagaactaccctttaccatcccatcaggtggtgtatctcggtccaaaggcaaaaagggtcgcccataaaggcatggccaatcacctcctagctgcaggacacgacggccaattaccccgccctaatctatcccaggaggtgttcttattcccaggcggcgtggccgacgtaaaacctcaggccctgggccctgat

SEQ ID NO: 10016 - DNA, 453 bp, Zea mays
  Clone ID: LIB3279-201-Q1-N6-H4
aggcaggctaaaactcagcttgtgcttccacaaacgtcgcagttaccaacaggctgagaaacggcaatttcacgctggtaaaataaaaaaacccagcgagcaaaaagcaaggaccaagccacggagaaggcaagggaaggcgatgtggcggaaatatttgcaatctcgccacccaagtgttgacactttgctattataccctctatgcctatgatttgtggactacctggccggaggcgaggaccacgggatccctcatgatctctgaggagatggggcaaaggaagtgctccggcacggcggcctccgtgctgcgcttgttctcccggccgtcgccggtcctgtccttgcgggggccaagctcggcgtccctgagcttggcgagcgcctctgcagcctcgtcgaaggcctcggcgttggcgctcccggccgccaccgcggccaccaggcgcc

SEQ ID NO: 10017 - DNA, 421 bp, Zea mays
  Clone ID: LIB3279-201-Q1-N6-H5
aacgccaatcacgaaatgcaacgggtttcagcagggggaaaaccacgttccaaccgcaaaccattccttcactggtacaggaacaactttacaacgaccggttgtcaaccagtcaagccaatttactttaacgccaaaacaaaagcgatgataggtttgtcaccatgaatgaacttttgattaatgggacaaggaacagctagctaaactacaatggttcatatcataacactgaatatgggatacatcagctacatttacattactttagttgaagttggtatgtgatctcaggcaacactcctgagctgtctcccctgagtcctcacatgaaatccatggggtcactcaagggctggccaccgccctttgaaaaattctgggggtcatgcttcggatggtgatgctggccctggtggcc

SEQ ID NO: 10018 - DNA, 569 bp, Zea mays
  Clone ID: LIB3279-201-Q1-N6-H6
gagtgaatcaatgtctcgagacttacatcgcaagttgaacaaatttggctgttgaacaaatcggaacaagacttggataacatctgcccacatcgcaaatcctagatcgtgagttccttcatgtgagtgctaacactcctgctaactaatggtggaggagagccttgacctgctgtgtgccgcacagctcgaaaggcagagcgttcccctggagctggaccgcgctcgccgacgccgtggttcccatggcaccggcagcaactttgtcggccagctccccgccgccgcaggtgaggaagcagtagtacatctcaaggttttcggcaccatggggagacgccgacgcagcagagtcatgcatggtgaacgccgtcgtgttcacgtccaccgcggccgggacagcggcggcaggtgtcgtgctcgtcatgtcgccgaggagaagggtgagggagaccagggcatggaggaggaggaggatggaagaagctgccgagagaggcatcgtgtcgtcgtcggccgggacgccgcgcagagcggaaacagagctagctgctagtctcgtggatggg

SEQ ID NO: 10019 - DNA, 335 bp, Zea mays
  Clone ID: LIB3279-201-Q1-N6-H8
agtgcaaaattactgggggtgtagtacttccaaaatcacgtttcagtgctatagactgtaaacgttctgacaagtgctgatcagaaagggtccaagaaaaaaaagaagtgggggcagatcgaacatcctagcacgagtaaatttcccatgagtgcggtcacggtcgtcaaatgttatctaagttggcagtacaaaaacatggttccataaaattggcgccgggtaactcttggcttatagcacaacattcagtgcccacagatcttggtcacgtcagcctccagagacttgtgcgctcccatgagtcctttatttgtggtacaggtacacaaacg

SEQ ID NO: 10020 - DNA, 494 bp, Zea mays
  Clone ID: LIB3279-201-Q1-N6-H9
tttttgcagatatgctcaatgaaggagcaactgatcgcatacagaaacacgattgttcttcaaaactacatgatctccaggtacaactaaacaatgatccatggcatcctacaataacatgctaattaaccaatctcatactgttacacagactgggaaatgatctccagttctccttttgtctagtttcatttggaggagatcacagaactacgagtcggactcctctccagaaaggtttgactccgacctgccttgccgcttcaacccctcctgaatccgacctttaatggcagtttccatcatgtggcagccttcctcgaacttctcaaggaagccaacgatccagcggtccgcgttctccatccactccacagggttggtcccagcgatcttcgccgcgctgtggaacttctcctggtgctccttcaccttctcccgtagcttgctgatccccatgttgactctcaactgcttctccttgacgtagctga

SEQ ID NO: 10021 - DNA, 638 bp, Zea mays
  Clone ID: LIB3279-202-Q1-K6-A1
cccacgctgtcctgcctctctgctccagcctgcttcacagcgccgccgctcgcctctccgaccgccgcgagaatgccgttcaagaggttcgtggagatcgggcgcgtggccctggtgaactacggcaaagactatggccgcctcgtcgtcatcgtcgatgtggtcgaccagaacagggcacttgtggacgcccctgatatggtcaggtgccagattaacttcaaacggctctcacttactgacatcaagattgacatcaaacgcgttcccaagaagtcaaccctgatcaaggctatggaggaagctgatgtgaagacgaagtgggaaaacagctcatggggcaagaagctgattgtccagaagaggagggctgcgctcagtgactttgacaggttcaaggtcatgctggcaaggatcaagaggggtggtgctatcaggcaagagctcgccaagctgaagaaggcgtccacggcttaagtcccttttggtggatggcatgttagtttttggtttcatgttgcatcagcattttgttttgagtgttgtcaaagccagaattagtaatatgtttcatgtgtacccttttcaaactttatcaagaatgggtgtgctctggatattttgtcgggaatgatatg

SEQ ID NO: 10022 - DNA, 653 bp, Zea mays
  Clone ID: LIB3279-202-Q1-K6-A10
gaccgtcatatgctgctttagcagagtattttccattagaagcaaatctgaagatatgcatgtcctccctccctggctgtagattgattgtcagtagggcatcccacacctcaagaaaatcagacagtacccctactgtcaatgcccctttgatatcagtcagccactttctgtctgagaactgtccatacagctctagcaaatagaagttggctgaatgacatcaaaggagctctcattgtggaagtccttgctgattttcttgatctttgggatgcaattctcacagtaaacttaaatcctcaaatggaggacaaacacatcttgagatgctcataatggaaaatattctgctaaagtagcctacgaaagtctcttcattggatcaacatactttgagcactacaacatgatttggcattcttggtccccccaccctcaaaatgcaattttttcttatggcttgcggcgcttcagtgatgttggacatttgataggcttcaaaggagagggcgggatcaccagatcagtatcttctatgtgaccaggaaccagaaaccattgaccatctccttgtgggatctgtgtttgcaagaagctactggttcaggctgctgggacagcttaacctccaggacttcgctcctcaagta

SEQ ID NO: 10023 - DNA, 636 bp, Zea mays
  Clone ID: LIB3279-202-Q1-K6-A11
gccggcaggcggggcggggggccgcacccggattccatcccacccgaccgcgccccattaaaaacgagggctcggccgccgcctcggccgcccactcccagaggctcttctcctcctcgcctcctctccctagtctccacgacgcaagggagagtgacggaaagcgacgcggcgcgagcgaggagggccaaggcgaagaggggaagcaccgcaccaggacccttgttcgccgccgccgcctctgatctccgcgaggttgtcaggattcaatatgtcgaccagcacattcgctacttcctgcacgctgttgggcaatgttagaacaacgcaggcctcccagacagcggtgaagagcccttcgtctctaagcttcttcagccaagttacgaaggttccaagcctgaagacctccaagaaactggatgtctccgccatggctgtatacaaggtgaagcttgtcgggcctgaaggtgaagagcacgagtttgatgctccagacgacgcctacatccttgacgcagccgagactgccggtgtggagttgccatactcgtgccgtgctggggcttgctccacctgtgccggcaaaatcgagtctggttcggttgaccagtcggatgggtccttccttgatga

SEQ ID NO: 10024 - DNA, 413 bp, Zea mays
  Clone ID: LIB3279-202-Q1-K6-A12
cgccgccgccaccccggtttccttcgtaagcccgtcgtcctccgtccgcgactctgcgcgagaagcgagagtatggacacccaagtgaagcttgctgttgtggtgaaggtgatgggaaggaccggctccaggggtcaggttacccaggtcagagtgaagttcttggatgaccagaaccgtctcatcatgaggaacgtcaagggaccggttcgcgagggagacatcctcacactgctcgagtctgagagggaggctaggaggctgcgttgaggcgggatactgtcttggtagttttcgtatggagttggatgtcatctaattgtgctatgtttgtcaaactttggtatgacctttaaaacacctgccttgtatgattatttgtgagcctggtggtaagattgcagtttggtttt

SEQ ID NO: 10025 - DNA, 633 bp, Zea mays
  Clone ID: LIB3279-202-Q1-K6-A2
ctccactatttgtgcttctgccaccgccaccttcctccacgccgtcagcagatctgctctgtcttctcctcccttcaccagatctgctgggtgcagggagcttcacagtgatggatctgaagagaagtgggaaatggcagaaaagacccggcagctaggtattgtgcacgtctctgtgtccgtccgtcgccggatctggtcgtagtggagacgtagtgtctgatcaggcagcaacagcagcgacgcgtcgatagatactagttgacgatagggttgttgtggcaggggcagctgcgtgttggacgacaacgcggtgcccatgccgttggcaagcgtcgcggccgtggcggcaccgcccaaggcgttggcggccaccacagacacggttggccttgtaggaaaacactaataaattcttgtttattagtgttgtcttatctcttggtttaataccatccaaagaagtactgtcctgtcaggaaaacactaataattcttgtttggacgaatcttcactccacttggatggtcaccatgctcagttgtgataacaagacaaatccaagctggttaccaacgcccgattgcacaaaagccattttattcgaatatatccaaatgcaatctgtaaaa

SEQ ID NO: 10026 - DNA, 614 bp, Zea mays
  Clone ID: LIB3279-202-Q1-K6-A3
caaggccaatgccaaggttgttgagcttgagaagcaggttgacaagataaaaaaggatattgaagcacaaagtagccagaaagcagcactagagtatagggccaacgatgcagagaagaaggtggaagtactgaatgaaaagcttaatacaatccaaaaggaaagtgatgagaaaaaacgcaaaatcaagaagacagaacgtgctcttaaagtcgctgaggaggaattaatgaggttgcagttagaagtaactgctaaatcaaaacagctgtcagaggttcatggagcatggttaccaccttggctaatggcacaatatgctcgttatgcggaggttgtctcaggtcactggaatcaacatgggaaacctgctgtgcagaatgttttgcataaggcatcagaaaaatcagcacaggcaaagaaatgggctgaacctcatatcgagactgctaagatgaaatggattcctgttaaacagaaattggttttcctcaagaaaaatgcagaaccttatgtacaaaaggtatcaacaagatcagtggagttttacgagtcatcaagggatgctgtgacacctcatgctgtcaaagttaaagtgtttgttcattcctact

SEQ ID NO: 10027 - DNA, 606 bp, Zea mays
  unsure (1)..(606): unsure at all n locations; Clone ID: LIB3279-202-Q1-K6-A4
cccacgcgtccgatagaatggacctgcttagagctgtcattatgggaccagctggtactccttaccatgacgggctcttcttctttgacatttacttccctcctcagtatccaaatataccaccgatggtgaattaccgtgctggtggtttgcggcttaatccaaacttgtatgcttgcgggaaggtgtgccttagcctcctaaacacgtggactggcagtggatgtgagaagtggaacccggccaattcaactatgctgcaggtcctggtctctattcaagctttggttttgaatgcaaagccttatttcaatgagcctggctacgctatgcatgctaacacagcccacggggagaagaaatccctgacatataatgaagacacgttcctgcactcctgcaggacgatgctgtattctcttcgaaatccaccaaagaatttcgaggattttgttgctggccatttccgcaagtatgggcgcaacatcctcgtggcttgcagagcctacctggagggtgcccaggttggatgcctctncggtgacggagtgcaagacgttgacgaaggcgacaagagctgctcggtgaggttcaagcagtcactga

SEQ ID NO: 10028 - DNA, 445 bp, Zea mays
  Clone ID: LIB3279-202-Q1-K6-A6
gacgaggataacagtgcttcagctacttcgaaccaaaacaacccagaggtgcccaaagtagaagaatatgccgatgccagcaaatcttattcagagccattggaccttgcaaagtacagttcagctgtagaattggaggtgcttggtctggagaagctaaaaatagagctgcaatctcgtggattaaaatgtggtggaactttacaggagcgagctacccgactcttccttctgaagacaactccattggataagttaccaaagaagctgcttgctaaggccgctattggggggaagtgagaagctgtataaacaagtactgatggtgcaatgcttaagttttttctttgacgatgtatggaaatctgttgtggtgtaatcacgtgttacaagcccttggtgtggcattgacgattaatgatgtgtctgtatctacgtatatgct

SEQ ID NO: 10029 - DNA, 622 bp, Zea mays
  Clone ID: LIB3279-202-Q1-K6-A7
cggacgcgtgggtccaaacctccaaaggagagaaggccaaactgaaagtgaaagtgcgtctcaacatccatgggaccgttacagttgattcagcaataatgctggaggatgatgtggaagttccagtttcatctgcaaatgaagctccaaatgatactatgaagatggacacagatgatgcaccaagtgatcctgctgttgcatctgatgtgaatatgcaggagcctaaaagcgctgataccgctgaggctgctcatgcagctgaaaatggaccacaagatactgaggaaaaatctgttccgatggaaactgatgcaaaggttgagccgtcaaaaaagaaagttaagaaaattactgttccggtccatgagttggtctatggggccttggctgcggctgacctgcagaaggctgtagagaaagagtatgagatggctcttcaagacagagtaatggaagaaacaaaggagaagaagaatgctgttgaagcttatgtgtatgacatgcgtaacaagctatatgacaagtacagtgattttgtcacgtctgaggacaaggaaggtttgattgctaagcttcaggaggttgaagactggctctatgaagatggcgaggatgaaac

SEQ ID NO: 10030 - DNA, 661 bp, Zea mays
  Clone ID: LIB3279-202-Q1-K6-A8
cccacgcgtccgccctgaggagatcccgtggggttcggttggtgctgaatatgttgttgagtctactggtgttttcactgaccaggagaaggctgcagctcacttgaagggtggtgccaagaaggttgtcatctctgctcctagcaaggatgcccccatgtttgtcgttggtgtcaacgagaaggagtacaagtctgacattaacattgtctccaatgctagctgcacaaccaactgccttgctcctcttgctaaggtcatcaatgacaagttcggtatcgttgagggtctgatgaccactgtccatgccatcactgctacccagaagactgttgatgggccctcgtctaaggactggaggggtggaagggctgctagtttcaacatcattcccagcagcactggagctgctaaggctgttggcaaagtgcttcctgtccttaacggaaagttgactggaatgtctttccgtgtcccaaccgtcgatgtttctgttgttgatttgactgttaggcttgagaagtcagcaacctatgatgagatcaaggctgcggtcaaggccgaggcagaaggtagcctcaaaggcatcctgggttacgttgaggaggaccttgtttccaccgatttccagggtgacagcaggtctagcatctttgatgct

SEQ ID NO: 10031 - DNA, 612 bp, Zea mays
  Clone ID: LIB3279-202-Q1-K6-A9
atttcgccgagaggcgagagaactgcttcgcacctacgttactgctgaagatccagccggcacaccatcggcgaagaagaggccggagagaggatgatactggccgtgctcttcgccaactccgatggaaacatccttgtcgagcgattccatggggttcccgcggaggagaggctccactggcgctccttcctggtgaagctcgggtccgagaacctcaaagggtccaagaacgaggagctccacgttgcctcccacaagtctgtgtctattgtttataccacggtcggggatgtctgcctctacattgttggcaaggatgaatatgatgagcttgctttggctgaggtgatctttgcaattacatcagcagtcaaggatgtttgtgcgaaacctcctaccgagcgcctcttccttgacaaatacgggaggatctgcttgtgccttgatgagattgtttggaaggggttgcttgaaaacacggagaaagacagagtgaggaggttgattagactaaagccccctgtggagccataatttgcatgtaaagcttatgttggcgttgctggaatccaaatccaatcccatttggatttgtaggcaaattttcag

SEQ ID NO: 10032 - DNA, 460 bp, Zea mays
  unsure (1)..(460): unsure at all n locations; Clone ID: LIB3279-202-Q1-K6-B10
cccacgcgtccgcccacgcgtccgcccacgcgtccgggagaacttcgatttcaggcctggcatgatcatcatcaaccttgacctcaagaaaggcggcaacgggcgctacctcaagacggcggcctacggccactttggaagggacgaccctgacttcacctgggaggtggtgaagccactcaagtcggagaaaccttctgcctaaggcggccttttttttcagtaagaagcttttggtggtctgctgtgcttaatcatgcttttatatggcttctacatgttgtggttctttcttgatctgcaccgcgcttatcgtttgtgttgtactgccctaataagtggtgcttatgaggactgtttctggttttgctgcttatgttgtaatgctttgaaacaatgaaagaagctacaggccacagctattttgagaagtaatggaacctcgtgccgttttngttna

SEQ ID NO: 10033 - DNA, 653 bp, Zea mays
  Clone ID: LIB3279-202-Q1-K6-B11
ccgcagccgcagccgctgcttttcgttcgtcttcatcctacgcgagggcgaaacccacaaaccctctccctcccgtactccggcctacacatccaggggcgatgacgctgggtagctccggcgccggatcgagcgtcgtcgttccccgaaacttcaggctattagaggagctcgagcgtggagagaagggcattggtgatggaacagtgagctatggaatggatgatgccgatgacatctacatgcggtcatggactggtaccatcattggccctcacaatactgtacatgagggtcgcatctaccagctgaagttgttttgtgacaaggactatccggagaagccaccatctgtcagattccactcaagaatcaacatgacatgcgttaatcacgagacaggaatggttgatccaaggaagtttggtttgctagcgaactggcagcgggactacacgatggagaacatcctcacccagctcaagaaagagatggctgcctcgcagaatcgaaagttagtgcagcctccagaagggacattcttctaacgaagtgttcacttggcccgtcatgggatccaacagtaattgaaagttttatgggctaaaaaacagcgtctacatctggtgcccctacctgtctttgtgattttt

SEQ ID NO: 10034 - DNA, 647 bp, Zea mays
  Clone ID: LIB3279-202-Q1-K6-B12
gttccacaggggttgtatgtatggtgaaaaattagacaacatcattgctttaacatttatagggggtacatttgagttgagccccctaatctcaatgtagcttgcactgatcacaacttcaatcttcttttatatctaacgacagcaagctacctgatgtagggaaacagttaacatcaataattgtggcctagtgaacaatttctcttttactttgacatttttgtgataattgtgtcatcagtgtgaatgtcacacactctttttgggagataaatgattaccgtcaagtcaagtttataccagccgatttacttattgtggaatggattcttaaatacggactatccttcttatttcaccaggagcttcctgagcggcttcttctgacatacaaaccagaagaagaagttcgtgataccgttccaattgtagcggagaaactgcaagttgttgaagaaattgctccagttccttcttcccaaatagctttgcctcccaagcctgagattgcagatactggtgatttactggggttaggtgattcaacccctactgtgttggcgatagaggagagcagtgctttggccttggcaattcttccgacaggtattgataactcaacaacaactacacagcaagatagt

SEQ ID NO: 10035 - DNA, 573 bp, Zea mays
  Clone ID: LIB3279-202-Q1-K6-B2
cgcctccaccctcctcgccgcctcactccctctgaggtcgcagatccgtccggttagacgaagccgcccgcacccatggcctccggtgagctcgcctgcacctacgccgccctcatcctcagcgacgacggcatcgccatcaccgccgagaagatcgccaccatcgtgaaggcggccaacatcaagctcgagtcctactggccggcgcttttcgctaagctcctggagaagcgcagcgttgaggatctaatcctctccgttggatctggtggtggcgctgctccagttgctgcttccgccccagctgggggtgctgcagctgctgctgcccctgctgcagaggagaagaaggaagagcccaaggaggagtctgatgacgacatgggcttcagcctgttcgactgagagtctgagaccctcgctacccagccattagcaaattcgcttatgctgtccaagacttatcttacgttatgtctgtaggcttttgttattacaagtactcaagttttgagtttttgagatgtggctatgacaatgtgatgaagaatcctaaaccatcgtattagagtg

SEQ ID NO: 10036 - DNA, 657 bp, Zea mays
  Clone ID: LIB3279-202-Q1-K6-B3
cggacgcgtggggggcggtgatgggcaccggcgcggcgtccacgaacaccaccgactcctcgggcggcggcgttgagttctggcgcgccccggagcgcgtgggttggctgaccaagcaaggcgagtatatcaagacatggcggcggcggtggttcgtgctcaagcaggggcggctcttctggttcaaggaatcgaccgtcacgcgcgcttccgtgccccgcggtgtcatccctgtcgcctcctgcctcaccgtcaagggcgccgaggacgtcctcaaccgaccctacgccttcgagctctccacgccgcgcgagaccatgtacttcattgctgacaccgagaaggagaaggaggagtggatcaactccatcgggcgctccatcgtccagcactcccgctccgtcaccgacgccgaggtcgtcgactacgacagccgccctggcgacaaatgattgatttgtgagccggtcacacctgttactctgcagcgtctctatgctactttatctctgcagcgtctctatgataattagtgcctgtttggtttgtgctaattatgtcatgctttgcctaatgttagtcgtttcaattaaataactaaccttagacagaaaagttagtcaaagtgtggtaagctaggacatgtttggtttgatg

SEQ ID NO: 10037 - DNA, 438 bp, Zea mays
  Clone ID: LIB3279-202-Q1-K6-B4
gttagacacccttggggaggagtcatacaaagatagcactctgatcatgcagctccttagggacaacttgaccctttggacctctgacctcacggaggatggtgctgatgagggcaaagaagccccgaaaggtgaggctggtgacggacagtaatcttgggagagcgcatattgttcgagcccattgttttagatgctctatgctgtcgaagctgaagctgtgccgtgctattattgtagctgatttcctgttccctcacttctttttttatattagtaggctggtagtgttcgaattagttccccattgctttgtgttgccgctagttggcattaagtccgtgtggactggtattattcactggatttgagaagcatgtcagtggttgctctagcgttttattgagttttgaagtcatctccctcaatttcggtttc

SEQ ID NO: 10038 - DNA, 630 bp, Zea mays
  unsure (1)..(630): unsure at all n locations; Clone ID: LIB3279-202-Q1-K6-B5
attcatatagccaatgtatttctcttgagctgccttgtgtgccatagaacccgcatgtttcaaaagtgatttgcttcctatattccaatttctccatccacccacagtaaatgcatctgtgcccttgcccttacttttcttatttttgaataaatagcacacaaaacaaaagactgcatcattcttgatactatattcaacccaaggaaaattatggaaccacacaaaattaaagttgcggtctctatctccaatttttctttttggaaattcatgtccatatggttgcaaaggacctttcagaacatatgctcttcgaattgcatcatgatcattaacatgataatttgagatgggttgtctttcacctggatcatgtggaagacgattgatatcataaaccggtggtgctgatgattgcgatgctggtggtggtgaagaagaaggcatatgattatgattttcttcgatcactccttcttcctcctgttcattactaggttgcccttgatttactgccggagttgaagaaggatatgtcggggaggtagcaagcttctttgcttcatgttttcgaaaaagtgaagcaatatctccacccctcttcatgttcaaatntcaatcgctgca

SEQ ID NO: 10039 - DNA, 566 bp, Zea mays
  Clone ID: LIB3279-202-Q1-K6-B7
atttcctctcccgataagagtgaggcctcggctaagcttgagcttcccctccctcccctccagcgctccagctcccctccatcctcggccaaaaattctgcggcgagctccgatccggtccgactactaacccacgccgcagaagccgcgcgacctgatcgcgcgggggtcgaggagaggggaagcgcggcgccgcggttgcctgccaccgtaccgccgcaggagaaggaagaggagcccgtatccctccgccccgctgcccgccggaccgatggactccgagcactggatctcgcgcctggccgccgcgaagcgcttctacgcggcgcagctcggccacagcgatcgggccgggatggacgagctggagatggacgaggaggtcaggcccgagttcccctgcccctactgctacgaggaccacgacgtcggatccctctgcgcgcacctggaggaggagcacccgttcgaaccccaagccgcggcctgccctgtctgctcagagatggttacgaaggatatggttaaccatattactacgcaacatggatatttattcaagaatc

SEQ ID NO: 10040 - DNA, 449 bp, Zea mays
  Clone ID: LIB3279-202-Q1-K6-B8
caaatcaccatgtttcgccttccatgtgtagaattgataagtaacatgataatgaatgtcaaattattacagcaaaacaactatattgtccctgcatcatctccaaaaaactcaaactctatgatttcttcgttttcgctaacatactaattgatttatactcttcacactaatttagattattgaccaagagaactagctatcaccatttctaaatccactattttttactttgaaaactcaatgctaaaaggagatcaacagagacgacatctatgacaacttatgtgttctcctgcagatgtaatacatgctcacgttcggcacccaaatgcccgtagaccgtggtcaacgtaccccatctacaccatgatcagagataacatgcaaaacaatatttctttccctttcattgagacaataagctaaacaaaattgccttcacttcg

SEQ ID NO: 10041 - DNA, 349 bp, Zea mays
  Clone ID: LIB3279-202-Q1-K6-B9
gggctcaacagcagcctgccactgccgccactggctttctgagtagccggagccaaacacaaaggagggtaggaatagctgtggtgactcggaagagaaagagacagtcgacgccttgttttgttgatgcttagtgtggtgacctggtggtggtggtggtgggtgttcttggcacaagttacatgctggggatagctataggaggtacctgttgaggtgtgtaagacagtagctagcaaccgtatgccttggtttcctgtttgggtgcgtgacttgccgactttctagctgcttctggggttttgacctcggtaaggaaagaataaaaagataatcggagtgcaatgaa

SEQ ID NO: 10042 - DNA, 648 bp, Zea mays
  Clone ID: LIB3279-202-Q1-K6-C10
ctcatctggaaccccggcttcgacttcgacgacaaaatcctcggcttcatcaagggctacaagcgcacctttaatctcgcttgcattgaccacagaggcacaccggagcatccggcgaggacctgcacgcttgaaaccgacgacgaggccatatgctggggaattgcatattgtgtcaagggtggtccagaaaaagagctaaaagcaatacagtacttggagagaagagagtgtgagtacgaccagaaaatatccattgatttctacaaggaaggagatcccttgaaaccagctgtgacgggcgtcttagtgttcgtttccactccagatccaattggcaacaagtactatcttggccctgctcctctgcaggatatggcaaggcaaattgctacagccaatggccctactggctataatagggattacctgttctcaatggagaaggcattagccagcattagccacgaagatgattcgatcatagagcttgcaaacgaggtgaggaaggtgctcaacagaacaaaggagaccaagatcactggtgccaatgcttccctgaatcacatgcccctcttgtgcacctgtccgcgcttccagaaagcaccgttgtggactcgagatagcgagagccttggacgttggacc

SEQ ID NO: 10043 - DNA, 386 bp, Zea mays
  Clone ID: LIB3279-202-Q1-K6-C11
tcttaattgcatgctagaaggaaatcgcatttcttgctgttcgttcaagttaataaggatatgattggtctccagcgggatatggctatggtctccaaagggatgtggtcatgttgtagttagttgcgatgcacggaaggtatcacttttgttaacctagttggtgttgtattaacaacccccttttgctgataatcttgggcaggaatgccaatcaacaatcatgattcatgtacatgattgctgactgatcacttttttttcacgagatggtcagtagttattgttgtagttgtctttaggattacttacagaaaccgaatttgggcagaactggattcaatcggccatgctgctatgccagttttcattctagattgggcact

SEQ ID NO: 10044 - DNA, 642 bp, Zea mays
  unsure (1)..(642): unsure at all n locations; Clone ID: LIB3279-202-Q1-K6-C3
cccacgcgtccgcccacgcgtccggctgtgcttggtagcagcgatggtgtcaagggcaccatctttttcacccaagagggagatggccctaccgctgtcaccggaagtgtctctggcctcaagcctggcctccatgggttccatgtacatgcacttggtgacaccaccaatggatgcatgtgaactggaccacactacaatcctgcgagcaaggagcatggggcaccagaagatgagaaccgccatgctggtgatcttggaaacgtgacagctggagcagatggtgttgctaatatcaatgtcaccgacagccagatcccactgactgggccaaactcaatcattggcagagctgttgttgttcacgctgatcctgatgatcttggaaagggtgggcacgagctcagcaagagcactggaaacgccggtggccgtgttgcttgtgggatcattggactccagggctgaaaacgatcgccggacttgggggtgcctgagaggtccgtctcctgccgtccccagcagacgagcctgaacattcggagacatcgtgaaataagagcgtcgctgatctgngatcatcgtatttgtcattatgcacctgtagcaaccgatggactgaactgtgctggattatgctgt

SEQ ID NO: 10045 - DNA, 593 bp, Zea mays
  Clone ID: LIB3279-202-Q1-K6-C4
cccacgcgtccgcccacgcgtccgcagaaagtgcagattgtaggagatgatcttctcgttaccaaccccaccagggtcgccaaggccatcaatgagaagacctgcaatgctctcctcttgaaggtgaaccaaatcgggtctgtgaccgagagtatcgaagctgtcaggatgtccaagcgcgccggatggggagtgatggcaagccacaggagtggcgagacagaggacaccttcattgctgacctctcagttggcctgtctacgggccaaatcaagacgggagctccttgccggtctgagcgcctggccaaatacaaccagctgctcaggatcgaggaagagctcggtgatgccgcggtctacgccggagcaaagttcagggcaccagtggagccctactaagaaaggaagaggatggggatgttttcttgtggagctatactagctcgctgctgccttttgttacaatgtttgtacggtcgcaataaatgtatggtcgtgtttgctcgagagctactcaggtgattttgtcgtgggagcaccaaaagcagaaaagaactttttttttttcaatctctctagattctgacgag

SEQ ID NO: 10046 - DNA, 611 bp, Zea mays
  Clone ID: LIB3279-202-Q1-K6-C5
gctcctcctcgcgattccaatccacgcacgccatctccgactccgcgtccgcctcgcgcaggacatatattcagtgatggaacacaaggaggccggctgccagcagccggagggcccaatcctatgcatcaataactgtggtttctttggaagcgctgccaccatgaacatgtgctccaagtgccacaaggagatgataatgaagcaggagcaggcccagttggctgcctcctccatcgatagcattgtcaatggcggtgataatgggaaaggacctgcaattgctgcaactgtaggtgtggcagttcctcaagtcgaggagaagactatcgtcgtgcagcctatgcatgtcgctgaaaccagcgaggctgctgctgttatcgcgaaggccaaggaaggcccaaaccggtgcgcaacctgtaggaagcgtgttgggttgacgggttttaactgccgatgcgggaacacgtactgttcgatgcaccgctactccgacaaacacgactgccagttcgactatcgaactgcagctagggacgctatcgccaaggccaatccagtggtgaaggcggagaagcttgacaagatctgaggcgggggcattgggtaac

SEQ ID NO: 10047 - DNA, 315 bp, Zea mays
  Clone ID: LIB3279-202-Q1-K6-C7
gcagattagagaatcgatactgagccgcagcagagggcatccctgcagcaccgagctggaggagaaccccgcggatggagacccatagcatacagtatgacgacgaaagcgagctgtatataagtagagaaggctagaagctagctggctgtcttttaagttgctggtggctgctgagatgattttggaaattaggtagctgctaggaactgaccaactctctatatctgctatacatgtataagctacggcagacatatatatctgggatgatggcccacttgctgggttgtgtaaagtcgagacgtttaactg

SEQ ID NO: 10048 - DNA, 478 bp, Zea mays
  Clone ID: LIB3279-202-Q1-K6-C8
cccacgcgtccggcgactgtatgaattgaataggttgtttcctagcttgtcttgaggaaggcaatatggaactagaaaacttcaactgactctcgaataaggcagcatacttataagaagtgatgcagacaacaaaccggatcactaggaagccagtgtcaagttaatccacattggtgattcagtttgagtagtgaaaatataccgctaccaactctcaatatcctgaagttcaggaggtctcatcaatggatgcactgtattacatccatgtcgaactcattctgtgtcaactatgtttggtctttccttgggagatatcttgatgcaagcataagtgacattcatggaaatgctgacttaatagtaagtcatctgtaccactgtaccattagccatctcagtctgagttcagatttgtatcttggtgttactcatgaacacaaaaggcatgtattataagaaagattgttcattc

SEQ ID NO: 10049 - DNA, 651 bp, Zea mays
  Clone ID: LIB3279-202-Q1-K6-C9
ctcaattaaagtcagcagaggatgatcttggtttcaagctccctatgcccacaaagctgttgtatcgcttttgcaatgctcaactgccttttagtgaggaccatgacacaaataaaagcatttccactcatggattgattgggggctatgcgttttatgatcattgggtgaatgtgcatttgtcaccgcttgagcaaatagttgaagagacgaaggacttctatcgggagttccctgatgtatttcatgggcgcaaattcattgtagtggcaacttcatggtttcatccgaaaacatttcttctagattgctcaaatggtgaactttatgttggtacatacaacttaccgataggaggaatgcttccctgtgtgcccaaagcattgataaagccagcaggtaatgatctagcacaagatggactacttctgtggttagaagaacaccttaggcgtttacagagtggcatgatcaagacccgtatgctgatggcatcgagatatatcagcttatatccagaagcacctccatcatgcagttcagctgttacaaatggcattaaggtacgctcatctgctgtctttgtgccagaacatcctgggaggcctggggaaaaatttatgttcacttactcaattcgcatgtcagttc

SEQ ID NO: 10050 - DNA, 618 bp, Zea mays
  Clone ID: LIB3279-202-Q1-K6-D1
gcgacgccgaggtcgcgctcatcatcttctccaccaagggcaagctctacgagtactctaccgattcatgtatggacaaaattcttgaacggtatgagcgctactcctatgcagaaaaggttctcatttccgcagaatatgaaactcagggcaattggtgccatgaatatagaaaactaaaggcgaaggtcgagacaatacagaaatgtcaaaagcacctcatgggagaggatcttgaaactttgaatctcaaagagcttcagcaactagagcagcagctggagagttcactgaaacatatcagaacaaggaagagccagcttatggtcgagtcaatttcagcgctccaacggaaggagaagtcactgcaggaggagaacaaggttctgcagaaggagctcgcggagaagcagaaagaccagcggcagcaagtgcaacgggaccgaactcaacagcagaccagttcgtcttccacgtccttcatgttaagggaagctgccccaacaacaaatgtcagcatcttccctgtggcagcaggcgggagggtggtggaaggggcagcagcgcagccgcaggctcgcgttggactgccaccatggatgcttagccatctgagct

SEQ ID NO: 10051 - DNA, 627 bp, Zea mays
  Clone ID: LIB3279-202-Q1-K6-D10
cccacgcgtccgcccacgcgtccgccgcaaaaccctcctccatgcaccgccggccgccgccgcggcggtcccctctcggatctcttccctcctccgcctcatcccctctgcatctttttctgaggtaagcggaggtggggaagaatggggcgcctcctcacccggaggcggcggcggcaggggtgggggtgggaacgaatggagctccacctggtctaccggcctcaccaaggaccatttcgacggatcctcgccctccgtcggtcgttctgtcccttccgagtcagcgcccgtctcccgtgagcgggtggccattcgcgctatggatgagtgggacgagagggtccgggaactggagcgtaacaatgtcgaggcgaaggcgtatgtggattcatgggacgaccggatgcgggagacctgtgcgctgctgaagcaggtgcgggagccgggcgctcggggctcttatctcaaggactcggagaagcaggagatgtaccggctgcacaaggaggaccccgcgacttacaccgtggagcggctcggcaaggaccttcgtgtcatgcgacagcgcgtgcacgccatcctctggctaaaggagatggaagaggaagaggagaggaagagggg

SEQ ID NO: 10052 - DNA, 654 bp, Zea mays
  Clone ID: LIB3279-202-Q1-K6-D11
catgaccccatttcatttctctacctctccagctgcccacttctctgtgagcgcgcgcgagtgtggagagaagggagggaattcccccctttctgttcggcgcacgcacccgcacgccccacgctgcacagtgcacgccgccttttcctccgccttgctgctgcgagtccgcaaccactggaggaaaaatcttttccttcacttttcttccctttccccccgcgcatgcacgggctctgattgacgccatgggggacgccgcggcctccacgtccgctcccaccacgcccacctccatcctcatctgcctggaagacggcagcgaccttctcgccgatgccgacgatggcgccggcactgacctcgttgtcgcccgcgacgaacgtctgcttgtcgtggaccaggacgaggagtatgtagcgctgctcctgtccaaggagagcgcgtcaggcggcggcggcccggtggaggaaatggaggactggatgaaggccgcgcgctccggatgcgtccgctggatcatcaagaccacggcgatgttccggttcggcgggaagaccgcttacgtcgcggtgaattacctcgatcgcttcctggcgcaacggcgagtcaatagggagcatgcgtggggtctgcagctgctcatggtggcgt

SEQ ID NO: 10053 - DNA, 640 bp, Zea mays
  Clone ID: LIB3279-202-Q1-K6-D12
ggcctcccgactccaagccaagtggagtccatggagccacaccggacaccctatccggtccggagcagcaaagcatacgggctcgagcgctccctccagagctccccgcctgccgacccgtactcacccttctcggtcgactcccgactaggctcgggtcccgtccggagccaccacgtgcgatctaccataccctgttcctgagaatcttcgcacgtgggtatggggtgaccagatcggcgctctccagctgaattctggtcgcggctcgtctaggatgcagacgatatggctagcgccggcgtggcggactgctcatggagtgctggcgatgcttaggtcaaggaactctggcatgcttgtgctgagccgttggtcacagagcctcaccaaggcgagctggttcactactccaccacagggtgcatatggaacagatcgaagcatctacagatcaacaactcgatcagtactgacctttgacagagctaccagacaagattctctgcaaggtggtcaatgtagaacttagagctgaaactgatcctgatgaagtttatgctcaaatcatgctgcaaccagaagcagatcaaagtgagcccaccaggccaaaatctgagccaccggagcctgacagatg

SEQ ID NO: 10054 - DNA, 559 bp, Zea mays
  unsure (1)..(559): unsure at all n locations; Clone ID: LIB3279-202-Q1-K6-D2
ctgatgtagagacattctgcgatatttgtcctgatgtgactgtttcctttcaacaacagatagttgggcccttcagttttcgtgttgaatcctctgtagccattgaccccagaagccagaaccattttgttcgagtggatgatccgatcttcgcaattgattgggctctcaaagtcctgggttcagcaaaggccacagcgtggtattcacccaagcatcaggaggccatgatggagctccggttctacgaaacctgaagctgttcatcgtgaacgttgtataaaataatgcctggacttcatgatcgcctatggtcgctgatttcactaggatcagattgtatgaatggctgacgccgtgatggtcaaatgaatcaacccccgtgtaatatctattcatatcctgctttaccggtttgagtcatcagttttttttttgcttcaggtgatgtagcttgtgctgttctcggcgttaacagaggaagttaatactgtttgtctttagtgaacttgctaggtgaaccagtctgagtttctgattgccttttgtcagtgtncca

SEQ ID NO: 10055 - DNA, 531 bp, Zea mays
  Clone ID: LIB3279-202-Q1-K6-D3
atgagggtgtggtcactcgttggggtgtcacccgccttccccgcaaaacccacaggggtctccgcaaggttgcttgtatcggtgcatggcatccggctagggtctcgtatacggttgcccgtgctggtcagaatgggtaccaccaccgcactgagatgaacaagaaggtctacaagatcggcaaggctggacaagagacccacgatgcctccacagagtttgacaggaccgagaaggacatcactcccatgggtggcttcccccactatggtatcgtgaagggtgactacctgatgatcaagggatgctgtgtgggtccaaagaagagggtggtgaccctccgccagtccctcctgaagcagacttcccggctggcgctggaggagatcaagctcaagttcatcgacacatcgtccaaatttgggcacggtcgcttccagactaccgatgagaagcagaggttctttggtaagctcaaggcgtaaggtgctgcggtgcagcgaaagtcccatttgtcaaaatcatcaaact

SEQ ID NO: 10056 - DNA, 647 bp, Zea mays
  unsure (1)..(647): unsure at all n locations; Clone ID: LIB3279-202-Q1-K6-D4
cccacgcgtccggaccaagagccgatggatccgaagatgacagaggtgacccagatgttcgcccgcttcaaggcggcctacacccgcaacgacctcgacgcctgcgtcaccctcctctcacagctcaaggtccatctcaccaaattccccagccttccgccctcatttgagcagacacctaaagccgtggaggagctcaaacttgcaagggacatttatgagcatgctgttgttttgagtgtgaaacttgaggaccaagatgcatttgaacgtgatttctgtcagctaaagccttattacatggatacatgtggcataattcccccctcaccagaggagtacccaattttgggactcaatcttctgaggctgttggttcagaatagaattgctgagttccatactgagctggagcttttacctgtcaaggcacttgagcacccttgcatcaagcatgctgtagagcttgagcaatccttcatggagggtgcctacaaccgagtgttaagcgctcggcaagctgtgccacatgagacctatgtttacttcatggaccttctcgccaagacagttagagatgagatcgctgggtgcagcgaanaggggtatgattccctatctgtaagtgatgcaaaacaaatgcttat

SEQ ID NO: 10057 - DNA, 638 bp, Zea mays
  Clone ID: LIB3279-202-Q1-K6-D5
cccacgcgtccgcgtccccgtcccgacgaattggaataggagaagcaaaagatgatggatctcgccgacagccagcaacagcggctcatcgccggcgcggctctgctggtcgccaccgtcgccttcctcaggctcctcctgagctcccgctccgggggcaagcgcctgccgcccaccatcccgggggcgccggtggtcggcggcctcgtcaagttcatgcgcgggcctatcccgatgatccgggagcagtacgcccgcctcggcagcgtcttcaccgtccccatcatcagccgcaagatcacgttcctcgtcgggcccgaggtgtccgcgcacttcttcaagggcaacgaggccgagatgagccagcaggaggtgtacaggttcaacgtgcccaccttcggccccggggtcgtctttgacgtcgactactccatcaggcaggagcagttcaggttcttcaccgaggcgctccgggccaataagctgcgcagctatgtcgaccagatggttgttgaggctgaggagtacttctcaaagtggggagaaagtggcactgttgatttgaagtacgagttggagcacctcatcatactgacagctagccggtgcttgctgggaagggaggtgcgagaaaagct

SEQ ID NO: 10058 - DNA, 624 bp, Zea mays
  Clone ID: LIB3279-202-Q1-K6-D6
cccacgcgtccgtcagaacgtagccattctcgacatcctaagaaatgcaggttcaagggatgttccaaaggtgcaagaggcgcatcaggattgtgtattgcccatggaggtgggcagagatgtcataaacctggatgccataaaggagccgagagcagctctgcatactgcaaagcccacggtggcggtcgtcggtgtgaggaacttggttgtaccaaaagcgcagaaggaaaaacagattattgcattgctcatggtggaggccgccgctgcgaacatcctggctgtcctaaagctgcccggggtaagtctgggcggtgcatcaagcatggtggtgggaagaggtgtttggttaaaggttgcattcggagtgcggaggggaaggctggattgtgcatttctcatggcggtggccgacggtgccagtatccagattgtggcaagggggcacagggcagcacattgtactgcaagggacatggtggtggcaagaggtgcgtcttcgatggttgcagcaaaggcgcagagggtagcacacctctgtgcaaagcacatggtggcgggaagcggtgcatgtttgaaggagggggtgtctgtgcaaaaagtgtgcacggggctactgaa

SEQ ID NO: 10059 - DNA, 291 bp, Zea mays
  Clone ID: LIB3279-202-Q1-K6-D7
ccatttggcagtgcccaacttctgtaggctacgtagttacaagagcaaatttgtgcttcagcagatgcgattttttcggtgattatatcgtgcattgtgctcggccattctttcatgcgatgcgtgtattatgaattggcttcaccacacggggagctatggcttgacccaacccttgttgtaaagaaattagcgacttgtgtaacatcgaatgtatgtcaataaacagtaggcaatgttattataactataaacaaaagagcggtggtatgtaggaattctgtttatttc

SEQ ID NO: 10060 - DNA, 397 bp, Zea mays
  Clone ID: LIB3279-202-Q1-K6-D8
cccacgcgtccgcggacgcgtgggcggcggcggcggagagaagatgatctacgacgtgaactcccccctcttccgttccttcctcagccagaagggcggcgccgacaagaggaaaatggaggagcataaaccaaaggagcagaggcccaaggccaacgagaacaagcctgtgatgaacgaatgagtatctccagaagctttgttcaatgtgcaaccaagtccgatgtccgtttgctctggttagcttaaaaccaacgcttccaataatcctattggtgtcttagtttccccttatagtgttatttgctcggcttgaacatggcaaacggaaatgaaacttgaactacctatggtactgtcatcaatttgagacccccatgattgacaacttttgtgc

SEQ ID NO: 10061 - DNA, 633 bp, Zea mays
  Clone ID: LIB3279-202-Q1-K6-D9
gagaaataaagcaagtttctgacggggacgaaagaagtggctcttccctaagggcagaaaacctgaagggcatgcttagtgacatatcaaatgctgaatctgagtcggatgttgatgacgttggtttaacagttgtccaaaagagtacggaccacagtttactaaccccagttcatgaagaagtcaaggggtcagatacttcgatattttgtagttctagcagtaagcatctcctagatacaactcctggatctcctcaggccacccctcaaatggagatgcccattcagttgacttgccgtaaatattttcctacctttgggtggctaaataatttagggaatgcttacattagtttgcatggtacatccgctggaaggactctggaaaaccttgctactggactgatcacgctcttgatcaggatatcatctttcttccacctttccgtctaccggcaagaaagatatctagaaaccgtccaaccctgtgccgcagcacaggaaccagaacctcaaagggaagaggacatgagtgcttgtttacgacgcctcaagaagctcgagtcactgtgtgatcacctcatgagcaaacctccggatatgccgaaggagaaagaacttgtattgatgc

SEQ ID NO: 10062 - DNA, 644 bp, Zea mays
  Clone ID: LIB3279-202-Q1-K6-E10
gcgccatcggcacgaccaggcctgtccagggatggggcggagaggggagccctactacgtcgaagcggcgccgccggtggacgtgaacaagaacacagagtggttcatgtacccgggcgtctggaccacctacatcctcctgctcttcttcgcttggctcctcgtcctctccgtctctggttgctcccccggagcagcctggaccgtcgtaaacctcgcgcacttcgccatcacttaccacttcttccattggaagaaaggaaccccttttgctgctgatgaccaaggcatctacagcagattgacatggtgggagcaaattgacaatggtcagcagcttactcggaacagaaagtttttgactgtggtacctgtggtgctgtatctgatcgcatcgcacttgactgactacaagcagccgatgtttttcctcaatacaatggcagtttttgtgctagttgtggcaaaattgccaaacatgcacaaggtccgcatatttggaatcaatggagacatctgaggaccactgcaggaagtacatggatgcaatgccatgatgtgatgaagagctaaacagaacaagcagtgtgtttctcaaacttgacacaactgtctgtaatatatgtacaggtttaggaagaact

SEQ ID NO: 10063 - DNA, 647 bp, Zea mays
  Clone ID: LIB3279-202-Q1-K6-E11
gccggctcggcccttgacccatgagtagcctgatccgcttgctcttcaccctcgccgcggccatcggcgccgcctcgctcctcgtcgcctcactccgccgccgcgcgccgcctcccgggcttcccgccaagctcgtcccctcctcccacatggcaggacgcaaccggagtttcgtgctgtggctgcacggcctcggcgactcaggcccggccaacgagcccatccgcaacctcttctccgccccgcagttccggctcgccaagtggtcgttcccctccgctccccgcgcccccgtatcatgcaacaatggttttgtcatgccgtcgtggttcgatatccacgagcttcccatgagcgctggctctccgcaagatgagactggggttctcaaggctgtggaaaaggtgcacgccatgatagacagggaagtagccgatggcatccaccctgagaacatatttgtttgtggattcagtcaaggaggtgctctgacattagctagcgttttgctttatcccaagaagttaggtggaggagcagtgttcagtgggtgggtgcctttcagttcatcagtcactgagaggatttcacctgaagcgaggaagaccccgtttctttggtcacatggaatggctgacaaagtagta

SEQ ID NO: 10064 - DNA, 654 bp, Zea mays
  Clone ID: LIB3279-202-Q1-K6-E2
tgctgcttcaaccaagttacttgttgatatcctccttagtgagtgggaggacaggatgactcgaggcttattccgctacgatgtcactgcctgtgagaccaaggtcattcctggcaaccttgggtttgttgcacaactcaatgaagggcgccaccttaagaagcgccctactgagtttcgtgtggaccgtgtgctccagccgtttgaccctgccaagttcaatttcacaaaagttggccaggaagaggttctcttccaatttgagaatagtggtggtgatgacagctatttcctgaacaacgctccaatcattgctgttgatcgggctccaaatgttattgctatcaatgtaagcccaattgaatatggacatgtgcttctcattcctcgtgttctggaccgcctgcctcagaggattgatccagagagcttcttgcttgcactgcaaatggcagccgagggaggtagcccatacttcaggcttggttacaatagcttgggtgcgtttgccaccatcaatcacctccactttcaggcgtactacttgtcagtgcctttccctgttgagaaggcagctacccacaagatcccactctctgaggacacgaagaagaatggggtgaccgtgtccaagctgataaattatcctgtgag

SEQ ID NO: 10065 - DNA, 621 bp, Zea mays
  Clone ID: LIB3279-202-Q1-K6-E3
gtggatttgtctagattcaaccaaccagtagttagcgagcagcagcagccgcaacaacaacaggcatggaagcaaaagtttatgggctcacagtcaatgtcttttgggggctcggtttcgcttaactcgcccactagcaaagatggttctgttgacaacaaagttggtcgtgatgtgcagaaccagtccctttttagccctcaagtcgactcttcctccctactgtacaatatggtacctaatcttacctcaaatgttgctgataataatatatcagcgtttccctctggatcaacatatctgcaaagtccaatgtatggttgtctggatgactcttctggtttattgcaaaatacaggagagaatgatccgacaactagaacttttgttaaggtttacaagtcaggatcagtggggagatccttggacatcacccggttctctaattatgctgaacttcgagaggaactgggtcagatgttcggcattaagggtcagttggacgaccctgatagatcaggctggcagcttgtatttgtcgacagggagaacgatgtgcttctccttggagacgacccgggggagtcatttgtgaatagtgtatggtacatcaagatactt

SEQ ID NO: 10066 - DNA, 378 bp, Zea mays
  unsure (1)..(378): unsure at all n locations; Clone ID: LIB3279-202-Q1-K6-E4
ggatgctactgcaaatgaggaggaagaaaaggaagaggacaaggagatgactctggaggaatttgagaaaataagagaggagaagaggaaagcactacttgcattgaaggctgaggagaggaaagttgaagttgacaaggatttgcagtctctgcagccactttcaaacaagaaagaaaatgatgaagttttcattaagnctggttagtttccctgtaattaatgctttgataccttaagtttgctgagctttgcacgggttcttcgatgttcttttgttctcttagggttctgacaaggataagaagaaggaaaatgctgagcgtgatgagcgtgccaagaagtcggtgagcatcaacgagttcctgaaacctgctg

SEQ ID NO: 10067 - DNA, 243 bp, Zea mays
  Clone ID: LIB3279-202-Q1-K6-E5
gctctgatgattatcacggactatgagtgctaacctacaaggtatctatgctagacaagatcattactctctacatagctcttcaactccaaatgatggttatcaacatgagccgtgtaggctgagcgacagtcatctgcactctagttgccgtcattgtataagaggactactgatagtggatatggcacgagacacatcggaaatgggaacgccttctactgcaagaacggatgatgaggc

SEQ ID NO: 10068 - DNA, 586 bp, Zea mays
  unsure (1)..(586): unsure at all n locations; Clone ID: LIB3279-202-Q1-K6-E6
agggagtcaacgggcatgcggaccggatccacctctcggtgagcacgggcggcggaggccaggacggctccggcctgcgcgtggcgttccagggcgcgccgggcgcctacagcgagttcgcggccaagacggcgctgcccggctgcgacacggtcccgtgccgcgccttcgcggacgcgctggctgccgtggagcgcggcggcgccgaccgcgccatcctccccgtggagtccaccatggaggggacggcgctgcgcaactacgacctgctcctgcggcacggcctggtggtggtgcaggagatcaacctgttcgtgcactactgcctgctggccatgcccggggtgcgcgccgccgaggtgcggcgggtgatcagccaccccatggcgctggcgcactgcgggcgcgcgctggcccgcctcggggtggaccgcgagcccgtggaggacacggcgggcgccgtggagatgctgcggtccaagcggatgctggacacagccgncatcgncagcccgcgcgccgncgacctgtacgggctccaggtcctcgcgcacgggctccaggacgagtcctggaacgtgacgcg

SEQ ID NO: 10069 - DNA, 473 bp, Zea mays
  Clone ID: LIB3279-202-Q1-K6-E7
cttgtcgggtcttcaagccacaccaaaccacactgcgacacacagtaggcgaggcgaaggagaggcaaggcggcgcggcgggcaagatgtttgacgatcaagacctgggcttctttgccaatttcctgggcatcttcatctttgtcttggttattgcgtaccacttcgtgatggcagacccgaagtacgaaggaaactgatgtcctctagtgcaaagatcctattatctgcaggccgaaatagggctatactgttagctaatgctagtgagatcgcttgacactttgagtgcatatcatggaagctggacatgcagttcctggcattttggttttgcccatgttttaatctgctgaattagtaaatcctggagaattcaaaagcgttttcaagtactgcagttggtggttgtttctggtcctagtgtatgcatgccagaatcttatgaataatattctttgttttgttgccca

SEQ ID NO: 10070 - DNA, 520 bp, Zea mays
  unsure (1)..(520): unsure at all n locations; Clone ID: LIB3279-202-Q1-K6-E8
gttcaccaaggagccgaacaacctctacaacatccactccttcaaacactcgggtttggcgaacaagaagactgtgacgatccagccagctgcaaaggactcggctgtggtcctctctactaccaagaccaagaagcagaacgcacctgcgaagctcagccacaagtctgtgatgcgcaaggagttccgcaagatggccaaggctgtgaaaaaccaggttagtgacaactactacaggcctgatctgaccaagccagctcttgctaggctaagctcggtgtaccgcagcctccaggttgccaagtccggtgtcaagaagaagaacaggcagtcctaagcgctaagtttgtgttctgtcagggggcatgttggtgctcgtagtcccagcttatatttatctatgttccaacagttgagacttgttagaactgagcaaaccatgttaagatgctgctgtgtgtcattccttaaaaaaattgccttgcacttaaaaaaaaaaaaaaaaaaaaaaaaannaaaa

SEQ ID NO: 10071 - DNA, 627 bp, Zea mays
  Clone ID: LIB3279-202-Q1-K6-E9
cctcgccccagcgacgcggcctcccgtagaccgagcaaggcaacccaccactgagaggcacgcagaggagcaggaagccggagaccaagatgtcgtcggtgttcagcggcgatgagacggcccccttcttcggtttcctcggcgccgccgccgccctcgtcttctcatgcatgggcgcagcgtacgggaccgcgaagagcggcgtcggcgtggcgtcgatgggtgtgatgcggccggagctcgtcatgaagtccatcgtgcccgtggtcatggctggtgtgctcggtatctacgggctcatcatcgccgtcatcatcagcactgggatcaaccccaaggccaagccctactacctttttgatggctacgctcacctttcgtccgggcttgcctgtggccttgctgggcttgcagctggcatggccatcggcattgttggtgatgctggagtcagggcgaatgcacaacagccgaagctttttgtgggcatgatcctcatcctcattttcgcagaagcgcttgctctgtacggtctcattgttggaattatcctttcatcccgtgctggtcaatcccgggcagattaagtgcactaccattctgcaattaccgtactggttattatgc

SEQ ID NO: 10072 - DNA, 668 bp, Zea mays
  Clone ID: LIB3279-202-Q1-K6-F1
cttgaagttgaagttgaaaaggccggcctgcgcggcgatggatgtcaagtgccggcgtctggaggggaaggtggccatcgtgacggcgtccacgatggggatcggcctcgccatcgccgagcgcctcggtctggagggcgccgccgtcgtcatctcctcccgcaagcagaagaacgtgaacgaggcggtggaggggctcagggccaagggtatcaccgcggttggtgccgtctgccacgtctccgacgcacagcagcgcaagagcctcatcgagacggccgtcaagagctttgggcacatagatattcttgtctccaatgctgccgcaaatccttctgtagatagcatacttgaaatgaaagagtctgttctcgataagttgtgggatattaacgtcaaggcttctatccttcttatccaggatgctgctcctcacctacggaaggggtcatctgtgattattatttcttcaattgctggttacaatccagaacaaggattgacaatgtatggtgtcacaaagactgctctctttggtctcacgaaggctcttgctggtgagatgggacccgatactcgtgttaactgtatagcccctggttttgttcctacacggtttgctagtttcctcacaggaaatgagaccattaggaaagagcttaacgaga

SEQ ID NO: 10073 - DNA, 652 bp, Zea mays
  Clone ID: LIB3279-202-Q1-K6-F10
tgattactacccagaaattgttaaagaagctgtcaatcttgccctagataaaggcaccaattttgttgatcctcttgttaggctactggagcatttgtacacaaagaaaattttcaagactcaagacctggaatccggttgcttgttatatggtactctgctggatgacattggcattgaccttcctaaagctccagcacaatttggtgagatcattgctcgcctgactttgttgggtgccttgagatttgaagctctggaggttattttaaagaaaatggaggatacctacaaccgcaaagcagtttctaatgctttcatgaaaaccttggaagcaaacccatcaggtcaggctatcttaggctcacctgctgctgctgcagtaatagacgcttgcaacagccttttggaataatcttcctagcagctttggcctatcaaccttttcagattctgtatcttgcgaaagacggtctcgtgtactctctatagtttaggtgtcaaggaattgaggaacagacaattttgagctgtataattttgcgagatcagatgagtgttgattgttattgtttcggccaagaaggaaagaaagaagccatgaattttggtcttgggcgaccagcttaatttgcaggagtcctagatgaac

SEQ ID NO: 10074 - DNA, 654 bp, Zea mays
  Clone ID: LIB3279-202-Q1-K6-F11
cccacgcgtccgagaagaatcacgacaactgatctaaccatacacaacaacattgtggatcattttcggcagcctattttcggtggccaaactctagctgccgaaaatatttttttttaaaaactgtcgggcccttcttctctattttttctcttctctcctgcctgcaccaacgcccgccgacgcgccgctcgccgctgccgtgcccgctcgcctgcgcgcaccgcccgctcgcgcgcgccgccgagccctcctacaaccactctgtcgttgtcgtcgagccgccgcatcaagagataatttttttgcgtattttattccttattttcggtggctgttatttagttgccgccgaaattagtatatattcgtaatgtgtttgtttgattactgtttatgattagtattattgtttagttcgatttcattaatgtattagtggtatatgtgatttaggattaggggcatattgtatttaggcattaatttcatattaatatgtggtatgtactattatattattagttttaatagtacattatattggtacgtagaatagttgcattattagtgtatgtggtacttagtttgatttgattaatattatatcattctttgttttatatataagtaatatattgtttagtggcagcg

SEQ ID NO: 10075 - DNA, 649 bp, Zea mays
  unsure (1)..(649): unsure at all n locations; Clone ID: LIB3279-202-Q1-K6-F12
gctcgagcaccgcagaaaaagaaaaagaaaaggcaaaggcaaaggaatcccaatcaggcaagcaaaaggaagaaccagctgctgcggagtgcggagatgtcgtcgcagctgatcgaggagcaccggtcgggcgcggaggtgcacgtcgggcacgagctgtgcgagcgcaagtcgcgcgagttcatggtggagctgggcctccccgacgggctcctcccgctgcccagcctggacgaggtgggctacaaccggtcgacggggttcgtgtggctgcggcaggccgccggcctgacccacaccttcgggtccatcggcaagcaggtgtggtacgacagggaggtgacggcgttcgtggagccggggcggatgcacggcctcgccggggtgaagagcaaggagctcctcatctgggtcaccatctccgagatcgtcctcagcccctccggcaccaagatcgtgttccgcacccccgcggggctcggccgcgccttccctgtcaccgccttccagctcgagcccgagggggaccacaaggccgaggacgccggcgccgncgncgncaactgatctggtctagcttccggcggcggcggccgtgcgtgggctgctcgatccggtagtggcagtggctttgtgagacagtcgagtc

SEQ ID NO: 10076 - DNA, 479 bp, Zea mays
  Clone ID: LIB3279-202-Q1-K6-F2
tggcatgctgggaaggcgggagaaccctggagaacatgaagccatgcgtaagatgaaaaatgagtttatggtgaactgggatggtctgagaacaaaggagaaagaacgtgtattagtacttgctgcaactaacaggccatttgatcttgatgaggctgttattaggcggcttccaaggaggttgatggtgaatttgccagatgcatcaaataggagaaagattcttagtgtaatactagccaaggaagatttggcagacgatgttgatctagaagctatagctaacttgacagaagggtactcgggtagtgatctcaagaatctttgtgttactgctgctcatcgtcctattagggagattcttgaaaaggagaagaaggagagagcttcagcagaaacagaaaataggccattgcctctgtcgcacactagcaatgatgtccgtgcattaagaataagtgatttcatacatgcgcatg

SEQ ID NO: 10077 - DNA, 383 bp, Zea mays
  unsure (1)..(383): unsure at all n locations; Clone ID: LIB3279-202-Q1-K6-F3
gatgcagcagctggaagaatgccttccagtcttccattatccacaccgcccccaatagcagcaatacccactccaaaatttgcaccatcccctgttcacacaaaatcaatcggtaaaacagattataacgaagataatgccagtggtgagacacaacccttcagaggtcaaggtgccatcaccgaccaacaaactgatagataccatacctcagcaggcacgttggatgctcttagggaaaggatgaaaagcattcaagcggcagctataggtcattttgacggagcgcaggctcggccgttggcaagtatgaacggaagtaatatggtgcatgggggaactcgangggacggggaacccccccaacaacgaagtaatatacc

SEQ ID NO: 10078 - DNA, 586 bp, Zea mays
  Clone ID: LIB3279-202-Q1-K6-F4
cccacgcgtccgctgacgaatattctcagagacgtgggcgaagatgccaggagggggagaatataccttcctttggacgagcttgcgcaggcaggtctcacggaagaggacatattcagagggaaagtgaccggcaagtggaggaggttcatgaagggccagatccagcgtgccaggctcttctttgatgaggcggagaagggcgtcacccatctcgactctgctagcagatggccggtgctcgcgtctctgtggctgtacaggcagatccttgatgccattgaggcaaacgactacaacaacttcaccaagcgtgcgtacgtcggcaaggccaagaagctgctgtcgttaccgcttgcatatgcaagggctgcggttgcaccatgaaccatccgtagatcacatcttttttttcttttcttttccaaacccaccttgttttgccccacccttcctttttttttgtatataatcagcttcagctgcctgcatggcataagccttgcctgttcagggtgattccatgtccctaaatactcaatcagctcttgttacaaggaatggagaattagaattcgagaagcgt

SEQ ID NO: 10079 - DNA, 523 bp, Zea mays
  Clone ID: LIB3279-202-Q1-K6-F5
ccgtgctcccccgtctgaaaaccctccccacctccggcggcggcggcggcgctggcgaccgggtgtcttctccggcgagtctcccccctagtaacaagaaaatatggatgtacctgttgatgaccctgtggagaacctcactggaagtcctagtacccttggcaatgaggaagaagccactacttatgctaatgtgcaagatcagtccaaggaagaaccagaaaagctttacgaggaacccaaagacccaatgcaagacgagttgggtaaccaagggcatgtgagcatgaacaatgaagatgtgggaggccagaacaaagtggaccaagctacccccacagagcacggcgaggaagctggggtgaagcagcatgatgctacagttcctgatgacaagaaatggcctgggtggcctggagagagtgtgttccgtatactggttcctaccacaaaggtgggtgccgtcattgggcgcaaaggggatttcatcaagaaaatgtgtgaggaatcaagagcccgcatc

SEQ ID NO: 10080 - DNA, 649 bp, Zea mays
  Clone ID: LIB3279-202-Q1-K6-F6
cggacgcgtgggcggacgcgtgggcaggatcttctgcaagaaggccggcgtcttcaccaaggtgctggaagcactctgcagctacaacgcgcaggtcaccagcctgaacacgataacgttctacggctacgctgagagcgtcttcaccatcgaggtgaaaggcgagcaggatgttgtgatggtggagctaaggagcctcttatccaacatcgtggaggtcccaagcaactgacgagattcccgattgagctcacatgtttcagtgcagaaacctcactttcgacgaagaactctagcggtggagtgtttgtgcaggcagtgtgacaagagtacatggtcaaactggtttactgacggataaaggctggattttgtgttgaacgcatagcacgatgggcatcgaggaatgaacttgtgattgtggacaaattcacagttcctctccattgcgttcgcttccgttagacctggattctgtttgcaatgttagcaccatgatgatatctactgacccatgtaggcagcaagggtcgatcggatgctgtgctgtgctgtcctgatttcagctcttatagatagaaaagcaaggcagtcgtgaaaaaaactgtcatgctttgttaaaatgattcgaagtttagatcagtctgtt

SEQ ID NO: 10081 - DNA, 515 bp, Zea mays
  Clone ID: LIB3279-202-Q1-K6-F7
tgctcgttgccggctgcccccgcccactccaccgctgatatttgtcatcgtctcgttcctgccctcggccctcccctcgctcgctccccaactccagcaggcagatcagatacatccattcgcggaccggaaggaaaggaaggggcgttgaactatgagcgccgtggcggtttcgtcgtcgctgaacccggacgcgccgctcttcatcccggcggcgctactacaggtggaggacttctcgccgcagtggtgggacctcatcaccaccactgcctggttccgcgaccactggtcccgcgagcgcgcccacctggacgagatggccgagcagatcgacgcggccggcctcctccccgacgacgaggacctcttctacgacgaccagctcgagcagggccccgtcgccgccgcccttaagacagattcggtgctcaaggcgctgaacatgacctccccgaagggcggcggcgacgccccgcgggggttccgggagaaacccaggaacgccgagaagc

SEQ ID NO: 10082 - DNA, 527 bp, Zea mays
  Clone ID: LIB3279-202-Q1-K6-F8
ggctgaccccacaacagcaagcgaaaatctcccgatcccctctagtctccgcggcgaagatgtcggggcgcggcaagggcgggaagggcctgggcaagggcggagcgaagcgccaccggaaggtgctccgcgacaacatccaggggatcacgaagccggcgatccggcggctggcgcgcaggggcggcgtgaagcgcatctccgggctcatctacgaggagacccgcggcgtcctcaagatcttcctggagaacgtgatccgcgacgccgtcacctacaccgagcacgcgcgccgcaagaccgtcacagccatggacgtcgtctacgcactcaagcgccagggccgcaccctctacggcttcggcggctaggctaggccggtcgcgcctcgttgtcgtcgctgcggttctattgtttttgcaattcgcaagttgtggctgggtggcgaaaatgctggttactgtaccactagatcaagcatgttgtgcgtgtctgaagaaatgccaattgtgacttgctgtttgttc

SEQ ID NO: 10083 - DNA, 657 bp, Zea mays
  Clone ID: LIB3279-202-Q1-K6-F9
ctcttactcagcgtttcatgtttgaatcatccttaagtgattatcacctaacagatgatatatctacatgtgtagaaaccaaaccatctactgatgatgcttgccaggaccaatcagtaccaccagcctctggttccgcaacaaccagtaacactggaagtatctcaccttcttccatagttggagaggagctaaaactagctttccaactgcgtagatttacttttagtgaactgaaatgtgccacgagaaacttccgacctgagagtcttcttggcgagggaggttttggctgtgtctttaaaggatggattgaggagaatggaactgctcctgttaagccaggcaccggattaactgttgctgtcaagacactcaaccatgatgggttgcaggggcataaagagtgggtggcagaagttgattttcttggaaaccttcagcatccacatctagtgaaattggttggctactgcattgaagatgaccagaggttgcttgtgtatgaatttatgccccgtggaagtttggagaatcatctttttagaaagtcattgcctctaccatgggccattagaatgaaaattgctcttggtgctgcgaaaggcctcgcttttcttcatgaagaagctgaaagaccagtaatctatcgggact

SEQ ID NO: 10084 - DNA, 409 bp, Zea mays
  Clone ID: LIB3279-202-Q1-K6-G1
gcgcccttcaccaacattagaaagatctctgcgcgcattgccgcagccgtggctgcaaaagcttatgaactcggtttggcgacccgtctgcctcccccaagggacctggtgaaatatgcacagagctgcatgtacactcctgtctaccgtaactaccggtagtgctgctgggatcaattctgcagtaataaaatatgtcgacgcagatgatcctgcaatgttgtagtttattttttcatttgttggccctgctgctgaccacctttgtggctgctagacactgtacctgtctatgcatatatgatactggaacatttggcgcgctgtgggcgtccctgtcatgagatcaattgcagaaataaaatgcaatttagatttgagcaccaaaataaaaatagtaataatacac

SEQ ID NO: 10085 - DNA, 638 bp, Zea mays
  Clone ID: LIB3279-202-Q1-K6-G11
attgaagcggacggcaacgagctctgcatgctgcgctgcgcccttctcaccgccgccagcccgccagaaggtctcctcccgtctctagagtggctctttctctctccgtcaaatggctctcgcgtgcgcctctcacgcgtgccgctttctcctcgccggccaggcgagatctttccacgcccagccctaccatgccaaggtcggcgtggtggagttcctgaacggcgtcgggaaaggggtggaggcgcacgccgcgaagctggaggaggctgtgggcggcgacctccagaggctccttgaggcccgcacgctgcggctcaagaagctcggcatcccctgcaagcatagaaaattgattttgagttttgcacacaagtaccgtcttggtctctggaagcccaaagcagaacccaggaaagttgaataaagttggttcgttcttgaaagatagtctactgttggactgaggcatgtttgggacattgaatatttgctttgtaatttagaaacctcaaacctttgttctctgtctctagccatacttatttgcaaccattacgcaaaaaaaaaaagattctagaaagattccaacttattgtgtgtgggtttgctccttttgaataacaaatcataagact

SEQ ID NO: 10086 - DNA, 418 bp, Zea mays
  unsure (1)..(418): unsure at all n locations; Clone ID: LIB3279-202-Q1-K6-G12
gccaacgaagcgaagcagggaaaaagccagcgtgagaacgacgagtgagtgagtgagtgagtgaggtgggggggggggggggggaagntggatccggnctagggactngagtnatntaagggcttgttngtttttattggattttacccggaatcgttccagctaatcaaagtttatatgagtgagagaaataatccggttagaaatcgttccgacccactaatccggcacaaacgaacaagacctaatagagaaacctgagagttgcaaaccggctgtctcaggccggcctactggaccgttgctcacgtgtaatctccggcgaaacaatccgttcccgttgaacggcacgctcgattgggtaattcgaattcccttttttttttcaaaaaaaaaaaaaaaaaaatanannnnnngg

SEQ ID NO: 10087 - DNA, 411 bp, Zea mays
  Clone ID: LIB3279-202-Q1-K6-G3
agctggcaggacgcggaggccggcggcctgacggacggcggcgggagcgtcatgagcctggacgacagcaagggcagcatccccgcccgccccgccggcttcgccgagtccttcacctcggccgatggccggtgatcggatcggatcggatgcatgcatgcatccatgtgtctctcaaatgtctctcgtctcccggtccctcccttgcctgttttcgcacattcgttgctgtaggtacaaaagaaagcagtacatgggatcgtcgtccatgtgcacaaccttgtgcttcttcttcttctcctgctctgctctgctctgctttgtagatacatgattttttttttttttgcattggtggtaggcatctcttttgcttcttttttctgtgtaattccagtcagtgttgagact

SEQ ID NO: 10088 - DNA, 521 bp, Zea mays
  Clone ID: LIB3279-202-Q1-K6-G4
aaccagaacgccatgaacgggtacgaggaggaagaggaggaagaagaagttgaagaagtcgaggaggtgtacgaagaggaggaggagggggacggggagggggaaggagacgagggggcagccgccgaggcagcagcgatggcggccgagacgagaagtgtcgatggaggccggggcctagcggaggccgttgggaatgttgatgccggaggcgaggatgagagggatgcagattctagcggcggtgacgcttcggggaaggttttcgtagggggtgtagcctgggagacaactgaagaaacattcacaaagcattttcagaagtatggagctataactgattctgtgatcatgaaggacaagcatactaggatgcctcgtggatttggatttgttacattttccgatccgtctgtgcttgacagggttctagaggatgaacatgtcatagatggaaggacggttgaagtcaaaaggactgttccaaaagagctgttgtcgaaagatgggcctaagacaaa

SEQ ID NO: 10089 - DNA, 533 bp, Zea mays
  Clone ID: LIB3279-202-Q1-K6-G5
atcgcaacacgatccaaagaacgacgtgggggagcgagcgatagagccagaacaagaggagcgatccagaggagaagacgaaagagtcaggggagctgctaaggaccgatggccgaccccagctattggatagggatggacatcgaaacctccgtcacgatgctcgtcatctgtctcgccgccgccgtcgtgagcgtgtgcctcttcttcattttcatgtgcatcgtgcaatggttggactcgccacggatgcgcgtcttcaggctcggcggcgtcaccaccctgaggcagaacctggactacacctgcaccctgtgccaaaacagcatggaggccggcgagaaggtccgcacgctctcctgcgaccacgtgttccacttgcggcggcagcgtcaagtgcgagggaatcgaccactgccttcgcaccggaccgatggagcgctgcccgacctgtgaccgggttcccaatcccgtgccctgaaagcggacaccgccaccgtggccaccagcacctacaccttcacagggagcat

SEQ ID NO: 10090 - DNA, 419 bp, Zea mays
  Clone ID: LIB3279-202-Q1-K6-G6
ggcggtaggtcagggcttcctgctggtggcgttggcgatcctgacagtgcaggggcgttcatgagcctggggtcggggcctagaatcaggtggtgttggaggccagatgtgtgcgcggtgcgtgctaaccatcagcaccggtcggtgcgccgcgacgtgtggatgcgtgatctcggaagacctctcgcatgagacacacacacatctgatgtggatcgcggcagctaaaccatatagaaacaatccaatcacgaagaggttattgggattcttctccgattcattccataagtgcaacagtttaggaaagaaaattggtcaacgggtaaagaaaaaagtcctactgctgtacacctaggaaaaaaaatgttagctccactttcacatattgtttatactgctatttgatttattagttc

SEQ ID NO: 10091 - DNA, 547 bp, Zea mays
  unsure (1)..(547): unsure at all n locations; Clone ID: LIB3279-202-Q1-K6-G7
tgaagtgatccatataggaagtttagctgttccttctggcgcagataagtgggcgctgcaaaaggatcaaggcatggagctgctcttctctgcagattttgaacctgatgcccgtatacattgtggctgcaacaccattaccgcggtgctgcgtggtggcttctgccttttcttcgtttcagcaataatgctcttagtgagctacgaggtgggcatgtgcatctatggcaagtagcaacctggtactggtctaagataaatctcacagcatttaggttaatcctatgttttgaggcagactcaactggggtctggggcctcctgctagcttttaagtgtgccgcattgcatggcatggacctgtggggtgtttagcactagcagtaccattttgcagctcgagagctaatggtgtatgtatgaattcagtgctatttagaaatactatgagaattgcctcattggcgtgtgaaaaaaaaaaaaaaaaaaaaaaaaaaaaaaaaaaaaaaaaaaaaaaaaaaaaaaaaaaaaaaaaaaaaaananggg

SEQ ID NO: 10092 - DNA, 654 bp, Zea mays
  Clone ID: LIB3279-202-Q1-K6-G8
ggtaaggtctgtgtcactggggcgtctggtttcatcgcctcctggctcgtcaagcggcttcttgagtctgggtaccatgtcctgggaacagtcagagacccagggaatggcaagaaagtagggcacctctggggcctggaaggcgcaaaggaaaggctgcagctcgtgagagctgatctcttggaggaagggagcttcgacgacgctgtgatggcttgcgagggcgtcttccacaccgcatcgcccgtcgtcaccggatctaattccaaggaggagatgcttgattcagcaataaacggcacgatgaacgtgctacgctcgtgcaagaagaacccatcgctcaagagggttgtcctgacatcctcgtcgtcgacagtgaggatcaaggacgaagccgacctgccccctaacgtgctgctggacgaatcgtcgtggagctccatcgagttctgcgaaagtctccagatatggtacgccgtcgcaaagatcctcgccgagaaggcagcctgggagttcgccggagagcacaggatcgacctcgtcaccgttcttccgaccttcgttgtcggacctactctgtctcctgagctcggccccaccgcttctgatgtcctcggcctgttccaaggagagacggggaagttcacgacgtac

SEQ ID NO: 10093 - DNA, 319 bp, Zea mays
  Clone ID: LIB3279-202-Q1-K6-G9
agcggggagagcatgggcagcgtcgtcgttcccgcatctccggccggaataatatgatccccggaacacggagaaatcgccgtcgtccacgaataaatcggaggccgccatgcgatccgtctggcactgctcacgttgtttgacattgttcagaatcgccgtgtgcactgtagtttcttatccgcagtagcttttactattcgaaataatgtagcatagcaatgcaagcgctgcttcttcctaagtccgtgcagcgtagcccgcgtgttcgagctagtttgtgttaagttgaatgagttaatggatgctagttgtagtc

SEQ ID NO: 10094 - DNA, 639 bp, Zea mays
  Clone ID: LIB3279-202-Q1-K6-H1
tgcaagtctcgctacgtagcagtgcaataaaaaaaagcagccgcaatggcgagcagcaccatggccctctcctccacggccttcgccggcaaggccgtgaacgtgccgtcgtcgtccgccttcggcgaggcccgcgtgacgatgcgcaagacggcggcgaaggccaagccggcggcggcgtccgggagcccgtggtacggccccgaccgcgtgctgtacctgggcccactgtccggcgagccgccgagctacctgacgggcgagttcccgggcgactacggctgggacaccgcggggctgtcggcggacccggagacgttcgccaagaaccgggagctggaggtgatccactcccgctgggccatgctgggcgcgctcggctgcgtcttcccggagcttctcgcccgcaacggcgtcaagttcggcgaggccgtgtggttcaaggccggctcccagatcttcagcgagggcgggctggactacctcgggaacccgagcctcatccacgcgcagagcatccttgccatctgggcctgccaggtcgtgctcatgggcgccgtcgagggctaccgcatcgccggcggcccgctcggcgaggtcgtcgacccgctctaccccggcggcagcttcgacccgctc

SEQ ID NO: 10095 - DNA, 646 bp, Zea mays
  Clone ID: LIB3279-202-Q1-K6-H10
gttgatgctgctacaagttcagctatagctgcgcccttggtagcttcagatgttaaaccctctcagccggtcagtaattcagctaccaagatgattatgtcaagcaaatccactgctaaggaatttaaactcaatccttgtgcaagggttttctctccatcttttgcaagttctaggcaagtacttgcagctatggcccctgttgacacatactacatttcacactctgcccctgaagtaccaatgggcgtacctgtatatgagtcaaagtctgtgcctggcgtttcacctctaaccaacaaggttcattgtagtaacctgtctcctgcaaactatgccatttcacctcaatatgttcagtcaatcgtggggcataatacatccagactagacccagctagagtaggcacaccataccatcccatgcaggtgggggcaacctacactacccctagtcctcagcctgcaatgactgggaagttcagtcctgttgtttatgttcacccagttcctcaggatccattgcatggaacaccctctggttttcaaggatggcctcgccctgtgcttttgaattcatatcaagctagcatgcagaagttccaaggcaacaccccggtgtatttggccccttcatcatggaact

SEQ ID NO: 10096 - DNA, 654 bp, Zea mays
  Clone ID: LIB3279-202-Q1-K6-H11
gcatgcaggaagtttatcagagggtttttatcagactcaagttagtaccttggcagtcaaggacaatttactggtagctggtgggtttcaaggagagctgatctgtaaacaccttgatcgggaaggtattagtttttgctgtcgaacaacttatgatgataatgctattacaaatgcggttgagatatttaatacctctagtggcgctgttcacttcatcgcatcaaataacgattctggtgtgagatactatgacatggagagattccagctattcaagcatttgcagtttgaatggccagtgaatcatgcttctttgagtcctgacagaaaggtcgttgttattgtcggtgatgatcctgatggtctacttattgatgccaactctggaaagacactccattccataaaaggacatcgggactactcatttgcatcggcttggagccctgatgggcgaacatttgctactggcaaccaagacaagacatgccgaatctgggacgcgaggaatctctcaaaatccgtccatgtgttgaggggtaaccttggagccatccggtccatccgcttcacctcggatggccagtttatgtccatggctgaacctgctgactttgtgcacgtctacgacgtgaagagtgactacaacaa

SEQ ID NO: 10097 - DNA, 640 bp, Zea mays
  Clone ID: LIB3279-202-Q1-K6-H12
cggggatcgtgggccttgaggtggtgcctaacgcgcgagaggttctggtagggctctacgagcgcacgctcaaagagatcaaggccgtccccgaagacgagggttaccgcaaggccgttgaatccttcaccggtcaccgcctccagatctgccaggaggaggaggactggaagcgcatcgaggaccgaatcggatgcgggcaggtcgaggagctcatcgaggaggccgaggacgagctcaagctcatcgctaaaatgattgaatgggatccatggggtgttcccgatgactacgaatgtgaggtgattgaagacgacaccccaattcctaagcatgttcctcagcaccggcctgttgctcttcctgaggagttcttcaaggcactagatgctgtcaaatctgatcctgctcttcaaggcgatgctcctcctcaagtgaaggcgtaaggatggctgttcctggctaacgtcatttcacattttgccgcggtgggtagggactggtttcttgtgtcatttgccagcaatgcgcttgctctgagcagaataaatttctggtgagtaccatcaaagtgtgaatttgaacttagtgattcggcacagtaaacttgttgcccatgaaatactcgatgccctgaaca

SEQ ID NO: 10098 - DNA, 574 bp, Zea mays
  Clone ID: LIB3279-202-Q1-K6-H2
ctcgctgctcgttgccggctgcccccgcccactccaccgctgatatttgtcatcgtctcgttcctgccctcggccctcccctcgctcgctccccaactccagcaggcagatcagatacatccattcgcggaccggaagtaatcatcaggaaaggaaggggcgttgaactatgagcgccgtggcggtttcgtcgtcgctgaacccggacgcgccgctcttcatcccggcggcgctactacaggtggaggacttctcgccgcagtggtgggacctcatcaccaccactgcctggttccgcgaccactggtcccgcgagcgcgcccacctggacgagatggccgagcagatcgacgcggccggcctcctccccgacgacgaggacctcttctacgacgaccagctcgagcagggcccgtgcggcggcgcccttaagacagaatcggtgctcaaggcgctgaacatgacctccccgaagggcggcggcgacgccccgcgggggttccgggagaaacccaggaacgccgagaagccgaccaagtacgccggcagccccaagagcagcgccccccgcgtg

SEQ ID NO: 10099 - DNA, 619 bp, Zea mays
  Clone ID: LIB3279-202-Q1-K6-H3
cccacgcgtccgcccacgcgtccggtcggcgccactggtcacgctggtcaccggtggtaaggcggggaagttagtcaccgccgagatgccgcgtgtggacctcctccgtgtgcttgcagaaatcgacgagaggttcttgaaggcgtcagagagcgcaggtgaggtatctaaggcgctggaggccaacaggatgcattaccactccaatttcgccgacaaccgagggcatattgatcattctgcaagggtcatgaaaataattacatggaatagatcctttaaaggaatgcaaaatggcgatgatgggaaagatgacttcgaaaatgatgaattggagaccttggcaactgtagttgataaaatcttagcatgggagaaaaagctctatgatgaagtgaaggctggtgagattatgaagcttgagtatcagaggaaggttgctttgttaaatagacaaaagaaacacaatgctgccattgaggttcttgagaaaacgaaagctgcggtaacccacttacatactagatacatagttgatatgcaatcaatggattcaactgtgtcagaaattcagtatctccgtgataaccaactgtacccaagactattggatcttact

SEQ ID NO: 10100 - DNA, 302 bp, Zea mays
  unsure (1)..(302): unsure at all n locations; Clone ID: LIB3279-202-Q1-K6-H4
attggcaacggctatgccccagtgctggactgccacacctcccacatcgccgtcaagtttgctgagctcattaccaagatcgacaggcgatctggcaaggagctcgagaaggagcccaagttcctgaagaacggtgatgctggtatggtgaagatgattcccaccaagcctatggtggtggagacattctccgcgtatcctcccctgngtaggtttgccgtccgcgacatgaggcagacggttgctgttggagtcatcaagagtgtggagaagaaggacccaaccggcgccaaggtgaccaa

SEQ ID NO: 10101 - DNA, 496 bp, Zea mays
  Clone ID: LIB3279-202-Q1-K6-H5
cttgaattgttggtagcaactctaattgacctggatgccatggatgggaaaaggagtgtttccttgattgctgaatgttcaagctctccagatgttaatactaggaaagccctagctaatgcattggctacagctccatctatgtggactcttgggaatgctggcatgggtgcattgcagaggctggctcaagatcccaactacgccgtagctagggctgcatcaagagccattgatgaactcaagaagcagtgggaacttgaagaaggtgacagtctgaggtttgtgatgaaccagaatctggcctccagggatactgaggatgacaattcaccagcggatgatgccgcatgagtcgtaaacaagatgaaagattccagtttcagtggcaatggatcaaagcataaggaaccaccatgggcagcacataagcattcccattttacttttaggactgaaaatcagatagatgtgttctagttgaaggggggggggg

SEQ ID NO: 10102 - DNA, 526 bp, Zea mays
  Clone ID: LIB3279-202-Q1-K6-H6
gtcgtacacaagatgaagaagttggtgatggcactacatctgtcattgttctagctggagagatgctacacgttgcacaggcattcattgacaagaactaccatcctactgttatttgtcgagcatacaccaaagcacttgatgatgctattgctgtacttgacaaaattgcaatgcctgttgatgtgaatgatcgtggggcaatgctaggccttgtgaagagctccattggtacaaaattcactggccagtttggtgatcttattgctgaccttgctattgatgctacaacaacagcaggcgttgaccttggtcagggtatgcgtgaagttgatatcaagaaatacattaaagttgaaaaggttcctggtggtcagttagaggattctagagtccttaaaggagttatgatcaataaggatgttgtggctcctggaaaaatgaggagaaagattagtaacccccgtatcatccctgtggactggcctgttgagtttaagaaaggagaaaatcagaccaacgctga

SEQ ID NO: 10103 - DNA, 656 bp, Zea mays
  Clone ID: LIB3279-202-Q1-K6-H7
gatgaacttactttggataacatgagcagatcacgcttggtaaatatgtgcaaatatatgggtatccggccttttggtacagatcactacttgaggttcatgcttcgcaaaaaactgcaagacattaagaatgatgataagatgattcaagctgagggtgttgaatctctttctgaagaggagcttcggcaagcctgtcgggaacgtggtcacctaggtctactgtcaactgaagagatgagacagcagctccgagactggttggatctctcattaaatcatgcagtgccatcttcacttctcatactttcaagagcttttactgtatctgggaaagtgaaacctgaggaagctgttgtagcaacactatcttcactaccggatgaagttgtggatacagttggaacagtactgccatctgaagattcagtttctgagaggaggagaaaacttgaatttcttgagatgcaagaagaacttatcaaggaggaagagaaaaggaaggagaaagaagaaaaagcaaaacaagaggaagaggaaaaggcaaagctcaaagaaacgaagggttctgctgaagatttagctttgaaagaaatgattgaggctactgctagggaagaggaactgcgaaaggcaaaacaacacgacagggaaaa

SEQ ID NO: 10104 - DNA, 609 bp, Zea mays
  Clone ID: LIB3279-202-Q1-K6-H8
cccacgcgtccgcttgcctctgtgaaaattcctctaggaaagcaatgtggctttgttcaatttgttagcagaactgatgctgaagaagcactacaaggattaaatggatcactcattggaaagcaggcagttcgcctttcatgggtccgcagcccatcacataagcagtctaggggtgactccgtcaacaggaggaacaacatgtactatggcacaccattctacggcggatatggctatgcctccccggtgccacacccaaacatgtacgctgcagcgtatggcacgtacccgctatatggcaaccagcagctagtgagctagagagctcccctccgacgtgtcccctctgacgggaaacaaaggttttggtccggtgagcatagtagcgtcaggtgagaaggtgcctttataaggctgtcctaagaagtgggcgagatatgttgttgcatcgttatcgttatggtgcctgtaactgttgtgtgtgccgtgtgcgttcggaagaattggatggaatggaacttcgtgcttgttgtagtacatcagagagtaatgttattctttcaagaaatttgacttggaaataattaaactattgtttgtgccgtc

SEQ ID NO: 10105 - DNA, 259 bp, Zea mays
  Clone ID: LIB3279-202-Q1-K6-H9
ggaagggatgaacgatatggttccattaggctgagcatcatgaaaaagacttctatgaagtcctaggtccagtagttatattttctccggttatttcttcagtgtgactgatatatacatactaaaataacgaagctagcacccaaacgctagtatcacaaaaaaaaaaaaaaaaaaaaagggaaaaaaaaaaaaaaaaaaaaaaaaaaaaaaaaaaaaaaaaaaaaaaaaaaaaaaaaaaaaaaaaaaaaaagggggg

SEQ ID NO: 10106 - DNA, 403 bp, Zea mays
  Clone ID: LIB3279-202-Q1-N6-A10
ggacaaaaggagctctcgatattattgattgcattcctctgaggtacacttgcaaatggattcaaatttgatacatttcaacggaaacaaatcacaaagaatacacgtaaagctgtgaaactactcaacctactagtatacaacaacgtatcctcctaaacccaacaactgtgtttcgatgtatacaaacgaaaacattcagtgccgttgtatggtgttacaaaatttgaaacaaaacatgctcaagtcacggacctggtatcttggcctggccgcgatgcactggacaagaattagatggtatgacaaattcataccagggcaggcagcgctatacacgagcacccaatgcctggagctggctaacaagaagatccacctgctctctgtacatttcttttta

SEQ ID NO: 10107 - DNA, 433 bp, Zea mays
  Clone ID: LIB3279-202-Q1-N6-A11
ctcccaacataacaaaaagccatgaaattatactattatggcatcacatcagtttttctttttattaatcagctagtatattcccacggactccgaacataaactagcagaacatagaagacagcaaccacacaagtttgatgccaaacagttcgcacaacggggtagggcgcgcagatggagctttgcttgacaaagcaccactcgagagcatttttggtccctcgccaaattgaaaatccctagccctagtacaggtcgccttccttgtgggtgtggatgacgcagtcggactttgggtaggagacgcatgtcagcacataaccttcctcctgctgcccggcatcaaggaaggacccatccgactggtcaaccgaaccagactcgattttgccggcacaggtggagcaagccccaacacggcacgagtatg

SEQ ID NO: 10108 - DNA, 413 bp, Zea mays
  Clone ID: LIB3279-202-Q1-N6-A12
aaaaccaaactgcaatcttaccaccaggctcacaaataatcatacaaggcaggtgttttaaaggtcataccaaagtttgacaaacatagcacaattagatgacatccaactccatacgaaaactaccaagacagtatcccgcctcaacgcagcctcctagcctccctctcagactcgagcagtgtgaggatgtctccctcgcgaaccggtcccttgacgttcctcatgatgagacggttctggtcatccaagaacttcactctgacctgggtaacctgacccctggagccggtccttcccatcaccttcaccacaacagcaagcttcacttgggtgtccatactctcgcttctcgcgcagagtcgcggacggaggacgacgggcttacgaaggaaaccggggtggcggcggcg

SEQ ID NO: 10109 - DNA, 563 bp, Zea mays
  Clone ID: LIB3279-202-Q1-N6-A2
aagaaacaaaacatgattcttgttgctcgtgcgtagaattcacattcacaacagtgccatgaatgccagtgctagctctgctgctcgtgcgagcacaaagcaacaacagaaaattcccagattcttgctgggattaaactgattcgcagtaatctttttacagattgcatttggatatattcgaataaaatggcttttgtgcaatcgggcgttggtaaccagcttggatttgtcttgttatcacaactgagcatggtgaccatccaagtggagtgaagattcgtccaaacaagaattattagtgttttcctgacaggacagtacttctttggatggtattaaaccaagagataagacaacactaataaacaagaatttattagtgttttcctacaaggccaaccgtgtctgtggtggccgccaacgccttgggcggtgccgccacggccgcgacgcttgccaacggcatgggcaccgcgttgtcgtccacacgcagctgcccctgccacaacaaccctatcgtcaactagtatctatcgacgcgtcgctgctgttgctggctg

SEQ ID NO: 10110 - DNA, 603 bp, Zea mays
  Clone ID: LIB3279-202-Q1-N6-A3
aaaccaaccactgtatacataagtattaagttcgaatgtaggtcgccgacaagaacaagcatacaaattcaaacgcattcacaagttacaataaacaaatgaccaatcaaacaaaggccgaggcataaccacatgaacccagcaaagtgcagataaaaggtctgctgcactgaagtccatattacacctgggacgaaaatgcaaaagagaagagtatgttggtggtgtacaatgctttcaaggtaagggtgcccatgacccaatcctgctcaaagatctgccacggtacacagcatactgaaccctaaagtgttcagtaaactgatctacttgtcagcatgtcgccgcttgtatctcttgtggccatggttaccattactactacgaggccttttattctttttggagcagaaggtccctactagaagcctgtatataatgaagacaggcagagccagcaaagcagaagccaggaaccaaactaactccttagttgccaatgattttgttatatcacgctggtgaaggtagtccatgatgcttgcttgagcctgtcgatggtatgtggttgccgacttgagaaagacccaatgcatgaactgc

SEQ ID NO: 10111 - DNA, 499 bp, Zea mays
  Clone ID: LIB3279-202-Q1-N6-A4
agaccaacatcattttgatatccaaatggtgggtcccaatcatatcagcacaagctgaggacgaggtcacagcccaacacagctgccggggctgcggccagcagttataaacacgtaaatacctacggtataatggtgtccctaaacgcccaatatgtctcgcttatgtctttaccagaagagctagacaggtatatacatagactacctacagaaagcagttagatgatcggcagctcaggcatcaaacttgctgtgttgaggatagcttgaatggcagatttatttccaacagcaagcccgactccgccttacagcctcaacgtggtgtccgctgccgatgtggaagctccggaccttgccttctcgctgaggaacttgccacagtccgcgcccttcgcggtgaactccgccagaagttcctcgtgaagcctcttcagtgactgcttgaacctcaccgagcagctcttgtcgccttcgtcaacgtcttgcactccgt

SEQ ID NO: 10112 - DNA, 445 bp, Zea mays
  Clone ID: LIB3279-202-Q1-N6-A6
agcatatacgtagatacagacacatcattaatcgtcaatgccacaccaagggcttgtaacacgtgattacaccacaacagatttccatacatcgtcaaagaaaaaacttaagcattgcaccatcagtacttgtttatacagcttctcacttccccccaatagcggccttagcaagcagcttctttggtaacttatccaatggagttgtcttcagaaggaagagtcgggtagctcgctcctgtaaagttccaccacattttaatccacgagattgcagctctatttttagcttctccagaccaagcacctccaattctacagctgaactgtactttgcaaggtccaatggctctgaataagatttgctggcatcggcatattcttctactttgggcacctctgggttgttttggttcgaagtagctgaagcactgttatcctcgtc

SEQ ID NO: 10113 - DNA, 437 bp, Zea mays
  Clone ID: LIB3279-202-Q1-N6-A7
acggaccatcatcaataaagatatcgagcgtgtggggcacaaaaacgtgagaaagtgtaccccactggttttatccttcaaacacccaaccacctcccttgtcaaggacaagaaacagaataccttgaatgtcccaacacacatcctcaaatcaaatggggcgaacctctcgcttagttcactcccccctaccgactataacagcaggtgaacagggtcaatcacacaaatgtttgatcactggcaaagctaagccgagggatctgtggctccctcaggtttggctgtctccatctgctcggctcgaggctcctctgcggctccctcgctggctgggctttcgccacctgattgctgctgctctggtgtctgaggctcaggagcttggttttctgccacaggcggagtctgcggcttaagagctggcttcggtttcg

SEQ ID NO: 10114 - DNA, 520 bp, Zea mays
  Clone ID: LIB3279-202-Q1-N6-A9
ttttacaacgcagtaacacacttatcaacatagcaaatacacagatgatacattgtttttgatgtcacacacgcaatcctccaataagtgatgataattctgtagatacaaagtgcagatgaaaactctgaaaatttgcctacaaatgcaaatgggattggatttggattacagcaacgccaacataagctttacatgcaaattatggctccacagggggctttagtctaatcaacctcctcactctgtctttctccgtgttttcaagcaaccccttccaaacaatctcatcaaggcacaagcagatcctcccgtatttgtcaaggaagaggcgctcggtaggaggtttcgcacaaacatccttgactgctgatgtaattgcaaagatcacctcagccaaagcaagctcatcatattcatccttgccaacaatgtagaggcagacatccccgaccgtggtataaacaatagacacagacttgtgggaggcaacgtggagctcctcgttcttggacccttt

SEQ ID NO: 10115 - DNA, 514 bp, Zea mays
  unsure (1)..(514): unsure at all n locations; Clone ID: LIB3279-202-Q1-N6-B1
ggcccccggattcacgcttccttattttcagttcagttcggaaggtgatccaaatccagagtcaccaccggcaaagacgagctcgcgcgcgcgcgcacacacacacacactactggccctctgccagcggctcggcctctggcgccgacgaaaacaccttggcgatgcgttcggtggggatggcggggaggtacttggcccccgcgtagccgtgctccgcggcggctgcgaccgccctgttgtacttgtcggcccagtgcgcggcggtgggcacgacgatctccgcgacgtgcgggaacaccggcaggccgttcagcgagcgccaggcggagacggccaggtgctccgccgcgggctcgtaccgcacgtagaggtccttggccacgggctccacgcggccgtacacgtcccgcgccaccggctccgtcatcgcgagcgccgcacgggctgcgcccctcacgcccgaccgctgcgccttggncgncagctcgcgcgccacctccggcacgccccg

SEQ ID NO: 10116 - DNA, 470 bp, Zea mays
  Clone ID: LIB3279-202-Q1-N6-B10
aatcaaaacggcccgaggttccattacttctcaaaatagctggggcctgtagcttctttcattgtttcaaagccttacaacataagccgcaaaacccgaaacagtcctcataagccccacttattagggcagtacaacacaaacgataagcgcggggccgatcaagaaagaaccacaacatgtagaagccctataaaagcatgattaagcacagcagaccaccaaaagcttcttactgaaaaaaaagcccccttaggcaaaaggtttctcccacttgagtggcttcaccacctcccaggtgaagtcagggtcgtcccttccaaagtggccgtaggcccccgtcttgaggtagcgcccgttgccgcctttcttgaggtcaaggttgatgatgatcatgccaggcctgaaatcgaagttctcccggacgcctgggcggacccctgggcggactcttgggccgacccctgggt

SEQ ID NO: 10117 - DNA, 545 bp, Zea mays
  Clone ID: LIB3279-202-Q1-N6-B11
accacttccaaagatatccctggaacttgcaacaaccgttgttcactgcggttcacgatacaagaacataaaagtcataaaaaatcacaaagacaggtaggggcaccagatgtagacgctgttttttagcccataaaactttcaattactgttggatcccatgacgggccaagtgaacacttcgttagaagaatgtcccttctggaggctgcactaactttcgattctgcgaggcagccatctctttcttgagctgggtgaggatgttctccatcgtgtagtcccgctgccagttcgctagcaaaccaaacttccttggatcaaccattcctgtctcgtgattaacgcatgtcatgttgattcttgagtggaatctgacagatggtggcttctccggatagtccttgtcacaaaacaacttcagctggtagatgcgaccctcatgtacagtattgtgagggccaatgatggtaccagtccatgaccgcatgtagatgtcatcggcatcatccattccatagctcactgttccatcaccaatgccc

SEQ ID NO: 10118 - DNA, 562 bp, Zea mays
  Clone ID: LIB3279-202-Q1-N6-B12
acacaaatgcaaacgctgatggattattgccttattggcacgtactcatggttttatcagcccaaagcctgatgaaacaaatttctttacaatgagtgcaatggctcgccacggaagatggaaaaccaggcacagcaaaacagaaagctacacaaggccaagcggccaaagcctacggaagggcgagatgaggctggtgcaacatggcgattccctgattggtaacggtctgacggagaaaagcgattccagagacgtcgattgcttgtcttgcatcgtggcgtgggtatctacagattgcacatcttctatgtaattgtaatgcaaactttggaaagtatatatgactagagaagttgtgcggcgcctccgaaggggttggtctgtggatgcattccatttactgccgggaacgcaccgaacccggcgtcgaggaaggggtttgctgcaggagcgacgcccgcgtgatgctgctgtggtggtccgaagggatttggttcaatcatcatgggcaaatgcctgggctgtgtagccatggccgccatttgaactgacggtgggg

SEQ ID NO: 10119 - DNA, 434 bp, Zea mays
  Clone ID: LIB3279-202-Q1-N6-B2
cactctaatacaatggttgaggattcttcatcacattgtcatagccacatctgaaaaactcaaaacttgggtactgtggaataacaaaagcctacagacataacgtcagataagtctcggacagtataagcgaatttgctaatggctgggtagcgagggtctcagactctcagtcaaacaggctgaagcccatgtcgatatcagactcctgcttgggctcttccttcttctactatgcagcaggggcagcaacagctgcagcacccccagctggggcggaagcactaactggagcaccgccaccaccagatccaacggagaggattagatcctcaacgctgcgcttatccaggagcttagctaaaagcgccggccagtacgactcgagcttgatgttggcctgcttcacgatggcggcgatcttctttgttgtg

SEQ ID NO: 10120 - DNA, 549 bp, Zea mays
  Clone ID: LIB3279-202-Q1-N6-B3
gcagtactgtatcagatagcacgctatacataagatgccgaacttattccccaatgaccaaaatattatacaaatacacagatcatacatccacaaaacaacaataacaagtgtgaaactaagggcttgtttggttcggtgactaaaaacctgtttaactaagggcttgtttggttcggtgactaaagacctgtttggttcgtggctaactgcgccacactttgtctaagcttagtcgttcaaattgaaaaactaatcttaaacataaaagttagacaaaatgtgataatttagtcatcaaaccaaacatgtcctagcttaccacactttgactaacttttctgtctaaggttagttatttaattgaaacgactaacattaggcaaagcatgacataattagcacaaaccaaacaggcactaattatcatagagacgctgcagagataaagtagcatagagacgctgcagagtaacaggtgtgaccggctcacaaatcaatcatttgtcgccagggcggctgtcgtagtcgacgacctcggcgtcggtg

SEQ ID NO: 10121 - DNA, 437 bp, Zea mays
  Clone ID: LIB3279-202-Q1-N6-B4
gaaaccgaaatgagggagatgacttcaaaactcaataaaacgctagagcaaccactgacatgcttctcaaatccagtgaataataccagtccacacggacttaatgccaactagcggcaacacaaagcaatggggaactaattcgaacactaccagcctactaatataaaaaaagaagtgagggaacaggaaatcagctacaataatagcacggcacagcttcagcttcgacagcatagagcatctaaaacaatgggctcgaacaatatgcgctctcccaagattactgtccgtcaccagcctcacctttcggggcttctttgccctcatcagcaccatcctccgtgaggtcagaggtccaaagggtcaagttgtccctaaggagctgcatgatcagagtgctatctttgtatgactcctccccaagggtgtctaac

SEQ ID NO: 10122 - DNA, 595 bp, Zea mays
  unsure (1)..(595): unsure at all n locations; Clone ID: LIB3279-202-Q1-N6-B5
gtaaatctgaagttcattattaatgaaataattttgatgtcgtgccctgtcaatttacttgtacaatgcagcgattgaaatttgaacatgaagaggggtggagatattgcttcactttttcgaaaacatgaagcaaagaagcttgctacctccccgacatatccttcttcaactccggcagtaaatcaagggcaacctagtaatgaacaggaggaagaaggagtgatcgaagaaaatcataatcatatgccttcttcttcaccaccaccagcatcgcaatcatcagcaccaccggtttatgatatcaatcgtcttccacatgatccaggtgaaagacaacccatctcaaattatcatgttaatgatcatgatgcaattcgaagagcatatgttctgaaaggtcctttgcaaccatatggacatgaatttccaaaaagaaaaattggagatagagaccgcaactntaattntgtgtggttccataattttccttgggttgaatatagtatcaagaatgatgcagncttttgttttgtgtgctatttattcaaaaataagaaaaagtaggggcaaggcacagatgcatttactgtgg

SEQ ID NO: 10123 - DNA, 508 bp, Zea mays
  Clone ID: LIB3279-202-Q1-N6-B7
ggtacaacaaaccaatgctccagagttcagacgtacacgcacaaccgcgacttgcgtgcgtagcgtaccacacacagatcgtcagttgtgaagacaagagaccggcttacaataacttagaaagatacattacgcccacatcaactctgcaccttactagaggtgttctggaccgccgcgctggtcttcgtggacctccacccttccagtgataatagcttaggctcgctctggttcgtcatcagtcgccgaatagagtagagagcagcaggtcctgcacgaacgtggctctgacgcgggcttgcttccgcttcagctccctttcttcacttgtgagcgacgaatcgatacttagcttccgtgcctgagcgggcgcttctttcaccgtcgtagcatcatcaggaatggaaacggtcgacttggatgcttgctcagcgtccgaggtagggaagccaaggccgaacgacgacagaagaggatcagccgaaatgttcgtggcgctgctgct

SEQ ID NO: 10124 - DNA, 618 bp, Zea mays
  Clone ID: LIB3279-202-Q1-N6-C1
atcaagctgccggcaacaattgattacatatacaaggcacaactgattcccgcgtgatccggtcccagtctttaccacttgatccgaccacactggaagtttgcatcaacttacaccgttttttctctccgatttaattgcttcgtaagacttgacaacctccttgaacttctcttctgcagcatctctatcattttgattttggtcaggatgcacttccatcgcttttgttctaaaagcagtcttcacttctgcatctgtatatggtgtcgctcgtgatctgtcaagacctagaactgcatagtgatgcgacataggataaaccctaggtcctgccggtgtgtacgtccgcctatttttatgttctgagtgagaagcatcggtctgccaataccaatcatcccgagggatgtaattgtagccacgaggagggccattctccctccagctttcataacctcgtccaaatttattcctctctctgttgaagacactctgcatatgccttattctttgaactctctcttgttcctcttcatattcctgctgcattcgctgataatatcttttcttagcttcctcactgaagcttccacgacttgagttattacttgtata

SEQ ID NO: 10125 - DNA, 527 bp, Zea mays
  Clone ID: LIB3279-202-Q1-N6-C10
ttttgatttttcaagttaatatcattattagtgccggcttttagcattttttttaactccagaagatacagcctcacgacaactgttgaaaagggaaaatcagtacatgatggccacaaacatgcaagagctggaagtaaattccgagtagaggtccaacgtccaaggctctcgctatctcgagtccacaacggtgccttctggaagcgcggacaggtgcacaagaggggcatgtgatttcagggaagcattggcaccagtgatcttggtctcctttgttctgttgagcaccttcctcacctcgtttgcaagctctatgatcgaatcatcttcgtggctaatgctggctaatgccttctccattgagaacaggtaatccctattatagccagtagggccattggctgtagcaatttgccttgccatatcctgcagaggagcagggccaagatagtacttgttgccaattggatctggagtggaaacgaacactaagacgcccgtcacagctggtttcaagggatctc

SEQ ID NO: 10126 - DNA, 385 bp, Zea mays
  Clone ID: LIB3279-202-Q1-N6-C11
agtgcccaatctagaatgaaaactggcatagcagcatggccgattgaatccagttctgcccaaattcggtttctgtaagtaatcctaaagacaactacaacaataactactgaccatctcgtgaaaaaaagtgatcagtcagcaatcatgtacatgaatcatgattgttgattggcattcctgcccaagattatcagcaaaagggggttgttaatacaacaccaactaggttaacaaaagtgataccttccgtgcatcgcaactaactacaacatgaccacatccctttggagaccatagccatatcccgctggagaccaatcatatccttattaacttgaacgaacagcaagaaatgcgatttccttctagcatgcaattaaga

SEQ ID NO: 10127 - DNA, 411 bp, Zea mays
  Clone ID: LIB3279-202-Q1-N6-C12
acccggagaaggggtttttggggctggatttttgggtctccaagggaattacaaaaaaaaaagctccttttttaaccagaaaaaaaaggcgcatgggggcacttgaaaaggcggtaaatattaaaaaaaatttggttgaagtttgagcaaaccccatgttgccaaaagtgttagttactagttatgtccaaatgaaactcccaactcaaccaaggaaggccactttgattttttcaaaaagggggccatgaaaaaacctaattatttggttccccaaaaaattgatgggggggcctacttccagccaatttgtttaaaaaacaattttattaggaggccttgggaaaaagtttttctggaaacaaaaaattggttggaaaaacttttaaaaagggccttgaggggcccaaa

SEQ ID NO: 10128 - DNA, 580 bp, Zea mays
  unsure (1)..(580): unsure at all n locations; Clone ID: LIB3279-202-Q1-N6-C2
gaggaacatcataaagcacaagggcgctccactgaatattggattagcttaacatctgctatttcctatgattctgtcatatataacatacaaaggaacattatatccagcgctacagctactgcggaatacatcagtttcttttattacaaaaagggtatcccggaaaccttttgtacagtttgactaaatgctcgctgctcacagctcacttggatagggaaaatctctgctaccaatcctctaagcaaaggcaaaggcaaaggtccatctcgcaaaatattgcaggtcttcgaaaacgcaatgaccttaactgacagaggtgcaaatagacggctgagaatataggccatttatggggttcatgaacggctggggacgccttcggcgttttgaaacgacagtgaatccctctgtatccttcaggcccttagtagcctccgccgctttctcttgtttatccggatctttgcgaccagaagcgttcttgcctaagacgctggtctgttcattactagcttcatctgatccacttggcttcctctctggttcagccccggnagggacctaaactgtcgtg

SEQ ID NO: 10129 - DNA, 487 bp, Zea mays
  Clone ID: LIB3279-202-Q1-N6-C3
actcaggtgatccaacagcataatccagcacagttcagtccatcggttgctacaggtgcataatgacaaatacgatgatcacagatcagcgacgctcttatttcacgatgtctccgaatgttcaggctcgtctgctggggacggcaggagacggacctctcaggcacccccaagtccggcgatcgttttcagccctggagtccaatgatcccacaagcaacacggccaccggcgtttccagtgctcttgctgagctcgtgcccaccctttccaagatcatcaggatcagcgtgaacaacaacagctctgccaatgattgagtttggcccagtcagtgggatctggctgtcggtgacattgatattagcaacaccatctgctccagctgtcacgtttccaagatcaccagcatggcggttctcatcttctggtgccccatgctccttgctcgcaggattgtagtgtggtccagttgacatgcatccat

SEQ ID NO: 10130 - DNA, 536 bp, Zea mays
  Clone ID: LIB3279-202-Q1-N6-C4
agaccagcaagattacctgttccatcaaaatcagtttaggcaaacgacattacaacgagtgcagaccaccactcgtcagaatctagagagattgaaaaaaaaaagttcttttctgcttttggggctcccacgacaaaatcacctgagtagctctcgagcaaacacgaccatacatttattgcgaccgtacaaacattgtaacaaaaggcagcagcgagctagtatagctccacaagaaaacatccccatcctcttcctttcttagtagggctccactggtgccctgaactttgctccggcgtagaccgcggcatcaccgagctcttcctcgatcctgagcagctggttgtatttggccaggcgctcaaaccggcaaggagctcccgtcttgatttggcccgtagacaggccaactgagaggtcagcaatgaaggtgtcctctgtctcgccactcctgtggcttgccatcactccccatccggcgcgcttggacatcctgacagcttcgatactctcggtcacagacccgatttggt

SEQ ID NO: 10131 - DNA, 529 bp, Zea mays
  unsure (1)..(529): unsure at all n locations; Clone ID: LIB3279-202-Q1-N6-C5
atggcagacaattgctgattactattactgattggaaggcaacacacatgagaatagtagattacagagctacctaaaccggggaatgacacgataccgacccaaaccaccaagaataactgaataagcttacacgacatagccaacacgcaaaccatttcgtgactcgactggggatgaattcttgcagctgccaggatgctgtgcgcatcatagtattgaaccccaggggacgtgacagcaagacaagaatgggaagttcaatgataaagcagcaaagagacatgctgaattcttgcagatcgcaaccttttttcgttacccaatgcccccgcctcagatcttgtcaagcttctccgccttcaccactggattggccttggcgatagcgtccctagctgcagttcgatagtcgaactggcagtcgtgtttgtcggagtagcggtgcatcgaacagtacgtgttcccgcatcggcagttaaaacccgtcaacccaacacgcttnctacaggttgcgcaccggtttggg

SEQ ID NO: 10132 - DNA, 531 bp, Zea mays
  Clone ID: LIB3279-202-Q1-N6-C6
gaggcgtacagaagcacaatccaacagatggcaacatgtcatgttcaagcagtagccacatgttcagacagtattcgtcagttcgagtagactagttgaggctgaatctgcacttcagtagttagacatcctacaggagttcatgcagcacatgctacgttttttatatacacatcataacacgtttccgcagcacatccaaaacaccgaagggccagtttgcagattccgcgctcctcaatcaacaagacagctgcttccgatttattgtcggtctagttccattggagattcacttagcagcttttatgtttgcgagggcggtaagaacctcggtgactgaaccttcgatagctgacctattagccttgagagatggcactagtgcgtaaacctcttcaacggtctcaggcccaatgtttgctatcatgcatatctctccatcactgaccccacattttttaagagggtcaatggcttgtttcacagagcttgcaggggtgaaatgatttccatcttttgaatactgaa

SEQ ID NO: 10133 - DNA, 315 bp, Zea mays
  Clone ID: LIB3279-202-Q1-N6-C7
cagttaaacgtctcgactttacacaacccagcaagtgggccatcatcccagatatatatgtctgccgtagcttatacatgtatagcagatatagagagttggtcagttcctagcagctacctaatttccaaaatcatctcagcagccaccagcaacttaaaagacagccagctagcttctagccttctctacttatatacagctcgctttcgtcgtcatactgtatgctatgggtctccatccgcggggttctcctccagctcggtgctgcagggatgccctctgctgcggctcagtatcgattctctaatctgc

SEQ ID NO: 10134 - DNA, 368 bp, Zea mays
  Clone ID: LIB3279-202-Q1-N6-C8
gggaggaaaaaatttttttaaaaaacaagccctttggggtcatggggaacccccagaaacaaaattgaacccaaactgggaggggtaatgggaccgggggcccaatgactttcttttaaagcagcatttccaagaatggcacttttggttggaaaaaaaattttcccaaggaaaaaccaaacatagttgaaacaaaaagggttccaaatgggtggaaaacagggccttccttggggaaaccccccgaactttaggaaattgaaaggggggagggggtttttttgacctcccaaaatgagacaccaatgggggttaaattgaaactgggttcctaagaaacccggttgggggctgataaatttttaaaa

SEQ ID NO: 10135 - DNA, 566 bp, Zea mays
  Clone ID: LIB3279-202-Q1-N6-C9
acacgaagagcgcacggttccttattttacattactccaataaggttattacaagcatccggacttttccccaacaagcatacatacatttatttctgctgtgatcatcagaagatgtattctggcacatcaagagggaaaggagccaccatgacttcgaacggcttcccttcaggtcggctcaacttgccaggcacaaacgaaaaagagccctccacagatccaggtacttggggcagtggcgtgcaactctcgtagacaaactcatcctcgccaggtaacagtagaggatactctccaataacccctcctccgctcacatcagaaacaaccctgtcacacgatctgatggtccagtggcgggagcaaagctggcaggaagaatagtacacgccacctagcatgcatgcctctggaactgacatgcgaattgagtaagtgaacataaatttttccccaggcctcccaagatgttctggcacaaagacagcagatgagcgtaccttaatgccatttgtaacagctgaactgcatgatgggagtgcttctggatataagctgatata

SEQ ID NO: 10136 - DNA, 561 bp, Zea mays
  unsure (1)..(561): unsure at all n locations; Clone ID: LIB3279-202-Q1-N6-D1
ccagcaggaacggtgaacaaaatatacacattgcagatatgctacttatacacagtggtaaaaaatacggcaaaccgctgctgctgcttctcgcgatcacgacgatactgcaccaggcggagaagcggggacagtccggggtccggggaagacttgctggattttgggctatcacatcgcgacggtgagggcaaaccttcagcagctcagatggctaagcatccatggtggcagtccaacgcgagcctgcggctgcgctgctgccccttccaccaccctcccgcctgctgccacagggaagatgctgacatttgttgttggggcagcttcccttaacatgaaggacgtggaagacgaactggtctgctgttgagttcggtcccgttgcacttgctgccgctggtctttctgcttctccgcgagctccttctgcagaaccttgttctcctcctgcagtgacttctccttccgttggagcgctgaaattgactcgaccataagctggctcttccttgttctgatatgtntcagtgaactctccagctgctgctctagttgctg

SEQ ID NO: 10137 - DNA, 389 bp, Zea mays
  Clone ID: LIB3279-202-Q1-N6-D10
aagataattattcggctgccaaaatgtggggaaataatccttgttacaaaacacatcaaaccatctactgtgctgtgaaaaaaacaggagctgttctggcggttccaaactacttcacagtttcttgcttcagcctcgctggacaatgtcaaaagacagttgcagaaaatttgcatttcagcaaactgaagttgtccatgtcacttgtatggtgcaattatcctccgccgccgatttggagtctcccgcttaacatacatcattctccatatcatttagtggacggcttgatccatcaggcaagctgatgaacttacagccccctgctgcaccacgctttacctgagaaccaagcttatggaccatgtaggtgcatccatttgactggc

SEQ ID NO: 10138 - DNA, 467 bp, Zea mays
  Clone ID: LIB3279-202-Q1-N6-D11
agcaggctattaataattaataaacagaaagaaaaaaaaagacagacggacgcactagctgctacaaacggtattcacacacaccctcccgactccttgacttcactttcaccccagtaggcgctaggcggtaccctgtgagggctcgactctcgaggccttcacgcttgttctgtcgtctttacactgcccccctccctttggtcccgcgaaagatctcctcaaaacaaagaaatctttccggcactaaattaccaaatcactctgcgacaccgcactaatctttccggcactaaattaccaaatcactctacggccacccctgaagaaacaatcggcagcaaaaggaaatggtgagctgaaaaaagaaaagcagctggactgcactgcactgcaatgcactgccagcaactgagctgctcctactggcgctgaggtgagcgcaaccgtctactctttttgcggtt

SEQ ID NO: 10139 - DNA, 596 bp, Zea mays
  Clone ID: LIB3279-202-Q1-N6-D12
ggaacaagcagagacatttttgcaccagagcatctgatacctagccaggactaaaatgcaggggaggatgctacataggagtacatgtagcaagcaacatgaccgaagatgtacatatactgctactaacaaaataattgtgtacaaagtcctatttaccagaggtgagaggagcgtccccgacaacggcagcagtcagtggcagtctccaaaaccaaagtacccggcaatacgccatgcctcctacaaagcacggcaaacagatcacggggtgccacacacggaacgataccagtatccattccctcccagccattcctttccttgctgcaggtaaaaggaccacggcggtccaagccgttccaaaccaaggcagatggtgcagggaagcgccctttgggcccgtgaagcaacaaaacagataactcttacaagtcccaaggagcgtggcattgcctcccatgacccgtgaccgacatccaagaggggaaagaaaagtaggagcccagttagcatccatcagtcctgataatcagcagcaaccgagcattggtgtttgattacgtcagattccggaggcaatttgtttgggtctg

SEQ ID NO: 10140 - DNA, 407 bp, Zea mays
  Clone ID: LIB3279-202-Q1-N6-D2
gtacactgacaaaaggcaatcagaaactcagactggttcacctagcaagttcactaaagacaaacagttttaacttcctttgttaacgccgagaacagcacaagctacattacctgaagcaaaaaaaaaactgatgactcaaaccggtaaagcaggatttgaatagatattacacgggggttgattcatttgaccattacggggtcagccattcatacaatctgatcctagggaaatcagcgaccataggcgatcatgaagtccaggcattattttatacaacgttcacaatgaacagcttcaggtttcgtaaaaccggagctccatcatggcctcctgatgcttgggtgaataccacgctgtggcctttgctgaacccaggactttgagagcccaatcaattgcga

SEQ ID NO: 10141 - DNA, 511 bp, Zea mays
  Clone ID: LIB3279-202-Q1-N6-D3
tttttgattagggcattaaaacaaccaaaatagcacaaaacatagtcactgcagttctgaagcgtagaacaatccattgaagaccggaacatgctcccaaatcatcctgctacaaaacttggtacagcaaggtaacaaacaaaggtttcacagtttgatgattttgacaaatgggactttcgctgcaccgcagcaccttacgccttgagcttaccaaagaacctctgcttctcatcggtagtctggaagcgaccgtgcccaaatttggacgatgtgtcgatgaacttgagcttgatctcctccagcgccagccgggaagtctgcttcaggagggactggcggagggtcaccaccctcttctttggacccacacagcatcccttgatcatcaggtagtcacccttcacgataccatagtgggggaagccacccatgggagtgatgtccttctcggtcctgtcaaactctgtggaggcatcgtgggtctcttgtccagccttgccgatcttgt

SEQ ID NO: 10142 - DNA, 547 bp, Zea mays
  Clone ID: LIB3279-202-Q1-N6-D4
gatgacaggcatctttcaagcaatgcagttaatgtggtgaaacaatgccgcagagatcaagcccttcagagattgatcagagctgacatgagctgcgatcagagctgatctcaaatgtaaaggacagtacatgccatgccaagtgaccacagaaataaacatcaaccagggattactgtgaaattaaatcatacaatacgctccagctccctcgcatagctgagcgtctggttgatgagctgcaaggatgggatctccttgtagggctgtgactcctttgccttctggaagaagacggcaccgttcttaagctcccattccgggtgctcctctgtgatgtactcgtgcagatcttggtcagaactgaacataagcatttgttttgcatcacttacagatagggaatcataccccttttcgctgcacccagcgatctcatctctaactgtcttggcgagaaggtccatgaagtaaacataggtctcatgtggcacagcttgccgagcgcttaacactcggttgtaggcaccctccatgaaagattgct

SEQ ID NO: 10143 - DNA, 542 bp, Zea mays
  Clone ID: LIB3279-202-Q1-N6-D5
cacactgaacacctgagtttattcattaggttatttgttatgtttgtgtttacatccatctaagacaatgataaacatcaggatttgaacaaaagacccacaggcttatagatgctacaagttacagatttgacataggggaatgcttagccaggaagctgaacatgcagaagttgcagatcatggcggccccatagtgaagcaaatttcaaaatcctaaacaacagaaacacccctaacaaggctggcttgcgtacagcagaacttgcactgaacaaatgctgacaaacatgtgaaaacaattgaatcaacaagaagcaagcatctagagactgcggccacaatcttagttgtccacggcaagcttccgcctcttggagttaaccatcacctggcccttgatgccaaccaccatggcgttccagtcgttctctgggaatggcgataccagctcatactcaaagttccctaataaggtgccttccaaattgccttggatctagaggtaggcaaaagggctcaccgaggcacccatgcctgcc

SEQ ID NO: 10144 - DNA, 260 bp, Zea mays
  Clone ID: LIB3279-202-Q1-N6-D6
aaaaggcacaataagaatacaatgggccgaaacgcggcctgtttatgtacaaacaaactgaccgaatctgctgatggaaaagcactaacttagaagcttttccaaatcggggttcctgaagctgccaccggtaagtgacaggaggccaccaccatggaccctcgcctcgggaaacaacaagacctgcctgtctggctgcatgtacagggtcagtcggccaaagagggataatggagggaggaaccagggcctggggggga

SEQ ID NO: 10145 - DNA, 291 bp, Zea mays
  Clone ID: LIB3279-202-Q1-N6-D7
gaaataaacagaattcctacataccaccgctcttttgtttatagttataataacattgcctactgtttattgacatacattcgatgttacacaagtcgctaatttctttacaacaagggttgggtcaagccatagctccccgtgtggtgaagccaattcataatacacgcatcgcatgaaagaatggccgagcacaatgcacgatataatcaccgaaaaaatcgcatctgctgaagcacaaatttgctcttgtaactacgtagcctacagaagttgggcactgccaaatgg

SEQ ID NO: 10146 - DNA, 398 bp, Zea mays
  Clone ID: LIB3279-202-Q1-N6-D8
gcacaaaagttgtcaatcatgggggtctcaaattgatgacagtaccataggtagttcaagtttcatttccgtttgccatgttcaagccgagcaaataacactataaggggaaactaagacaccaataggattattggaagcgttggttttaagctaaccagagcaaacggacatcggacttggttgcacattgaacaaagcttctggagatactcattcgttcatcacaggcttgttctcgttggccttgggcctctgctcctttggtttatgctcctccattttcctcttgtcggcgccgcccttctggctgaggaaggaacggaagaggggggagttcacgtcgtaaatcatctttttttcgacgccgccgcccacgcgttacaaggacccgtggg

SEQ ID NO: 10147 - DNA, 121 bp, Zea mays
  Clone ID: LIB3279-202-Q1-N6-D9
ttttttttttttttttttttttttttttttttttttttttttttttttttttttttttttttttttttttttttttttttttttttttttttttttttttttttttttttttctttttttt

SEQ ID NO: 10148 - DNA, 557 bp, Zea mays
  Clone ID: LIB3279-202-Q1-N6-E1
aaagcatacttccgcatcctgaaacaggccagaaacgagagtgtataaccagatggcgagtagttgagacaggaagcgcaacactgacataggccaagttgaaatcatttatactttcttcacatgattcacggatgggcaagagatccacggcaccgcatactccttttgtgtatttcccccttttttgcgttcaaaagatataaagcagtcgaaacatggggcgcaaagggtaacatctctagaactccagcattcggcctctgaagatggcctcggctttcctgacttcattcactgctccaatgatgaaaaccctatctggaggccccttagcaccaccaatatggatttcaacattgcaagattctttcacaaccattatcgttgacccctttctgccaataactcgtcccattttcccatgaggaacatctaagactgataggatatcaacttcaggaacataaacatcagcttcaatgccatcaggaacaggaggaagaggtgaccaatctgcaaactggttgtcgtttaagcaaaagcacctacagtac

SEQ ID NO: 10149 - DNA, 563 bp, Zea mays
  Clone ID: LIB3279-202-Q1-N6-E10
aagacaaaaatatgaacttaactgatttcttggttcaatcgaaccagataccaaatagcatctgctacacacttccttttttcttatccacatgctggtggttgtttaccggagttaccgtttccccttccagtgaaactcaaaagaaagcagcaacggcaacaacacaggccagtccgctggcaaagcttctatggtagagtaacatttacagttcttcctaaacctgtacatatattacagacagttgtgtcaagtttgagaaacacactgcttgttctgtttagctcttcatcacatcatggcattgcatccatgtacttcctgcagtggtcctcagatgtctccattgattccaaatatgcggaccttgtgcatgtttggcaattttgccacaactagcacaaaaactgccattgtattgaggaaaaacatcggctgcttgtagtcagtcaagtgcgatgcgatcagatacagcaccacaggtaccacagtcaaaaactttctgttccgagtaagctgctgaccattgtcaatttgctcccaccatgtcaatctgctgt

SEQ ID NO: 10150 - DNA, 566 bp, Zea mays
  Clone ID: LIB3279-202-Q1-N6-E11
caagctagagctgcagcccttgtattgaattgtattctaggagagtgtcagataccagggccgttacaagtgcattcagaacatccatggccagcaaaagatcccggttctatgtgcccttagtcacccgacaacgataacctatcggaaattccaataacaaattccaggaccagtagttgatttgtgtatcgtataataaaaatactaaataaatgccacttaagcatgatggaatcagttaactgtccttctcttgagaggcatttagacgactcttgatccacgactcaagataaagtagctcttcttgggaaagcgaatggcccaaatctggatatgccttgaattcacagttaacacccgcgctttgcaaaaacggtggaccagcctggccagcttcaaacaatactactttgtcagccattccatgtgaccaaagaaacggggtcttcctcgcttcaggtgaaatcctctcagtgactgatgaactgaaaggcacccacccactgaacactgctcctccacctaactttttgggataaagcaaaacgctagctaatgtc

SEQ ID NO: 10151 - DNA, 567 bp, Zea mays
  Clone ID: LIB3279-202-Q1-N6-E12
gccaattgacgtgcattattaccttccccaaaaaaatcaataatgattacatcaagtatgatcattacacagcatcaacaacacgctacagctacaaccctaatgtcctatttgtcggcacaatcttgaccattagtttcacctacagctacaccctaataaaaatatgttacatgggcaatccaatcagtttcccagaaatcaaacgatacaacagatttcacaaagctccctcatttagcagcatttccctgtgatcatatcgcggtgatctctttacatggaaattatttttacacgacccagaaaattgttagctattactggcagtacaagggtcagacgctagggacggatacacttgcgctgtttatgtggactttgcccagatgttgtgataggtggcatgctgttattcaatgcgaaaccaaatttattgcttccttcccgttaggctttggcaaaggactaggctgatggtatgggactgaaaaagcatactggtcggtgtatgtgctgcagagccagaactggaggccgaactcaaagtgggaggtgacaaactat

SEQ ID NO: 10152 - DNA, 378 bp, Zea mays
  Clone ID: LIB3279-202-Q1-N6-E2
aaatggccatcgcatttcaattagctggcaaacgacccaaacaatacaatagcttttgcttaatattgcaaaacactggggtagcgggttcaccacgggggccgcaagacacaaacgagaagaaaatagcggcagagcacagggctcgcaatcatatacggccctttatttaaccgaccacggactcacgggaggacgaggcacccttcagcgacgggcagaggggtaaccttgacaggaacataggccgtagggccctcaccggcgctggcttcctccttttcctcatcatactgaaccaggccagcagcgctgaaaatgtaccccttcacttccttgaagcgctccttggagagagagacctcagcgaggagtttc

SEQ ID NO: 10153 - DNA, 537 bp, Zea mays
  unsure (1)..(537): unsure at all n locations; Clone ID: LIB3279-202-Q1-N6-E3
aatctcaaacaatcctcctgcattcagattattgcagttcatcgtcgaaagcatgtcgaggaatcctcaaatacatgaatagcttacgaatcacgagaacggtttcgactacgcattttagtccgaagatcctgatgcgacacaggaacgagcgccgcgcgagcctaccacaaactaggatagagttgctgatactgattcctacgtggaacctacaaaatatcagtccaggagcggtgacctgcaccggatacaagcgacggggagttcgtcttctgaagacgagcacggtggtgcatgctacagatgacacgggcgaacatgcgagcacagtagagcaggccgtcgtgaacagtgctacagtgtgccgcagaatcgtcatgggagccagaaagagctccatgtatcgatttaagataggtagctaagataggtagcgtggatcgtttcctggctttcccatcttatgcacatcctcaggtgaaagtatcttgatgtaccatacactattcacaaatgactnccnacggtcgtctc

SEQ ID NO: 10154 - DNA, 522 bp, Zea mays
  Clone ID: LIB3279-202-Q1-N6-E4
tttttcaagtaccacataactaaagatagccacatgcaacatcattatttgttccgtttaaaccgtggcacagaaatttaacgtcggacaaaatttaaatatgacaacagcagacaacacaacgctcggtgacagcagcagctgggcgcccttcacttcccaccgaggcttgggaactgagcttgatcttcaatggatggagcagcagcagctgggccacgactgtatccccctccgtatccgcctctaaaaccaccacgatccccacggccccttccacggccacggccgccgtagtacctttctccttcagcaggtttcaggaactcgttgatgctcaccgacttcttggcacgctcatcacgctcagcattttccttcttcttatccttgtcagaaccctaagagaacaaaagaacatcggaagaacccgtgcaaagctcagcaaacttaaggtatcaaagcattaattacagggaaactaaccagcttaatgaaaacttcatcattttcttttcttgt

SEQ ID NO: 10155 - DNA, 453 bp, Zea mays
  unsure (1)..(453): unsure at all n locations; Clone ID: LIB3279-202-Q1-N6-E5
aaaccataaacagatttttgaagtacctataatcttttcagcattgggcagaaacgtaaaaccctagggttatgtcctttacacgtacacatttatctgacctttaaagaggaggtgcctacatacatctgacgagtgtaataaacgatatgtgtggatatagctggagagagacctttaggacccaatccatcaccatctgcaagtaggacttgttgatcttaaacacccgaccttttagaaaacgatatggacttgaccggtctcctacagatcaacttttctatacggggctgtaaatataacaccattagaaagttggccgagacccaagcttgactatcttgcatcagaagacctcntggatctcccattagaccccacatgagtggaaatatagaggcaccattcacttccacatatgatatgggttcagcaatagataacaacatc

SEQ ID NO: 10156 - DNA, 506 bp, Zea mays
  Clone ID: LIB3279-202-Q1-N6-E6
tcgcctggtccggatccagcgccttcgttgttgatgacctccagcttggtgaggttgatgttccgggaggagaaggccgagagcaccttgagcacgaccaccatggagccgccccggtgcgcgaccaccatgctggtcttggcgtcggcgtccacgcccagcgccacgggcgacggcggcctggagaggagcaggaatcgcgtcacgttccaggactcgtcctggagcccgtgcgcgaggacctggagcccgtacaggtcggcggcgcgcgggctggcgatggcggctgtgtccagcatccgcttggaccgcagcatctccacggcgcccgccgtgtcctccacgggctcgcggtccaccccgaggcgggccagcgcgcgcccgcagtgcgccagcgccatggggtggctgatcacccgccgcacctcggcggcgcgcaccccgggcatggccagcaggcagtagtgcacgaacaggttgatctcctgcaccaccaccaggccgtg

SEQ ID NO: 10157 - DNA, 463 bp, Zea mays
  Clone ID: LIB3279-202-Q1-N6-E7
ggcaacaaaacaaagaatattattcataaaattctggcatgcataccctgggaccagaaacaaccaccaactgcagtacttgaaaacgcttttgaattctccaggatttactaattcagcagattaaaacatgggcaaaaccaaaatgccaggaactgcatgtccagcttccatgatatgcactcaaagggtcaagcgatctcactagcattagctaacagtatagccctatttcggcctgcagataataggatctttgcactagaggacatcaatttccttcgtacttggggtctgccatcacgaaggggtacgcaataaccaagacaaagattaagatgcccaggaaattggcaaaaaaacccaagtcttgatcggaaaacattttgcccgccgggccgccttgcctttcctttgccttgcctactgtgtgtacaaaagtggttttggtgtggtttgaaaa

SEQ ID NO: 10158 - DNA, 445 bp, Zea mays
  Clone ID: LIB3279-202-Q1-N6-E8
aagtgcaaggcaatttttttaaggaatgacacacagcagcatcttaacatggtttgctcagttctaacaagtctcaactgttggaacatagataaatataagctgggactacgagcaccaacatgccccctgacagaacacaaacttagcgcttaggactgcctgttcttcttcttgacaccggacttggcaacctggaggctgcggtacaccgagcttagcctaacaagagctggcttggtcaaatcaggcctgtagtagttgtcactaacctggtttttcacagccttggccatcttgcggaactccttgcgcatcacaaacttgtggctgagcttcgcaggtgcgttctgcttcttggtcttggtagtagagaggaccacagccgagtcctttgcagctggctggatcgtcacagtcttcttgttcgccaaaccccattgtt

SEQ ID NO: 10159 - DNA, 477 bp, Zea mays
  Clone ID: LIB3279-202-Q1-N6-E9
cacgttattatttggctacacctccgtgttcattattcaccaaggataaaaattaaatccacttagcccaggagcatccatccaatcttaacccgcatccctccaaccttaacccaataaataacctttgcttaacaccgccaaaaccaacatggctggaagtgtcaccttccttcagctacaaattgtttcattaatacatggtaacaagaataaactagacaagggcatagggtttcaattctcttagaatagcataataaacagtacggtaattgcagaatggtagtgcacttaatctgcccgggattgaccagcacgggatgaaaggataattccaacaatgagaccgtacagagcaagcgcttctgcgaaaatgaggatgaggatcatgcccacaaaaagcttcggctgttgtgcattcgccctgactccagcatcaccaacaatgccgatggccatgccagctgcaagccc

SEQ ID NO: 10160 - DNA, 505 bp, Zea mays
  Clone ID: LIB3279-202-Q1-N6-F1
atagaaaatcttttagagttgcctgtcatatatagaaggtagcctgatgctctagcggcactagtacacattattagccacgcctagggcactagtacacattattaaccaagtaaatataaacttcagccagatttacagcctagactgcacccctccagcaacaacaatggtttcagccgtaatgtatgatgcgtcgtcagatgccaggaaagccgcagccgcagccatgtcttccacagtacccaatctcttaagcttggtcctctcgttaagctctttcctaatggtctcattttctgtgaggaaactagcaaaccgtgtaggaacaaaaccaggggctatacagttaacacgagtatcgggtcccatctcaccagcaagagccttcgtgagaccaaagagagcagtctttgtgacaccatacattgtcaatccttgttctggattgtaaccagcaattgaagaaataataatcacagatgaccccttccgtaggtgagga

SEQ ID NO: 10161 - DNA, 522 bp, Zea mays
  Clone ID: LIB3279-202-Q1-N6-F10
aacccaaacaaagagacccatcaaatatccagtcaaacagcatggaaatacaaagcccaaacgaattggagccaacatacgctaagtcgcccaaaggaattagggagccaacatcacggcagcaacagggtaaaccaggacctagagatagttttgactcctaaataacacaatatattgtacccaataaaacattccaaaatcatagtacaacgttacaaaaatgtgtagtcacaggaaaataactaacaacattttaggtggacatagtaacaacatatttagccttgttcatctaggactcctgcaaattaagctggtcgcccaagaccaaaattcatggcttctttctttccttcttggccgaaacaataacaatcaacactcatctgatctcgcaaaattatacagctcaaaattgtctgttcctcaattccttgacacctaaactatagagagtacacgagaccgtctttcgcaagatacagaatctgaaaagttgataggccaaagctgctagga

SEQ ID NO: 10162 - DNA, 587 bp, Zea mays
  Clone ID: LIB3279-202-Q1-N6-F11
aggctaactctttccttattaagaaacatactgtttttgtgccgcctacaagggcatctgatagtgccggttaatgacaaggagaatacgtggtccacaaaatctttggtcttggctacccaatcatcaaatgacgtccattcctactccagccattgtacatccttgcacggtcttcagccatgcctgagactgttaaaccaaaccatatcgtgaaaacattattcaacttagtcaagggtatcagtcctacatttataggcaaggataggttctaaacccacaacaagctagcaggatcttaaaaacattcggcagcataacctcgctgccactaaacaatatattacttatatataaaacaaagaatgatataatattaatcaaatcaaactaagtaccacatacactaataatgcaactattctacgtaccaatataatgtactattaaaactaataatataatagtacataccacatattaatatgaaattaatgcctaaatacaatatgcccctaatcctaaatcacatataccactaatacattaatgaaatcgaactaaacacatatactaatcataaa

SEQ ID NO: 10163 - DNA, 488 bp, Zea mays
  Clone ID: LIB3279-202-Q1-N6-F2
cccagacagggatatgttgcactcaaaactgttgttaggacaactgcaagccagaccatccgtcatgtccagatgcatgatacatggcccaaagtggaggcagcaaccaatgtgtatactactccattccgctccacctgagccatcaattctttcaatggatggatggcaggtgaacctagcttttttccaactgcacccgatacacacccccaactgcctccaaccatttttgctttgtgccagggcacttttcccgatatacttgcaacatcagctacatgaagtagcttagcgttgtctttttccttgacccgccttctccatagagatcattccattgcacaagctcgttcatgttactggaatctgaggaaacacttgcacacacctgttcatgcgcatgtatgaaatcacttattcttaatgcacggacatcattgctagtgtgcgacagaggcaatggcctattttctgtttctgctgaa

SEQ ID NO: 10164 - DNA, 438 bp, Zea mays
  Clone ID: LIB3279-202-Q1-N6-F3
aaaatgaaaaattcttttgctgtccaccacaggaaaaccaattcagtccgggaaaatgtgtcaacactaattagcccttggtggggtagcaacaaggaaaacatttggctaccttttatttaaaactgcatccaaaggctttgcaagaatggcttgacacatgggttacgaaatgttgaccccgtgccatatagtttttccgacattcaaatccctatttacaaagaacaccattactttgcctcaaatttacaaagaattacaattgttggtatttctcaaaattgttatcgtatctattgtaattccataaacccactctttagtctctccattcgtgcttgcagcccaaatagagctcgctcatccatggggtgggtattactttgttggtgggggggttcaccgtccaatcgagttccccatgcaccatttact

SEQ ID NO: 10165 - DNA, 363 bp, Zea mays
  Clone ID: LIB3279-202-Q1-N6-F4
ttttttttttttttttttttttttttttttttttttttttttttttttttttttttttttttttttttttttttttttttttttttttttttttgtttttttttttttttttttttttttttgggttgaaggcgggggagattaaaaaattcaaatccctggaaaagggggggggggggaattagggggacgggaaaacccctgaaaaggggggggttttgccccgccgggggtgaaggccgttttttaaaaaaaaaaaggggggggggggaaaaaaaaggggggggggaaaaaaaaaaaaaaaaaaaaaaggggacacggggggggttagggggcaaacccgcccttttgaaatgagaaggg

SEQ ID NO: 10166 - DNA, 461 bp, Zea mays
  Clone ID: LIB3279-202-Q1-N6-F6
aacagactgatctaaacttcgaatcattttaacaaagcatgacagtttttttcacgactgccttgcttttctatctatgagagctgaaatcaggacagcacagcacagcatccgatcgacccttgctgcctacatgggtcagtagatatcatcatggtgctaacattgcaaacagaatccaggtctaacggaagcgaacgcaatggagaggaactgtgaatttgtccacaatcacaagttcattcctcgatgcccatcgtgctatgcgttcaacacaaaatccagcctttatccgtcagtaaaccagtttgaccatgtactcttgtcacactgcctgcacaaacactccaccgctagagttcttcggcgaaagtgaagtttctgcactgaaacatgtgagctcaatcgggaatctcgtcagttgcttgggacctccacgatgttggataagaagctcctta

SEQ ID NO: 10167 - DNA, 339 bp, Zea mays
  Clone ID: LIB3279-202-Q1-N6-F7
ggtcatttttttttttacttgcttgctatacaaaaggaacttctacagttgagccacactatccactagctcgaaccaccgttacttcgacttgaaagagcagaccacgagtccacgacagcggcggcagccaggagcaaggctgcaagaggggcagcagccttcctgatgagttcccccagcgaacctagcgaggctggtggatcacgcggggggcgctgctcttggggctgccggcgtacttggtcggcttctcggcgttcctgggtttctcccggaacccccgcggggcgtcgacgacacccttcagggaggaaatgttcaacgccttgagcaccg

SEQ ID NO: 10168 - DNA, 524 bp, Zea mays
  Clone ID: LIB3279-202-Q1-N6-F8
gaacaaacagcaagtcacaattggcatttcttcagacacgcacaacatgcttgatctagtggtacagtaaccagcattttcgccacccagccacaacttgcgaattgcaaaaacaatagaaccgcagcgacgacaacgaggcgcgaccggcctagcctagccgccgaagccgtagagggtgcggccctggcgcttgagtgcgtagacgacgtccatggctgtgacggtcttgcggcgcgcgtgctcggtgtaggtgacggcgtcgcggatcacgttctccaggaagatcttgaggacgccgcgggtctcctcgtagatgagcccggagatgcgcttcacgccgcccctgcgcgccagccgccggatcgccggcttcgtgatcccctggatgttgtcgcggagcaccttccggtggcgcttcgctccgcccttgcccaggcccttcccgcccttgccgcgccccgacatcttcgccggggagactagaggggatcgaggagattttggcttgctgatggtggggt

SEQ ID NO: 10169 - DNA, 413 bp, Zea mays
  Clone ID: LIB3279-202-Q1-N6-F9
gggacaaatataccttttaaagtaatatgtgacgtggcaaatttggatattgtgacaagaaaccataggttatgaacagccttaggacaactatgtaacatatatcagacttgcttactgctggtttccaggaaggaacaaattccaatcatttgctgcctgagcattgtttcaaagaccgatcaaaaccctgtttagttccacctttcaagtcaaggtatctagagccgtaaagacagtacagctaaaatgtaagcgataacaagtagagtaaaaaaattcactcgcagatgatatgcaaattcgaatcaatgttgctgcttcatccacaataatagatagctcatatgcttgtaggatggctgatttaatacaccaattgtgtgtacaactttaatgcttgaaaatatgtt

SEQ ID NO: 10170 - DNA, 409 bp, Zea mays
  Clone ID: LIB3279-202-Q1-N6-G1
gtgtattattactatttttattttggtgctcaaatctaaattgcattttatttctgcaattgatctcatgacagggacgcccacagcgcgccaaatgttccagtatcatatatgcatagacaggtacagtgtctagcagccacaaaggtggtcagcagcagggccaacaaatgaaaaaataaactacaacattgcaggatcatctgcgtcgacatattttattactgcagaattgatcccagcagcactaccggtagttacggtagacaggagtgtacatgcagctctgtgcatatttcaccaggtcccttgggggaggcagacgggtcgccaaaccgagttcataagcttttgcagccacggctgcggcaatgcgcgcagagatctttctaatgttggtgaagggcgc

SEQ ID NO: 10171 - DNA, 572 bp, Zea mays
  Clone ID: LIB3279-202-Q1-N6-G11
atcaaaccgtaaggattgagagggattgaatcccctacaagtcaaaacctcactcaatccactccaatcctgatgaattagggatgaaaccaacagtcttatgatttgttattacaaaaggagcaaacccacacacaataagttggaatctttctagaatctttttttttttgcgtaatggttgcaaataagtctggctagagacagagaacaaaggtttgaggtttctaaattacaaagcaaatattcaatgtcccaaacatgcctcagtccaacagtagactatctttcaagaacgaaccaactttattcaactttcctgggttctgctttgggcttccagagaccaagacggtacttgtgtgcaaaactcaaaatcaattttctatgcttgcaggggatgccgagcttcttgagccgcagcgtgcgggcctcaaggagcctctggaggtcgccgcccacagcctcctccagcttcgcggcgtgcgcctccacccctttcccgacgccgttcaggaactccaccacgcccaccttggcatggtagggctgggcgtggaaagatctcccct

SEQ ID NO: 10172 - DNA, 387 bp, Zea mays
  unsure (1)..(387): unsure at all n locations; Clone ID: LIB3279-202-Q1-N6-G12
gaaaaaaaaagggaattcgaattacccaatcgagcgtgccgttcaacgggaacggattgtttcgccggagattacacgtgagcaacggtccagtaggccggcctgagacagccggtttgcaactctcaggtttctctattaggtcttgttcgtttgtgccggattagtgggtcggaacgatttctaaccggattatttctctaatttatataaactttgattagctggaacgattccgggtagaatccgatagaaacgaacaaggccttagatgacacgagtcactatgaccggatccaccctnccccccccncccccccaccttacttactcactcactcacttgtggttctcacgctggctttttccctgcttcgcttcgttggc

SEQ ID NO: 10173 - DNA, 412 bp, Zea mays
  Clone ID: LIB3279-202-Q1-N6-G3
agtctcaacactgactggaattacacagaaaaaaagaagcaaaagagatgcctaccaccaatgcaaaaaaaaaaaaaatcatgtatctacaaagcagagcagagcagagcaggagaagaagaagaagcacaaggttgtgcacatggacgacgatcccatgtactgctttcttttgtacctacagcaacgaatgtgcgaaaacaggcaagggagggaccgggagacgagagacatttgagagacacatggatgcatgcatgcatccgatccgatccgatcaccggccatcggccgaggtgaaggactcggcgaagccggcggggcgggcggggatgctgcccttgctgtcgtccaggctcatgacgctcccgccgccgtccgtcaggccgacggcctccgcgtcctgccagct

SEQ ID NO: 10174 - DNA, 456 bp, Zea mays
  Clone ID: LIB3279-202-Q1-N6-G4
gcaaagcttctctccacatatgtagagatagcaagtctctgatcagtgagtgaatgttacaacaacgtacatctgttccattacaccataatgttactaccacaaagataatagtttcaagggcattctaaggctcatgccagactacgagaatttcagctgcagcttctacagaaagctcggggtgggggcggttcagggttcagcgactatagactatagaatcgttgatgtgcaatgcaagttccaaggaaaaaaatgtccagatgccgctgattcaacaagacgaatggaatgttccattttctcagtatcagaaacgaggaaaggtatggctttattatcagatcctagagaaacacagaatggatgatcatttcccataagggtggtatctgctggagccccgaccaccagggctgccacccccacccatgcctccagcaccaccgtaac

SEQ ID NO: 10175 - DNA, 523 bp, Zea mays
  Clone ID: LIB3279-202-Q1-N6-G5
aagagcaatgaaaaccaaggatctattcatgctgatgtaagaactaacaagtcatcgttcattggcattcagacatttggttcattaaggtggactcaactctgaagtccgaacaaaagagcaggaacgcagctaagctcgatgagttcgaaggaagcaaaaccggaaacaactaaggagtacttgaagaactggtcctgagtctctgaccatcagaaagacgcactacccttgatcagtttcaacgaagcagaaaacaaaatgacgaaagaatcctataagaacatcttcacgaactgacccagttcgagatcgccgcacacaggacgtgctgtgtcaacaccgtcccatccaggcttgatcacgcacgcgtgtctactgcgatgacggcgcctcaggtagtatctcgtcgtccgccggaagcggcaacacctcctccttgtccgacgtcgacgtccgcgggtggcgccgatgcagcgatgctgatgacgacgcttgcgctagtttctggatttgctcccaa

SEQ ID NO: 10176 - DNA, 333 bp, Zea mays
  unsure (1)..(333): unsure at all n locations; Clone ID: LIB3279-202-Q1-N6-G6
gaactaataaatcaaatagcagtataaacaatatgtngaaagtggagctaacattttttttcctaggtgtacagcagtaggacttttttctttacccgttgaccaattttctttcctaaactgttgcacttatggaatgaatcggagaagaatcccaataacctcttcgtgattggattgtttctatatggataaactgccgcgatccacatcagatgtgtgtgtgtctaatgcgagaggtcttgccagatcacgcatgcacacgtgtggggcgcaccgaccggtgctgatggttagaacgcaccgggcacacatgtgggctacaacaccacc

SEQ ID NO: 10177 - DNA, 226 bp, Zea mays
  Clone ID: LIB3279-202-Q1-N6-G7
ccaaccccccattggggcaatttttatgtttttttaaaagagcactgaattcatccatccccctttagctttcaagctgcaaagggggactgatggggttaaacaccccaaaggtccttgccatgcaatgcggccaacttaaaagctaagaggaggcccccaaccctatttggttgctgcccaaaaacataggattaacctaaatgcttgaagatttattttaaac

SEQ ID NO: 10178 - DNA, 569 bp, Zea mays
  Clone ID: LIB3279-202-Q1-N6-G8
agggtcggtttggttctaaccgactaaattttagtccatcacatcagataattaaatgctagttaaaagtattaaatataatataactataaaataaaacacactgataaagactaaacggcatgattagatgctagttaaaagtattaaataatttaattagtacatgatacgttcattcatgtagtttcagaccaagaggctacgcgtgccggcgttcctcggcggcggggagatggccatggcctatgaacgaggcgacggcgtcgtcgaacatctcctcgacgcccttgaattccgccagccccagcgcgcgggccttggacgtgtcgaagccgtacgactgctcgccgtaggcgcggggcaggctcctcgggacggggtacgctgggaaccgccgcgcgagcagggcggagaggtcgccgcagtccatcaccggcgcgctgcagatgtacctgcctcgggcgcccgcggcctcgtacgccagcatgtggcacctcgccacgtcttcgatgtggacgtaccccatcctcccgtacgtagggaactttccagtctctccttggaac

SEQ ID NO: 10179 - DNA, 475 bp, Zea mays
  Clone ID: LIB3279-202-Q1-N6-H1
aatgacaatgaacacaattattccttgtcgattgaacaatagtttacatcatggtacaaaccgaaaaccagcgtgcgctcacatgcatccggacacctaaaggtcaccggcggcgcctccctcacttgccggggacgaagttggtggcgtaggcccaagcgttgttgttgacggggtcggcaatgtggtcagcgaggttctcgagcgggcccttcccggtgacgatggcctggacgaagaatccgaacatggagaacatggcgaggcggccgttcttgagctccttgaccttgagctcggcgaaggcctcggggtcgtcggcgaggccgagcgggtcgaagctgccgccggggtagagcgggtcgacgacctcgccgagcgggccgccggcgatgcggtagccctcgacggcgcccatgagcacgacctggcaggcccagatggcaaggatgctctgcgcgtggatgaggctcgg

SEQ ID NO: 10180 - DNA, 571 bp, Zea mays
  Clone ID: LIB3279-202-Q1-N6-H10
gaatgtacattagcctcgcgaaaataggccttcactatcttaatcttttataatgtcaccttgtacatagtgctctcggaagaagaaaggtgttgctaagataacaaagaattgctgcaattcctctctatttcattttgctgcaccatgcctcccccctctaaaaagaatattgtcgaaaacccacacagagcatgaagaatgacgaagttgcaaagcccttccaactaaaatacggacacagaccaccaactgacaagtgaatcaacagaccaggcaaaatcgcggagtcctttcagacgtataccccaaaccaaaggtggtaacctgagaaaagccagagacttcttaccaacagtaaggcagatatgtcattggatatgacaagtctcacatgtatttttactcgggaccacgcttgcttgcagcaaggaaccatgaatgggcatgaatgggcctggcaacggctgccacaagtgggtggcagggcctcgggaaccacccaatggcagggttcccaagtgccatggattgggagggcgcaaatacaacgggggatgtggccttggga

SEQ ID NO: 10181 - DNA, 489 bp, Zea mays
  Clone ID: LIB3279-202-Q1-N6-H11
atatacacatcgggcacgggacaacatttattaattcaattatctttgtcaacttaaaatcctgatataagggtaaccgcctaatcatgctgacaacattcaaagaaccggggcacaccaaacccaacagtccaacatccgtttggttccacatcaaaacacggggtcaaaatacgagtagttgtacaggcggccaaactgaagcaggctgccatacattctatcccacacgccaacgaaaagcgcgtcagtgtctgggctgaacgatgtgccggatatttcgccaaaaaagtccaactcctgccttttgttgtagtcactcttcacgtcgtaaacgtgcacaaagtcagcaggttcagccatggacatgaactggccatcccaggtgaagcggatggaccggatggctccaagggtaccccttaacacatggacggattttgagagattcctcgcgtcccaaattcggcatgttttgtcttggttgcc

SEQ ID NO: 10182 - DNA, 368 bp, Zea mays
  unsure (1)..(368): unsure at all n locations; Clone ID: LIB3279-202-Q1-N6-H12
agcatcaaatatttcgtcaacatcgattataacgtcaaaacaaacgatgttcagggcatcgagtatttcatgggcaacaagttaactgtgccgatattatttatttcaaattcacactttgatgggactcaccagaaatttattctgctcagagcaagcgcattgctggcaaatgacacaagaaaccagtccctacccaccgcggcaaaatgtgaaatgacgttagccagggacagccatccttaccccttaacttgaggaggagcatanccttgaagagcaggatcagatttgacagcatttaatgccttgaagaactccttaggaagagcaacagcccggggcttaggaacatgcttaggaattgg

SEQ ID NO: 10183 - DNA, 279 bp, Zea mays
  Clone ID: LIB3279-202-Q1-N6-H2
cgtacgtaacttggaccttagagggcgcctttttttttttttttcctttctttttgcgactgtctcaaaagccgcttactaaaagcaaaattatccccaagaccaaaagtttacaaaacacagacatcatcccaaaacaaataacaagggaaaaactaagggatggtggggtaagcgctaaaaacccgttaaactaaggggatgctaggatcggaactaaagacctggtggtggaggtaactcaccacaatacgctaaactcgaggcacaaaggaaaaa

SEQ ID NO: 10184 - DNA, 440 bp, Zea mays
  Clone ID: LIB3279-202-Q1-N6-H3
gtaatcagttcatcacatgctaactatccagcatatgtccacactacaagtacccgatggtttcatcaagccaataaattaaacaagaatcctcatccaatgagctactagccttttacacataccacagaagggggtagaacacatgcattacaacacttgggggagggatattactgatcctaacttctgaacatactgtccatctagttgtttccctgatcctgcatcaacgacatcagcctcagcttcgagtacatttcgaaggaggcgtcggagaagtcggtcagagcacggaacagctctgggagatgtgccttcaggatcgagagggacttctccctgacctgctttgatagcttattatgggattcaatttcatcatcaagcttgctcttcaagctctgcactgcgaatctcttctcggtgactacatactt

SEQ ID NO: 10185 - DNA, 302 bp, Zea mays
  Clone ID: LIB3279-202-Q1-N6-H4
ttggtcaccttggcgccggttgggtccttcttctccacactcttgatgactccaacagcaaccgtctgcctcatgtcgcggacggcaaacctacccaggggaggatacgcggagaatgtctccaccaccataggcttggtgggaatcatcttcaccataccagcatcaccgttcttcaggaacttgggctccttctcgagctccttgccagatcgcctgtcgatcttggtaatgagctcagcaaacttgacggcgatgtgggaggtgtggcagtccagcactggggcatagccgttgccaat

SEQ ID NO: 10186 - DNA, 449 bp, Zea mays
  Clone ID: LIB3279-202-Q1-N6-H5
ccggataaaggtatattaatgttaccagcagacggtagctatgctggtacaagtcatactcaatcctaaatatgcagtgccgacaaaaccaagctacatgtgttatccagatacataatttttgccatattacagtactatatattaaaacaaggagcacctaagactagatactctggtacaaggtacgcgcttttcaaatataacattttgcttcatgcatgaacaatatccaaagggagcagacttctatttacactgttttcaaaattcccccatttacccaagttccagaacaccccccccccccttaaactagaacacatttatctgattttcagtcctaaaagtaaaatggaaatgcttatgtgctgcccatgggggttccttatgctttgatccattggcactgaaactgaaatctttcattttgtttacaacttatgcgg

SEQ ID NO: 10187 - DNA, 596 bp, Zea mays
  Clone ID: LIB3279-202-Q1-N6-H6
aacagcattaccgtgtattaggtagatttacggcatacaacaggcaaagttcgtccatcagtccaaagcaaaatgcgcagcaaccacactacaaaaaaccctcggacgagtgtatcaaactatatataaaacctaaggctaaccaccaacactcaaataaaatgaactctattcaaagtgctattccggcactagtaaataataactttgctagtgcaggttggtcacagcctctactcactctgggatcatctgctcattgtcggcatcaccctcagtttcaatttggggttgcttgggagctgaggctccaggagcctgcttcttcttgataccgatgacaatgtcatctattctcaaaagcatgcaagcagcctcaatcgctgtcttgaacgtctgcgctttaacgctgtaggaatcccagatctttcgctctttcatatcaacaatatcgccactcctttcatgaatgccaacccacgctttttcaccattagcatgctttccctggaagtgggtcattatcctaataacatttaaaccgcaattttggggccaaagtccttggaattgcctaaaagctaaagcagagctta

SEQ ID NO: 10188 - DNA, 414 bp, Zea mays
  Clone ID: LIB3279-202-Q1-N6-H7
ttatttttttttttttttttttttttttttttttttttgagaatttgaaacagatccaatatttcgggattgcatagtagtaacaaatacaattgatctgtattatccacgttcatgcaaccggtctaaattttggttgcatttttacctgccaaatcacaacagggggggtaactaaatgcatgtcagcatgagcctttctacagaaaatttaccttgctaattggaaggcactattaaaggtagtcaagagacacaagaaatggacgtattgcctttaaatacatgagttttgactgttgaacgagtgggatgtttccatatactctcccatctaccgggcttactttaactctgtattgtaatctgatggggatgctagtttaaaaatattttgaacaaggggtttttcct

SEQ ID NO: 10189 - DNA, 363 bp, Zea mays
  Clone ID: LIB3279-202-Q1-N6-H8
ggacgcacaaacaatagtttaatttatttccaagtcaaaatttcttgaaagaataacatgactctctgatgtactacaacaagccacgagttccattccatccaattcttccggacgcacacgggacacacaacagttacagggaccataacgataacgatgcaacaacatatctcgaccactttttaggacagccttataaaggcaccttctcacctgacgctactatgctcaccggaccaaaacctatgattcccgtcagaggggacacgtggaaggggagctctataactaactaactgctggatgacatatagggggaacgtaccatacactagagcgtacatgtaatgggtgtggaac

SEQ ID NO: 10190 - DNA, 186 bp, Zea mays
  Clone ID: LIB3279-202-Q1-N6-H9
ggaatactagcgtttgggtgcttgctacgtgattttattttggtttttttattcaaacttgggaaatatccggggtaaaatttgccttctgggcctgggacttacatagaagtctttttctgggtggtcaggctaaaggaaccatatggataatcccttcccggaccagggggtcaggccgggaat

SEQ ID NO: 10191 - DNA, 530 bp, Zea mays
  unsure (1)..(530): unsure at all n locations; Clone ID: LIB3279-175-Q1-K6-A1
gcttngaggatttagcagcgatgagaggataaaggtgatagctgcaacaaatcgtgctgatattcttgatcctgctctgatgagatctggtcgtctggaccgtaagattgagttccctcatccatcagaggaagcaagagctagaatcctgcagatccactcgaggaaaatgaatgtgaatccagatgtcaactttgaagagttggcgcgttcaaccgatgatttcaatggcgctcagctaaaggctgtttgcgtagaggctggcatgctcgctctacgccgagatgctacagaggttacccacgaggatttcaacgaggggatcatccaagtgcaggcaaagaagaagtccagcttgaattactacgcgtaaggggggaacgccccgtacttggtgatcattcagttgtttgtgacactgccattgtctgggcaggctaacttactatttgtactataagcaagctgttgcttttgagtcttactccgtatgagagtatcatttatgaaatattaaccaagtctgcctg

SEQ ID NO: 10192 - DNA, 669 bp, Zea mays
  unsure (1)..(669): unsure at all n locations; Clone ID: LIB3279-175-Q1-K6-A2
gtctccatttcctgcaaacagaaaagacagctagcgagaagaagcaatggcgtcggctcctgcgttctgcgtcgcgctgctgctgctgctggcttccgccgctgccgtccaagcggtgccgccccaggccggcacgtcgtccacctgcagcactgacctcctccgcctcctcccctgcctgcccttcatcgagggcaccgccaccgtgccggcggacacctgttgcgccaacctgggcagcatggtgcacgacgagccgcagtgcctctgccaggctctcagcaaccccagcacggcccccgtcgccgtcaacatgacgcgcgtgatggccatgcctcggctctgccgcctcgacctcccgcccgccaccggcgcctgcgcagttgccggtcttcttccccatggaccatcaccgccgctgccaccgccgccgccgccaccggcggtcactccacacgcaagcgccaactccagtgctccagcgaccctcaccacgccagcgacgccaacgccgacgacaccacgtatgataccgtcaccatcggtgagcagtcagacgccgccgcgatacagccggnggtccaagatgatagctgacggcttctctgtcactcttggtttcgtggcatttgtgtcagtcctagctntctgaagaattgggcggcattc

SEQ ID NO: 10193 - DNA, 635 bp, Zea mays
  unsure (1)..(635): unsure at all n locations; Clone ID: LIB3279-175-Q1-K6-A3
ctctcggctccccgtccaccaaaggagaaacgcgcagcccgcagcgctagccgtcgtctatctcgtctcctagtccaaggaaggaaagaggcgcttggcatgaagcgacctaccaagaatgagacgctgggctacccctggcacaagtagagcaagagccccagcaaccgagccacagtgaggaggactcgagggaagagatgggcaactgcggcacgcgggaggagaatgccgtcgtcgctgcgcacgcacaagttcaacagctccacttgttacaaaatcctgccaagaatgccattggagataggaagcacaaccgcacctcatcagatataagtgatccttccacacctaggaaagctgaagatgccaagaacatttccatatacaacgatgtgattgtcttcacattgtttgagctagagacaatcacaaagagcttccgtgccgattatgttctcggcgaaggaggatttgggaccgtttacaagggctacatagatgaaaatgtcagggtggggctgaagtcactgcctgttgcagtcaaggtgctcaacaaagatggacaccaagggcacagagaatggcttanccgaattaactgcctggggcagttaaggcatccaaacttggtg

SEQ ID NO: 10194 - DNA, 265 bp, Zea mays
  Clone ID: LIB3279-175-Q1-K6-A4
gcgcagcgcggcgcgggcggcgggcgcgcaggcccgcggagcgggggggggcgagggccggcggagaccccccgcagggggcggcagccgacgggggacgggggggggcgcgccgccctgggggcgggggcggcggcccgcgcgcggccgcgagagggccaaccggcgcggaggcggcggggggcgcccccgcgcgagcccgcgcaaggggcgcgcgcaagcgccggcgggggaagacccagcacgaacgccagaggagaagggg

SEQ ID NO: 10195 - DNA, 580 bp, Zea mays
  unsure (1)..(580): unsure at all n locations; Clone ID: LIB3279-175-Q1-K6-A5
gtagtatctggactgcaggtgcagaatgctattgcagcagttgcagctccacccaaggaaagcaatagtgtcagcagcaacgatcttggtagctcgtcctctgtgatttttccgtctggtccagctgatcaagtccctgttcctgctacctctccagaaattgagccccgttttgcaaaccaaatccctgctgcttcttcggaggttaaggcaccatgcatggcaggtctgttgtttgtaagcgacaggaacgagaggaactttaggttgcctagcccttctgataattgtccatggaacttattcgaatctagccgtagcgcagtcagctttctacaggagtatatgctttccggaatcgtgccactgaagttattcagcatgagatctatggttcttagactgggcatattgctgaataactatagttggtagatggtctcgctacagtagacaggaaaggcaccatgcctggcactggcaggtctgcagcgaacaccgttgtatgtgtatgtatagtatgcacgtgtgcaattcatattagcttaacagcctgtgtaacaaaaacaattacccanct

SEQ ID NO: 10196 - DNA, 655 bp, Zea mays
  Clone ID: LIB3279-175-Q1-K6-B1
ccctcgtctcgtgccactttctcagtcccctctagccgccgcctaccgctcgcgctctcctcgcgttcgggaaggtcgtttcgccatggcctcggagacggagacgttcgccttccaggcggagatcaaccagctgctctcgctcatcatcaacaccttctactccaacaaggagatcttcctcagggagctcatctccaactcctccgatgccttggacaagatcaggtttgagagtttgacggacaagaccaagctggatgcacagccagagctgttcatccacattgtccccgacaaggccaacaacacgctgacaatcatcgacagcggcattggtatgaccaagtcagaccttgtgaacaaccttggtaccattgcgcggtcaggcacgaaggaattcatggaggcacttgctgctggtgctgatgtgtccatgattggccagtttggtgtcggtttctactctgcctaccttgttgcagagagggttgtcgtgaccactaagcacaatgatgatgagcagtacgtgtgggagtctcaggctggtggctccttcactgtcgcacgtgatacctctggggagcaacttggcaggggtacaaagatgaccctctacctcaaggatgatcagttgggagtaccttgaggagcg

SEQ ID NO: 10197 - DNA, 136 bp, Zea mays
  Clone ID: LIB3279-175-Q1-K6-B2
atctttatggccaacatctttcttgtatcatggaatcatgtgtcccagcagtgctgggaaatcgagatcaagatgtatctttctttgcagtaatagaatgttaaaatcgagatcaagatgtatctttctttgcagt

SEQ ID NO: 10198 - DNA, 655 bp, Zea mays
  unsure (1)..(655): unsure at all n locations; Clone ID: LIB3279-175-Q1-K6-B3
gnagggattagcttaactagctttatatatatttaaccttttttggtaggttctacttttggtcgaccctatggatgaattggctatccagaatctgagctcctacaaggataagaaatttgtggacattagcaaggaagatttggatttaggtgataacaatgaggaaagagagaaggagataaagcaggagttcagccaagcctgtgactggataaagaatcgcttgggtgacaaggttgcacgtgttgacatatctaatcgtctcaggtcatcgccatgtgttcttgttgcagcgaagtttggttggtcagccaatatggaaaggctgatgagagcacagtctatgggtgatacagcctctttggatttcatgcgttcgaggaaagtttttgaaataaacccagagcatgagataatcaaggccttgaatgtggcatgcaggaataaccctgatgatcctgaagccctaaaggctctggatgttctctttgaaactgctatgatttcaagtggcttttcgcctgacaacccggcggagctcagtgggaagatttacgagatgatgacctctgccatcgctggcaaatggtcctcacagccacaggcgcaggcgcaacctgccgacccatcccacagcacgacgcacctgtga

SEQ ID NO: 10199 - DNA, 657 bp, Zea mays
  unsure (1)..(657): unsure at all n locations; Clone ID: LIB3279-175-Q1-K6-B4
cagctcccatcctctcgctcgccagnagaagcagccgccgttgctgctgccgcgtccacagaatggggggtttcgtgaagactcataagaccaatgcgtatttcaaacgtttccaagtgaaattcaagagaaggcgggctggcaagacagactacagggccaggataaggctgattaaccaagacaaaaacaagtacaacacacccaaatacagatttgttgtgcgatttaccaacaaggacatcactgcccaaatcatatctgctagtatagcgggtgatatggttcttgcttctgcctactcgcatgagttgccacgatatggtcttgaagttggtctgaccaactatgcagctgcctactgcactggccttctgttggctcgccgtgtgctcaagatccgtggtttggatcaggagtacgagggcaatgttgaggccactggtgaggacttctctgttgagccagctgatgagaggaggcctttccgtgctctcttggatgttggccttatcaggactacaacagggaaccgtgtctttggtgccctcaagggagcattggatggaggcctggatattcctcacagcgagaagaggtttgctggattcaagaaaggacgacagcagttggatgctgataccccaccgcagtaca

SEQ ID NO: 10200 - DNA, 273 bp, Zea mays
  unsure (1)..(273): unsure at all n locations; Clone ID: LIB3279-175-Q1-K6-B5
ataatttgaggggagtgctgatactggcaccaaaatatactcaactgacatgagaaataacgctgtgtctgcatcaagcttttcaagcattgcacaaaggtttcttgctaatacacttcagagaagaacttccaaatatactgatcttcctatgtcttctgagagggnnncaanatgctgnataccaagtgcaaaatctgaatctactctaaatcctgttgtagaaccaagtgaagcggtatttgcagaggaaactaagtttgagaacaaaac

SEQ ID NO: 10201 - DNA, 366 bp, Zea mays
  Clone ID: LIB3279-175-Q1-K6-B6
cgcggtctcgccccgcgatgtctctctcccccccagcctctttctttcttccggtctctactcgtagtcaccgtcagtccgtcaccaccctcctctaccccggccgccgaaccgcctgctctcctctgcgtcgtcagctgcccgaagcgctgtctcccgcctctaccccggctgctggaccgccgctgccacccggccgcccgaaccacccccacacgccctcctctaccccgtctcctcacggcctcgcgccctcgcccaacatgccagactgtcctcgcctctaacggttagaagcgaattaaaaggattgaagaagattaaatctcttattaatcaaaattaaataaaaataaatttaatttc

SEQ ID NO: 10202 - DNA, 628 bp, Zea mays
  Clone ID: LIB3279-175-Q1-K6-C1
ctccactcatcttttcgcgtttagaacctctaaaatttcccccactcgccagtcgcagcagcacctgtagccatggacgccagcggagccggtagcaaggggaagaagggtgcggccgggcgcaaggcaggcggccccaggaagaagtcggtgacgcggtccgtcaaggccgggctgcagttccccgtcggccggatcgggcgctacctgaagaagggccggtacgcgcagcgcgtgggcactggcgcccccgtctacctcgccgccgtcctggagtacctcgccgccgaggttctggagttggcagggaacgcggcgaaagacaacaagaagacgcgcatcatcccgcgccacgtgctcctggcgatccgcaacgacgaggagctcgggaagctgctggcaggcgtcaccatcgcgcacggcggcgtcctccccaacatccactccgtgctcctgcccaagaaggcggcggagaaggcggccagcgccggcagcaaggagcccaagtcccccaagaagggcgccaagtcccccaagaaggcttagaaagtagggacttcatttgcactgtgtgctgtagcatgctcgtgtctagatctgtggatgggatgtgtcctgctctagtttc

SEQ ID NO: 10203 - DNA, 650 bp, Zea mays
  unsure (1)..(650): unsure at all n locations; Clone ID: LIB3279-175-Q1-K6-C3
gcggttgtatgattatgcgaagtctgctaaagacggggtttcgaggtcataattgcaggtgcaggcggagcagctcatttaccagggatggtggcttcattgactcctcttcctgtaatcggagttcccattaagacttcaacactatcaggatttgattccctcctatctattgtgcaaatgccaaaaggtattcctgttgcgactgttgctatcgggaatgcagaaaatgcaggtttgctggcagctaggattctggctgcaagagatcctgagctccaggacagggtaactaagtaccaggatgatctgagggacatggttttggagacggcagaaaggctggaggaccaaggcccggaggaatttctgaagggaatggattgaccccttttgaagccctggctctggggcctgggagaggaatacgagtgtatgggtcggcgataactcactgtccactcgattatggtttaagatggggagtcatcaagaagatactttaataggctcggctgcattcgattttccttacaattcttttttgataattgtactatcttaacccatctcaacatgcccttttnccttctaatatagggtatgaattttgggtttagaggggggaaaaagatgggaataaacgttgt

SEQ ID NO: 10204 - DNA, 669 bp, Zea mays
  unsure (1)..(669): unsure at all n locations; Clone ID: LIB3279-175-Q1-K6-C4
cgcatttcgaaatccccaaacgnaagcatcgccactcttccgaacctgaacaatcaccaccgttattaagaagatgatgcgctgcgctgcaacgggcggcgggtgcgtcgcttcgtggagcggcgatcggagattgccggcggtcaacccctgcagcgtgcggatgccgacgggcaacgatgggtggtgcgccggcctgaggtcgcgggcggcggatctcgccggcctcgagatggccaacctgcgcggcggcgtcggggggctcttccgcgcgagcccgcgctacgggcgcttgcaagccacggcggcagttgaccctgaagatattccattggagaaggttcaagttaaatcctcaggacatgttctgccatatgttggcgttgcttgtttgggggctattctgtttggttaccatcttggtgtggtcaatggcgcacttgaatatctcgcgaaggatcttgggattgctgaaaatgctgtcttgcaggggtgggtggttagcacatccttggctggtgcaacactaggttcttttactgggggttctttggcagataaatttgggcggacaagacattcatcctgnatgcagtcccacttgctctaggtgcattcttgagtgcaacagctcaagaatccgcacatgattattggccgattgctgct

SEQ ID NO: 10205 - DNA, 662 bp, Zea mays
  unsure (1)..(662): unsure at all n locations; Clone ID: LIB3279-175-Q1-K6-C5
cttcgttccggtcaggcgagttagtcgtcgtgccgccggtgccctgtatccatggcggcggcgttgcgtgccgtcttgagaggcatcaaggagaaggggctcaccaacttcatccgcgacgtccgcgacgaaggatacttanaatgccttctggacgggaaccttttgcaaacgaaaattcacaatattggagcaacacttgtaggagttgacaagtttggaaacaaatactatgagaaactacatgacactcagtacggaaggcataggtgggtagaatatgcagagaaaggtcgctacaatgcatcccaagtgcctcctgaatggcatggatggctgcaccacatcacagatagcactggggataagctgctgaaccagaagactgctaggtaccttgtagagcacaagcagaactactccggtgagggtgaagagctgatctaccactccaaggggcatgctttgaatccgggacaaagggactggacgaggtatcagccctgggagccaaagaaagagcaagcctagctattgagtacattgtggggaagctactgaaatgtttgcatggcgttgggtcaggtatcaccgagctgaatggactctgagttatgtttgaactgngcccaaataatgttgtcctngatatcaatatcatc

SEQ ID NO: 10206 - DNA, 649 bp, Zea mays
  unsure (1)..(649): unsure at all n locations; Clone ID: LIB3279-175-Q1-K6-C6
ccccgcgtccgctacactgtgttgaagtttcttttcttttacataatagctagataatgtctctgctgggtcaactgaatggaagggtcttctgaaagatactgggaacgattcagcaaatattgtgcagatgtgagtaaactggatggcagaaaggtagagagaatgcttgaagaaaaatttggtcctatcctcttttccgatgtttacaaggattgtagaatttgccctagttgttctgaaggaaccttgagattcaaagttagtaggtacggtgaaggctattttgtaggttgtgatcgacatccaaaatgcaagtacattgctcgctcactgtcacagcaagaagatgaaactgaacccatagaagaaaatgcaaaatcttttgaacccaggttacttggtgtcatgcctgattctgatcaaaaggtgtttttgaaacaagggccatatggctactatgttcaagttggagaggacaaaaaaggtctgtttccaaaaagggtttccctttccaaggtcaaagatatagactctgttactctagaagatgcaattgagcttttgcaatatcccaaaatcctgngaaaacatcctngaaatgataatcttgtacttataacacattctaaggttggatacaacatca

SEQ ID NO: 10207 - DNA, 689 bp, Zea mays
  unsure (1)..(689): unsure at all n locations; Clone ID: LIB3279-175-Q1-K6-D1
ccatggcatgcttgcttcgagaacaacatgaacaatggaagcacaagtacgagaatccatgtagaagcgtgaagattttccggtgccaattgccacagaataatgccttctactcagctcaacctccaaagcatgatggctctgacaaaccactctgtccaggagctcctgtatgccactggtgtggtacctggaaaggtgataaaatatgtagtagctgcaagaaagcaaggtactgttatgagaaacatcatgcattgcattggcgtactggtcataaaaatgattgcctccagataataagttcttctgcttcaaattcagttctgccagctgtaggaatagggtttgtccgctggtttgctaaggcaagcaacgtacatagactgcacgtcttggatccttcatgtttatatagtgtgttgttttatgatcaattgaccattcattacctccgcctgatggcccttattaacaacagaatcataaaagcatatggaggaactatgtataggctacaaagaagcataagaaccatttttatagcagaagccaaatgttctgatgattntgttttttcaattgtgttttctgttattggttcagcatgcacatatattgacatgatttatggcatggcatctaccatctttgntatatntatgacatcgttcttaataatgtgtgcg

SEQ ID NO: 10208 - DNA, 613 bp, Zea mays
  unsure (1)..(613): unsure at all n locations; Clone ID: LIB3279-175-Q1-K6-D2
cggtcgcgtggggcaacatcgaggtcactttgtttgttggatgaattcggtaagggcaccctaacggaagatggcattggtctgcttggaggtactatcaggcattttgcaaactatggttcccccccaaaggtccttttgtcaacacatctgacagagatcttcaccgagaattacctaccacagtgtgaacatatcaaatgttatgccatgagtgttctgaatcctgatggacagacgagcaatgaagatatcacattcctttatcgactggtacctgggcaagctctcttaagctttggtctgcattgtgcacagcttgctggtgttccaaatgaagtcgtccagagagctggcattgttttggaggacatgcattccaagaaacctacgaggcgcgtgaccagtgagaaattaacagcaacagacaagcagtaccaggatgcagtgactaaactgatggccttcgatacacagaaaggtgacctgaacagcttcttccaggaactatttcccgtcgacttgtagctctggaaatcaagacttgtcgccagcactggaacctagtagaggaaaaagagtgaattccatgtagcgccgttagcagctaana

SEQ ID NO: 10209 - DNA, 491 bp, Zea mays
  Clone ID: LIB3279-175-Q1-K6-D3
tgtatggaagagagaacaaatgctggccttcaaactccaccagcaagatatcgcgctgagcggcagcatgagagagcttgagctgggttaccatcctgaccgggacctggcggcccagatgccaatcaccttccgcgtgcagcccagccatcccaacttgcaggagaacaattagactgctggatgccctcgttccactcgccgaggatttcacccagccaccaccgctggcttgtatgccctcgtgcgctggcaactgtatctttatctttccggtatgtttggatgaacgtataatgtgtgtcagtgtcggtcgcatgacgtgccgatgtcgtgcatctctctctctgccagagcagcggaactctgcaccgtgagtaacttaattggtaccgtatgatctgccggacagtgaatagtttatgtgagtgggacaaaccataatgtgtaatatttgtgtccaactgtcaatggcacgcatttggattttc

SEQ ID NO: 10210 - DNA, 571 bp, Zea mays
  unsure (1)..(571): unsure at all n locations; Clone ID: LIB3279-175-Q1-K6-D4
gcttgtcgggcctngaagtgaagagcacgagtttgatgctccagacgacgcctacatccttgacgcagccgagactgccggtgtggagttgccatactcgtgccgtgctggggcttgctccacctgtgccggcaaaatcgagtctggttcggttgaccagtcggatgggtccttccttgatgacgggcagcaggaggaaggttatgtgctgacatgcgtctcctacccaaagtccgactgcgtcatccacacccacaaggaaggcgacctgtactagggctagggattttcaatttggcgagggaccaaaaatgctctcgagtggtgctttgtcaagcaaagctccatctgcgcgccctaccccgttgtgcgaactgtttggcatcaaacttgtgtggttgctgtcttctatgttctgctagtttatgttcggagtccgtgggaatatactagctgattaataaaaagaaaaactgatgtgatgccataatagtataatttcatggctttttgttatgttgggagaaaaaaatacatgaaatgaaagcatantctngcaagaagcaaagta

SEQ ID NO: 10211 - DNA, 672 bp, Zea mays
  Clone ID: LIB3279-175-Q1-K6-D5
agatccacatcttcccgagcgagttcttggttgacctcttcctcttcggaccacctccaagctcttggtgtagcttgccactctcaccaatcaagttttcatgtctgatctcgacattcagatcccaactgccttcgatcccttcgctgaggccaatgctggggactctggtgcggcagcagggtcaaaggactacgtacacgtgcgcatccagcagcgtaatggtcgcaagagcctgaccaccgtccagggattgaagaaggagttcagctacagcaagatcctcaaagatctcaagaaagagttctgctgcaatggtacagtggtccaggacccagaacttggacaggtcattcagctccagggtgatcagaggaagaacgtctcgaatttcctcgtccaggccggcattgtgaagaaggagcacatcaagattcatggtttctgagcaaccgccgggtccatagcaaaccaaccctgcatgcagggccagcttattatatataatatctgaggtggagcatatctatctggctgtgtactgcaagcaggcctagtacgccgcctgcgcgttcctcctattacacatataggcccctccctgcgtgtatgcttgttaccgtcgtgtcgaaccttgtactacgaggctccatcgaacatcgatggcttgct

SEQ ID NO: 10212 - DNA, 670 bp, Zea mays
  unsure (1)..(670): unsure at all n locations; Clone ID: LIB3279-175-Q1-K6-D6
ccggngtcgacccacgccgtccgaccaaattcaaatctagttgttataggtatagcaaacacaatggatcttccagaaagttattgcctcgtatatcaagtcggatgggtatccaacgactgtgttttggtccatacaattatagacaactgcaggaaattataacaagccgtttaaagggtattgatgcctttgaggaacaggctattgaatttgcttctagaaaggtagctgctatgtcaggtgatgctaggcgagctttagagatttgtagacgggcagcagagtttgcagactaccgtgtcaaacagtctcgacagtctgcacagactactgtttctgcaaagaaaggtgatgctgttgtttccatgggtgacatagaagctgctattcaggaagtcttccaggcacctcatattcaagtgatgaagaattgtccaaagtttggaaaagttatactggttgccatggttcatgagctgtacaaaagtggactaggtgaaataatgtttgataagttagcaacaacagttttctcctggtgccatgccaacagagaactattgcctggatacgacactctcttgaaaatttgctgcaagcttggtgaaagcaagatcatcctctgtgaagagggtagtaagcacaagttgcagaagttcagcttaac

SEQ ID NO: 10213 - DNA, 677 bp, Zea mays
  Clone ID: LIB3279-175-Q1-K6-E1
gtggcgagccaagcagccatgtgaggagcgtggtgcctggcaatgcctcgtcctcagcaatgccatcagggcagccttcagagaggttgacatattctgggcagtcaatattcttcggtggccccatgctgagcacccctggcgtgggcgccaataggaatgaggcagacgcaagagcacgccccgagggaagcagagatcctaatgccctgtgtgagaaagcgaggactggctctggctcctcgccaatatttgctcctggggcgttccagaggaacccaccctttgacaaatgacttgctcctgctcatgaagtttatctgaagtgccgttacgctggaataacctcagcctgaagagttgacagatagtttaggttgctcttttgggcttgccagaaggacggacaaaggcagccgtaggaatgaggcagctgccggctgtggcgataacgaaaaaaccacaaatatcgctcggagccagtgctgactttttccagtgttgggagagcgatggagtgactggtgtacactgtcatcttgttaggaattcatcagatacttgatgcgcgacagatagaaagagctctaatttctggcgatgtcaaacgctgatctgcagctgactttgtaggcgtcgattgccgtcactgtatgtgcgccatgggatactattcg

SEQ ID NO: 10214 - DNA, 676 bp, Zea mays
  unsure (1)..(676): unsure at all n locations; Clone ID: LIB3279-175-Q1-K6-E2
ngatagaggtgtgatcggctcaagcaccagctagccacctcgctgcctcgctggtgctcttccacctcctgcaccacagcgccattgcgcttccacggccagctaccgctgccggaatatacactggtggatctttaacaggttcctccggtccgatccaccgccagcttccgacgtcgtactcgggcggatcggttccacaatgggggaacggggagcagaggaggacggctcgggcggctcctccctctccctcatgtgcctggaggacggcgccgacctcgacgccggtggctccgcggagagcgccgacgacggcgagccggccgtcgttgctcacagcgacgccggtgaggaccaggaggaggagtacatggactacctcgtgtccaaggagagcagcttctgctgctccccttcctcctcgcccgtctcctccgacgccggcgccgagacgcgcccttcgtccacggcgtcgtcatccgacgagtggttccgctgcgcgcgccacgccaccgtcgcgtgggtccttgagacgcgggcttacttcggcttctcccaccgcgcggcgtacctggccgtctcctacatggaccgcttctgcctccgncggtgcatggacgtgtcagtgatgccctgggcggcgncgctgctggccgtggcgtgcctgtccctg

SEQ ID NO: 10215 - DNA, 638 bp, Zea mays
  unsure (1)..(638): unsure at all n locations; Clone ID: LIB3279-175-Q1-K6-E3
cactttgagtagttctgacttaagaggacatcatgggnaatatatgacgtggatacacgtgctataacacgaagattaagagaagacggcagtcttattggtgtcttgagtactgatcagtctcagacagacaatgagttgttggaaatggccaaaaagtggaaaattgttggagttgatttgattagtggtgtcacatgtgatgctccatatgaatggttggacaagactgactcagaatgggagttcaagagggatcagtcaagtgaaacttttcatgtggttgcctatgactttggtatcaagcataatattttgagacgattggcatcatatggatgcaaaataacagttgttccagcaaattggcctgcttcagaggtactcaatttgaagcctaatggtgttctttttagcaatggtcctggagatccagctgcagttccctatgctgtgaagacagtacaagaaataattggaaaggttcctgttttcggcatctgtatgggccaccaattgattgggcaggcgcttggtgggaagactttaaaatgaaatttggtcatcatggtgggaatcaccctgtctgtgatctccgtagtggacgtgtagacataagtgcacagaaccataactac

SEQ ID NO: 10216 - DNA, 647 bp, Zea mays
  unsure (1)..(647): unsure at all n locations; Clone ID: LIB3279-175-Q1-K6-E4
cccgctttccctaacccacacaanaataccagatcgagcaccgatctagggttgcacctcttctgccagccggctggcgaggagccgttcgggatctggacgaggccaagggagatgaagctcgcggggctcaagtctgtggacggcgcccacgaggagtccatctgggcggcggcgtgggcgcccgccgctgaccaccgccccacggcggtgctcctcactggcgcgctcgacgagaccgtccgcgcttggctccccgacgacctcgctgccttggggtcccccacgcggggccacgcgctcggagtcgtctccctcgccgcccaccccgccggcgcgctcgccgccgccgtgtcgctcgacagcttcatccgcgtcttcgacgtcgacacgggggcatccgtcgccacgctggaggcgccgccgtccgagatttggggcgtccagttccatcccaagggtaatgctctggccgcagccggtggtggcagtggatcagtgaagctgtgggacacggagaagtggaaggcgatcaccagcctcgccgtcccacgcccggagggagctcgccccgacaagacaggcagcggcaagttcgtcctgtcagtcgcctggagccccgacggaagctnctacatgcgggtcca

SEQ ID NO: 10217 - DNA, 634 bp, Zea mays
  unsure (1)..(634): unsure at all n locations; Clone ID: LIB3279-175-Q1-K6-E5
gttagaaggtcaaatcatcaagtatcagccttcgatcaacgaagcagccaaagcaatgctaaggaagatcctaaacgtagattcttcgcatatgtttgaatctatgggcaattcagataatagtaataataataataataatctgctggaggattatatgccggccggccaagcttttgagagctcttcgtcgacaagaaattctggggtcacccttgcagaggttccagcaaactcaggcttggcgtatgtcggcacgagctcggctatctgttctcctccagcggcccctgaaatgcagtgcccagtggtgctggataacaaggcgtacaagcaagtggccagcatgagtgctgtgcctcctgtttcaagtgacatgggtattattccggaattctcagatctggcagacttggtctctgtggatattcttggaggggcctttgagatgatgcctggtcctgagttccccctgccagaagaaggtgatgatgggaccaccatgtacaacaacaacgacgaggaggctcagagccttccaggcatcgtcaactccatctgggagcagttcctggtaggcagccctcttatctaccgataatgaggaagntgattcagcaggcggactatatgc

SEQ ID NO: 10218 - DNA, 636 bp, Zea mays
  Clone ID: LIB3279-175-Q1-K6-F1
cggccgcgtggggcaccgcgcgggactagggctgccatcgtggcgccgacacgcgtcatcatctcattgggccgcgggactcggcgacaggccttttgtagaccgcagccggcaccatctcttcccgcaccccccattcgaacgccggagctcgacgaggacgaccgacgacgcacgcagagatccggcgtactgcaaattttgaaaactgaactgtaagatggcatcagcagagctttcccgtgaggaaaatgtgtacatggcgaagctcgccgagcaggcggagaggtacgaggagatggttgagttcatggagaaggtagccaagactgttgactcggaggagctcactgtggaggagcgaaacctcctgtctgttgcatacaagaacgtcattggagcccgccgcgcctcatggcgcatcatctcctccatcagcagaaggaggagggccgaggcaatgaggaccgagtaacactcatcaaggattatcgtggcaagattgagactgagctgaccaagatctgtgatggcatcctcaagctgcttgagacccatcttgtgccgtcttccactgcccccgagtccaaggtcttctatctcaagatgaagggtgattactacagatacctcgct

SEQ ID NO: 10219 - DNA, 663 bp, Zea mays
  Clone ID: LIB3279-175-Q1-K6-F2
gcatctccccacgtcttctcgccggtcgcgcacgggcaaagcagcgatggctacagcgacggcagttggcggacccgacaggtggagactgcggcgtcgtccgcggcggcagtgctggccgtcgccgttgcctcgcagaggttgctaggtctgctcgctcttgcggttcaaactgtaaatgttgcgagcagaaaatatataataaagatcagcgggcaatatacaagttattatctggaagaatcaaatctgaaaagtccctgaaaataaggatgggtcagacgacgacgacgatgacgacgactatgaacacaatgacgatgagggtggtgacgacgatgatgatgctgaggaggaattctctggataagaagatgggggtgatgacgatgatgaagatgatgatcctgaagctaatggtgaaggaggaagtgacaacgacaatgatgacgacgaagatggtgatgatgatggcgatgaggacgacgaaggtgatgaggacgacgaagacgaggacgatgatgaagatgacgaagaccagccaccttccaagaagaagaaatgatttgctcatccatggatttacctcagcttctccatgctgttagttgtgttgtttagatcatggacagctctgggatcaatgtagcttgttgcttgtca

SEQ ID NO: 10220 - DNA, 651 bp, Zea mays
  Clone ID: LIB3279-175-Q1-K6-F3
cgcctctactttcttctctctctgctcctccgcctccgcctgatccatccaagacagggatcgccatgtcggactcggaggagcaccacttcgaatcgaaggccgacgctggggcgtccaagacctacccgcagcaggctggcaccgtccgtaagaacggcttcatcgtcatcaagaaccgtccctgcaaggttgtggaggtttctacctccaagactggtaagcatggccacgccaaatgccactttgtcgccatagacatattcaatgggaaaaagcttgaagatattgttccttcatcacacaactgtgacattccgcatgtgaaccgtactgagtatcagctgattgatatttctgaggatggatttgtgagccttcttacttcagatggcaacactaaggatgatcttagactcccaactgatgagactcttgtggcccagattaaggaagggttcgaaagcgggaaggatcttgttgtgactgtccagtctgcgatgggggaggagcagatctgcgcgttgaaggatgttggccccaagtaacttccttggctttggagacggaaccctactgtatctcaacttaaatcggaaaagaagtgtatcaccaaaggattgctaccgagacattcacctggcttgagct

SEQ ID NO: 10221 - DNA, 646 bp, Zea mays
  unsure (1)..(646): unsure at all n locations; Clone ID: LIB3279-175-Q1-K6-F4
ngaaggcttgctatccgtatagcagtagaggtagccagttgcccagataagaagaccgcagctgggaaagcatatgctttggccctgtgcaaggttgtggtccttctaagattccggcaatcagaacagaaggccatcaagtgcatgagaggccttgtgaatcatttggctgcttcagtggcttccgacaaggagctcgggaaggagctagctcaaatggctgcacggcttagatcgcttgatgcctgtccagacgaagaacttgcacaagatgacgcagatgccatattcaagaaactaggattcgatgatggcttcaagttggacaccaatcaagcagtgcctcctacaccagcaccacggtcagtccggcctccggctcctgccaggagaagagcgagacaggcaccgtcctctagcgatgacagtgacgaggaagcgggagaagctgacgtgcctgcaacatcggcaagcagggttccagccactcccagtatgactgctgctgcacgttctcagagagcaagcaagactgctgctctgagcaggatgtctgcgaaacctgctaccgcgtctgatgacagtgagctggacgggcagtctgacgtcacgagcgagggagatgcatccgatgaggagtcgtcat

SEQ ID NO: 10222 - DNA, 647 bp, Zea mays
  Clone ID: LIB3279-175-Q1-K6-F5
cggtcgtcgtcgtcgcggcgtgagcgtctgagcgagcgtgcaagagcgagaggggggaacacaaaaccctagcaccgtcgccgacggacgccagagtagagagatggcggtggacgaggtgaattcggtctacgtcggcagcctcccctacgaggccaacgaggagatgcttcgcgacgccttcgggtactacggcaccatcgtctccgtcaaggtgattaatgatcatactatcaaaggcaagtgttatggttttgttactttcactcaccccagagctgctgagcaagcaattgcaggcatggacggcaagaaattaggcaatcgtattattcgagtaaatgaagtgcgtacaagaggtccccgagattttggtcgagatggttttagacgagatccaagaaggtatggtagagatccatactgggacagaagggatagggaacagagctatgatcgtgaaagagatccctaccatgacagggatagtgatagatcccacgagcatgatagagaaagagattatgagcatggtggctttaatagagaaattgactatcccatggatcgagatcatgaagtagacggcatacatcctagagacatgatcgtgcagcagaaacacatatatggattcagataatgac

SEQ ID NO: 10223 - DNA, 650 bp, Zea mays
  unsure (1)..(650): unsure at all n locations; Clone ID: LIB3279-175-Q1-K6-G1
tggtttgtagtttagtctactcaagccatggtgttgaaacttgaccatacttgtctcaatgagactttggagtgaaccaaatgagcttatgttcctatatgactactagctagaagttagagcctagatgatggctgcttctgttggcgtgcaagctcgagtgctcctaaatggtcgtcgtattagctgatacgacatcgacccgatgcaatagataatattttttacacgcgcgagtccaaaattgttggctttgggtcggagcagttaacgagagaagtgtattttatcacttctgagtgcaaccttttttatttttccgagcttctgcctcttgcatatgttgtagattctcgccgagaagggagtagtagtattacctgatatctatgctaattcaggtggtgtggtcgttagctactttgagtgggttcaggtaaaatgcctgttcgtcgctgcttcattgctcgattggttcctttctctaatctgctttcttgtgccatgttgattgatcgtgcagaacattcaaggtttcatgtgagctgaggagaaaggaacgatgaactagaanaagacatgagcagtgcttttcaacacatgaaggccatgtgcaaatctttggtgctgccgaagtgtgtcgtgacatt

SEQ ID NO: 10224 - DNA, 676 bp, Zea mays
  unsure (1)..(676): unsure at all n locations; Clone ID: LIB3279-175-Q1-K6-G2
ccgcacctctctccaactccctgctcctccgcctccttcttgatccagccaagccagggatcgccatgtcggactcggaggagcaccacttcgaatcgaaggccgacgccggagcgtccaagacctacccgcatcaggctggcaccgtccgtaagaacggcttcatcgtcatcaagaaccgcccctgcaaggttgtggaggtttctacctcaaagactggtaagcatggccatgccaaatgccactttgttgccatagacatattcaacgggaaaaagctcgaagatattgttccttcgtcacacaactgtgatattccgcatgtgaaccgtactgagtaccagctgattgatatatcagaggatggatttgtgagccttcttacttcagatggcaacactaaggatgatcttagactcccaactgatgagactcttgtggcccagatcaaggaagggttcgaaagcggcaaggatcttgttgtgactgtccagtctgctatgggggaggagcagatctgcgcgctgaaggatgttggccccaagtaacttccctgccttggaatactgtatctcaaaacctaaatcgaaaaaagaagtgtatcaaggattgctacagagacatccatctggcttgagctggctnttgctatggcaaacaccagtgcagggatcgc

SEQ ID NO: 10225 - DNA, 645 bp, Zea mays
  Clone ID: LIB3279-175-Q1-K6-G3
gtagtaccctaagaacagtctgtcgctgcggtgggaaagctgctggcgacaggtggaaatccctgagcgagtcggacaaggctccctatgtagccaaggctaacaagctcaagctagagtacaacaaggccatcgcagcctacaacaagggcgagagcactgcagctaagaaggctcctgccaaggaggaagaggaggaagacgaagaggagtctgacaagtccaagtcggaggtcaatgacgaggatgacgaagagggtagcgaggaggatgaagatgatgacgagtgatggagagctcgctcgagacaatggacggtgcttcatccaacaatggagcggctacacaaggccccgtggcgatcaaaaaaaaggagcctatatccatgtactagaattattcagtttcactccacatcgtgatgttttatttttacttttgtcgtgctataacggatagcgctcctcgttggcgccactggcgggtggttctgcctctggtctggtgtgtttgtgtgtggtcacacttgccagctagcagaggcgcctgcttgtacctagattactgtttccattgtcgtcgtcatcggctaacattgtcataatgtcagtttgggtaatgttagattaagtaattattgggttc

SEQ ID NO: 10226 - DNA, 436 bp, Zea mays
  Clone ID: LIB3279-175-Q1-K6-G4
catgatctcatctggtcagccagtgaacgagtacattgactcggctgtgagacacgttcttctcagacagggtgttcttggcatcaaggtgaagatcatgcttgactgggacccgaagggcaaggttggcccgatcactcctcttccggacctggtgaccatccacaccccgaaggacgaggacgagccgcgccctccggtcttggcacctcctgaggtgtaaggtcccaactgtgtccttgaaatggcagtttgatcgggtcctagataggtttctatcttacgataaggacaatgctaaggcagttggttaccttaatctttatggacagatgctatgtgttgcttctgtggcacttttgtttaagctaagttttgcggagacaagatacttatatatgttcccgatgaaattatggttccttgtatgctctgg

SEQ ID NO: 10227 - DNA, 612 bp, Zea mays
  Clone ID: LIB3279-175-Q1-K6-G5
gttatgcgtctcctcttcgatctactctgctacctagccactacctgcagacttgctctacggcttgggctactgaaatcgaggaacgaaacgatggctcgcagtggctccatgctgttctggatgctggtcctgcagctggtcatgcagctggtcatgcagacagccacgcagacagcggcggcggccgaccaacccggagatcaacgccgagttgtacgccaggtgatgtggcactacacctgccactacagcaacagtaatcgcctaacttgctcgatatattgctggacttgctgcaacacttgctgctagctagctagatagctagcgtgagctcttgcacgctctcaataccacttttcataccaaccttattgctgagctcatgcatgcgcatgatgagctcgttgctgggctcgtctgcgtcgtcgtctgcggcggcggcggcggcggcatctgcggcgtcatctctggcttatcaacgacctcatcaggcacttgtaatagcgctagctccagcattactttctgcaatactaagtcaaataagaagccaacacacgcaagtgcactcacaatcctaatattttttgctcttctttgtgccaa

SEQ ID NO: 10228 - DNA, 562 bp, Zea mays
  unsure (1)..(562): unsure at all n locations; Clone ID: LIB3279-175-Q1-K6-G6
tgttttangacaccatagagtacctgagacagaaagaattggcatcaatgttcttaggagaggtggacactatatgacccttcagggagaagcagctgccctagcagataggtatggattggctgtagggcttcctgctgctactgctgttttactaaagaaacagatgcagtatcgttattctcatggaatagagtattggtggacatacatgagagctgacgccgaaggccttcacgagatccaaaggctatctggagctgggaaactacagatacctgtggagaagacctttcccatcagccatgtaagagaagctcatgcggccaaggagaaaaagttggctcctggcaaggtggttctggaattcgattaatgttattaagattttgtccattgggacctgaagggctgtgcgtttgcaaatcatgatagttttttttgtaaaaaaataaatctgaatctctctgccgacttcaggttccattttatcgttccgtttcagtagaaatacggtaaataatcatatcagctatggcctatgggcacgattttcctgatg

SEQ ID NO: 10229 - DNA, 642 bp, Zea mays
  unsure (1)..(642): unsure at all n locations; Clone ID: LIB3279-175-Q1-K6-H1
cagaattccatactcgatctcatagatccctatagaattctgtggaaagccgtattcgatgaaagtcgtatgtacggcttggagggagatctttcctatctttcgagatccaccctacaatatggggccaaaaagccaaaaaaataagtgattcgtttttagcccttataaaaagaaaacggattcttgaacctctttcacgctcatgtcacgtcgaggtactgcagaaaaaagaaccgcaaaatccgatccaatttttcgtaatcgattagttaacatggtggttaaccgtattatgaaagacggaaaaaaatcattggcttatcaaattctctatcgagccgtgaaaaagattcaacaaaagacagaaacaaatccactattggttttacgtcaagcaatacgtagagtaactcccaatataggagtaaaaacaagacgtaataaaaaaggatcgacgcggaaagttccgattgaaataggatctaaacaaggaagagcacttgccattcgttggttattagaagcatcccaaaagcgtccgggtcgaaatatggctttcaaattaagttccgaattagtagatgctgccaaagggagtgggggtgccatacgcanaaaggagcgactcatagaatggca

SEQ ID NO: 10230 - DNA, 636 bp, Zea mays
  unsure (1)..(636): unsure at all n locations; Clone ID: LIB3279-175-Q1-K6-H2
cggtcgcgtgggcgcgcacccggggngagaggcgcggcggcgcgacccgcgcaggtaccactactcgggcgccgcctgcccggacttccgcaagggcgggtgcaggcgcggcgacgcctgcgacttcgcgcacggcgtcttcgagtgctggctccacccggcgcgctaccgcacccagccctgcaaggacggcacggcctgccgccgccgcgtctgcttcttcgcgcacaccccggaccagctgcgggtgctcccgcccacgccgcagcagtccagcgccagccccaggggcgccggcgcgctgcccgagtcctacgacggctccccgctgcgtcgccaggcgttcgagagctacctcaccaagagcatcgtgtcctcgtcgccgaccagcacgctcctgtcgccgcccaagacgcccccgtcggagtcgccgccgctgtcgccggacggggccgccgccgccttccgccgcgggtcctggccgggcgccgggtcccccgtcaacgacgtcctggcctcgctacgccagctccgcctcggcacggccagctcgtccccgtccggcgggtggggcggctacccggcgtccgcggctgcctacgggtcgcccaggcgggcgggctctacagcctgccc

SEQ ID NO: 10231 - DNA, 661 bp, Zea mays
  unsure (1)..(661): unsure at all n locations; Clone ID: LIB3279-175-Q1-K6-H3
gcaaccaccgcctccccgatctcgtcgagaggaagcccaatcccgaaaccgtcgccgtattccaatggcgcccaaggccgagaagaagcccgccgccaagaagcctgcggaggaggagccggcggcggagaaggccacggcggggaagaagcccaaggccgagaagcggctccccgcgggcaagtccgcaggcaaggagggtggcgagaagaaggggaagaagaaggcaaagaagtcggtggagacgtacaagatctacatctttaaggtgctgaagcaggtgcacccggacattggcatctcgtccaaggccatgtccatcatgaactccttcatcaacgacatcttcgagaagctggcggcggaggcggccaagctggcgcggtacaacaagaagcctaccattacgtcccgcgagatccagacctccgtccgcctcgtcctccccggcgagctcgccaagcacgccgtctccgagggcaccaaagccgtcaccaagttcactagctcctaggcgagcgatgcgacgtgcactcgtctcctcttcttgcagtagtgcaatagtagtacggtttaggtgtgttgccgtggttggtagttngccgctgtgtttgctttctgggctgggctcggttgatgtgttntatgtaagaaataactg

SEQ ID NO: 10232 - DNA, 349 bp, Zea mays
  Clone ID: LIB3279-175-Q1-K6-H4
taagtggtccacccagctgaagaagctgatgaacgcctattgcgaccgccagtctgtggacatgaatgccattgcattcctgtttgatggccgcaggcttcgcggcgagcagacccctgatgagctggagatggaggacggcgacgagatcgacgccatgcttcaccagaccggaggcagcgttcctagcaccacctaaaagcagcagctgcggagcctcgttttgctctccgccctgcgtagtactaaacaaaagggaaaaagtctttttaaggaacttgtgatgctctggctccttgtgccattgctgagggacatccttagcctttatttagtggtatggtttggt

SEQ ID NO: 10233 - DNA, 648 bp, Zea mays
  Clone ID: LIB3279-175-Q1-K6-H5
gtcgcccccaggccaggccccacccgctcagcctcctcagctgcccaaccttctccccatctgctcagcctcagctgtcattcccgcgaagcgccgtctcccggctctatcgatggaccgagtcgccgccctcgtcgtcgcgctcctcgccctcttcttcgccgccggggccacggcgcaggccccggcctcgtcgcccaagcgcactccagcgccagcgccacccaggacggccttcctcccgccgccgccggccagggcgcctatggcctccccgccctcgcctcccgcgatggcgccggtgcccgcgccctccgccggcgtgccggccacgagccccgtcggcgcgggagctggtgacgacgcgatggcccccgccggagccgcggcggctctgactccggctgccgcgcccgtcacggagaagagcgccgccgtctcagcctccgccgccgccgccagcctcgtggccatcgttgccgccgtggcagccgccgtcgcgttctagaccgggaccgaccttgggacatctgatatgtcggtggatccgtggaggagctagagctgcactctttctctgctgtgtgtgttgggtgttttcctcctcttttttcgggacctatttatttgtttattcatttgttattt

SEQ ID NO: 10234 - DNA, 522 bp, Zea mays
  Clone ID: LIB3279-175-Q1-K6-H6
gcctctcgcctcgacgccgtcgtggcccgcctcgacacgcaggccaagatgcaggtcatcggcaagtccatgcagtccatcgtcaagtcgctcgactcctcgctcgccaccgggaacctccagaagagtccgagaccatggacaatttcgagcgccagttcgtcaacatggaggtccaggccgagttcatggagggcgccatggccggctccacctccctctccacgccggagaccgaggtcaacagcctcatgcagcaggtcgcggacgactacgggctcgaggtctccgtcggtctgccgcaggcagccgcccacgccatccctgccgccaaggataaggagaaagtcgacgaggatgacctttctcgccgcctcgccgagcttaaggcccgcggctgagaggttgtttcaggctttatcaggtgatgatagattcatcctagccccccgtgaccttagcctatgttttgctgcggtagcctttgatcattgttgaagaactgctatcgtgaatcgtgag

SEQ ID NO: 10235 - DNA, 667 bp, Zea mays
  unsure (1)..(667): unsure at all n locations; Clone ID: LIB3279-176-Q1-K6-A1
cggtcgcgtgggcgacgttcgacggccgtagccaagaagtatctcgcccaaacaaaggccgtcaagccaccatggccgtgtccggcgagaagccgccaccgccaccgccaccggccacggcgtccggcggaacggcaaggaagctcatcctagcgctgcttacatgtctgtcgtcggcgctgctgtacaggcagattcagccgctaccgcccaagatccccggcacgccgggcggcccgccggtgacggcgaccaggacgaggctcagcgacggcaggtacctggcctatctggaaaccggcgtcccgagggagaaggccaagcacaggctcgtctttgtccatgggttcgactcctgcagacacgacgcgcttccgatctccacggagcttgcgcaagagctgggcgtttacatgttgtccttcgatcgccccgggtacgccgagagcgacccgcacccggccaggaccgaggagagcatcgccctcgacatcgccgagctcgccgacaacctgcagctgggtcgcaagttctaccttgctggcttctccatgggcggcgagatcatgtggagctgcctcaagtacatcccacacaggctctncggcgtggccattctcggccccgntagcaactactggtggccccgcttgccgtcgaacgtgtc

SEQ ID NO: 10236 - DNA, 635 bp, Zea mays
  Clone ID: LIB3279-176-Q1-K6-A2
gctgcatctgcttctgctgacttctcggctaaagtatgggatgcacttactggtgatgaactacattcatttgaacataagcatatagttcgggcatgtgctttctctgaggacacccaccttttactcactggaggcatggaaaagactttgcgtgtgtatgatattaatcgtcctgatgcagctccaagagagcttgacaaatcacctggttctgtccgaactgctgcctggcttcatagtgaccaaactatattgagttcctgcactgacatgggtggagtaaggctatgggatgtgagaacaggtaaaattgtccaaactcttgaaaccaaggcttctattactagtgcagaagtaagccaggatggcaggttcatcactacagcagatggctcaagtgtaaaattttgggacgcgaatcacttcggccttgtgaaaagctatgatatgccgtgcaatgtggagtcagcttcacttgaacccaagtctgggagtaaatttgtagctggaggagaagatttgtgggttcatgtattcgatttcttcactggtgaagaaatagcttgtaacaaagggcatcatggaccggtccactgtgtccggtttgcacctggtggtgaatcatacgcatc

SEQ ID NO: 10237 - DNA, 676 bp, Zea mays
  unsure (1)..(676): unsure at all n locations; Clone ID: LIB3279-176-Q1-K6-A3
cggtacgccgtgggcagnnaaaatcaactcctccccaaatccacgcctgccannncaactcgccgtcctccgcgcccaagnncaccaaagctccgatggggcccgcactaaacatgacggcgcgcatagtcgacggggcggcaaggggcgccccgcaagcatgctggcgaccaagggcggcgcgcaatgtctgcgccggcccaccggcggcgtgaagaagccccaccgcttccgccccggcaccgtcgcgctccgggagatccgcaagtaccagaagagcacggagctgctcatccgcaagttgcccttccagcgcctcgtccgtgagatcgcgcaggacttcaagaccgatctccgcttccagtcctccgccgtcgccgcgctgcaggaggccgccgaggcctacctcgtggggctctttgaggacactaacctctgcgccatccacgccaagcgcgtcaccatcatgcccaaggacatccagctcgcgcgccgcatcaggggagagagggcctgagcgaggcgagctcctctcaccgcaggcggcgtcgttgttgcttcgggcctgcttgtaggacttgtgcttctcttggtttcctttctggtggcagtggcatcttggtaccattgtgcttgttcttagaatcttagggatagagagttgttcagttgctgg

SEQ ID NO: 10238 - DNA, 690 bp, Zea mays
  unsure (1)..(690): unsure at all n locations; Clone ID: LIB3279-176-Q1-K6-A4
ccctcgcgctgctccaaaaagcactactcctcccccatcctgctttcccctcctcgtctagggtttcccacccccatgcctctcccgaaaccctagccgccgcctcctgttcactgctctcctcgccgctgcagccgtttccggccatggccgctggagccagcgactactctttcgcggcggagtacgttggcccgccactcccctacacgctcccgcgcgccatcccgctcgacctctcccgcatcccgctcgccgcgctgtcttcctcgcccccggcctccccctccgcctcctcgtctccactccccgtcgttcgcccgctcaccccgtcctccctctgcaacgccatccacgcgcacgcccacccggcgccccgctccgccgtccccgcgccagccgggggaggagctgtggtggattcccccacctccgtcatcgagaaccaccacgctgccgcgcaccactccgccgagctcccctcttccccctccgacgacgaggccgcaggcgacggcgacggcgacggtggctccgaggcgctgccgctgaagcctcgccacacccgcccgtggtcaccttcgccgagaccagcgctccctcctncagtcctctgatgacgaggacgagtatgaggaggaggacgacgacgacgatgccgacgcaggggagggctcgncccgtgctgct

SEQ ID NO: 10239 - DNA, 661 bp, Zea mays
  Clone ID: LIB3279-176-Q1-K6-A5
atcaatcagcaccgaccactcgcgatccgattcgaatcgagccagagtcccaggcagcggcggcggcggcggcgcccgcctccaagaccacctccacccggaccccagccccaaccccaagttaacagatgggggacgttgcgaaggacttgacggctgggaccgtgggaggggctgccaacctcatcgtcgggcacccgttcgacaccatcaaggtcaagctccagagccagcccacccctgctcccggacagctccccaagtacgccggcgccatcgatgctgtgaagcagacggtcgcggctgaaggcccgaggggcctgtataaggggatgggggcacctctggccaccgtcgcggccttcaacgctgtcttgttcagtgtcagggggcagatggaggcgcttctcaggtcagagcctggtgtgccgctgacagtgaagcagcagattgttgcgggcgccggtgctggaatcgcagtctccttcttggcgtgtccaacagaactgatcaagtgcaggttgcaagcccagagttccttagccgaggcagccgccgtttctggtgtggctcttcccaaaggtccgatcgacgtggcgaagcatgtcgtccgggacgccggcgcccaagtctcttcagggcctggtcccgagatgggcgc

SEQ ID NO: 10240 - DNA, 639 bp, Zea mays
  Clone ID: LIB3279-176-Q1-K6-A6
gtattctagggttttgctgctctccgaccccgagctccgaaggccgcagcatcaggcgcggcccccctcgcgtgtgaccgagatggcgctgccgaatcaggggaccgttgattaccccagcttcaagctcgtcatcgtcggcgatggtggaactggtaaaactacatttgtgaagaggcatctcactggagagtttgagaagaaatatgaaccaaccattggtgtggaagttcatccgttggatttcaccactaactgtggtaagatcaggttctactgctgggataccgcagggcaagagaagtttggtggcctcagggatggatactatatccatggccagtgtgcgatcatcatgtttgatgtaacctcaaggcttacttacaagaatgttcctacgtggcatagggacctgtgcagggtctgtgaaaacatccccattgtcctctgcggtaataaggttgatgtgaagaacaggcaggtcaaagccaagcaggttactttccacaggaagaagaatctgcagtactatgaaatttctgccaagagcaactacaactttgagaaacctttcctgtacctcgcaaggaagctggctggtgatccgaaccttcactttgttgaagctgttgctcttaa

SEQ ID NO: 10241 - DNA, 691 bp, Zea mays
  unsure (1)..(691): unsure at all n locations; Clone ID: LIB3279-176-Q1-K6-B1
gccaagnagccttcagacaagcccctgcgtctcccccttcaggatgtgtacaagattggtggtattggaactgtccctgttggacgtgttgagactggtgtcattaagcctggtatggttgttacttttgggcctactggtcttactactgaggttaagtccgttgagatgcaccatgaggctctccaggaggcccttcccggtgacaatgttggcttcaacgtgaagaatgttgctgtgaaggatctgaagcgtgggtatgtggcctccaactccaaggatgaccctgccaaggaggctgctagcttcacctcccaggtcatcatcatgaaccaccctggccagattggcaatggctatgccccagttctggactgccacacctcacacattgctgtcaagtttgctgagctcgttaccaagattgataggcgatccggcaaggagctggagaaggagcccaaatttctcaagaacggtgatgctggtatggtgaagatggttcccactaagcccatggtggtggagaccttttctcagtatcctcctcttggtcgatttgctgtccgtgacatgaggcaaacggtggctgtcggagtcatcaagagtgtggagaaagaggacccactgnagccaagtgacgaagctgctgccaagagaaaagatctatctggctgtgacgaagctgctg

SEQ ID NO: 10242 - DNA, 613 bp, Zea mays
  Clone ID: LIB3279-176-Q1-K6-B2
cccacgcgtccggccagccaggcaggcacaaagttgggtgttgtgatcgatgacagactttacacgctagagccttccagctctttggacagtggtaagataaaaagatacgactccgaggaggacgcatgggtaactatcaccccacaagttccagttaatgatttcactggtgcagaggccccttatttactcgctggcctcggtggaaggctccatgttataacaaaggcggcgaacaacactcttcaagttatgcaggctgtggtgcagaataactcggtatctgaagaaaatgtggtatggacaacagtggcttctaggaaagttgggacggctgagcttgtcagctgccaggttctagatgtttaaaatgtgggtcgcaagttacgctttgtagaggatatagtatgccatagaccaacgatttagccaagaaaaatattacatagtttttgctttgtgtgtgtgtggaacaagagttcaatttgacgtggagggagatcaattacagatattcagatatgtataactgtataagctaactcatttgctgggagactgtgtatagacatacgatcgacgtgttaatgtacagtgctcaattctagtt

SEQ ID NO: 10243 - DNA, 587 bp, Zea mays
  unsure (1)..(587): unsure at all n locations; Clone ID: LIB3279-176-Q1-K6-B3
ccacgcgnccgccagccgctcctccaggcggcctggagccggcgcgacgggatggggggcgggaactacgccaggcagatggcgatgtgcttgagcatgattgcctccggcatcgggatggagaccggcggaattagttccgagatggtggaccagatgaagcgcaacgtagcgtcgtccgattgtgacgggagcaacgttatggagttgctcgatagaatgactgaagactctgacaaggaggagcacctggggccactgcatgatgcggcaagggcaggtaaaatggatgtttgcaaacacctggtggagaatcttgggtttgatgtcgatgttcgtgctaatgatgnttcggggaagactcctttgacttgtgcagtgtcatgtggcaaagtaattgctgtgaggtatcttattgccatgggtgcagatcttgaaaaacaagatgctatttgctttactcctctgcactatgctgccaaacgagggtacagtgnacttagcatgtngttgctctctagaggagctaatgttgnatgtggattcttctggagggacaccactacatggtttctgctgcttgtgga

SEQ ID NO: 10244 - DNA, 677 bp, Zea mays
  unsure (1)..(677): unsure at all n locations; Clone ID: LIB3279-176-Q1-K6-B4
ggaaaagctcgaagcgggagccggcgagcgagatgggcgcagggagcagccgcgcggacgcgccgtcgcggcgccgggcgcgcctcagcctcggcgggtgcttcggggccgggtcctcctcgtccgcgcacgacggcgggagcttcgccgcggccgggccctcctcctcgcgcgccatcgaggtacaatcacgacagtcagggcgacaagtgagtgccctgaattttcaggcttctctagctgctaaggatctccaggtttccagtgagtcaaatccaaggctgcattcgtcttcaagcaccataagccatcatctcagattcaatcacctcaattaccatgaaaacaaggaagatggcctggggtctgaaaacgctgaaacaagtggtcttcaaagctcatctaggaaacctgtcatggtaaggggaagtctcattaatgaagctgttaatggtgacatatcaggagaaggaataagttctataggatcagagctggaaaatgttcctagcacagtatccactaatgaaattggtggctcaacttctgaatctggtttgggcccctcatcgatgacatctgaaaggatcatgtctgnactcagagtagagatatctncgcaagggacctcatccacaactgtcatgacaagtgaaatatcagatgcatctcaatct

SEQ ID NO: 10245 - DNA, 544 bp, Zea mays
  Clone ID: LIB3279-176-Q1-K6-B5
cagcgtccgcaccgactggcacatggagccatcgaggatgaccctgtacaggtttggcaacacatcaagcagctcactctggtacgagctggcgtacactgaggcaaagggtaggatcaggaagcgcgacaggatctggcagatcgcatttggttctggattcaagtgcaacagcgccgtctggaaggcactccggacggtgaacccggccaaggagaagagcccctggatggatgagattgacaacttcccggtggatgttccaaagatttcaaaggttggtggcgcttgaagaaccattcttcttattattaggtggcaagtggagttgggtgattgtcaggggctgggcagagatttattccatcgtttccaccgttggttcttgtattcagttgtagcatggcatctgtgaaggaacttgagtagatgattcggttaggtagaaagggtgtgttcttcggctcgctagggttgtctgaatgcctgatatgtcctatttattcagattggagagagcaatcgatttgcattctttgctgcg

SEQ ID NO: 10246 - DNA, 554 bp, Zea mays
  unsure (1)..(554): unsure at all n locations; Clone ID: LIB3279-176-Q1-K6-B6
cagacggaacaactgaaccgggagtacgacatcggcgacgagatcggccgcgggcgtttcggcgtggtccggcgctgtgtctcccgcgccacgggtgacgccttcgccgtgaagtccgtggaccggtccctcctcggcgacgacctggaccgcgcgctggcggagctggagccgaagctggcgcggctcgcggggggcgagggcgacgggaacccgggcgtcttgcangtgcgcgccgtctacgaggacgacgcctggacgcacacgttcatggacctctgcacggggcccgacctgctggactggatccgcctccggcgcggcgcgcccgtgcccgagcccgacgccgcgcgcgtcgtcgcgcagctggccgaggcgctcgcgggctgccaccgccgcggcgtctttctccgcgacgtcaagtcccgcaacgtgctcctggacgtgtaccccgccggcgaggcgcccccccgggtccggctcggggacttcgtctccgccgcgtggctcggcgagggctcgcggggccgccccgaggtcttcgtgggcacccc

SEQ ID NO: 10247 - DNA, 377 bp, Zea mays
  unsure (1)..(377): unsure at all n locations; Clone ID: LIB3279-176-Q1-K6-C1
ccccgcgtccgccccgcgtccgcgcgcaccacgagctcaagtggtggggcacggaggtggatcattgcccgctcgcctcctgccccaccgcgccgggcatcgccgtcaagggctgcccggtgttctgaatcttccgagacctgagcgtagtaagcagtgtgtgtaacagtgtaaggaaatgtttgctacgggagccatggattcaaccaagcatcgattaaccgatgcagtgctttgtcactcgtgaatgtaacaccatagcgccagtggtggattcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaanag

SEQ ID NO: 10248 - DNA, 652 bp, Zea mays
  Clone ID: LIB3279-176-Q1-K6-C4
ggccgcccttttttttttttttttcagagaaacaggcatttcttcttccattctaaatagcaaaggacaacttgcagcaggacacatacacatacaagcacattcgtcccatctgcagcctacgcatcaccgcatactggtaacaaggtactgctaaacatcagatcactccggacagtcagtctatgccttcttaggggacttggcggccttcttgggcgactttgcctccttgctcccgccactggacgccttctccgccgtcttcttgggcagcagaacagggttgatattggggagcacaccgccgtgagcgatggtcacgccgcccaacagcttcccaagctcctcgtcgttccggatcgccagaagcacgtggcgcggaataatgcgagtcttcttgttgtccctggcagcattaccggcgagctccagaacctcagcggcgaggtattcgaggacagcggcgaggtagacgggggcgccggtgccgacacgctgcgcgtagcggcccttcttcaagtagcgcccgatgcggccgacggggaactggagaccggccttcacggacctcgacaccgacttcttccttggcccgccgaccttgcgcccggccgctcccttcttccccttaccccctgctccggtgccg

SEQ ID NO: 10249 - DNA, 506 bp, Zea mays
  Clone ID: LIB3279-176-Q1-K6-D1
cgccaggtccctaacaccgccccttgaagaagctaagccaaaggcaaaatccgcaaagaaggtcttgaagaagccgccttcatctgctgtgaagcgcttgcggaagttgcagagtttctcagcctgagttttttggtgtatgacgtcatgatggtcatgtcaatgtatcttttctgttttagtttatcattacttaattcttatcctttttgtaggttagtttatactgtgttgacttagctgtcagttcatatttggtggattgcttaatgatttgtgtggtcactatgcttttataataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggccctttttaaaggaccaaattttacttcccggggcttgcaaggtaatattttttttttggggccccctaaattaaatcaacgggc

SEQ ID NO: 10250 - DNA, 640 bp, Zea mays
  Clone ID: LIB3279-176-Q1-K6-D2
aaaggaaatacagtacctatggcttctctggacgccgtgcgaggagacctcgccctgctgattctgtacctgaacaaggccgaggcgcgggacaagatctgccgagcgatccagtacgggtccaagttcatcagcaacggcgagccagggcctgcgcagaacgtcgacaagtccaccagcctggcccggaaagtgttccggctctgtaagttcgtcaacgacctgcacgctttgatcagccctcctgccaaggggactccgctcccgctgatcctactcgggaagtccaagaacgcgatgctgtcgactttcctcttcctggaccagatcgtgtgggcggggaggacaggaatatacaagaacaaggagcgggcggagttcctcgggaggatagcgttctactgcttcctcggctccaacacctgcacggccatcatcgagctagccgagctgcaacggctgtccacgtcgatgaagaagctggagaaggagctgaagcaccaagagctgtacaagaacgagcagtaccgcatgaagctgcacaagtcgaacgagcggctgctggcgctcgtcaagtcgagcctggacatcgtggtggccgtggagctcctgcagctggcccccgaaaaagtgacccccc

SEQ ID NO: 10251 - DNA, 684 bp, Zea mays
  unsure (1)..(684): unsure at all n locations; Clone ID: LIB3279-176-Q1-K6-D4
cgttgctcgcctcgggtcaaaccctaagcagggagttgatttatccgctgcagccatgagtaagttgcagtctgagtctgtcaaggatgccatctcccagattgttggggatgccaaggagaagaataggaagttcactgagactgtggaacttcagattggtctgaagaattatgatccacagaaggacaagcgtttcagtggctctgttaagttgccccatatccctcgtcccaagatgaaggtgtgcatgcttggtgatgcccagcatgttgaggaggccgagaagatgggacttgactacatggatgttgaggctctcaagaaaatgaacaagaacaagaagcttgttaagaggcttgccaagaagtaccatgctttcttggcatcagaggccatcatcaagcagattccccgtctccttggtcctggtctcaacaaggcaggcaagttcccgaccctggttactcaccaggaatccctcgaatccaaggtgaacgagactaaggcaaccgtcaagttccagctcaagaaggtcctttgcatgggcgtcgccgtcggcaacttggcgatggaggagaagcagatccagcagaacatccagatgagcgtgaacttncttgtttcccttctgaagaagactggcagaatgtgagatgcctctacgtcaaaagcaccatgggg

SEQ ID NO: 10252 - DNA, 617 bp, Zea mays
  unsure (1)..(617): unsure at all n locations; Clone ID: LIB3279-176-Q1-K6-D5
cggacgcgtggnngtctgaaatccccttcgacccttcctgctccagcgggagcgcaccagcaatgtcgtcggcggggccaccgccgccgctgccgccgtggagcaggctggaggggcaggtggtgctggtgacgggcgcttcctccggcatcggacgcgacttctgcctcgacctggcgcgcgccggctgccgcgtcgtcgccgccgcccgccgcgccgatcgtctccgctcgctctgcgacgagatcaacccctccgctgcctcccgagccccccgcgcggtggctgtggaggtcgacgtcgccgccggtggttcggccctggaggcggcggtgcagaaggcctgggacgcctttggccgtatcgacgccttggtcaacaacgccggcatacgaggtgcagtgcattctccattagattggcccgaggatgagtgggacagaatcatcaagacgaaccttaccggatcatggctcgtggccaaacatgtctgtcgacgcatgcgtgatgccaagctgaagggttcagtggttaacatcacctctattgctggccttaaccgtgggcatctgcctggctccacgggatacgcatcctcaaggctgctgtgcattatg

SEQ ID NO: 10253 - DNA, 688 bp, Zea mays
  Clone ID: LIB3279-176-Q1-K6-E1
cggtcgcgtgggcggacgcgtgggcggacgcgtgggcgccgccgcccaaagaaagacgtcaactccaggagacaagatagtgagaactgaagagaaggatgggcttcgagaagcagatcctgagatccggcaccggccccaagccgataaagggccagaaggtcaccgttcactgcaccggctacgggaaggatcgtgatctgtccaagaaattttggagcaccaaggaccctgggcagcagccattcagtttcagcattggtcagggttcagtgatcaaaggatgggacgagggagttatgaccatgcaagtgggtgaagttgctcgtatccagtgcacgcctgattatgcttatggagccggcgggttcccagcctggggaattcaaccaaactcagtgcttgtgttcgagattgaagtcctcagtgcccagtaattcgcatctgtcagctatggaaacgttggccatgcttctcaagtaatgaaataattccgttgtcacctcatgctacatacagcagattggtgttacgagttaaatcctgtgaaactttagcattctgtaaccgtggatgtcgagtttatggagttccttgtgtggcgcctcaagtcaagttctcgtcaaagattgtaatctgatggcttccattgtgacttgtaggcggctgcaataaacttacttgatgc

SEQ ID NO: 10254 - DNA, 578 bp, Zea mays
  unsure (1)..(578): unsure at all n locations; Clone ID: LIB3279-176-Q1-K6-E2
cggtcgcgtggggctatgctttgttgtgtgttggtttcccatctggcgatgttgaagtcgagactcaagatgaagatgaggtatattggctccaattcgggagatactttgcacgagggccagtgngaaagagatgattacgcgctagaacttgcaatgggagacgaatgagctgtgcctaagagaccttgccatctcaaatttgaataccatctcaaatttggacccctgtagttctgagtatgccgattatctttttgtggctccaaatctcactctcagccttctttccttcggctgttagcgtttagagtgacaaggacacttcctgagaggaggaataaagttctgctctgctctctattttccaggttgcccccttcccgcctttccttgttcggttgtcacttagcagcctggtgcgtggctgcgtgcagttctcgtttctcctctaatagatggcacacgttatgaagtgtgtaaaggtgtcaaaatccaaaaacatccagcattcacaatctttgtcgtgatgaagtgtgtaaacttgtaaaaatatatccaaaaatgcattcacgatc

SEQ ID NO: 10255 - DNA, 409 bp, Zea mays
  Clone ID: LIB3279-176-Q1-K6-E3
gcgtccgcaaaccggcaaggggagcgacacggagagtctcgagtgcaagggagcgcggtgacgacagcgttttccagggtttctctatcggctgctatggcgaccagggtagcgtggagattcctgcaccgcaggcccctgtcttccggcggcaaggtcctcaccgcggagcgagaagccgcgccgacagcgtacatcacagaaaatggaacaagagaagctgtagaagctcgcacgcaagggccccacctctactagagcatgcttcgtcgactacagcctctgcagcaagcgatgtgaaggctggggctgggccaacggcagtcagcagtctgctaacgagtcaaccgacaagaacaggaactacgcttgtcctggcaggcacaattgcctgctcctgagtcgccct

SEQ ID NO: 10256 - DNA, 639 bp, Zea mays
  unsure (1)..(639): unsure at all n locations; Clone ID: LIB3279-176-Q1-K6-E4
aatccccaaagtcgcccttcccccaaccctatccaaccgaatccagcggcggcggcggcggcggcggctatggcggcggttatgaacgccgatgtggaggtggtcgacttcgacctagacgacgacgacctcatggacgaggatgccgggccggatccagcgccggcccccacctcgcgtctccgctccaccatcgcgggcgacgacgcgccgcgtaggaccaagggccgcggcttccgcgaggaccccaactcctctgcgccccgcgattcgcgctttggcgcggggggacgcgccgacctcgactcgctcggcggcccgggacccatccaatcaattgaaggatggattgtgttggtcactggagttcatgaagaagctcaagaagatgacctccaaaatgctttccaagaatttgggcaggtcaaaaacctgcatttgaatttggaccgtcgtaccggatttgtcaaggggtacgctttgattgaatatgagaagtttgaagaagctcaggctgcaataaaagaactggatggagctgagctttatgaacaaaaaatgagtgttgattgggcctttagcagtggccctgctaagcgcagatttactcggnaaaagacaccaccaagggctcgttca

SEQ ID NO: 10257 - DNA, 654 bp, Zea mays
  Clone ID: LIB3279-176-Q1-K6-E5
gctgagacggggcgtcgccgcctgcgacatgatggtcgcgagcgcggcgacgttcccgtacgtcgagcggcggatgagcgccggcatgtgggacagcaacggcgtggccaacgacccgagcctgcgggggctccaggcgcgctggccgtggctctccgccgccgtccagcagtccttccagggcgccttcgccgccccggtccctgtccagcggagcaacggcaagtggatgcgggtggacaacgtgcgtagcgcggtccccctcgtgtccttcctggagcacggaagctgcaacaggacgcggggggcgccggccttgctcataaggtccgtcgtgcaagagccggtcgaggacgaggacatgcagccgggcggcggcgctcgggccacggccacggccacgacggcggcgtgcggcctgccggccgagccgacggtgcgcctcgtcggcccggaagggaggtgcgtggacgtgccttacggctactactacaacggcaaccaggtgcagctgtggagctgcaagtccaccagcgccgtgaaccagctctggacgctcaagagggacggcaccatccggtccaacggcaaatgcctgaccagcagcggcgacgcggccggcgcccgcgtgggtggtcgacgactgcccgcgct

SEQ ID NO: 10258 - DNA, 406 bp, Zea mays
  Clone ID: LIB3279-176-Q1-K6-E6
ctcggtcgcatcttccccactcctcatcgccgcaccggcggccgcgcacgtgaagcgacgaggaaaggcacgctacgacatgtcggggaccactgcagcgcagcccttctggcggtcggcggggatgacctacatcggctactccaacatctgcgctgcgctggtcccgaactgccgacaggagccctgcaagtctgacgccgcgtcccgtgagaaggtatatcattccatttccaagtgctcggatggtaagcaggataagacaacagtccgcacacacaccgatgactaatggctggcgcgccatggcaccatgacccttcctacagatcatttgaagcgttgatgaacgtgtagagacttgatatctagatggcttgattagtaatcaaggctgaagaataaa

SEQ ID NO: 10259 - DNA, 611 bp, Zea mays
  Clone ID: LIB3279-176-Q1-K6-F1
tctgtacatcgacgtccactcgtgtagctattgatgctgaagacccaatgcttcatgccaccgcaatggtggctggttgatctgcgtattcaacaggtgggaagaggctctgagaaatggtgcagatccacatctgtttgtgcataattgctgacttagctacaccaattgcatttcatgggaaatcatttacgagaacacatggttatggctgttccacatgactggcattttattgcattcattgaaaggcttacctagcttatggtgctacacacacagacatgaaactattttcacttatgcaaaagatttgtgcattaataatattatatatcaccatttactataagaatgcaagattctcgataggtagattagatcttttttattgacgtatcctgagttcactctaataacaatcatgtcctatcacctgtgacaatagtactaaacattaccatgctaccagctcttaaatacgtactacaaaagctgatttaccctataattctacacattgactgtcgttgaaagaatgataatacccagccacctctgcaagtgcccaaagaggatccaaagaaggccctacttgttgctcctccccc

SEQ ID NO: 10260 - DNA, 660 bp, Zea mays
  unsure (1)..(660): unsure at all n locations; Clone ID: LIB3279-176-Q1-K6-F2
gtcccagcgtccgctgncgcacaatcaaaactaccagcgttttcttcactggctacaaggttgagcagccattcgaggaagatgaaatggatcttgattctgaagatgaagacgaggagctgaatgttccagtagtcaagggaaaatggcaaagctgatgagaagaaacagaaaatcaagaaaaggcagttgctgcaccttcaaaatcaagtccggattccaagaagagcaaggatgacgacgattctgatgaggacgagactgatgattctgatgaggatgagacggacgattctgatgagggtttgtctcctgaagaaggcgatgatgattcaagtgatgaagatgataccagtgacgatgaggaggaagacactccaactcctaagaagcctgaggtaggcaagaagagagctgctgaaagttccgtgctgaaaactcctctatctgataagaaagcaaaggttgccacaccgtcatctcagaagacaggtggcaagaagggcgccgccgtccatgtggcaactccacacccagcaaaaggcaagaccattgtaaacaatgacaaatcggtcaagtctccaaaatctgcgccaaaatctggtgtcccttgcaaatcgtgcagcaagtcattcatcagtgagacggcacttcaggctc

SEQ ID NO: 10261 - DNA, 665 bp, Zea mays
  unsure (1)..(665): unsure at all n locations; Clone ID: LIB3279-176-Q1-K6-F4
ccccgcgtccggnggagccacccanaactctatcagggttgcccaatggatgcttcaaactcctggtgcaacaagttacatgggatgcattgngaaaggacaagtttggtgaggaaatgaagaaaaacgctcaagctgcaggagttactgctcattactacgaggatgagactgctcctactggcacatgtgctgtatgtgttgttggtggtgaaaggtcattgattgcaaatctgtcagcggcaaactgttacaaatctgagcatctaaagagaccagagaactgggcactagttgaaaaggcaaaatacatctacattgctggatttttccttacagtgtcgcctgattctatccagctagtcgctgagcatgctgcagcaaataacaaggtgttcctgatgaacctctctgctcccttcatttgtgagttcttccgtgatgcccaagagaaggtcctcccgtatgctgactacatcttcggcaacgaaactgaggcaaagatctttgccaaagtcagaggatgggagactgagaatattgaggagattgctttgaagatctctcaacttcctttggcttcaggcaagcaaaagagattgctgtgattacnaaggtgctgatccagtggttgttgctgagatggggaggtgaaaacgttcctg

SEQ ID NO: 10262 - DNA, 656 bp, Zea mays
  unsure (1)..(656): unsure at all n locations; Clone ID: LIB3279-176-Q1-K6-G1
gccactgcatgtcgacagatcccagcggtgctggtggttacttgtttcttggcgacgattacattcccaggtggggaatgacttgggtccctatccgcgatggtccagcagatgatgtacgcagagcccaagtcaagcagataaaccatggggatcaacagctcaatgcgcaagggaagttgactcaagtggtctttgacactgggtccacatacacatatttcccagacgaggcgcttacaagattgatatcttcgctgaaggaggctgcatccccaaggttcgtacaagatgactcggacaaaacacttcctttctgcatgaaatctgattttccagtgaggtctgtggaggatgtgaagcattttttcaagcccttgagtctgcaattcgagaaacggtttttcttctccaggaccttcaacatccgccccgaacattacttggtcatcagtgacaagggcaatgtctgcctcggggtgctcaatgggacaacgatcggttacgattcagtagtaatagtcggagatgtttctcttcgtgggaaattggttgcttacgacaacgataagaatgaggtcgggtgggttgatttcgactgcaccaaccctcgcannacgaagcagattccttccttcctgcgacgagcgttgcgc

SEQ ID NO: 10263 - DNA, 659 bp, Zea mays
  unsure (1)..(659): unsure at all n locations; Clone ID: LIB3279-176-Q1-K6-G2
cttctnntcgacatggggaccgtcgnngcggcgccccccggnncgggcccggnatnncgtgatggnnnagctgtacccgccaacnngaggtgnncccaagaacnncgcggnagnnaacttnnccgcgcgcctgnntgcacggnngcgagnnaagggcngnntgggcnnaagtccccgggaaaggccccgctccactttacaagnnggctcncnnaccttcncnnaccgcgtncnnatccccgnnagttcatgnnntgccagggnncggcgactttcacccccgcggcaaccggcaccccggcgnngcgagtccattctacnnggcgagaagttccnccgacnngagaagttcgtgcgcaagcacaccgcccccnggtgtgnctctccatggccaacgccgggcccaacaccaacggctcccagttcttcatctgcaccgtcgcgaccccttggctcgacggcaagcacgtcgtcttcggccaggtcgtcgagggcatggacgtcgtcaaggccatcgagaaggtgggcacccgcaacggctccacctccaaggtggtcaaggtcgctgactgcggacagctctcctagatctctctgatctggtctgttcggccgncctccctccgtcatcgtcgactccccctgcgtccgttcctttt

SEQ ID NO: 10264 - DNA, 616 bp, Zea mays
  unsure (1)..(616): unsure at all n locations; Clone ID: LIB3279-176-Q1-K6-G3
gcgtccggngacgcccctctgcttcctttcctccgtccctcaaaagttgctggagccctcttctctctctcctctccgagccccaaccatggatgaggcgcaagttgtggacccaaaggatggaaccatctcagttgcttctgcatttgttgctcatcaggaagctgtacaagcacagggatcacaaattcttgacaaaagcattggaagaagcataccgcggagtcgactgcggcgatggaggtccatttggagcactcgtcgtccgtaatgatgaagtggttgttagctgccataacatggttctgaagcacactgaccctactgcgcatgctgacataactgcaattagagaggcttgcaaaaagctcgggaaaatcaagctctctgactgcgaaatctacgcgtcctgcgagccatgcccaatgtgctttggcgcagatcatctctcccgacatcaagagctggtttatggggccaacgcggacgctgccatcgccattgcgtttgccgactccattgcagatgctctgagaggcactcggtcctaccacaaggccaacatggagatcacgaaggcccncggacatggcgcactgatcgccgagcaggtctt

SEQ ID NO: 10265 - DNA, 681 bp, Zea mays
  unsure (1)..(681): unsure at all n locations; Clone ID: LIB3279-176-Q1-K6-G4
agcagcccccacggcggagatggagaagggggccctgtcgtcgtcgagggcgctgtagatcctgagcccgagcccgagccccaacacgcggcgcacatggagcggagcaggtcggaggcggatgcagaggcgaagctgccgttgctcccgtcgcgtctgcacaagtccgccagcgacaagtcggcgttcgcgcacttcggcgccgaggaggtggaggagaccgtgcgcgcggtggaggcgcggcgccccgcgacgacgagggagaaccgcggtcggcggctccccgtggcggagccggagccggcatctgagtcgtcggagtccgagtccgagtcagaggaggaggaggccagcggcggcgaggtggacgcgcgcgcggacgacttcatcaaccagttccgtcaccagctgaagctgcagcgcatcgactccttcatacgccacagggnagacggtccgccgcggccaggcggcggcccagggcgtgtaggtgtgccccagcggagggagcgagatgctgcaagagtcggtgacaccgtgaggagaggttgaaatggacgaagagaagctgcagtgaagggagatcgggtgggggaggaagnagatggtaattcctgcctgccttcttcgccgtctgctttgggttttcccgtttgctgggttctggtgcgagcatgtcgt

SEQ ID NO: 10266 - DNA, 661 bp, Zea mays
  unsure (1)..(661): unsure at all n locations; Clone ID: LIB3279-176-Q1-K6-G5
cgtccggtaaaacaagctgagactctaacttcaaaggaagatacacacacaaaggacagtgagaaggaggccaagaagcttgctcgcaaggcgctagggaggaagaagacaaccacgcactattgctgttgcttgtgcttagtgtgtgctcgcggctagaagcagacaagcagctgcgggagcataagggcggcatggcttcttgcggtagcttctactttgttcccttgctcctgctgatgctcctgctcgcttctcccgccactgctgcactggtgacatcctcccagcctggcggcaatgccactgctgcaaggccgaggccggggatggagcagctcaagcgcaagaggatcagggctctgctcaccaagcttaacaagcctgctctcaagactatccagagctcggatggcgacatcatagactgtgttccctctcacctccagcccgcatttgaccacccaaagctcaggggcgaaaagattctggatccgccggagaggcccaagaaccgcaacttcacctttggcatcagcggcagaagcagggtcggcgagggtggtggtgccagcgtggcacgccaccggcgagggcgtgtccagaaggggaccgtgccgatacggcggacgacggnaaaaagatctgctcagggctagct

SEQ ID NO: 10267 - DNA, 555 bp, Zea mays
  Clone ID: LIB3279-176-Q1-K6-G6
tttcttgttcgacccagcgtccgcggacgcctgggtgcaaactacagctaatcaggatcctctggtgactaaaggtgcaagcttggttcccctgttggggattgatgtctgggagcatgcgtactacctgcagtacaagaatgttaggccggattacctgaacaacatctggaaggtgatgaactggaaatatgctggagaggtgtacgaaaatgttcttgcttgaattgtcttaatggacaatactcatctgcgcgggtttgttttccgctgtttgaccatgtgaaataaagatggacttgtgtacctgctggaccaagtgtacatttcgctaagcatagactaacgcacaatggcctgtcgattttgtccatcctgtattcctgcttgcgtgccactccactttctgctgctcgtattggcaggcacatagtatgtgcttaacgttagactacggcacggccctttcagagttcgagcatggtgatgcccaaaagaaccatttctactcttgtctccattaataaaatctgccgaggtgcctatgtttgcttg

SEQ ID NO: 10268 - DNA, 664 bp, Zea mays
  Clone ID: LIB3279-176-Q1-K6-H1
cggtcgcgtgggcacatatgttccaagagttatatgaactttgcattttgtagctataaatatatgttgagcgaactctgactattggaggaaaccaaaacaccatgttttgacttccacatgtagaattgataagtaacatggtaaggaatgtcacaataatagaacaaaacagctatatttttttctccatcgccccaaaaaactcaaaccctatgattgatatcttttcactaaccaacttcttgatttatagtcttcttgaggatgaagtaggtgttgcagttgctggagtacccaaacctgacgtagctggagacgacgctcaagacgatcgaggccttgctgccgatcgtctttgctagggagacacggcacttgaatgagtgcctcgtcgataccgtcatgggtcgtgccttcctcttctagggtgacaactaagctgaaagcttcaaagagttcaacatcgacaacatatgtggcaccatctgcgtcctcctacagatatttgtcgtgctcacgttcggtacccaaatgcccgtgaaccgtggtcaagataccccatctacaccatgagcagagacaacacgcaaaatgagattcctttcgcttttgatcaaacaatacgataaatgaaattcgatttgaactgatagtgccacat

SEQ ID NO: 10269 - DNA, 531 bp, Zea mays
  Clone ID: LIB3279-177-Q1-K6-A1
gcgggcgcagtcgatgccgtcgaccccgacgacgccggtgacgccgtcgtcgtcgtcgtcgtcgacgacgccgcgcggcgccggcaacgtgtggcgcagcgtcttccacccggggagcaacctggccaccaagggcatgggcgccaacctcttcgaccggccgcagcccaactcccccaccgtctacgactggctctacagcgacgagaccaggagcaaccaccgctagatcgggcgagatggatggacagtgaagaggccatgtttgctggtccttgtggttatctaaaacgcacgcatgctctattatagctagtcatcactatatatatacttgtgtttgtgtattgttgttcttgttctgctggtgtctccgccgtttaatttgacctatgttatggagtgagtgatatatgtgccgtcactcctagtatatagtagtgagtgactagttggtatgtgtagtactgtactatcttttctccatatgcatgttttgccagcgcgtaatgaatgtaatgtcagtactgc

SEQ ID NO: 10270 - DNA, 712 bp, Zea mays
  unsure (1)..(712): unsure at all n locations; Clone ID: LIB3279-177-Q1-K6-A2
ccggngtcgtacccacgccgtccggctcttacnncttcccttgcnncttcccctccattgccacnnctccacctcgcgcgtcttcgaactccccctccaacncgcaacaattcccccatngggggtcgcatggccactcgaggtcgctaccgcnngcgggcgcggnaggtcgtacccagcggcgcggcgcctgtgcgccggagaagtcgacgtgagctgctggcagaggcgcacctcccgctgggcctgctgccgctggccgacatggaggaggtcggctacaaccgcgccacgggcttcgtgtggctgcgccagaggaagtcgctcacgcacacgttccgcccgatcgcgcgccaggtctcgtacgccgccgaggtcaccgccttcgtggaggaccggcggatgaggcgcatgaccggggtcaagaccaaggagctcctcatctgggtcaccctctccgacatgttcgtcgacagggacgacccgtccaagatcaccttcaagacgcccaccgggctcggcaggacctaccccgtctccgccttcgccaaggaaggcgccggtgacgacggcgcggcggccaagcacaaggatgatgcccccgccccgaccgccgccggtaaggctgctgccagcaagtgaggtgcgcggcgtccggagctttntaccttgccgtagtcgccatacttgcctnctcataatggcgtttgta

SEQ ID NO: 10271 - DNA, 635 bp, Zea mays
  Clone ID: LIB3279-177-Q1-K6-A3
ccgacgccaacatcctcatcaacaccgcccgcctccacgcccaacgctacgcgctctcctaccaggaacccatccccgtcgagcagctcgtccagtccctctgcgacaccaagcaggggtacacccagttcggaggcctccgccccttcggggtctccttcctattcgctgggtgggacaagcaccacggcttccagctctacatgagcgacccatccgggaactacggcgggtggaaggccgccgctgttggggccaacagccaggccgcgcagtccatgctcaagcaggactacaaggacggcttgacccgcgaggaggccgtcgccctcgcgcttaaggtcctcagcaagaccatggactccaccagcctgactgccgagaagctggagctggccgaggtgtttctgcagccgggctccggggaggtacagtaccaggtgtgctctcctgaagcgctggggaagctgcttgcaaagtccggcctgacacagccaacacccgaggcataatgctctgttttgctgtggcttgtgatgcctactactgctcttagacatggtttaagcatttgtgcttctgttgtgtgaacttgaatattcgacgattatgtggtctaattttatgttgagcat

SEQ ID NO: 10272 - DNA, 677 bp, Zea mays
  unsure (1)..(677): unsure at all n locations; Clone ID: LIB3279-177-Q1-K6-A4
gcccgagcgaanaagaaggagggtgctctgccggcggcggagcggagatgtccgagaggaggcgcggcgccggcaccggcacccgcaaggatgaggtggtgacccgcgagtacaccatcaacctccacaagcgcctccacggatgcaccttcaagaagaaggcaccgaatgccatcaaggagatcaggaagttcgcccagaagaccatgggtaccaccgatgtccggatcgatgtgaagctcaacaagcacgtctggagcagcggtatccggagtgtgccgaggcgagtccgtgtcaggattgcccgcaagaggaacgacgaggaagacgccaaggaggggcagtactctctggtcacagtagctgagatccctccggagggtctcaaaggtttgggaactaaggttgttgaggatgaggattaagtcgaagggttcaatcatctagcacttaaatgcataccatgagagcaagtttgataatgctgcttcagcttgttatctatgccggatgacgtgtgatagaagtttcgagacgttgctcctttcaagttttgaaattntgactatatgccatgccaagtctgtgttatctttacacattccgagcatctgtatttattatgctgagacagactcatcaatttttgcttgtacaacctgatatgactgatgtag

SEQ ID NO: 10273 - DNA, 635 bp, Zea mays
  Clone ID: LIB3279-177-Q1-K6-A5
tcgcttggccttcgtctccgccttccgacttcctctagaattcgattccctttcccaagaaaccaagaacccaagccccccaccatgacgagctcctcctctccttccagaaaggcgctgagcaagatcgcttgcaatcggctgcagaaagagctcgccgagtggcagcaaaacccccccgccgggttcaagcacaaggtctccgataacctccaaaggtgggtaattgaggtcaccggagcggcgggcaccctttacgccggcgaggcttaccagttgcaggttgacttccctgagcattatcctatggaggcacctcaggtcatttttctcaatccagcgccaatgcatccacacatttacagcaacgggcacatctgcttagatattctgtatgactcgtggtcaccagcgatgaccgtgagctctgtctgtatcagtatcctgtctatgttgtctagttcgccagcaaagcaacgcccggcggacaatgaccgctatgttaggaactgccgcaacgggaggtcgccaaaggagactagatggtggttccatgacgacacggtgtaatgatctccgtggcattgcctgtcagccttctgtactgtgaactgtgatatatctcttcaagggga

SEQ ID NO: 10274 - DNA, 185 bp, Zea mays
  Clone ID: LIB3279-177-Q1-K6-A6
tgtaaatttggattggatgggtttacaaaaccgcgagacgcgtggtggtcaaagccacagggggtggcaggcccttgtccagcgtgtgtgtagtgctgctgctgctgctgattctcaagcctgaactcggcagacgcggcctcgtcaaaagtgtaaagaacctccagttccggagggttcgttcc

SEQ ID NO: 10275 - DNA, 673 bp, Zea mays
  Clone ID: LIB3279-177-Q1-K6-B1
cacacagcagctcaaaaacccacacacctcaacaagcagagcaaagacccgggattcgccggcgcggtagcgagagcgagagatggacgggaggatgttcggtctcgagacccccctgatggtggcgctgcagcaccttctggacgtgcccgacggcgacgccggcgcgggcggcgacaaggcgggcggcggcgggcccacgcgcacctacgtccgcgacgcgcgcgccatggcggtcaccccggccgacgtcaaggagctcccgggcgcgtacgcgttcgtggtggacatgccggggctgggcacgggcgacatcaaggtgcaggtggaggacgagcgggtgctggtgatcagcggcgagcggcgccgggaggagcgcgaggacgccaagtacctgcgcatggagcggcggatgggcaagttcatgcgcaagttcgtgctgccggacaacgccgacatggacaagatctcggcggtgtgcagggacggcgtgctcaccgtgaccgtcgagaagctgcccccgcccgagcccaagaagcccaagaccatcgaggtcaaggtcgcctgaggtgggactaggtcgaccgatcgtggctctgaagatgtgggagcagtgccagcgagttgtgaggacctctacctgtgtgggatgtggcgaggaatatcgtagtct

SEQ ID NO: 10276 - DNA, 628 bp, Zea mays
  Clone ID: LIB3279-177-Q1-K6-B2
aaatccatccatcctcgtttcctccgtcccgcagcatctcaaccccatggccaagatcaagatcgggatcaatgggttcggcaggatcggaaggctggtggccagggtggccctgcagagtgacgatgtcgagctcgtcgccgtgaacgaccccttcatcagcaccgactacatgacctacatgttcaagtacgacactgtgcacggacagtggaagcaccatgaagtcaaggtgaaggactccaaaacccttctctttggtgagaaggaggttgctgtgtttggctgcaggaaccctgaggagatcccgtggggttcggttggtgctgaatatgttgttgagtctactggtgttttcactgaccaggagaaggctgcagctcacttgaagggtggtgccaagaaggttgtcatctctgctcctagcaaggatgcccccatgtttgtcgttggtgtcaacgagaaggagtacaagtctgacattaacattgtctccaatgctagctgcacaaccaactgccttgctcctcttgctaaggtcatcaatgacaagttcggtatcgttgagggtctgatgaccactgtccatgccatcactgctacccagaagactgttgatgggccctcg

SEQ ID NO: 10277 - DNA, 549 bp, Zea mays
  unsure (1)..(549): unsure at all n locations; Clone ID: LIB3279-177-Q1-K6-B3
gcgcgcggncaccccttgcctgttggcctggcgccgaaaagagctggggccctcttctctctctcctctccgagccccaaccatggtatgaggcgcaagttgtggagtcaaagggtggaaccatctcagttgcttctgcatttgttgctcatcagaaagctgtacaagacagggatcacaaattcttggcaaaagcagtgaaagaagcataccgaggagtcaattgcggcgatgggaggtccatttggagcacttgtcgtccgtcatgatggagaggttgttagctgccatgacatggttctgaagcacactgaccctactgtgcatgctgtagtgactgcaattagagaggctagccaaaagctccttaaaatcgagctctctgactgcgaaatttacgcgagctgcgtagccatgcccaatgtgctttggtgcaaatcatctctcccgaatcaagaggctgctttatgatgccaaggccgagggtgccatcggcattgattttgacgacttcattgcaagtgctcttgagagcactggatttttacc

SEQ ID NO: 10278 - DNA, 671 bp, Zea mays
  Clone ID: LIB3279-177-Q1-K6-B4
atcagaattactagtcaccagcagagggacgacgggaggaggaaacccttcgccctcgctgccgccttctccttccccggtcgcgtcttgttggggctctctcgtggtctcgacccgccggccgagttctcgcgtccaagcgtggcaatccacatatctctgtctccctctctcgctcacccctgtatccccgtctaaccgaagagcccaacttccggaagcacagctcgaagcagatccggatccttgtgagatcgctcatcgaaggctggaaacgcacggttgacgtgtggatcgctcggcgcggagaggccgtcgtagatcaaacgccccagtccatgggtccttccagcctggaggatcaggaggatcgaggggcagctttcacccacatggatgaaggcgacctcttcgcaacgccaagcactacgattcggctgtccgaggaaaacccagcttccaagttctccgacgcaacggagggggatggaggcatcgtgaacaacaccagcagggattgcggcgagcggtacccatcgaaccaagagacagctagaaggcctccgccgatgggccagcagcggtacgacgatccagggccgtgctggaggcaagaaccgagcagcgggcagacgaaagagcagttcgtcgcggagatgctcgctaggccc

SEQ ID NO: 10279 - DNA, 492 bp, Zea mays
  unsure (1)..(492): unsure at all n locations; Clone ID: LIB3279-177-Q1-K6-B5
cgtccgccccgcgtccgctgnctatcatcctaggttcgggggtgcttgcgttctgccttaacttctccatcttctacgtcatccattcaacaacagcagtgacgttcaacgttgcaggcaaccttaaagtcgcggtggcagtgttagtgtcgtggtcgatcttccggaatccaatctctgcaatgaatgcaatcgggtgtggaatcaccctggttggttgcactttctatggctacgtgaggcatctgatctcgcagcggcaggctgcagccccagggagtctaggaacagcgcaagcaaggaatcagacggagatgcttccccttgttgtggacgagaagcaagaaaaggtttagcaatggtgctaggccttctcttcacttgttgaagagagaattatatatgtactcgtgcgtgcgtgtgtggtgagggtagtaaactggaacttcgtacaagcatcgtttcctccttccatttgtgacactattcgcc

SEQ ID NO: 10280 - DNA, 526 bp, Zea mays
  Clone ID: LIB3279-177-Q1-K6-B6
gcgagggtagaaactacagctaatcaggatcctctggtgactaaaggtgcaagcttggttccgctgttggggattgatgtctgggagcatgcgtactacctgcagtacaagaatgttaggccggattacctgaacaacatctggaaggtgatgaactggaaatatgctggagaggtgtacgaaaatgttcttgcttgaattgtcttaatggacaatactcatctgcgcgggtttgttttcggctgtttgaccatgtgaaataaagatggacttgtgtacctgctggaccaagtgtacatttcgctaagatagactaacgcacaatggcctgccgattttgtccatcctgtattcctgcttgcgtgccactccactttctgctgctcgtagtggcaggcacatagtatgtgcttaacgttagactacggcacggccctttcagagttcgagcatggtgatgcccaaaagaaccatttctactcttgtctccattaataaaatctgccgaggtgccgatgtttgcttg

SEQ ID NO: 10281 - DNA, 473 bp, Zea mays
  Clone ID: LIB3279-177-Q1-K6-C1
caaatttatattattttattaagtatcttaataatctcaaacataaacattcaaaactacaaagtaaactattattgagagctaaaagtatcttcattgataacataagaatattgtaatatgacaggctttagtacataattgttatattgctaaaattttatattgttgttttaaacatcttaactttcttaaataaaaaacttaaaactagaaagttgcagatatcttcgagatctataggtttcatataaaaatcatctgtagccaatgttgtatcaaagagttataatttttttaagattttgccttgtcacatcacttctggtggtgcggttaggtctgttcatttccctctgctaatttaacacctatcacatcgaatatttagacgttagttagaagtgttaagtatacaaaactaattatatagataaaaattaaatgacaagacgaatctatctagatcgcga

SEQ ID NO: 10282 - DNA, 482 bp, Zea mays
  Clone ID: LIB3279-177-Q1-K6-C2
gtcacactagtttgaattaacaactttggacattattatggtgttctttgtaatgtcttgctgcgaacctttgcgtattttttatgttgcttaacttgcagtttatgtatgtgatagaacagtctgcagcagtgctcacatcttccatgtgtatttgtttttgcagatgggttaatgcagcaccttgtgacagctgtggccgtgagacatccaatgttggaatgggcaccccacttacctcagaaatcaaatttggcgcttcacgtgttgagatgtataggtagctataagttgaatgttattttcttacatctcatatgcttaatttagatgtgtcatatcctttcaaaacttgcaactcaatatcaggtgaatcatattgctactgtttgaagttctctaacacgtagaagagctgcatatcattatattaaaaagaaaaaaagggttaagaatccttgcaacatgcacccgcacccact

SEQ ID NO: 10283 - DNA, 630 bp, Zea mays
  Clone ID: LIB3279-177-Q1-K6-C3
gtcagcatttgctccaattgccaatccgataaactgcccttggggtcagaaagcattctcaaattacctgggctcaactaaatcagattgggaggaatatgacgcaacctgcctgattaaaaagaacagcaaagttcccactactatcctaattgaccagggggaggccgacaagttcctggctgagcagcagttgctacctcacaagttcgaggaggcgtgcaaggccgcaggggctgctctgaccttgcgcatgcagcctggatatgaccactcgtactatttcatcgctacgttcgtggacgatcacattgcgcaccatgctcagtttctcaagagcgcctgactgtaaatgtgtagcgtgaggaagacaaggaggcagcctagcatgggtgttttatctatgccgacagtgttgtctcgtgtgccagcttgaggagaggtgaacagcacaccccacatgcgaaataagatggaagatttgctgttcctgtccattgacattgacgagctcgaatgggaaggatgttgcaccgaatggtagtttccctgtcattcgctatgcgcaattatattataacggccctggtggctgaaaaaattttttatcaaaagaaaaaaaaagggcgg

SEQ ID NO: 10284 - DNA, 655 bp, Zea mays
  Clone ID: LIB3279-177-Q1-K6-C4
ccccgcgtccgctcttcttcacctcactaacaccagctagcaactctttctctcctgcaataatggccgctcgctcctcctcctcccagccgcagctggtcgcggcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgctcaacagccgcgcgtcgtcggcggcggaccggcaggccacctgcaactgcctcaagagcatgacgggccggctcggcggcggcgtcagcatggccaacgccgccaacatccccggcaagtgcggcgtctccgtcggcgtgcccatcagccccaccgtcgactgcaccaagatcaactgatcgatggaaccatagtggaggtagctcgctcgttggatggcagcgtacgtggccatcagcagcatgcagtcgtcgtcgtagcagagatgtcctagctacgtgtgtgtcatgcatcagactggcacataataaagaagtagatcatgcacccactagtgatcacttcgtctagtgtccctccgttcaatgtcgtcgtcgtcgtc

SEQ ID NO: 10285 - DNA, 542 bp, Zea mays
  Clone ID: LIB3279-177-Q1-K6-C5
tccagcgtccgcccacgcgtccgcggtcgcgtgggcggcacgacctgaaggagactccgaacatggaggccatctacaccgcgtacataccgccgtgcttgaagcctgataagctcgaagatctggacgcgttcgaggacgcccagtcgcgcgccacctccagagtcccgtctatttagctgtgcacatcgtcgacttccgcggaagacttgaagaaattctgttcacttgtcattacattcgtgtgggatttctgatggatttcaatgcttccacgttgaaccctctggacttgtttcaggataggaatctgatgtgaagaatgtacatatgctcgatctgtgtgtctgctgagcgtgtgtggatgtggactgctgtaggtaggtagatgctgtggatattggagggttctaagttgtcttcatttccatccatccatgcgcgtgtgtttactgcagactgtcagccgtgttgctgtgttgtcggacggtcgttccagagccaaaccttaaagtcaatcgaaataaatatagtctgatttg

SEQ ID NO: 10286 - DNA, 610 bp, Zea mays
  Clone ID: LIB3279-177-Q1-K6-C6
cggtcgcgtgggaagcttgaaccaaggttgtagaaaactgccgctatcagtagccgccactgcaaaatcaagcggagtactcctacatggattagagtaagatacttagcttggccaaggagggaactccgagctaaaacttgggcaattgaatttgagaaatggatggaaccaaatttgattgagaaagaaaaggcaatacttggtttcctccaattttctcatgttcggttgatcggatgtgtaggtggcagtgcagcaagatgagacctgtctgaagaatttggaagctgaaggtgagcgttggcggaaaccaagtctccaactgcacgcaaagcacaagatttagttccctccaatgtctcatcttcaaatgtctcaaatcaatgcaaatctcgaggcgttagtaggatcattattatcctccaaatacggtgttcctagttaagcaaagtaatgggctctttgtttgcaccaatttggcgtttcgtgttagacaatttcatatcgggtgaacatttccaaattcactactgacaatgtcatatatttgtgggttcagattggactgaggggccatcatttgttttttatgaagtaattgtgcaat

SEQ ID NO: 10287 - DNA, 674 bp, Zea mays
  unsure (1)..(674): unsure at all n locations; Clone ID: LIB3279-177-Q1-K6-D1
cgccgccttcaggccgtggtctacatccagatgcagcacggctgggcggcggcgttcggcacgctggcgctggccatgggcacctccaacgcgctcttcttcgtgggcacgccgctgtaccgccaccggctgccggggggcagcccgctcacgcgggtggcgcaggtgctcgtcgccgccttcaggaagcgggacgcggccttcgacagcggcgacttcgtcggcctgtacgaggtcgccggcgccaagtccgccatccgtggcagcgccaagatcgaccacaccgacgacttcagatggctcgacaaggccgcgctgcagctggagggtgacctcgccggcggcgaggacgaggaggcggtgaacccgtggcgtctgtgcacggtgacgcaggtggaggaggtgaagatcctgctgcggctgctgccggtgccggcgtgcacggtgatgctgagcgtggtcctcaccgagttcctcacgctgtcggtgcagcaggcctacacgctgaacacccgcgtggcggcgctgcacctgcccgtgacgtgcatgccggtgttcccctgcctggccatcttcctcatcctggcgctctactaccagaccttcgccccgctggcgcgccgnctgacgggccacccgcacggcgcctnccagctgcagcgcgtcgggctggg

SEQ ID NO: 10288 - DNA, 675 bp, Zea mays
  Clone ID: LIB3279-177-Q1-K6-D4
cggtcgcgtgggttcgacatctccggcgaggacatggagaggatgaaggccgtcgaccggaagtaccggactaaccagcctgccaagctctggggcatcgacctctatgcttagcttttagttgggtcgcgtcgcgtgctgcgtctctcggctccccccagacaagacaacatcaataatgaggattccctcagacgacatcagtcaaagtcatgaggatctcagacaacatcttccatcacatgtgacagtgtgaggttgatggtgaaggcaaatgttataatgctaattgtaaggatctgagaaccttgagtggtcgcatgaaaaaggttggacagtacctcttgcgcaggcaaacctaaaaagttggcatactgctcgttttcttcgacactataaatatggtgaaggcaaatgttatactgctaaaaccgtaagggtctgagaacctacacttgagtggtccctggaaaaagttgacagtacctcttacgcaggtaattgaggggttataattatttcgttaagtatttgttttcagtgctataatgtaatgagtatagctgacctgtgttttttccaaggtagtatttactatgtagtgcagtttgcaacccggtttattgtctataataatattatatccatctaactgtatgcttatttttatgctat

SEQ ID NO: 10289 - DNA, 675 bp, Zea mays
  unsure (1)..(675): unsure at all n locations; Clone ID: LIB3279-177-Q1-K6-E1
gccaganagacgtgttatgcggaaagaagagtgctcttgcatctgacagtcttcaatcacttattgtggaatatgctgaattgacaatggacgacatattaggggctaacataggacctgatactccaaaggaaaattgggacctgaacaaacttatagctaagctgcaacagtattgccatctgttggatgacttgacaccagaattgttggagggcaaaagctcaagctacgacgatttgcgggagtacctgcgtaagcgagggcgtgaagcttacttccagaaaactgaaattgtggagaagcaagctcctggattgatgaaggaagctgagcggtttctaattctcagcaatattgataggctgtggaaagagcatctgcaggcactaaagtttgtccaacaagctgttggtttaaggggttatgcccaacgagatccccttattgagtataaacttgagggatataatcttttcttagacatgatggctcaaatcaggaggaatgttatttattctgtatatcagttcaaaccagtagtgaagaaccaagaaggggaagcatcccaaaaggtgtcaaaaaagaaactggacaaaggagctaacaaacttggtgctgcccaagctgcgtcatgatcttcctgtgagaaacgnntgctgtgcttttagttgc

SEQ ID NO: 10290 - DNA, 453 bp, Zea mays
  Clone ID: LIB3279-177-Q1-K6-E2
gccttggtggcatctctgtttcatggccgagatctgctgtgaggcggcggcggcggggtcggaccagaagggggagtgcgccggcagccgcgcggcgcggcggcggaggatggagattcggcggctcagggtggtggccgaggaggcgtccgccaagaggcggaggctggaggcggatgaggaagacgcggttggggggcgagcgccgaggtacggcgtgacgtcggtctgcgggcggcggagagacatggaggacgcggtgaccgcccgtccggagttcatcaacggccaccacttcttcggggtgttcgacggccacggctgctcacacgtggcgacgtcgtgcggggagcggatgcaccagattgtggccgaggaggcgacagctgccgcaggctcgtcggtttcggacgaggcggcgcggtggaggggtgtcatggagaagagctacca

SEQ ID NO: 10291 - DNA, 640 bp, Zea mays
  Clone ID: LIB3279-177-Q1-K6-E3
cgggtcgtacccagcgttcggtgagagagagagagagcgagagggggacaggatgccccgcagcggcatttcggggaccctcaggtcgccccagatcgacgtggtcctcgacacggggaaccccttcctgaaccgcaccgtcgacggcttcctcaagtatcggcgctgtcggcgcctgcaagtggcggccgaggagaccttcgactgcctccaaggggggatgtttcaaagcgcaaggttgagcatgccctgaagaagatgtgcaagcgagtggcgcactattggtgggatctgtctgctggtcgtctacgctgggccgtggctgtatgtgcgtggagagggtgcgtgggcgcagtgactggaagaacgccatggtcgtatgcgccttgtccggcgcgctggtctccgccgccagcagccaccgcggagacaagatcgtcgaggacgccatcaccgtcggcgccgttgcagcggccgtcgagttctgccgctacctcacctagctgagcaaactgcatctgcagcgccgctgttcataagccagggtcttcaggcttcgcttcttctgacaggcaggcagcagtttcgttttgcgtgagtgtctcctgaattcggtgcctcttgcggtcgcaaatgcagc

SEQ ID NO: 10292 - DNA, 315 bp, Zea mays
  unsure (1)..(315): unsure at all n locations; Clone ID: LIB3279-177-Q1-K6-E4
gttgcatacttcatcttccacgtccactcggnaaactcataacctctgtgatgagacctcttgcccagtaacaggtgaatttgtgctagctagccaacagacattaccatcgttcaccccgccaggttcctacaccctcacgatgaagttgctgggggacagcaacaaggaactgacctgcatctctttcgggttcagcatcgggtttgttgcgccgaatcccgtcatctgaacccagtatcgaatttgtcatggatgtactttacatgaaccttgtagtgcaacattctccagtaagactcggaacgtgtgacc

SEQ ID NO: 10293 - DNA, 398 bp, Zea mays
  Clone ID: LIB3279-177-Q1-K6-E5
gtcaacgttaacgtttccttctcgatggttcgctcgaaggaaaatcatcggcttatggatatggagttcacatatgaattgcacgagttatctggcaggaagcacccagcagtcaaaaccaagatgtacttagagtagaacaagatggaaagacggaacctcacgacgccgttgctgaaacctttgctcagaagctgagcatgtagtgtgcttgttacacccatgatgggtacattgagaccatttatgttgtattagtaatatattgtttgattgcccaattaacggggtgagccattgtttcatcaaaaaaaaaaaaaaaaaaaaaaaaaaaaaaaaaaaaaaaaaaaaaaaaaaaaaaaaaaaaaaaaaaaaaaaaaaggggcgggcggttttaa

SEQ ID NO: 10294 - DNA, 617 bp, Zea mays
  Clone ID: LIB3279-177-Q1-K6-E6
ggccagacctagcgatctgaagtgccttagccttctataggatggtccttgattcattaagcatggacttgtagctagaggttatcctccaggcagagaatcctaagcgccgaccaaaggaccgccatcttattacaggatcgcataaaggcagcttcggtgaactcactactaatgcttcaaacgctagcattactcccttgttggcagaataccattccaaccatggctgtcttgcgaaccgcgacaaactatgcagatcacctgaatgactcaaatgtactctaagattgttggctgtgagaacggcccatctaaaagcacttcttcgaaggtggcgccactctgtcctttgatgttggtaagcaatctatgacgtgcccaatcattgctgaggatcttgatcggtctcactagatgctcgccgagatgctctgtgaggatagaggtgtcttctttgacatagcttactttattaaaggactcgacttaaccatcttattgctcgtcatggcagcacgccacgatgacatttggacacggctcactgtcgaggccaacacggatgtcactacaatggaaatcttgcttctactactacgcttgcttgaaccgag

SEQ ID NO: 10295 - DNA, 655 bp, Zea mays
  Clone ID: LIB3279-177-Q1-K6-F1
gttggcggtgggcaccgacggcggcagtccaaagaggtcgacgaagcggtgcccctgaagctggagagccgagctgcgtgcgccacgaaccctggctgcagaatataacgagttattatcgaagaagcgaggagagacacaatgggatgagtggcggcactgtcattgtcgccgcttccttcaccatgtaccatgtcactttgtcgaacactgagaaggaggttgttttttctcaacgtagagaaggcgatgcctaggttctagaataatatagtaacatataggaccgagtcgttcattcctgttataggaaagaaaatgtgaagcatctttggccattggaacgtgatcgtgcggccaggaaaaagatccaagcgccgcctctccctcccacagctattgatccaaacgcgctcggcctctggaagcatcgcgacgtcgacgtgcggagttgccgagaggctatacaggataatgtccactcgatgttcatcgtttgggtgccaaaaaatagcgacgtggatactctagccggcgagctttgctcctggctgtaatatataggaatgtggtattaggactatgggattttcgctgagggcacaattctatgcaattgttatgggtccagaacatatatccatgcatggactgc

SEQ ID NO: 10296 - DNA, 377 bp, Zea mays
  unsure (1)..(377): unsure at all n locations; Clone ID: LIB3279-177-Q1-K6-F2
cggtttttggttttctttgttttgacccagcgtccgcggncgcgtgggnggaggacattattttgatttcaacagtttggtccaataaagatgggaaagtaggctctctgattctgagagaatcaacgtggctttcacaagagccaagtatcttgccctagactccctagtatagtgaagtcacatttaaaacactcttccactgcatttttagttcagtaattgctatatttctgccataatagttcagtagtgcctttggattcttggaaatggaaccactttactggctagcaattcaatatgggctgatttagtctgtgtcgttagcactatcttcttgaatatgacaagtggaagtgtgtttttcttcttct

SEQ ID NO: 10297 - DNA, 656 bp, Zea mays
  Clone ID: LIB3279-177-Q1-K6-F4
atttgtattcttctcaaaaaagagcaaacatcgaagtagaaattgtgtttccagtatcttcggatgcaatttctaagacatcgaatggttctcatcatgttggttcttcaatggctactgatttgaatagtcttactattgttcctggtgtgagttctggcgaaggctgctccattcatggtggttgtgcctcgtgtccctacatgaagatgaataccctggggtcgctacttaaagtttgccatcagcttcctgataaaaacaacaaattatctgtataccaagctaacagaattaatgttaggactcctctcggaaaatcagttgcagaggttgggtgtgagcctattctgcatatgcggcatttccagaaaacaaggaggttacccgacaagcttgttcaccaggttgtaaatggtaatggtgacaaacccttgcaatagctgttcatcaatacttgtatttattttataaaggtggtatggaggatgaatatatctcaagtgaatgccatgttgagctggcataccgaagataagattatttgccctgtacggtagacatgtggacttgccctgtacgtcagacatgttgacatctgcaggcaaattaatgttgaacaaatgtgattggtctaattgaaaaatattattctg

SEQ ID NO: 10298 - DNA, 679 bp, Zea mays
  Clone ID: LIB3279-177-Q1-K6-F5
ccggtccggtttttttgtgttttgtccccgcgtccgaaaaggccaccgacgagctcgcccacgccgtcgcccccgccccggccgggggcgaccactccccggccttctcgttcagcatctggccgccgacgcagcgcacgcgggacgcggtggtgcggcgcctcgtggagacgctcgcgggggacaccatcctctgcaagcgctacggcgcggtgccggccgccagacgccgagcccgcggcgcgcgccatcgaggccgaggccttcgacgccgcggcctccacgggaggcgccgctgccgcctccgtggaggaggggatcgaggcgctgcagttctactccaaggaggtgagccgccgcctcctcgacttcgtcaagtcccgctccgcggacgccaaggccggtgacacgccgtcggaggaggcccgggctcctggcgcgcccgaggccgaggccgcccagcccgcggcgtgagcgccggacagccattcgttccgtttttgtatttcctgcagcctgtgtgtggcttgggtctgagtttgtatgacttgaaaacgttagctgtttgcacatctatgcaattcttgttcttccatgaatagccccgttctagtgcgtgttccttccatgaatagccccgttctagtgcgtgttcctgtttttctgggaatccctgccc

SEQ ID NO: 10299 - DNA, 667 bp, Zea mays
  unsure (1)..(667): unsure at all n locations; Clone ID: LIB3279-177-Q1-K6-G1
gtaccgagccgcgacttcacccctgccttctctcccttctccgtccaggccctggtgcccgagcgttctcgtgcggcaagtgggcgccgccgccggactacgccaggtgcccagttcctcgtcgggtccttcgtcgacgacgagcacccaccagttatgccctttctcttcccttcttgctgtgcgaaacccagcaccatccgaaccctaacttgagctatctggctatttgcatccggatctgatctaattaccaagcgtgtacatacatactactaacttcgatttttttttgggaaaaatattggaacatccgtgtcctttaccgggttcccccctatagaaaattcgagtattagactctacatgtcaagaaagtatggcgccaggaagcaaggcggagcggaaagcagcactagatgctggcgcatggatgttcaatgtcgtcacatctgttggtatcatcatggtcaacaaaggcttaatggcgactcatggctttagttntgctacaacactgactggacttcattttgcaatgacaaccttgatgacgttagtaatgaaatggctgggatatattcagccatcttatttaccattaccagaactagtaaagtttgccttttttgcaaacctgtcgatcgtcggaatgaacgttagtttg

SEQ ID NO: 10300 - DNA, 631 bp, Zea mays
  Clone ID: LIB3279-177-Q1-K6-G2
gcctccaatccgtaccctccaagactggacctccggttcgcgggcatgcctggtcgcggcctccgcgtccacaccgccggcgccgggaggcggcctctactcggcggcgacgtacgagctgaccccggaaaacgtagaccgcgtcctggacgacgtccggccgtacctcatctctgacgggggcaacgtcaccgtcgttgccgtcgaggacggtgtcatctccctcaagctcgaaggagcttgcggcagctgccccagctcgacgacgacgatgaatatgggcatcgagcgtgtgctcaaggagaagttcggcgacgctttcaaggaaatccgtcaggtgttcgacggggaccagccggcggcggagacaacggccgaggcggtgaaccggcacctggacatactgcggccagcgatcgcgaactacggcgggagcgtggatgtgttggccgtcgatggcgaggactgcctggtgaggtacgacgggccggaatccatcggcagcggtatcaaggcggccatcaaggagaaattcccggacatcaccagtgtggtgtttaccctgtaaaacaccgactggggctatgcatattcggggcagtccacagcaaatgaacatgctgatcgaact

SEQ ID NO: 10301 - DNA, 510 bp, Zea mays
  unsure (1)..(510): unsure at all n locations; Clone ID: LIB3279-177-Q1-K6-G3
cgncgactgggcgaccggcgctgccgccccacgtttggcgctcaggtcttcgaggggcccttagccggcgacgagcatcaccagctgaaagatggcgaggataccgtctctgaagcgcctcaatgcgtttccacatgcggaggaacacttgccgaagaagacttactctggtgctgttgtgacaattcttgggctacttataatgattacactgttagtacatgagctgcaggtctatctcaccacatacacagtgcatcagatgtacgtagatctaaaacgaggagagactctgtcaatttatgtcaacatgtcatttccttctttgaccatgtgacgcattgagtgaggatgcaattgacatgtctgggaaacatgaagttgatttgcatacaaatatttgggaagcttcgcttggacatagcaggccatatcatcggtacagagtaatagtctgacctagttgaaaaggagcattgggcacactatgatcatgaccatgaacaggac

SEQ ID NO: 10302 - DNA, 663 bp, Zea mays
  unsure (1)..(663): unsure at all n locations; Clone ID: LIB3279-177-Q1-K6-G4
ctcgttgtcttaccgtgtcgttgttgccgggttttcttggcgagcgacggagccacagaaatggagtgcaatacgggcgcctaattttagcggcggggaagggagcgaagcctgggcaaccactcgccggcctccaagaaaccgtcgccattttttcatccgagtgccgccgattttgatttcattattttctgccttcgtggggaaccaattcggttttgtttcggaagaagggagaggaggatgcagtgggcaggtctgagatcgcaggcgccggttcccacggcggcgtggacggggccgaggccaagaaccgcgaggtgcccgcagggtagattccccacagcgcgccgggcgctggtggcgtcggcagcggcctcggacgctaattcgagctcgaattcgccggggaaggacgaggagggggaggaggtggtgcgaagggagaaggaggagaaggcggtcgcgtcgcttctgatgagaagccagaagtacgccatgctaaagcagcagctcgccgtggccgcccaatttgaggattacaaggaagcagcgaggttgagggactcgctgaggtccttcgaggagaaagagcccgtgttgtgcctccgncggttgatgaagaaggccattgagaggagaggtttgagatgctgctaatac

SEQ ID NO: 10303 - DNA, 366 bp, Zea mays
  Clone ID: LIB3279-177-Q1-K6-G5
agctgaggctgctgctgctgtgtattgattgatctgcaggcagatgctaacgcagacaggatagttcttgttgtgttatggatattctggcctattgttgtagctgtgtatatgtgtgatgcagttaggtagctattggaccagcttgtttggcgcatcaacgttgtgaatgtagcagctaccaccttggtttggtaccagctttaattaagtttgggaagcgctgattagactagacgtacgttacatgttgccccatgattgttgtatggcacgcccagcccaaaatggcagtaatcagttcatttcgacaattaacgtaagtgtaagtgtacgagtagtggtattcaaatgttttttaactgt

SEQ ID NO: 10304 - DNA, 650 bp, Zea mays
  Clone ID: LIB3279-177-Q1-K6-G6
ccgacgcgtgggcggccgcgtggcctcgcctaccgtcaaaccctccacgaggagctgatttatccgctgcctccatgattaagttgcccactgagtctgtcccggatgccatctcccagattgatggccatcccaaggtgcaagaatcggaagctctctgcgactgccgaacctcacattggtctcgaataattatgatccaccgaaggacaagcgtaacagtggctctgttatgttgccccatatccctcgtcccaagatgaaggtctgcatgccttgctgatgcccagcatgttgaggaggccgacacgatgggacttgactacatgtatgttgaggctctcacgaaaatgaacaagaacaagaaccttgttaagaggcttgccaagaagtaccatgctttcttggcatcagaggccatcatcaagcagattccccgtctccttggtcctggtctcaacaaggcaggccagttcccgaccctggttactcaccaggaatccctcgaatccaagtgaacgagactaaggcaaccgtcaagttccaagctcagcaagacctttgcatgtgcgtcgccgtcggtaacttggcgatggaggagaagcagatcccagcgaacatccagatgagcgcgaacttccttgtttcct

SEQ ID NO: 10305 - DNA, 660 bp, Zea mays
  unsure (1)..(660): unsure at all n locations; Clone ID: LIB3279-177-Q1-K6-H1
cggccgcgtgggcggaagcaaacactgcccgagacatagacagcgggacgtcgagatggccgacggggaggacgccgccgccgcgcgccgccgggccgccatcacagactaccgcaagaagctgctcaactgcagggagctagagtcgcgcgtcggcaccgtgagagaaagccttaaaactgcaaagaaggattttaccaagactgaggacgacttaaagtctctgcagagtgtggggcaaataattggagaagtactccgacctcttgataatgaacgctttatcgtgaaggccagcagtggtccccgatacgtggtcggttgccgaagtaaagtggacaaggagaagttgacatctggtactcgtgttgtacttgacatgacgaccttgacaataatgcgcactcttccacgggaggtggatcctgtggtatataacatgcttcatgaagatccaggaaatgtcagttactctgctgtaggtggtctgtctgatcagattagagagctcagggagtccattgagttaccacttatgaatcctgaactctttcttcgggtgggaattaagccntctaagggtgttctactctacggtcctccaggaactgggaagaccctattgggcagggctatcgcaagtaacatcgatgccaactt

SEQ ID NO: 10306 - DNA, 586 bp, Zea mays
  Clone ID: LIB3279-177-Q1-K6-H2
acccagcgtccggcgccctcacgtcgatgcctcccgacaccccgcaatggctagacagaaggcagagcgcggcatgagcaggatgaacaaaaccacgcccgacaggccctggccctatactcctccgcgcctgggtgctccccgcgccgccatccctgaagccgtacagggacgacggggacggcttcctgccggggcaggttactcgccgggacaaagtgctgtttgagctccagctcccactaataaccacagtgacaggttcctctacccttccgtactctgtgagcgcgcccattgcatcggggggaatgctcttgccctaacagatcatgacaccatggctggcatacaataagctgcgtcactgagcctacaagtttgtcgtgagaataattcctggagtcgaaatcaaagcgctatataatacaagggaaggtgctggtgcggttgagactgattatatgcttgcatactatggcttgagcgggccgctgacgtgtgatgagaagcacggaatgctattggacagtacagatggcctatacttacgtgccgagtacatgctgctaaaggtaactactac

SEQ ID NO: 10307 - DNA, 656 bp, Zea mays
  unsure (1)..(656): unsure at all n locations; Clone ID: LIB3279-177-Q1-K6-H4
ctgttgggnnaaaactctcgaanaaacaaatgctaacttggatgagatagttgagctggcaaagcagctccagggtgagaccaatataaagccattgtggggtactgcacagctctttatgcatcctcgttacatgcacggagctgctactagcccagaggttaaagtatatgcatatgcggctgcacaagttaagaaagctttggaggtcactcactacctaggtggtgaaaactatgtgttttggggtggaagagagggttaccaaactcttctgaacactgatcttaagagagaacttgaccatttggctaactttcttcaagctgctgttgactacaagaagaagattggattcaacggaacactgttgatagagcctaaaccacaggaacctacaaaacaccagtatgactgggatgttgcaactacgtttgcttttctacagaagtatggtcttaccggagagttcaagattaatgttgagtgcaaccatgctactctatctggacatagctgccatcatgaactggagactgcacgcattaatgggctgcttgggaacattgatgcaaacactggtgatcctcaagttggctgggacacggnatcagttcatgacagacattgcagaggctactttggttatgtcaact

SEQ ID NO: 10308 - DNA, 612 bp, Zea mays
  Clone ID: LIB3279-178-Q1-K6-A1
caaaacctcgccggcggcgggcggccatgtcgcactggaaggagaaggagaatgctccacctctcccgctctatccgagcggcgcctctaacccctctcatctcctcccctgcaagcgcccgctgcaatccccatccccatgcccaccgctgcgccggccgctcgtcgatatcactggcaacgcatcggaacagcggggcgggtatgggtatacaactcccctcccgaacgcttccaggccttgcgggtttcttctgcacgacgacgaagacgacatgaacgaggcattcttgcgggaggtggacgccatctgcgaggagcgtgcgcggtccacggccaggaaggaggaaaaggagaaggagaaggagaagaagccagcagaggagcataaggggacgggcggagtggcgctcatggcggcagcgggcacgattgacgccgctggaacagagatagcaacgcttgacgatgctttctgggaggaggtgagcgccatctgtgaggagtgtgatgcccagtctgctgccaagagccaggagaggacgaaggaggaggggagcttggtgctgtcctgcgatgatgcttcactcccccctgctatttccatcaccg

SEQ ID NO: 10309 - DNA, 686 bp, Zea mays
  unsure (1)..(686): unsure at all n locations; Clone ID: LIB3279-178-Q1-K6-A2
gnaacatcgcaggttgttgttttgtttgaacacacactatcgagaggaagaggaggaggaggcggagttttgcgttgagagcggcagaatagataatcggacttccggctggataagtcatcctttttttttttgaatcgccagacgcggagagcaggagggtttatagctagcaacaggtgaaatggcaattggacagggcgacgagaagaagggctcccttgccaggagcttgagctgctcaaactgcgggagcggggcaataatttttgggcggaagagagtcgccgtctcgccgactccgggttcccggagcccgcactcgccgacgcgcaccctgcgcaagcagcgcagcgtccggttccacatggaggacgacggcgtcaacctcttcaaccagctgtcgctagatgtactggttatgatcttttgcaaggtgaaccacagtgatctgaggaacctcctcctgacatcgaaatcggtcaaagaagcgaccatcgttgctagggagcagcatttcaagttctcgacgccgccggcgaagtccggttttagagacgaggaaaccgccgccggcgacgacgacgacgaggccccccggcgcgcccaagcacacaggggtgcgaggtcgcgcctgggggacacgaacctgtcgagcatcgncgtcaaacctgtcggcgtcgttc

SEQ ID NO: 10310 - DNA, 630 bp, Zea mays
  Clone ID: LIB3279-178-Q1-K6-A3
ggcctgactggtgattctaggcaaagcactcggtgctggagttgttccagtcagtgcagttcttgcagacaaggatgtcatgctgtgtatcagaccaggggaacatggaagtacattcggtgggaatccgttagctagcgctgtggcagttgcatcactgaaagtggtcagagacgaaggtcttgttgaaagggctgcaaagttaggacaggagtttagggaccagttacagaaggtccagcagaaattccctcaaatcctaagagaagtgcgcgggaggggtttgctgaacgcagtggatctaaacaacgacgcgctatctcctgcttctgcatatgacatctgcatcaagttgaaggagagaggcattttagcgaaacccacacatgacactataatccgacttgctcctcccctcacaatcagtcctgaggagcttgcagaagcatccaaggcgcttagtgacgtgctggagcatgacttgccacagctgcagctgcagaagcagataaaaaagccagaatctgaggcagagaagccagtctgtgacagatgcggccgggacttgtacggatgaatgaagcctccgaacagagataacttctttttcgtaggcacccatctcgcccc

SEQ ID NO: 10311 - DNA, 577 bp, Zea mays
  unsure (1)..(577): unsure at all n locations; Clone ID: LIB3279-178-Q1-K6-A4
gcgagcggccgcccctttttttttttttttttttttttttttttttttcgtcgtcgatcactctattacttatagaaaataataaaatcgcacttcaattatgttcttaaaaaatcgtactaataggcaggctaaaactcagcttgtgcttccacaaacgtcgcagttaccaacaggctgagaaacggcaatttcacgctggtaaaataaaaaaacccagcgagcaaaaagcaaggaccaagccacggagaaggcaagggaaggcgatgtggcggaaatatttgcaatctcgccacccaagtgttgacactttgctattataccctctatgcctatgatttggggactacctggccggaggcgaggacgacgggatccctcatgatctctgaggagatggggcaaaggaagtgctccggcacggcggcctccgtgctgcgcttgttctcccggccgtcgccggtcctgtccttgcgggggccaagctcggcgtccctgagcttggcgagcgcctctgcagcctcgtcgaaggcctcggcgtnggcgctcccggccgccaccgcggccaccaggcgcc

SEQ ID NO: 10312 - DNA, 674 bp, Zea mays
  unsure (1)..(674): unsure at all n locations; Clone ID: LIB3279-178-Q1-K6-A5
cccacgcgtccggtcttcctgcctccttcgcccgagaaaggagagaatggggagcagcgagaagaccgttaccgcctacggcgagtacacctacgctgagctggagagggagccctactggccgagtgagaagctgaggatttcgattactggggctggtggtttcattggatcccacattgctcgccgtctgaagaacgagggccattacatcattgcctctgactggaagaagaacgagcacatgaccgaggacatgttctgccatgagttccacctcgttgatctcagggtcatggacaactgtctcaaggtcacccagggtgtcgaccatgtcttcaatctcgctgctgatatgggtggcatggggttcatccagtcaaatcactctgtgatcatgtacaacaacaccatgatcagttttaacatgctggaggctgcacgtatcaatggtgtgaagaggttcttctatgcctcgagtgcatgcatttaccctgagttcaagcagctcgacacaaatgtgagcttgaaggaatctgatgcctggcctgctgagcctcaagacgcctatggcttggagaagcttgcaaccgaggagctgtgcaagcactacaccaaggactntggcatcgagtgccgcgtcggccgcttccacaacatctacggccctttcg

SEQ ID NO: 10313 - DNA, 657 bp, Zea mays
  unsure (1)..(657): unsure at all n locations; Clone ID: LIB3279-178-Q1-K6-A6
ccagcgtccggtatcatcgntttccatcgctcctactcctatcatccanaaaatctgagcggtattgatggcgcccaagcggagaagaagccggcggcgaagaagtggcggaggaggagccctcggagaaggcggctccggcggagaaggcccccgcggggaagaagcccaaggcggagaagcggctacctgcgggcaagtccgccggcaaggagggcggcgacaagaagggtaggaagaaggcgaagaagagcgtggagacctacaagatctacatcttcaaggtcctgaagcaggtgcaccccgacatcggcatctcctccaaggccatgtccatcatgaactccttcatcaacgacatcttcgagaagctcgccgcggaggccgccaagctcgcccggtacaacaagaagcccaccatcacctcccgcgagatccagacctccgtccgcctcgtcctccccggcgagctcgccaagcacgccgtctcggagggtaccaaggccgtcaccaagttcacctcgtcttagcccccttgtagtaggcgtcgttgttgtctgcttctcaagcaagcactgtgatgtgccgcttctcatggtagtagtggtggttggctggtgtgtgtaagtggtgcagtggcttttgcctgtgttatga

SEQ ID NO: 10314 - DNA, 654 bp, Zea mays
  unsure (1)..(654): unsure at all n locations; Clone ID: LIB3279-178-Q1-K6-B2
gcnacgaattggttaacttcagnaggaagaagagtattcatgggaggatatgagtccaactttgactgatcgagtcagaagcagcatgccatcttttcctcctggaaccatgagaattggatttcctggggcaaatgcagggctactggaatctgatgttgggaggcacaatttcctaagccaagctactagatcatcagttgatgtttcaccatttaatattgaagataggatttcagctgcaagtcatgttgacatttccacaaggagatatccaagcaattttggtgttcagaatggagctcttttggagtaccagaattctgaacatactctaaatcatgggagaattgctaccatgccagctccaccttggcaacagcctattggtcttccattgcgaatacaagcacctcaacatccttcagtacttggtagaataccacagcctgtcgatggtgaaatgccagtcaagaggttggacattagtggcacgtacaatggtttgaatgtagataaacccttgatgaagcataggtcatcacctgctcctgccccgacagaatggctcccccttcaccatgcccaatcacaaactntaccactaattccnacctgataccaaacatgttagaagtgcatcagatagtttag

SEQ ID NO: 10315 - DNA, 652 bp, Zea mays
  unsure (1)..(652): unsure at all n locations; Clone ID: LIB3279-178-Q1-K6-B3
cccacgnncgtccgcccacgcgtccgagcagccaatatctgtgcttccaccggtgctagagctgtcaagagaaaactagaagcaagcaggatcccacctaatggtttagtcagaagaacaggcaaggaacagaaagtatctacatatgaatttcgccagttaaccaagaacgagttgcctccgaaggtgtctgctaggaatgccatcgacggagatcattttcataggcctttaagtagcagatacaacgatctgcctgagaaacctctgcgcaccagagaagaggacgagtgctcggtggctagctgcagcgcgaattactcagagcacagtaccagtgatgatgaccatcaatcagtcggaaccggcagttgtttccctgatgatgttatgtctgcatgtgagtatgggcaggagactgaggacgcctatggctctggtttgtttcagaacgtccatgagctggagctgcgagcatatcgatcaaccgtcagagctctccatgctgcaggacctctgacgtgggagcaagagtcgctcctgacgaacctgcgcctctcgctcaacatctcgaacgaggagcacttgcttcagttgaggcatctcctagctctttgaaaatttcaaaatcaatatgttttttgaacacctg

SEQ ID NO: 10316 - DNA, 667 bp, Zea mays
  unsure (1)..(667): unsure at all n locations; Clone ID: LIB3279-178-Q1-K6-B5
cggacgcgtggggagcggcgccggcctacaaccgttttcgtgctcacacacccaaaccttagtcgcgatcaggccccaaggactcgagatgaagtcgagggcacggtccaccgccggcgactccaggctctcggtgaggaagaccaaggctgagaaggacccaaacaagcccaagaggcctccgagcgcgttcttcgtcttcatggaggagttcaggaaggactacaaggagaagcaccccaatgtgaagcaagtctccctgattggcaaggctggtggtgacaagtggaagtccctgtctgatgccgagaaggctccctacgtgtctaaggcagagaagctcaaggctgagtacaccaagaagatcgacgcttacaacaacaagcagtctggagaccccacggcgtctggtgattccgacaagtccaagtccgaggtgaacgacgaggacgaggagggtgacgagtgatgtatgacggatgaaactctgtccaagtgtttgcagtcagggaaaaaatctcgtcgttgtcggcctaaccgggttttctcgaaggactntctagatgcagtagattagtgccgtcttctgagtagtttccttgcaagtgtcgtcccgtccctggagtgagggcagttagtttgtagtttcttcgcttcatcggcactc

SEQ ID NO: 10317 - DNA, 98 bp, Zea mays
  Clone ID: LIB3279-178-Q1-K6-B6
tataaaaaaaaaaaaaaaaaaaaaaaaaaaaaaaagaaaaaacaaatataaaaaatcacaaaaataaaaaacacaaaacatgcaaacgaaaaaactaa

SEQ ID NO: 10318 - DNA, 671 bp, Zea mays
  unsure (1)..(671): unsure at all n locations; Clone ID: LIB3279-178-Q1-K6-C1
gttggtgacctctgtagagcactggnagnacaaaattttgcccttctgtgatggcatcatgactcaactcctgaaggacctgtccagtaaccagttgcacagatcagtgaaaccaccaatattttcgtgctttggtgatattgcactggcaattggggaaaactttgagaagtatttgatctatgcgatgcctatgctccaaagtgctgctgatttgtctgcccataccactgcaactgatgatgagatgctcgactacaccaatcagctaaggagtggaatcttggaagcctactctggtatcctgcaaggatttaagagttcacctaagacacaactactgatgtcatatgctccacatattattcagttccttgatgctctgtacaatggaaaggatatggatgatgctgtgatgaagactgcaataggtgtcttgggagatctggcagacacattgggtgtccatgctggccctttgatcaatcaatccacctcaacccaggcatttttagaggaatgcttggcatcagatgatccttntgtgaaagaatctgccgattgngcgaggatagcaatcagccgtgcagtttcgggttgatgccagagtcttgagtctgcacttgcattcatctacatatcatcatgccntggtctttgattgcatcatg

SEQ ID NO: 10319 - DNA, 683 bp, Zea mays
  Clone ID: LIB3279-178-Q1-K6-C2
cccctcctcacctcaccaccatctccagctccatccgcaccaacatctccaccaaccgacacggcgaggagatgaacgcgtcgcagttcatggacaagcagatcctcggcctcgccgcctccgcctccccgtccggcggcggcgcggggggcggtgggggtgtgaatctcagcgatctgatgatcccgatcccccaggaggacggcgaggaccgtctccgtcgccggcgtagcagtagcagcgtcaacggcacatcagacgacatgctacccagctacgatttccagccgatccgcaccggcggcgccaccgccgccgcccccgtgtctcaggcctcgtggggatcgctcgactccaaggcaccctccgcctctgcctctgcctccgccgccgcctcatacaacctcaagagtgctggtatattggagccacatgtgctgaagaaagttagtcatgaggaagacaggagtaacttccctacagttactatcgcagatattgatcgaaccatgaagaagtactctgataaccttttgcatgcactggaaggtgtaagctcaaggctttcacagatggagggcagaacacaccaactcgaaaactctgttgatgaagtgaagttaacaattggtaactataatggtagcactgatggaaaaactcagcaccttgagaacatgctc

SEQ ID NO: 10320 - DNA, 636 bp, Zea mays
  Clone ID: LIB3279-178-Q1-K6-C3
gtccaaaccatcctccccctccgccgcttcgtcgccgcagtacccaccgggcaagatgaagacgatcctggcgtcggagacgatggacatcccggagggcgtcacggtcacggtggccgccaagctggtcacggtggaggggccccgcggcaagctcacccgcaacttcaagcacctcaacctcgacttccagctgcaggaggccggccgcaagctcaaggtggacgcctggttcggcacccgccgcaccatggccgccatccgcaccgccatctcccacgtccagaacctcatcaagggggtcaccaagggctaccgctacaagatgaggttcgtctacgcccacttccccatcaacgcctccatcaccaacagcaacaccgccatcgagatcagaaacttcctcggcgagaagaaggtcaggaaggtggacatgcttgatggcgtgaccatcctccggtccgagaaggtcaaggatgagctcatccttgacggaaacgacgtcgagctcgtatctcgctccgccgccctcatcaaccagaaatgccatgtgaagaagaaggatatccgaaagtttttggacggtatctatgtgagcgacaaggcgtcatcgaagagagcagtgagcgacagtgt

SEQ ID NO: 10321 - DNA, 650 bp, Zea mays
  Clone ID: LIB3279-178-Q1-K6-C4
ctaaaaaccctagcccccgaatcagatcccaccgcccgccggagcgcggaaccctgcccccggccgccatggacatgagcgatgcggagcggctgttcttcttcgagatggcctgcaacaactccgaggtcgcgtacgagcagaaccccaacgacgccgacaacttgacgcgatggggcggagcgctgctggagctatcgcagctgcgtaacggccccgacagcttcaagctcctccaagatgcggaagccaagctggaggaggcactgcaaattgatcccaacaagtctgatgcactctggtgcttgggaaatgctcagacttctcatggattcttcactccagacactgcaattgcaaatgagttctttgcgaaggcaactgaatgtttccagaaggctgctgatgtggaacctgcaaatgagctgtacaggaagtcattagacttgtcagcgaaggcacctgaactgcactcggagatccacaggcaaatggcttctcaagcggcaacacaagcatcctcagcctcaaatccaacgcaatcaaggaagaagaagaagaaggacaccgacttctggtacgatgtttgtggatgggtgatccttggcgcgggcatttgtgcttgggttggattggcagagcagcatgcc

SEQ ID NO: 10322 - DNA, 269 bp, Zea mays
  unsure (1)..(269): unsure at all n locations; Clone ID: LIB3279-178-Q1-K6-C5
gctcggtccggtcacgctgtccggcctcacgaggggaagcgggacctcagcgaccagaagtggacctaccagatcggcctccacggcgagtcgctgggcgtgcagtccgtcgccggtagctcgtccgtcgagtggggcagcgcggcagggaagcaacccttngacatggnncacaaggnccttacttcagcgcgnnccgtccgnngcgacgcgccggtggccctgngacatgggcagcatggggcaaagggccagggcgtggggtgaac

SEQ ID NO: 10323 - DNA, 633 bp, Zea mays
  Clone ID: LIB3279-178-Q1-K6-C6
cggacgcgtgggcggacgcgtgggtttatgaacaaggtgctgtatgcaagagagggagcaaagaacataatggataacacatttgattgttttccttgggatgtcaagcttgagatagatggatccaaaattgatattcctcaggactccgaaggtatccttgttgccaatatcaggagttacatgggaggggttgacctttggaagaacgaggatgatgtctctgacacttacctccctcagtccatgcatgacaagaagctggaagttgttagcttcacaggaatgctgcatctcgggaaactgcaggttgggctttctcgtgcaaaaagattagcccaaggccatcatataaaggttgaagtcagtactacaatgccgatccaagttgatggagagccatggtcccaggagccgggaaccatagaggtttctcatcatagccaggccttcatgcttaagagagtctccgaagaaccgctgggtcatgccgcttcggtaatggccgacatcttggaaaacgctgagagcagtggcattatctcagccttgcagaagagactttgctccaggagatagcgtctaggcttttgtaggacacagttctaacgccagtagttgtgtgtagctcac

SEQ ID NO: 10324 - DNA, 338 bp, Zea mays
  unsure (1)..(338): unsure at all n locations; Clone ID: LIB3279-178-Q1-K6-D1
cgctcatgcccccgagncgcatggatacgctcgtgctcgctccgccgccaccgacctcgcccgtcgtcggtcgccttaacgccggccgccccagccccgcccgcgcctgactgccccggcatcgcccgacgttggccgccctatcccttcggtggccccgctcgacaccagccgccccggaaccatcggccgtcccgacctcgcctgcagtcgtcttcctgtggccagcgctctctgctctctattattcactgctctctattgttcttatgaccaatgaagtcaaacatggtaggctcattacacattgcatgcagtaggatttaacttcgacagtc

SEQ ID NO: 10325 - DNA, 449 bp, Zea mays
  Clone ID: LIB3279-178-Q1-K6-D2
gaacaacaggcttgaaggcattggaaatacacaatccgttttttaaataattgtgtgaaaactatagtgagtgttgtagcactcgcagaaatatgcttagcaacactcgcatgtcaggatctgtgtgtgcaatgtttgcttggtggtggtctgacctacaacaatggcatccataaaacgagtgcaagtaacagatgatcttggagttgcaagggaaaaagaggtgactgcccgaacgtgagaaaaatagcatgacatgtagacctctgtgttggagttgttgtgtaaaccacaaatgccacactgaaacacatagtataaaactgcttgaaacctcctgtagccatctatgcatcaaattatcaactagcatttccagcatactgaactctcttctagccttgtgtaatgtgtatgtcaaatgtataagtcatgacatttcatattct

SEQ ID NO: 10326 - DNA, 638 bp, Zea mays
  unsure (1)..(638): unsure at all n locations; Clone ID: LIB3279-178-Q1-K6-D3
gtggtcggtggggcggcgccgnngcgccggcgccggtagtaaggcgacgccaactctggcctgaccgcgannaccgacgctcaccgtgaagcnntgctggcaccggagggcgcgggagaagtgctacaagaaagacggtggggngaggaggcgacgttcctggagatcgccaaggactacttcaaccagttcaaggaggtacccgcgcaaaagcactggatctgcttcaagagctacttcgaccagaagcgcggctcggtgttcggcaagcagaagatcatcgaccctgcggtcaaggatgagactccggaggtggtgaagcccgcagcagcagcagttgaatctcactgaggcctcgccggattgcacctggaatcgttccagctaattaaagtttatataaattagagaagcaatccggttagaaatcgttcctacccaccaatccggcacaaacgaacaagacctgaaggggttatgatcgtctcagggaaacaaaatgtaaataatccttgcgtgttctacgttggaaactactttggtctcctcagaaactagtatgtcatgctagaagtcgtagtagtggtttgacaatggttggtccagcaattcgtcatggactctgtgtttctgcttca

SEQ ID NO: 10327 - DNA, 676 bp, Zea mays
  unsure (1)..(676): unsure at all n locations; Clone ID: LIB3279-178-Q1-K6-D4
anaagaccgccttcagcttgctcaggaaaaacagtagccgcaatcactcatatgcgcaaagttcactggtttgagaaattcaattggttcatcagcagtgaaaactacttgataatcagtggccgagatgctcaacaaaacgagttgattgtgaagcgctatatgtccaaaggagatctgtatgtgcatgccgagttgcatggagcttccagtactataatcaagaatcacaaacctgacactcctattccaccattaacattaaaccaagcaggatgcttcactgtttgccacagcaaagcatgggattcaaaaattgttacaagtgcttggtgggtgtatccacatcaagttagcaagacagctcctactggcgagtaccttactgttggtagttttatgatccgtggcaagaaaaattttcttccacctcacccccttgttatgggctttggtatactcttccgtttggacgagagctccctagcatctcatttgaatgaaaggagggttaggggtgaagatgaggccctccatgaaatggaagcatagtctcgcaagaagcaaagtaaccctgaatctgatgaagatattggtagtgaaggtgcaaataaggaaactcatgaagatgaatcaaacgggcaaactacanacattcaacanaaacatgatcttg

SEQ ID NO: 10328 - DNA, 658 bp, Zea mays
  Clone ID: LIB3279-178-Q1-K6-D6
tctagatatagttgatagctcttcgagcaatggtgatactggtgccagtaagaaaagactgaaaagagcagtttccgcccaattgccaaggagagcctgtcacttgaggactcaaaagagaagaataaaactcagaaggcatcaaaccaacgctctgccaaaaacgatattgacgaagaatcaaatgaaagtgtgaaacctcaaagggtgggcagcactccttcatatggatttagttttaagtgtgatgagagagctgaaaaaaagaagagagttctactcaaagctcgaggagaagattcatgcacaggaactggagaaaagcaacttgcaggcaaaatcaaaggaaactgaagaagctgaactcaaaatgctgagaaagagtttaaagttcaaggcaacaccaatgcccagcttttataaggaaccacctcctcccaaggttgagttgaagaagatcccaacaacaagagctcgatcaccaaagcttggtcgctccaagaacacaccctcaggagggacagaaggaaattcaaaccccccagctcgttcagctcgactgagtctcgatcaaagggtcccccaaaatggtgccaagaaagcacctgctgcaaatgcggcgaagaagccccaacgaaatctctccctaaatgccttc

SEQ ID NO: 10329 - DNA, 652 bp, Zea mays
  unsure (1)..(652): unsure at all n locations; Clone ID: LIB3279-178-Q1-K6-E1
gcttatcccaattagttagtagatgagctcctgggctatataagggctgcaatatgtacctaagagatcaacaaagaagtaaactctccccagttggctgggactgccccagtctgtccagcattcagtctggctttggtgacagcagcagtaccactgccagtcgagtcccataccaactccgttccatccctcaaatctcatttgttgctacactctcctctgcgcacaccatgacagcaacgctgtatcaacatgtctgtatccctatgcttttcctattgacactgttagatattctgtactggctcttaatatgtttttaaattagtgctagttagtcagggaacccaagcaaagctcttaactcaattcattggctgtgtttgttttagtttgaacttgagagctctagtgatagtaccactgccagtcgagtcccataccaactccgttccatccctcaaatctcatttgttgctacactctcctctacgcacaccatgacagcaacgctgtatcaacatgtctgtatccctatgctttttctattgacactgttagatattctgtactggctcttaatatgttnntaaattagtgctagntagtcagggaacccaagcanagctcttaactcaattgattggct

SEQ ID NO: 10330 - DNA, 177 bp, Zea mays
  Clone ID: LIB3279-178-Q1-K6-E2
cggtcgcgtgggaattagttgagtgaatacaccaaatccgtgctctatcgttgggagacacatgtttttatgggtacaattgttgtattggtgcttggcgagcaaacatggcaatcgttttgctgaattcaatgttgacacctatgttttgcgtaatatgatttgaactttgaagcc

SEQ ID NO: 10331 - DNA, 648 bp, Zea mays
  unsure (1)..(648): unsure at all n locations; Clone ID: LIB3279-178-Q1-K6-E3
gcgcgcgcgatacggccgtagcgtgtgggtggcgtcgccgtgcggtctcttggtgccggtgcgggccgcgtgacggtgtgtgagtgtgtgacgcccacgcggaggaggtcgttctgttggttggttggtccgcggccatgatggcggtacgcggcggagaggcggtctccgtagcgctcctcttctccctcgttttcttctgcgcccgcttcctgctcgacctcctcgtctacaagccattggcagtctaccttttcaacactaaagcttctaagttgatgagtgatgaggccaggcaagcaaagattgtcaaattctcggagtccatttggaaacttacatactatgcttctgttcaagcatgggtcctcatgataataaagcaagaaccatggtcgttggatatggtgcagtactttgatggctggccaaatcaacccatcgtgtcctcgttgatgcttttctatatgtgccagtgtggattttatatctacagcattggtgctcttgttgcttgggaaacccgcagaaaagatttgctgtaatgatgtctcatcatgtaataacatctactcttattggagtttcatatctgacaggatttttntcgaattgggaccatcgttcttgctcttcatgatacaagtg

SEQ ID NO: 10332 - DNA, 653 bp, Zea mays
  Clone ID: LIB3279-178-Q1-K6-E4
cttcaatacgggccagcagttggtcctcattacccactgctccaatggaacccggatagcagcttcaagcacaaagagtaacgagttcatcattagtgagatccaggcccagctgaagaataagaatgtcacagtggatgtcaaagcaaattcagaggctaatctctcaactacagtcactgttgaggaacttggtgtactaggcttgaaaaagataattaccattccttatccacatccagcatttgggaggcttgaaatccagtacttgcatgattatgctggtatcaacgccagttctaccatgaacagaaaacctttggttaacctttctgctgtatttggcaacaaagctattgctgctggtgctgatgttgtgtatgatggtgctactggggatttcactaagtacaatgctgggttgagtttcaccaatgcagatctcaatgctgctgtgaccttgaacaacaaaggggacagcctcactgcgtcctactaccacttggtggacacagagaagacacagctgttggtgtggaggtggcccgcaacttctcaaccaaggcgaacagagtcacctttgggatgcggcatgctctggaccctaccccactgtgaaggcgcgctacagcagcaatggaatggccagcgcc

SEQ ID NO: 10333 - DNA, 635 bp, Zea mays
  unsure (1)..(635): unsure at all n locations; Clone ID: LIB3279-178-Q1-K6-E5
gctttaaggcgccgagnacgccatggcgtcctactgctccgagctgcagttcctggggaacccggtcaccaaccacgtgcagagcgcggaacagcacaaccaggacgtcaactcgctgggactcatctcctctaggaagactgctgaggccatcgagatcctgaagctcatgtcctcgacgttcctgatcgccctgtgccaggccgtggacctgcgccacatcgaggagaacgtcaagagcgctgtcaagagctgcgtgatgacggtggcgaagaagaccctgagcaccaactccaccggtggtctccacgtcgcccgcttctgcgagaaggacctgctccaggagattgagcgcgaggcggtgttcgcgtatgccgacgacccctgcagcgctaactacccactgatgaagaagcttcgcaacgtgctcgtggagcgcgccctcgccaacggcgctgccgagttcaacgcggagacatccgtgttcgccaaggtcgcccagttcgaggacgacctgcgtgcggcgctgcccaaggcggtggaggctgcacgggcggctgtcgagaacggcacggcagggataccgaacagaatcgccgactgccgctcctacccgctctaccgnttcgtgcgcg

SEQ ID NO: 10334 - DNA, 645 bp, Zea mays
  unsure (1)..(645): unsure at all n locations; Clone ID: LIB3279-178-Q1-K6-E6
cgggagggaaacagagaagaggcgacgaagcgcgacaccgagtcggacggcgaaggctccaaccccgtcggtggtggcgcgactccgccgcccctagccgccgcccctgtcgtatgcctcctccgctccgccggggacttcggtggcggcgccttcgttggatccatcttcggatatggacaaggcttgatcaccaagaagggttttaagggctcattcagcaatgcaggggcctctgccaagacttttgcagttctctctggcgttcagagtttggttttgtgcttgttgcgaaggctacgtggcaaggatgacattgtcaatgctggtatagctggttgttgtactggcctcgctttgggctttccaggggcgccacaggcattgctccaaagctgtgccaccttcgcagcattctcatgcatcatggaggggctcaataagcagcaggctgcaatggctcgcacgcttggagggactgccacgatggccgtgcatgagaaatgtggtgttctgcccccgttcacgcttccacctattcttgatgcatctgatgctttagcttcatgctgcttagcgttagtaaagcctaagcactagctacacaatagnaggggcgtgagcgatggcgaaaagggtaacttc

SEQ ID NO: 10335 - DNA, 647 bp, Zea mays
  unsure (1)..(647): unsure at all n locations; Clone ID: LIB3279-178-Q1-K6-F1
cccagcgtccgaaaggtttggaatgtgtggcactcaggaataaggcagctaggagccgttggatctccatttggtaggcaattcttgccttctgtccgttggcgcaccggacagtccggtgcaccaccggacatgaacagtgcacgatttctttccttctttggcgaagtcgaccgttcaaccctcggtccacttggcataccgaacactgtcaggtgcacaccggacagtccggtgctgtctagtgaccgttggttctggccacacgtcgcccgttgattacgcgaacgcgctgccgaccgttggcgtgagcgctgttggctcaccggacagtccggtgcacatcggacagtctggtgaattttagccacaacgacctcgatgattcccgagagcagcgagttcgtcgctgagccagcctgtctggtgcacatcggacagtccggtgcactgcaggttggtgcaagtctggctggacttagccaaacttctccaatccgatctcatttgatttgactntcaagtggcagcgccgaccttcgctagacacgagcaacgacggtgaacctcgnacatgtgaacgacgacagatcctagaggcacgcgcggaggcagcggctccccagaggacgcttgggttcgccgtc

SEQ ID NO: 10336 - DNA, 244 bp, Zea mays
  Clone ID: LIB3279-178-Q1-K6-F2
cggtcgcgtgagcaacgccgccgcctcctaaacgagcccctcttgatccatgggccaagtcacgtgctagccaacagtgggcaggacctaaaatcaccaagacctcggaatcagacggcttatgagctagtatacctatgttccatagaaagttttagttattgttgcttaagagatttttttttatctagagataactgccgatagaataattcaaactttattgtcattttgtgtgctcaat

SEQ ID NO: 10337 - DNA, 497 bp, Zea mays
  Clone ID: LIB3279-178-Q1-K6-F3
caactgggccgtccaccgccacctcttctaccaggacgcgtcggatctccgggacaagttcgaggccaaccgacacgtggataacctggacgtggtcgataggctcatcgacgatgcggaggctcagtacaggaacttccagcaccccgatccctacattgttccatgggcaccaggcggcactaaattcacaagaaacccccctccacctcaagggatcgagatcatctacaattatggcaaggaggaccagtaaacaagagtcctgcaagcggggggcagaacttccacagttccaaatcacttcctgtttaatcgagttgttgtacgagaaataagaatggaaattactggactccatccatgcttctcatttgcttgttctgataatcatgtgctcttcatctagtgcatattgaagtcatgtttcctgtcataaaatggaactgtactatctttgtcgtgcagtttaaactgaccgccggcatctcagtttt

SEQ ID NO: 10338 - DNA, 537 bp, Zea mays
  Clone ID: LIB3279-178-Q1-K6-F4
caaccccggctaccaggacgagtcggtgctgtggacggagagccgcgacgtcggccacggcttccgctgcgtccgcatggtcaacaacatctacctcaacttcgacgccttccacggcgacaaggaccacggcggcgtgcgcgacggcaccaacatcgtgctctggaagtggtgcgagggcgacaaccagcgctggaagatcgtcccctggtaaatgtgctgttctgtggctgcactggtcatcaccatgatctggagctttgaaggcatagccacctgtggtcagcagctgctgccgtgttgttagaataaagttggtggcgatcgatcgatctgtggtgatgagtgtccctatctgtgtgtttgtgtttagttccagtcgtctgtgaggaagtcagttatgtttgagtgagaggggtacttcgctcttcggtgaacactgtacttgtcatgaggagagttttcatacccggagtgtaggaactctgtactgtactcggatccttcctttttcatcgaagtgggttttattttatc

SEQ ID NO: 10339 - DNA, 644 bp, Zea mays
  unsure (1)..(644): unsure at all n locations; Clone ID: LIB3279-178-Q1-K6-F5
ccccgtgtccgcccacgcgtccgcccacgcgtccgcggccttcgagatctcatcggtgttcgtctcagcccagaaggggctacggcgcggagtcggcgagttccgagtggaacctgggttcgattcggtgatcggcggcggaatgggggtgccggaggcggtggcgctggagatacctgcggtggaggaggggtcgccgacgccactggccagggtgccaccaaggatcaggcggaggctcctccaggcgggcagcggagaaaacggcggcaaggcgccgacggctgaggagatcgagaccaagctacgccaggcgcatctccggaggcagcaattccatgaagcattgtcctccaaagcaaggcgctcaattaagagcccttcagggtcattgcaggaggaggatcgagggcagcttcttgaggcaaagctcctggctgccaggcagaagaggttgaccctcttggaaaaggaacagagccggttggctaagctggacaaactgcgacaggctgttaagagtgatgcagagatgaggttcgagagggaaagggaagaactcggaatgaaagttgaatcacgggttcaaaaggctgagaacaatcgtatgcaactaatgncatgatcgtttgaagaggcaggct

SEQ ID NO: 10340 - DNA, 398 bp, Zea mays
  unsure (1)..(398): unsure at all n locations; Clone ID: LIB3279-178-Q1-K6-F6
gngaatatgctcctccccctggccgcggacgtggcagagggagaaggggcggcatgccttggcgtgggcgtggaggccgcgggccaccgcgcggtggccgagggagctactactaggcgcgagaaatgcgacgtgccgaatgcgtgtgcttattagttatctgttagcgtttgctgcagtgctcttctatggagctccgaccccggactggaattatctcgtaggcccttccaggtgctactctacttcagctgctgtccctgtgcaactcgtccgggcaagttttgtggctcgctcgtggttttgtagctaggttaagcgagtgaagttacactcggtagcgcagtatttcctgcgagattgtttattcttctgttaatgtacctaccttactattt

SEQ ID NO: 10341 - DNA, 681 bp, Zea mays
  unsure (1)..(681): unsure at all n locations; Clone ID: LIB3279-178-Q1-K6-G2
tggcttctcctccccctcttaccaagtcctcttcgggttagggttacttagggttttgtggaggggcgatggcggcggctgatgtggagtaccgttgcttcgtcggcgggcttgcctgggccaccagcaacgagtcgctggagaatgccttcgcctcctacggcgagatcctcgactccaaggtcatcaccgaccgggagacggggaggtctcgcggcttcggcttcgttaccttctcctccgagaactccatgctcgacgctatcgagaacatgaacggcaaggagctcgacggccgtaacatcaccgttaaccaggcccagtcccgtggcggtggcggtggcggcggtggctacggcggcggtcgcggcggcggcggctatggtggcgggcgccgtgacggcggttatggcggcggtggcggctacggcggtcggcgcgagggtggtggcggcggctacggaggcggtggcggctacggcggtcggcgcgagggtggtggtggcggctacggcggcggcggcggcggctggagggactgatgtgtgggcccatcctggcttcggccgagttatcttatctatctatagtatcgngttaccgttcgcttctgtcaccgtgttagtgtccgttctacctttggattangtgttggtacccctgttgttccctttggttgct

SEQ ID NO: 10342 - DNA, 613 bp, Zea mays
  unsure (1)..(613): unsure at all n locations; Clone ID: LIB3279-178-Q1-K6-G3
gcgtaccgcgagcggnggctgctccccgcgctcctcaagaccctagctccagccggcgcgcgcggcctctccaccgagaaggctgttggtgcagccgccgtcgtcggcagccacaccgctaagtggatgcaggacacgagcaagaagtcgccaatggaactgatcaacgaggtacctccgatcaaggttgatggtcgcattgccgtctgtgaaggggcttctgaaggtgttggacttggccacccaattgagtacatctgccttgatctggaggcacctaatgtgtgcaagtactgtggtctccgttatgttcaagttcaccatcactaaattgggaagatactgccgtctaccgctgcagaagctgagttgaggagtttatgtgcacacacatttgttccacaatgttctgtagtgtactttgtactatgcttgcgggcaaaatattacctttgatgatcatcctcttctcgggcgatcgtttattaatcctgtcttagtatggttcatttttctacagatgaattgtgctcctttttcagaatctatacaagctgtgtgtattgaagttttactctaaataagcatggaactaacgagggcaatttaatct

SEQ ID NO: 10343 - DNA, 364 bp, Zea mays
  unsure (1)..(364): unsure at all n locations; Clone ID: LIB3279-178-Q1-K6-G4
gcgaggcggcggccccgcgttctccgtctccgtctccgtctccgtccgcccggcgtaaagaaaaccctccctcaccacagccgccacgccatggccgaggagaccgacaccaggcctgcctccgcgggctcccgaggccgccccgcgcccgaggacgacgacagggaggagggcgagatcaccgacctcgcctgcgctccttccccgcccgccacgcacccgctcgagcactcctggaccttctggttcgacaacccgcagagcaagtccaagcaggccgcctgggggagctccatccgccccatacacaccttctccaccgtcgagggaattctggnggctntacaataaacataatcaccct

SEQ ID NO: 10344 - DNA, 254 bp, Zea mays
  Clone ID: LIB3279-178-Q1-K6-G5
ctttggattgaccttaacatgagcaagatgaagttggtttatttaccggccgttacaccaacgtttcacttacattcgcgtggtgtgcagtcagtatatcggatgaggagttgaggacatcaacttttttttgcggcaggtacgtatgtagttggtaatacagattacagtgactcagttaatgtcgatgtaccggatcatgtgttccttacttttgcaatagtgctcgatcgttccgatcaacttttgcgtgc

SEQ ID NO: 10345 - DNA, 642 bp, Zea mays
  Clone ID: LIB3279-178-Q1-K6-G6
tgtgcatcagcgatctttacggtggaacagtgaaattactatgacttcaatgaatgtccctgaacctgtgatgtccttggcagtttcacctatatctaaagactctggaggacagttttcaaaagctctgaatcgcttccaaaaggaggatcctactttccgtgtgggtttggatgctgagagtggccagacaattatttccgggatgggtgagctgcatctggatatatacgttgaacgtattaagagagagtacaaggtggatgcaaaggtaggaaaacctcgtgttaacttcagggaaacaattacccagcgtgctgaatttgattatttgcacaaaaagcaatctggcggtcaaggtcagtatggacgagtttgtgggtacattgagcctctaccttcaggttctgatggtaaattcgaatttgataacatgattattggacaagcaattccttcaaactttataccagcaatagagaagggttttaaggaagcttgcaattcaggctcgttgattggtcatcctgttgaaaattaagaattgtattgactgatggggcttcacatcaggtggattccagtgaacttgcttttaagctagctgctatctatgcttttcgacagtgctacacttctgcc

SEQ ID NO: 10346 - DNA, 680 bp, Zea mays
  unsure (1)..(680): unsure at all n locations; Clone ID: LIB3279-178-Q1-K6-H1
cccagcgtccgcggttcccaaanaataagtcgctattttccgctgctcttggcataggaactcaattatttgcactcacaacctttatatttcttcttgcacttgttggagtattctacccttacaaccgtggtgcactatttactgcattggttgtcatctatgcactcacttcaggaattgctggatacgttgctacctctttttattctcagctggaggggacaaactgggtgaggaacttgctattgacaggatgcctgttctgtggacctctcttactgacattttgcttcttgaacactgttgctattgcttatagtgcaacagcagcactgccctttggcactatctgtgtcattgtgctcatctggaccttggtcacgtttcctttgcttgttttgggtggtattgctggtaaaaacagcaaaagtgagttccaagctccttgccgtaccacaaaataccccagggagattcctccacttccctggtaccggagaaccattccacagatggctatggctgggttcttgcctttcagcgccatatacattgagctatactacatctttgctagtgtttggggccacagaatctacacaatctacagcattctgtttattggcttcatcatcctncttattgtcaccgcgttcatcactgttgcactgacatac

SEQ ID NO: 10347 - DNA, 652 bp, Zea mays
  Clone ID: LIB3279-178-Q1-K6-H2
ctctctttctctctcctgccccaaccaaccaatggaggctctcgcgggcgccgcatcctcctccgttctccccgcgcgccacccgccctcccgcgtggccgcgcagtccctcgcgctccgccctagccgctgcggtcccctccgcgcggttggcgccggcggtgtcagtggcaaggacgacgcccaggccgcccacgccgccaacgggtctcccgtcctcaagctgaatagcgattccagtctaaatggagtcctaccgattgcagctgacaagtcacagaaggcttcatcaactaacgttagtactgactctagtggatctagagctggcctgtttagaacacccatatcaggtggtgtgcagagtgcaactttcgcccacggtctacccccgccggctttggctgttcgcaatttgatggaacaggcgcggtttgcccacctgtgctctgtcatgtctggcatgcaccaccgccgtactggatatccgtttggttcacttgtcgactttgctaacgattcaatgggccacccaattttttcgctgtcacccttggcaatccatacgaggaacttactcgctgacccaagatgcacgcttgttgtccaggtgcctggatggagtggactgtcgaacgcgcgagtcaccata

SEQ ID NO: 10348 - DNA, 653 bp, Zea mays
  unsure (1)..(653): unsure at all n locations; Clone ID: LIB3279-178-Q1-K6-H4
tgcaaagtcttttcttgtgcatacttggttaacatgtctcggccagaacatcgccgtatacctgtaaaacatcaaaggcactttggttcagtggtcttagaggggccatggcttttgcacttgctctccaatctgtgcatgaacttcctgaaggacatgngaaaaacgatattcaccaccaccactgccattgttgttttgacggtacttctcattggagggtcgacaggaactatgcttgaatctttggatgttgttggagatgaaaacacatcaagagaaaattacgaggacaacaatggttacatgcctccgagttatgaagaaggaacatcctctggaggaggattgagaatgaaactcaaacagtttcacaaaagcacaacatcattcactgcccttgacaagaactatctcactccattttttaccagtcagacagatgatgataacgatgacgacttcagtcagcaaccccaaaaccgaagactagctttttatgatcaatagcggaatttgatactctacatatcaagctaaatacacggagcagaactgacgtgcatgactatgtctatgtgtgattgggtcgaacaaatatagcaggagcatacttagttgagtagcatatggcagagcatatctgtataccg

SEQ ID NO: 10349 - DNA, 650 bp, Zea mays
  unsure (1)..(650): unsure at all n locations; Clone ID: LIB3279-178-Q1-K6-H5
gccgcgggaggcagcagcgccgccaacgcgccccgcttcggcggcggcggcgagcccaccgtccgcatctactgcaaggccgacgaggggttcagcgccacggtccgcaacggcgccgtgtgcctcgcgcccaccaacccgcgcgacgagtaccagcactggatcaaggacatgcgccacagcaacagcgtcaaggacgaggaagggtacccggccttcgcgctcgtcaacagggtcaccggcgaggccatcaagcactcccagggcgagggccacccggtcaagctggtgccctacaaccccggctaccaggacgagtcggtgctgtggacggagagccgcgacgtcggccacggcttccgctgcgtccgcatggtcaacaacatctacctcaacttcgacgccttccacggcgacaaggaccacggcggcgtgcgcgacggcaccaacatcgtgctctggaagtggtgcgagggcgacaaccagcgctggaagatcgtcccctggtaaatgtgctgttctgtggctgcactggtcatcaccatgatctggagctttgaaggcatagccacctgtggtcagcagctgctgcncgtgttgttagaatanagttggtggcgatcgatcgatctgtggtgaatgagtgtccc

SEQ ID NO: 10350 - DNA, 629 bp, Zea mays
  Clone ID: LIB3279-178-Q1-K6-H6
cgttggtctacaacgtaaacgataaaggcggcggcagcagcaagcatgacgaggtcgcgagctgtagtgacgttagtgctcctgctggccgtcgccacggcgagctgcaggctgtcgctcgccgccgacgagaccatcgcggccatcttgggccgcgacctgcgggggttcatcgccagggccggcaacctcttcaggtcggacggcggcgcctggcgcgccgcgaacctcaccgccgccgaggcgaagaacctgagggccgccaggaagtcgtcctccggcggcagagcgggctgcgtgagcgccgcggcgtgcgggaagaggcgggtgttctgcggcaagaggtgctctgacgtcgcctcctcgcgcgccgccagcctcagccacgtcccgtcgcgatgcgtcgtcaagtgcagggagtgcgtgcccacctgctagatcctcggcccctctcttcgttcgttctgcgatgggtctccactccactctcgcctcttggtgctcagcgcatatgcaggcaatgcagctccgactccggtccacacttgtgtatcgtaggttcagtcatcagtggaataaaataaaagatgcagagactgttccacaaaaaaaaaaaaaagggcggccgc

SEQ ID NO: 10351 - DNA, 613 bp, Zea mays
  unsure (1)..(613): unsure at all n locations; Clone ID: LIB3279-179-Q1-K6-A11
tcgtacgcgtgggcgccggcctacaaccggtggcgtgctcacacacccaaaccttagtcgcgatcaggccccaaggactcgagatgaagtcgagggcacggtccaccgccggcgactccaggctctcggtgaggaagaccaaggctgagaaggacccaaacaagcccaagaggcctccgagcgcgtgcttcgtcttttttttgagttcaggaaggactacaaggagaagcaccccaatgtgaagcaagtctccctgattggcaaggctggtggtgacaagtggaagtccctgtctgatgccgagaaggctccctacgtgtctaaggcagagaagctcaaggctgagtacaccaagaagatcgacgcttacaacaacaagcagtctggagaccccacggcgtctggtgattccgacaagtccaagtccgaggtgaacgacgaggacgaggagggtgacgagtgatgtatgacggatgaaactctgtccaagtgtttgcagtcagggaaaaaatctcgtcgttgtcggcctaaccggttttctcgaaggactntctagatgcagtagattagtgccgtcttctgagtagtttccttgcaagtgtcggcccgtccc

SEQ ID NO: 10352 - DNA, 652 bp, Zea mays
  Clone ID: LIB3279-179-Q1-K6-A12
ttctctcccgggcggtagataggagaggggaggagctgcggcacgaccgccgacgtagcagagggatctgttcgcctcccgtaccgagacccccctaccctttcgtcgacgactaggcttgcggcgaccgcccttggcttcgccgtcggcgagcatcaccagggactgacgattggcgggggggcgaatgcggtttttttctgatcagaactgcgacaaggtccggttttctctctaaaccgcggtctctggaggtgggtttgctttttccgtagtcacagatggacgacgacgacggcagcctgggcattcggaactggggcttctatgacaccgtgaaaggcagcctcggcctgcagctcatgtcgcccatgccacctgatcgggacacgaagccactgctcccgagagctggtttcttgcagcagcatgggcatcacaatgccccacaccagctccacgcacagcagccgcagcattaccgtgactccgctggtggcggagtctctggtggcacacctgccgagcagcaccctatccacatggacttctcgcgcaatgaagcttggctgcacccatcacaccaccagcatccccatgaacagaaggtgcttcattctcgcccctatcgaccagctgggcatgttgggca

SEQ ID NO: 10353 - DNA, 609 bp, Zea mays
  Clone ID: LIB3279-179-Q1-K6-A3
gaaactagaaaggctcctcccgaccgcaacgcccctcatctccctcgaccccgacatccccgacccgatggcgcccaaggcggagaagaagccagcggagaagaagccggcggccgaggagaaggcggagaagacgaccgcagggaagaagcccaaggccgagaagcggctgcccgcgtccaagtcctccggcaaggagggcggcgagaagaaggggaagaagaaggccaagaagagcgtggagacctacaagatctacatcttcaaggtgctgaagcaggtgcaccccgacatcggcatatcctccaaggccatgtccatcatgaactccttcatcaacgacatctttgagaagctggccggcgaggccgccaagctggcgcggtacaacaagaagcccaccatcacgtcccgcgagatccagacctccgtgcgcctagtcctccccggagagctcgccaagcacgccgtctccgagggaaccaaggccgtcaccaagttcaccagcaactgagcgcgctgcgggatccgcggatctgttagaagggttctttgctgtgtcctttccccagtcccccaccctacccggctagtagctagcttgcctgc

SEQ ID NO: 10354 - DNA, 634 bp, Zea mays
  Clone ID: LIB3279-179-Q1-K6-A4
gaagagggagcagcagtgggcaccatgaaagtgaagaacgggagaagaaggtaataagggtgcatcagagcaatcggaggcacagatatttgtgcagatggtagcggcatttggattgaaggataagttcgatgaggagttcttgagaaggctgtttgttgctaatggacggaagagggagcttgctaggattgcatgcgtgcttggatttgaggaaagccttggagatattgttgaggaactaataaagtcagggaatgctatagaggctatatatgttgcccatgaggctgatttgcttgggaaatttccacctgtgcctctcttcaaatcttatctgcagaattccactgataaggctcaggcagtgttgaaaagtggaagacattccagttctgcacttgaagaggcaaacagcttggagggcaatgcatacaggtccgtcataaggtgcgtcgagtcctgccagctacaatcggtgtttcctttagaggtcctgaggaagaattagggaagttggagaaagagaagtctgataggaaagaggcagctggtccaagcagattcccgaacagcgatcccggcgcgcagctggaccctatcccttccctgctgccaaggctgctaggggctc

SEQ ID NO: 10355 - DNA, 623 bp, Zea mays
  unsure (1)..(623): unsure at all n locations; Clone ID: LIB3279-179-Q1-K6-A5
ccgtcaccaagagcaagtttgacaacctgtatggttgccgccactcgctccctgatggtctgatgagggccactgacgttatgatcgccggtaaggttgctgtggtctgcggatacggtgatgtcggcaagggttgtgctgctgccctcaagcaggctggtgcccgtgtcattgtgaccgagatcgaccccatctgtgccctccaggctctgatggagggtcttcaggtccttcccttggaggacgttgtctctgaagctgacatcttcgtgaccaccactggcaacaaggatatcatcatggttgaccacatgaggaagatgaagaacaatgccattgtctgcaacattggccactttgacaatgaaattgatatgctcggccttgagacctaccctggcgtcaagcgcatcaccatcaagccccagactgaccgctgggtgttccccgagaccaacactggcatcattgtccttgctgagggtcgcctgatgaaccttgngtgtgctactggccatcctagctntgtcatgtcctgctcattcactaaccaggtcattgcccaacttgaactgtgnaaggagaagagctcnntgcagtatgagaagaaagtgtatgtgctc

SEQ ID NO: 10356 - DNA, 584 bp, Zea mays
  Clone ID: LIB3279-179-Q1-K6-A7
cccacgcgtccgcacaaacctaacgcggagcggcgcgggccggccgccgggcgaggtgcgcgtacctgccgtcgatcgtcgccggatccatccaccatgggcggtggcaacggccagaagtccaagatggcccgcgagcgcaacttgggagaagaacaagggggccaaggggagccagctcgagaccaacaagaaggccatgagcatccagtgcaaagtgtgcatgcaaacattcatgtgtaccacgactgaagtgaagtgcagggagcacgccgaggccaagcatcccaagacagacgtgtaccagtgcttcccccatctgaagaagtgaaaggcctgaacttagcaaccagtgctggtttggccagggggcgttccttgtgttgagggtgttcattccgtgttatcttcccgtcagtcatgcgtcctgtcctatgttaacctacataagaaagtgatgtggtgtccacttctagtgaaactactgtctgctgttaaaacctggttggtttcagaacgatgattttcgtgtgcaaaacagattactggtccgtgggagtttggccagtttgcattgtcttaag

SEQ ID NO: 10357 - DNA, 620 bp, Zea mays
  unsure (1)..(620): unsure at all n locations; Clone ID: LIB3279-179-Q1-K6-A8
cccacgcgtccgctcaaatctagagggttaactaccagtagcgtgatgaagtcatgtaggctatccgagctcagcaatgctgaggttagcagcctcaaggctcgtcctcgcatcgattcctcgtccatgtccatatttggcacggtgaatccaattgttgagggtgtctgtgtcagaggtgatgcagcagataagcagtaccaggtgaaaaactgcagatggaggccaacttttgccttggagactgatgggccatctaacactgatggccaagactttgatgaggacagtggttttcttggtaggactagactgggaagactcatccaagctgctgcaagggagctacttgacaagctgaactctgcgagaaccaattcgccaacaaagatattccttgtgctccttggtttttacacagccaatgccttggcaacaatactagggcagaccggtgactgggatgttcttgttgctggtgttgtagtggctgccattgagggaattggcatgctcatgtacagaaaaccaattgccaggcctnctggtaggttccaatctttgatttcaatggtgaactactggaaagccggtgtatgccctgggccttttgtggatgc

SEQ ID NO: 10358 - DNA, 639 bp, Zea mays
  unsure (1)..(639): unsure at all n locations; Clone ID: LIB3279-179-Q1-K6-A9
ctcacctgctctcaaccgcgaactcggcgccctgcacggcctccaagtcgcacgatgcggcggcgcccacatcctacgtggctgcgtctccgcctccgctttcgccgcgccgacgtgtcagcttcccgtccactacagagtccacattgtcctcctattacttgctccgccggcaactattcgcccctccccagtcgccactaaatccgctgccgtttcttctcgagtgtgaccatggcggctcagggatccctcgtcatgtggagggcggtcttcgcagtgctgggcttgctcatggtggccacgctggtgtacaccttggccaccgacggctcgccgttccgccttgagctgtttacgccgtggatggtggcaacactggctgatttttatgttaatgttattgcaatctcggcttgggttatctacaaggaagcaaactgggttagttctgctgtgtgggtggttctgttgttttgctttggcagtgctgtcacttgcgcttatattgttaagaaacttcttgaagtaacatctgcagggtcatcccaagatcctcttgaccttctatttatcaggcaaggtaatctatcccaaagaaagtgctctnatgttgtaattggaaggggtatttcagca

SEQ ID NO: 10359 - DNA, 539 bp, Zea mays
  unsure (1)..(539): unsure at all n locations; Clone ID: LIB3279-179-Q1-K6-B1
ctccgggnaagaagtcggtgtcgaggtccgtgaaggccggtctccagttccccgtcggccgcatcgggcgctacttgaagaagggccgctacgcgcagcgtgtcggcaccggcgcccccgtctacctcgccgctgtcctcgaatacctcgccgctgaggttctggagctcgccggtaatgctgccagggacaacaagaagactcgcattattccgcgccacgtgcttctggcgatccggaacgacgaggagcttgggaagctgttgggcggcgtgaccatcgctcacggcggtgtgctccccaatatcaaccctgttctgctgcccaagaagacggcggagaaggcgtccagtggcgggagcaaggaggcaaagtcgcccaagaaggccgccaagtcccctaagaaggcatagactgactgtccggagtgatctgatgtttagcagtaccttgttaccagtatgcggtgatgcgtangctgcagatgggacgaatgtgcttgtatgtgtatgtgtcctgctgcaagttgtcctttgcta

SEQ ID NO: 10360 - DNA, 611 bp, Zea mays
  Clone ID: LIB3279-179-Q1-K6-B10
ttttacatgtctaaccgtgtcgcgacgatgttatatagtattaacacctagtggtgtccatgccagtccagtcactatttcactttaagagatcgaaagatctagaacaaacacgaacatttatatcagtatagtcattatttcactttaagagatcaaaagatctagaacaaacacgaacatggatatcagtatagagtgtatttattatatttaaaaccataatcaatcacattttataaatcacattcatacatcataatctcatctataacccaccagttagtctaagtcgtgtctaatcgtgccaactctttagaccctttttgtaggactcttacatcaatcctttcaaccgtggctctaactcttctcgaaaaacaacttcctccttatttttaggaagagtacatcatttagtgggaaatgtagctcctcctgttttttacgtggtgaggagaatcggagagaagcctccttttgggctcctagcttctatttctaggagcaatttcttcctatttttacgaatttttacggataaaccagcagaggagttcctgtttgggtagattttttcaaatgagcccgtttaaagccctttgaggggg

SEQ ID NO: 10361 - DNA, 632 bp, Zea mays
  unsure (1)..(632): unsure at all n locations; Clone ID: LIB3279-179-Q1-K6-B11
acaagnagggcattccaccgggccagcagcggctgatcttcgccggcaagcagctggaggatggtcgcaccttggctgactacaacatccagaaggagagcaccctccacctggtgctccgcctcaggggtggtatgcagatttttgtgaagacattgactggcaagaccatcaccttggaggtggagtcttctgacacaatcgataatgtcaaagccaagatccaggacaaggagggcattccaccggaccagcagcgcctgatctttgctggcaagcagctggaggatggccgcaccctcgccgactacaacatccagaaggagagcaccctccacctggtgctccgcttgcgaggtggtatgcagatctttgtgaagaccttgactggcaagaccataaccctggaggttgagagctccgacaccatcgacaacgtgaaggcaaagatccaggacaaagagggcatccccccagaccagcagcgtctgatcttcgctggcaagcagctggaggatggtcgcaccctagcagactacaacatccagaaggagagcactctncacctggtgctncgnctncgtggtggtcagtaagccatggttcatttaagctgctgctgtacctgggta

SEQ ID NO: 10362 - DNA, 311 bp, Zea mays
  unsure (1)..(311): unsure at all n locations; Clone ID: LIB3279-179-Q1-K6-B12
ccagnggcagccaccgggaaccgngcngacaacacnggagccaagaacccnnacancancncngngaagggaaccaaggggcgccnnaacaggcnacccacaaccagcgaaggagagggggggangggggtttttttttttcctaaagccngnaccccagaagaaggggaggccagcggccanngcgaggcagcgcaagccanggcgccgaaaggacggngcccacangnacccngaagacaacgccggagcgancgggaacccaaagggagagaagaaaggcccngccaccaccggacccaccgaaaagg

SEQ ID NO: 10363 - DNA, 553 bp, Zea mays
  unsure (1)..(553): unsure at all n locations; Clone ID: LIB3279-179-Q1-K6-B2
tacgttatcacctaacggctggtgatggcggatgcgtgcctgatagaagggaatgcgctcttgccgccggaggtgaactggctgctctacttgcggaacctgccgttcaacatctctggcgaggagatgtacgacatcttctgctagtactgatcaagccggcagattcgattggacaacgtcatagacacgcgcgtgaccgcttactttttctactaggacatttacgactccaagaacgccgtctaccacctctcctgcttcaacctcggcaaccgctaccttatcgtgctctactatcagccagccaagatgtacaataagtcggatcttaacaagaaggaggacgagatcaccaggctacacgagaagtaatgaatcaggtccaatacgcccagcccgggctacagagactgagcggccatngtattgtctctgcagcctcttgtatgtatgaagagcaatcaaaaggaacatatcggttgcgctgtgctgagttacatacagcgacgataattactctggcgttattcaggctacataacaattgaat

SEQ ID NO: 10364 - DNA, 544 bp, Zea mays
  Clone ID: LIB3279-179-Q1-K6-B4
ccccgcgtccgtgacttcccagattcctgaacctgatggcaaggaagatgaaggacaccgactccgaggaggagcttaaggaggcctttcgcgtcttcgacaaggaccagaatggtttcatctcggctgctgagctccgccatgtcatgaccaacctcggcgagaagctgactgacgaggaggtcgacgagatgatccgtgaggccgatgttgacggcgacggccagatcaactacgaggagttcgtcaaggtcatgatggccaagtgaggagccgtccccgttatctatgaattgaagttaaatatcaggcacacaagctgtactttgccatgtcccttttgagtacacatcagtatcatgcaggaggtaatgtctagtagtggtcggtttaggtggtgtagtcatgggaactcgacatcagatacctggtctcttttgattgtgatgttatcttgcattattgctcctgctggagcttttaggatttgttgtaagctcatattttcaggggggtttggatcttttgtgcgagtcatatctcg

SEQ ID NO: 10365 - DNA, 283 bp, Zea mays
  Clone ID: LIB3279-179-Q1-K6-B5
ctcaaacatccctactctcctgctcctcttcttcctcctcctctcgctctcaagcgcgtcttcactccggcctagctcggacggacatcgaggggaaagggaataagtgggggcgccagcagatggatccatggatcagcagccagccttctctgagccttgacctgcgcgtcggcctgccgccgctcagcctccaccaggcaccggtggccgtcgccttggccaggcccaaggtgctcgtcgaggagaacttcctgctgcctcccaagaaagaaccagaggt

SEQ ID NO: 10366 - DNA, 613 bp, Zea mays
  unsure (1)..(613): unsure at all n locations; Clone ID: LIB3279-179-Q1-K6-B6
gcaacttccagcaggnaggctgccactcggctagctctcacgctgtcctagagaagagatgcattgggctccagagatgcgtcgtcgccatctcccccgacaacttcggtggagacccctgcccgagcgtgaccaagagggtggcggtcgaggcggtgtgctctcccgccgcttaggcttagagcccacccctacttctccgactccccgagcaacggatttgtggagagtggaactgtaagtatcgacttgcattggtcggagggaggtttagcattcgtccgtctgattccggattaggattggtgctctgctacgtctccatgaactgttcaaagcggccagctgggtccagggatggagctgtagagagagtaggagtagaagactgatcatgcgttcttttgctgttgtgtgttagtagtagctgtgtacctacccgtgacacatctcgtttttcttgaaacggaggaagacgcaggtgaagcgtgcatcgtgcctttgttgttgcaattgtgttgtgtgtggtgggggagggaaaaaaaagacaggctttgatgttctcagaaactcaagttcagatctgatagtgcatggaaaatcatgaaccctg

SEQ ID NO: 10367 - DNA, 626 bp, Zea mays
  Clone ID: LIB3279-179-Q1-K6-B7
atttggtgctgcagctgatggagatgctgaccgcaacatgattctgggtaaaagattctttgtgacaccatcggactctgttgccattatagcggccaatgctgttcaatcaattccttactttgcttctggcctgaagggagttgccaggagcatgccaacatcagctgcccttgatgttgttgcaaagaatttgaatctcaagttctttgaggtgcctactgggtggaaattttttgggaatttgatggatgctggaatgtgctcaatctgtggtgaagaaagctttggcactgggtctgaccacattcgtgagaaagatggcatctgggctgtgcttgcatggctttctattattgctttcaagaataaggacaaccttggaggagataagcttgtcactgttgaagatattgtccgtcagcattgggccacatatggtcgccattattacacacgctatgactatgagaatgtcgatgctggggctgctaaggagctgatggcaaacctagtaagcatgcagtcatcactttctgatgttaacaagttgatcaaggagatcccgtctgatgtttctgaagtagttgcagctgacgagtttgagtacaaggatccagttgatg

SEQ ID NO: 10368 - DNA, 230 bp, Zea mays
  Clone ID: LIB3279-179-Q1-K6-B8
cccacgcgtccgcagactagttaatccttggaggatctagaatgaggcatttgagggtagcccttcacaagtgacttctgcagaaagatagatgcctaaggaggtgctgaaaaatgtagtttcgtggtcgaacatctttgttgacaccattttcgaccttgtgtacttcacatggaacttttcttcaaacaaagttttgttaaaaaaaaggtatatgctgttgtctctgt

SEQ ID NO: 10369 - DNA, 605 bp, Zea mays
  unsure (1)..(605): unsure at all n locations; Clone ID: LIB3279-179-Q1-K6-B9
gagggaagttgttaaagattcagaagaaagtacagcaactggaatatcttgtagatgagttacaattccgatttgactcttcattgtctcttcctggaagcatgcacaatacttangccaagccatcgatatttctgatcggtggctacaatggtgtgacctggttatcatctcttgattctttttctcctgagaaagacacaatggtgggtctcacaccaatgagttttgcccgctcatatgcatctgctgctgcattggatggtcacatatttgcttttggtggtggaggtggcaagtcatcatggtataacacagtggaatgctatagttcgaggaataacgagtggatagaatgcccctcgttgaaccgcaagaaaggaagtctcgctggtatcagtcttaatagcaaaatatatgctattggtgggggagatggaaatgaaactttttcagaagttgagatgtttgatccataccttgngaaatggttatgtggtccatctatgctgattcctcgatttgctcttgccgtggctgaattgatggaacaatctacgccactggtgggtatgatggaagcatgtacttacaatcagcagaac

SEQ ID NO: 10370 - DNA, 600 bp, Zea mays
  Clone ID: LIB3279-179-Q1-K6-C1
cccacgcgtccgcccacgcgtccgccgtgttccgtgtccgcgtccagtgtgtccgctactccgctccccctcagtcctcagttcctcacctagcggtagcgtgcgcgcgggagacgtagatggcggcttcggaggcggcagcggcggcggcaacaccggtgacgccgacagaggggacggtgatcgcgatccacagcctggaggagtggagcatccagatcgaggaggccaacagcgccaagaagctggtggtgattgacttcactgcaacatggtgtcctccgtgccgcgccatggctccaatttttgctgatatggccaagaagtccccaaatgttgttttcctgaaagttgatgtcgatgaaatgaagaccattgctgagcaattcagcgtagaggccatgccaacattcctgttcatgagggagggcgacgtcaaggacagggtcgttggcgcagcaaaggaagagctagcaaggaagcttgaactacacatggcctcgtagatcagtgatgccgtaatgtagtattcgcctaaataagaggacgcctcgcctcaactctgagaaaactagtgcttctgtgatggtaattcgtatg

SEQ ID NO: 10371 - DNA, 161 bp, Zea mays
  Clone ID: LIB3279-179-Q1-K6-C10
actgagcctgtctgacgaagagcggagctggcagaaccatttgcgagaaacggccatatcgccatggctgtcggaggggttccctcgcacctttccttgcaacaagctgtaactgtacatagatccaggcggtgtatcaatggtggagagcgagttttttc

SEQ ID NO: 10372 - DNA, 595 bp, Zea mays
  unsure (1)..(595): unsure at all n locations; Clone ID: LIB3279-179-Q1-K6-C11
gaaattagttcatgctgtggcaactaccaatgctataatagctggtctaatcgtcatcgaggcaatcaaagtgctcaagggtgaccatcaagattatagaatgacatattgtcttgagcatccatcaaggaagatgctcttgatgcctgtcgagccttttgaacctagtaaatcatgctacgtctgctctgagaccccacttgttctggaggttaatactaagacaacaaagctccgggaagtcatntgaaaaagttataaaaagcaaacttggaatgaacctccctttgataatggttggtgccacgctagtttttgaggatggtgaggatttggaagaggatgagattgcaaattatgctttaaacctcgaaaaggtcttggctgaacttccagctccagttctaaatggtacaacacttacagtcgaggattttcatcaagaactaaaatgcagtattaacatcaaacacagggacgagtttgatgaagaaaaggagcctgacggaatggttcttgctgggtggtctggcccagttgataagcaaattaccagtaatggtgagaatagatcagttccatcttcatccaatac

SEQ ID NO: 10373 - DNA, 298 bp, Zea mays
  Clone ID: LIB3279-179-Q1-K6-C2
acccgcctcctcccacgcatattggcaccttacggaagggcttggcggccaacgacattgatactgagggcatggggatggaggccagggacgatgaagacgtgaccttcttctgcgcgccaatggacgacgagaaacactgcttctgattgcctgcatgagacgaagatgaacacttggatgcactgcatgcttggatcgagatttgtgacctgcatgctcgttaattgctgatatagatctgtgactgttggtatgcttcaatgcttttatttatcaataaatataggatcgcagc

SEQ ID NO: 10374 - DNA, 391 bp, Zea mays
  Clone ID: LIB3279-179-Q1-K6-C3
ctcaagttaagttaagttatcatggtgtgtgcttggtcgtcgtccgtcgttcgtcgtcgtcgttaaggttttaagagatgatttggtcctgtgttgccgaggggaagtccaatctgcttttcttttcttttttgtggtttgttccatcagactgaggaaggagatgagatgattattctcccagattaaaaaaaaaaaaaaaaaaaaaaaaaaaaaaaaaaaaaaaaaaaaaaaaaaaaaaaaaaaacaaacaaaaaaaatacaaaaaaaatagactcttctatagtgaaaaaaaaaatataattaaaggggcccccgttttaaaatacccagactgacgaacaccctggtgaaacctaaattattttttttggagcacataaaattaatt

SEQ ID NO: 10375 - DNA, 433 bp, Zea mays
  unsure (1)..(433): unsure at all n locations; Clone ID: LIB3279-179-Q1-K6-C4
cccacctactcacccacacattcgttcgagtgcctcacatatcaccatgtcgctgttaaacctccacttggccaagaacactggcctcctcagagggccccanagactgccctggaggaactgcagtgccactgtgtcagaggctcctggtgctgtcgctacaccctctccaagctccctgtgcgctacaagggagggacagttcttgacggctcactgtatggggcactggcttggattcaagcgtttaaaacagatggtggccctgcgtggtcccatctggatcctgcaacctacgaggccgatcagtcgacagggattaagcatcactctgtaccagtgattaggcgcacagtctgatgccctggattgaatcttgaatgatattggatgatcgctcacttcattatctacgctgtactcgttgagcaca

SEQ ID NO: 10376 - DNA, 605 bp, Zea mays
  Clone ID: LIB3279-179-Q1-K6-C5
ctcgcatccgcagcctctcgagctctactccatcccctcgatctcgaagcgcagcagcagcagtcaggcggccatggacgccagcgcagcaggagccggcgggaaggcgaagaagggcgcggccgggcgcaaggccggcgggccgaggaagaagtcggtgacgaggtccgtcaaggccgggctgcagttccccgtcggccgcatcgggcggtatctgaagaagggccggtacgcgcagcgcgtcggcacgggcgcccccgtctacctggccgccgtcctcgagtacctggccgccgaggtgctggagctggccggcaacgctgccaaggacaacaagaagacccgcatcatcccgcgccacgtgctcctggccatccgcaacgacgaggagctcggcaagctgctgtccggcgtcaccatcgcccacggcggcgtcctccccaacatcaacccggtgctcctgcccaagaagaccgctgagaaggcggcggccaaggaggccaagtcgcccaagaaggccgctaagtcccccaagaggcatagaggggcgcctctaccgctgtgatgttgaatgctcgtgttcagtagatctttacttctgtagt

SEQ ID NO: 10377 - DNA, 679 bp, Zea mays
  unsure (1)..(679): unsure at all n locations; Clone ID: LIB3279-179-Q1-K6-C6
gtgacaggttgcttattctaagttctgggcaggttctggaattcgactctcctgagaatcttctaagcaacgaggggagtgctttctccaagatggtgcaaagtacaggacctagcaacgcagaatacctcaagagtcttgtatttgcaagtggagaagagaggtcccggagggaagaaatcaagctgcaagatatccaaaggagatgggttgcatctaaccgatgggctgaagctgcccagtttgcgcttgctagaagcctcacatcatcacatagtgacctccttgcattagaagctgccgagggaaataatattctgaggagaacaaaggatgctgtaatcactctgcaaagcgtactggaagggaagcacaatactgaaatcgatgaatctctaactcagtatcaggtcccagctgatcgatggtggtcttcactttacaaagtgatcgaaggcctcgccacaatgagcagattgggccgcaaccgtctgcagcaaccttcttataattntgagaacaacaattctattgactgggaccaaatgtagatgtagaattctggatcacaacagcattgtggagtaggctggaggtgtagttatttctggcggatttgattcctgcngtgtgtaaacgctgcagcaacacgtaacttgcgaataagaacgagttttgc

SEQ ID NO: 10378 - DNA, 540 bp, Zea mays
  Clone ID: LIB3279-179-Q1-K6-C7
cccacgcgtccggccagccattggttggtagcaagccaagctaatcaagttagctttagatacccgctcccgctcttcttccctccgacgaaggcagctgacgacacagcaggctagcttcggagttcggagcactcagccatggccattgccggcgctctcctcctcctgctcggactcctcgcgcgggaggccgctgccggcgggtggcagagcgcgcacgccacgttctacggcggcggggacgcgtccggcacaatgggcggcgcttgcgggtacggcaacctgtacagcacggggtacggcacgagcacggcggcgctgagcacggcgctgttcaacgacggcgcggcgtgcgggtcctgctacgagctgcggtgcgacaacgacgggcggtggtgcctgccgggcaccatcaccgtcacggccaccaacttctgcccgcccaactacggcctccccagcgacgacgggggctggtgcaacccgccgcgcccgcactttgacatggccgagccggcctttctccccatcgggcag

SEQ ID NO: 10379 - DNA, 596 bp, Zea mays
  Clone ID: LIB3279-179-Q1-K6-C8
cagtgttcctgctatgtatgttgctattcaagctgtcctttccctttatgctagtggccgtaccactggtattgtcctggattctggagacggtgtcagccacactgtcccaatctatgaaggctatgccctcccgcatgccattcttcgtctcgatcttgctggtagggacctcactgattccctcatgaagatcctgactgagaggggttactctttcacaaccactgctgagcgggaaattgtccgtgacatcaaggaaaagcttgcatatgtcgcgctcgactacgaacaagaactcgagaccgccaagagcagctcatcagttgagaagagctatgaactgcctgatggacaagtgatcacaataggcgcagagcgcttcagatgcccggaggttctcttccagccatccttcattggtatggaagctccaggaatccacgagacgacctacaactccatcatgaagtgtgacgttgatatcaggaaggacctgtatggcaacattgtcctcagtggtggatccaccatgttccctggcatcgccgaccgcatgagcaaggagatcactgcgctcgcgccaagcagcatga

SEQ ID NO: 10380 - DNA, 647 bp, Zea mays
  unsure (1)..(647): unsure at all n locations; Clone ID: LIB3279-179-Q1-K6-C9
ttttaggtcccttttttttctcgatctggaagcgccgcagtagcagccatggacgtgagcggagcaggcgggaaggcgaagaagggcgcggccgggcgcaaggccggcgggccgacgaagaagtcggtgtcgcggtcctccagggccgggctgcagttccccgtcagccgcgtcgggcggtacctcaaaagggccggtacgcgcagcgtgtaggcacgggtgcccccgtctacctcgccgccgtcctggagtacctcgcggccgaggtgctcgagctcgccggcaacgcggcaagggacaacaagaagacgcgcatcatcccgcgccacgtgctcctcgccatccgcaacgacgaggagctcggcaagctgctggccggcgtcaccatcgcccacggcggcgtcctccccaacatccacactgtgctcctccccaagaaggtggccgagaaggcggccaaggagcccaagaaggccgccaagtcccccaagaaggcgtagagtgatctcctgtcttagaacaatattaccattagcggccgtgcagttagactagatcatgtttagtgtagatccgcaatgttcttgtccctgctgccatctgggacggtttatctagtacatccatgcattttncttgctaattgc

SEQ ID NO: 10381 - DNA, 604 bp, Zea mays
  Clone ID: LIB3279-179-Q1-K6-D1
ccccgcgtccggccctccgccgcctgcgtccacctccgctcgccgctctccccgcgtctccctatcatacgcagctcgtccagatgtcgtccgaggcgtcgaaggtagcggtgccggagtcggtgctccgcaagcggaagcgcgaggaacagtgggccaccgagaagaaggagaaggccctagtcgagaagaagaagtccatcgagagccgcaagctcatcttcacccgcgcaaagcagtacgccgaggaatacgatgcccaggagaaggaactggtgcagcttaagcgcgaggcccgtttgaagggtggtttctatgtcagtcctgaggcaaagctgctctttgtggtccgcatccggggtattaacgccatgcaccctaagaccaggaagatcttgcagcttctgcgattgaggcagatcttcaatggtgtgttcctcaaagtcaacaaggcgactattaacatgctacgcagggttgagccatatgttgcatatgggtacccaaacttgaagagtgtcagggagttgatctacaagaggggctatggaaagctgaacaagcagagatccctctgtccaacaaccaagtcatcgaggagggc

SEQ ID NO: 10382 - DNA, 313 bp, Zea mays
  Clone ID: LIB3279-179-Q1-K6-D10
cctacccctctggtgcggggggggcgctcgacaaaacgatgcttcggcccacagccaggacgcggacggatgcgaacctcgacgagctcaacagggtctggcctccgccgttcaaggacaggggcgcaccaccgtccaccgatgcccactacacgaaaaacacagcggggcggggggctcctttatggtgtaagagatccatcaggacgacgagagggaggggcggagtgcacacaaccagaggggaggggaacaaaggcgaccggggcacgcccacacagaacacggctcgccgccgaggacagatctgcgg

SEQ ID NO: 10383 - DNA, 485 bp, Zea mays
  Clone ID: LIB3279-179-Q1-K6-D11
ccccgggtcgaccgagcgtcctatcttttctactgcctggggatccgggggtggggcgctgcgctaatggcggcggcggcggtgggcgggcaccgcgaggcgctctactcgctggccgtggtccagttcaacggcagcggcgggggcaaggacgaccgcgacctccgcgccggagccgcgctgtgcgcgcgcgcggggtgggggggccacgtgttctttctccgcgagctggggcactgcctccaggacggctacggcgtgcggcggtccgtgctggacgggcggcgcctcctgatccaggcgaacgcgcgcgagctcgcggcggtcgccgccgcctcgccgctgcagccgccgccgcagccgctcggcaaggcggcgccccacccgactcggcgtcactcgtgcctcctgagcgacttcgggtgccgcgccgcggccggggagccgcacgcggccaaccggttcctggcggactggttcgcgtc

SEQ ID NO: 10384 - DNA, 128 bp, Zea mays
  unsure (1)..(128): unsure at all n locations; Clone ID: LIB3279-179-Q1-K6-D12
ctaaactccttccccttacagtgaggtttttacatgatccatcaaaaacactactataatgcctgtgctttaacaagcaacatgtnncaaaataattcaatacctcaacatacaaacaaaaaaaccat

SEQ ID NO: 10385 - DNA, 580 bp, Zea mays
  Clone ID: LIB3279-179-Q1-K6-D2
gttctagatcgcgagcggccgctcgcgatctagaactagtcaaaaaaatcccccattttcttcgaggcgaggagagcgtgaaagacagggcaccggcagcgacgatgtcggggcgcggcaagggcggcaaaggtctgggcaagggcggagcaaagcgccaccgtaaggtgctccgtgacaacatccagggcatcaccaagcccgcgatccgtaggctggctcggaggggcggcgtgaagcgcatttcggggcttatctacgaggagacccgcggcgtcctcaagatcttcctcgagaacgtcatccgcgacgccgtcacctacaccgagcacgcacgccgcaagactgttaccgccatggacgtcgtctacgcgctcaagcgccagggccgaaccctctacggcttcggaggctaggctggatgcctcttctccttgctgtcgtggatgcctgtttgttgttagggttatttcgtttagttccttgtctgtgacgtgttggactattgttagtagtattcttgaagttgtttcgaatgtaatccaatcttatcgttcgataattgaaatgattcctgggc

SEQ ID NO: 10386 - DNA, 586 bp, Zea mays
  Clone ID: LIB3279-179-Q1-K6-D3
ctgtaaccccgcccgcgatggaggccgcaaccgccgccacggcggcgatgatgtggttccggaagggcctgcgcgtgcacgacaacccggcgctggacgcggcccgccgacacggggccggcgctgcatccgcgcggctgtacccggtgttcgtgctcgatccgcgctaccttcgcccggatgccgtcgcggcgtccccaggttccgcgcgcgccggggtcgcccgcatccgcttcctcctcgagagcctcagcgacctcgacgctcgtctccgccgcctagggtcccgcctcctcctcctgcgcgcccgcgacgacgtcgccgacgctgtctgcgcggccctaaaggactggaacattggcaagctgtgcttcgagtccgataccgagccgtacgcgctggcccgcgataagaaggtcacggattttgcattggcgtccggcatcgaggtgctcacgcccgtcagccacaccctcttcgacccagaagaaattataaagaagaacggtggtcggccgcctttgacatatcaatcctttgtctacattgctggggagccggcagctcccgccatggaagaatactc

SEQ ID NO: 10387 - DNA, 515 bp, Zea mays
  Clone ID: LIB3279-179-Q1-K6-D4
accacacgtcctgaaggattgactaaggaattaacagtgcatgaggagatacgtgagaggagaattgctggggacatggatggggtgcatgtgacgtgaagggatacattgtatcacatgctgatgcactgccttgcatcatgagaggatcgatcaggtgaacggaaaggggagccaagtgctctgtcatcccgagtattaccatggcatgctgaggtgcatgctgcactatttgtacatcttgattcagggcttcatagggggatgtattatctggagagaaatgatgagcactttgatgctatgcagcgtgctatgaggcaggactatgcgtggggacaccctgaaggatgccctgtttgcctgccactctacaggctgatgaaaggagattgtcagaagatatctatgcatatatcatgcttttaggaaataggctctaatggatgtattagccttggaatgattgctagattccatcctgagatgcatgagaaaggtgaatggatgtatcc

SEQ ID NO: 10388 - DNA, 626 bp, Zea mays
  Clone ID: LIB3279-179-Q1-K6-D5
ggagaagcttggtgctgtccctcatggcctgtccaccgactctgaggttgcccagagggaagccgagtctatctctaggaagactctcaggagctcagccgagaagtttgagttccaagctgaggtttccagactcatggacatcatcatcaactcactctacagcaacaaggatatcttcctgagggagctcatatctaatgcctctgatgctggataagattaggttcctttcccttactgataaggaagttctgggtgaaggggacactgcaaagcttgagattcagattaagttggacaaagagaagaaaatcctctccattcgggataggggtattggtatgaccaaggaagatcttattaagaaccttggaacgattgctaaatctggcacttcaggaacaggagctgctcgagtctcttgtcgaagctgatacgagaaggcaggaaagagctaaaaagatggaagaaaagaaagtgtatctgcaactatacgaagcaatggaggcgttggtcaagatcaatctggagacgaacaagatcatggacttcatcaagtttgacgtcggcaacgtggtcatggtgactggcgggaggaacaccgggcgtgtaggagtcatcaa

SEQ ID NO: 10389 - DNA, 526 bp, Zea mays
  unsure (1)..(526): unsure at all n locations; Clone ID: LIB3279-179-Q1-K6-D6
gggacacacttttgattccatggtttgaatgaccaatcatttatgatgtccgtgctcgactgaatctcgtggagagtacttctgggagcctagaccttcagatgggtgttctggacaatgaaagcttgtaccttaaaacaggaggatacaagaagctggagtggttgtctgaaggcttttgaactgcttgaagcattagtgtagctttggtgcttttgtgactgatcagctctggagcagctagagtgatgtagttgtgggcttttgaacaatacctagagtgatatgaaacattagtgatgtagttgtgggcttttgaactgcttcacgctggagtgatgtcgctgtggtgcttttgtgactgatcatctctggagcttttgtgaatgatctagctagctatctgtaaatgatctagttgtgaatgatattataattgtgatgcttttgtgaatatacagaagagaccgaccgaagaagaaagtgncatcagcgagtgcggggagcttccagtggtctaagcgtt

SEQ ID NO: 10390 - DNA, 645 bp, Zea mays
  Clone ID: LIB3279-179-Q1-K6-D8
gcgcaaccgccgctacatcaaccgcagggcccgctcatcgtctacggcaccgagggctccaaggtcgtcaaggccttccgcaaccttcccggtgtggatgttgccaacgtcgagcgcctcaacctactagaccttgcccccggtggccaccttgggcgctttgtgatctggacccagagcgcgttcaataagctcgaggaggtgtatgggagctatgacgccccgtcgcagaagaagaagggcttcgtgctgccgaggcctaagatgtccaacgctgacctgggcaggatcatcaactctgacgaggtgcagtctgtggtgaagccactcaacaaggaggtgaagcgcagggagaagaggaagaacccactcaagaacatggctgctgtgctcaaactcaacccctacctcggcactgcccggaagatggccacccttgctgaggctgctcgtgtgaaggccaggaaggcgaagctcgactccaagaggaccaagcttaccccggagactgccaaggttaaggctgctggcaaggcatggtacaagaccatgggtctcgacagcgactacaccgagtttgagaacttctcaaagtggctcggcgtgactcagtgagcggcaagggtagttaaagttttgagtagc

SEQ ID NO: 10391 - DNA, 589 bp, Zea mays
  Clone ID: LIB3279-179-Q1-K6-D9
ttccgcgtccgcactaatcaacaagcaggaccagctagctagctcctcccactgctatcacccgggccccggccagccatctcgctgaaagagaaaagcgcagccatgaagactactagctcgggcattgcagtcgtcctcctggtggcgatgctggcagtccagtccgcggtggccgacatctggtgctccgacgtgctcaacgacctgtcgccgtgcctgcccttcctgcagggcaaggcagccaaacccagcgagagcaacaaccagtgctgcgacggcgtgaggaccctgtacgcggcggcggacaccaggcccgacaggcaggccacgtgccggtgcctcaaggcggcctacgttcaggtccacgctgtgctctccgcggcgcaggagctgcccggcgactgcggcctctcgctgtcctacaacatcacccccgacatcgactgcgacaagatcgaatgaagggatactgttcccttaccagaatccatacgacgggatggtgatgttcagtgccctgctagcagtaagctgcatctgcactgagtgactagaataaaggaatttgggatgtttgtgctgattg

SEQ ID NO: 10392 - DNA, 593 bp, Zea mays
  Clone ID: LIB3279-179-Q1-K6-E1
ccaaaccttcgacgttttgcatctccaagcagcagcgtctcctccccagatccatcaattcgttcggaccgcccttctcgtgtccccgttccaaagcgcggcaggctgagcggttccgtcagatttgagtcgtcatgaatcccgagtatgattaccttttcaaacttctgcttatcggtgattctggtgttggaaaatcatgcttgcttctcagatttgcagatgattcatatctggacagctacatcagcacaattggagttgacttcaaaattaggacagtagagcaagacgggaagaccataaagcttcaaatttgggatactgctggacaagagcgcttcaggacaatcactagcagctactaccgcggagctcacggaatcattattgtatatgacgtgacagaccaagaaagcttcaataatgtgaagcaatggttaaacgagattgaccgttatgcaagcgacaatgttaacaagctccttgttgggaacaagagcgatctaactgctaacaaagttgtggcaaccgagacagcaaaggcgtttgctgatgagatgggcatctcattcatggagacgagtgccaaa

SEQ ID NO: 10393 - DNA, 623 bp, Zea mays
  Clone ID: LIB3279-179-Q1-K6-E11
cccctcgtccgcgggatcgggcggcatcctccgtctcgtaccgacccccgcaccgccaaaccctagtccggcgaggcgaccttgcgacctccgttcctctgcgctccggctgagtttctgatttgggataatcctgttctctctgagtgaatcaacatgtctgggaatgatgataagccacatgctgctgcagacagaataaaggcagccacgttatcagtggctaagggattgagcagggctcaagctgaacgcgctgcgactgctgctgcccgcaatgtgaatgcctatgggcagaaggaagagggaccaagccgctggcaggagaggaaggaagccaagagacagatgtatctgatgagtacagagaaggctgcgaagctgggcactgtgaagccaaaagcttcagaaacttcttctgttggcgcatatacccaatgccagaagtgtttccagcatggtcactggacatatgagtgcaaaaacgagcgggtgtacatatcacggccctcaagaacgcagcagcttaagaaccccaagcttaagaaaagcgtaccggtttcttatcaatttgagaatcctgatattataaaggagagggaagaggagcagaggatgatgaa

SEQ ID NO: 10394 - DNA, 72 bp, Zea mays
  Clone ID: LIB3279-179-Q1-K6-E2
ctccgaaaaaaaaaaaaaaaaaaaaaaaaaaaaaaaaaaagaataataaaagatcaaaaaattaaaaacaaa

SEQ ID NO: 10395 - DNA, 666 bp, Zea mays
  unsure (1)..(666): unsure at all n locations; Clone ID: LIB3279-179-Q1-K6-E3
cttggtgttggtgttgcaactataactgatctgcaactcaacgtagtgggatctgtattgtccctactggcaatcatcacaacctgcattgctcagatcatgacgaatacaatacagaagaagttcaaggtatcttcgacacagctcctgtaccaatcgtgcccataccaagcattgactttgttcctcgtcggcccattccttgacgggtttttgactaaccaaaacgtatttgctttcgactacacaactcaagtcctgttcttcatcgtgctgtcgtgcctgatctcggtctcggtaaacttcagcactttccttgtgatcgggaagacgtcgcctgtaacctaccaagttctcggccacctgaaaacgtgcttggtcctcgccttcggctacgtcctgctccacgacccgtttagctggagaaacatacttggaatcctgatcgcggtgatcgggatggttctgtactcgtacttctgcactagagagactcagcagaagccggcagaggcctccccgcaagccatccaggcaaaggagggtgaatcgagccctctgatcttggattccctgagcgccgctgaaaacggnggcagtgccaccgacgacgagcctctgaaggtgcccatgtgnagctcgaagtactccaaggcgtgaaaagct

SEQ ID NO: 10396 - DNA, 595 bp, Zea mays
  unsure (1)..(595): unsure at all n locations; Clone ID: LIB3279-179-Q1-K6-E4
cggacgcgtgggcggacgcgtgggcggcaaacggtggtccagttgacattgaaatggttgattcgctagagacatagttccccagatcaaagcctgagtataatatgtggatcgagatatggagatcagaagagttatggaatttgcatgtctgctccggaatggaatatttgtgtatgaagcctttgacattttgaggcatggcagacaactgaggtcgaaatagcgtggtagcttggatctgcacatctatatgattgagggcctggtgtttaggattataacctgcccagattatataacctatcttattttgaactaagtgttagttcaaaataagttagattatataatctggacaaattatattcccaatcaaacaggctatgattggacttactgatacccatttgagtagaactgatcttgacaggtatccgagaaaacgatgaccttaattgaaaattttgctgatacgctgatgcagcacttanggtctactattgttattggtgtagccaagggattgcaaatgggaaaatggtgtaaaaacgctgcatatttttttttgcctaagctacagctgtgctacaac

SEQ ID NO: 10397 - DNA, 645 bp, Zea mays
  unsure (1)..(645): unsure at all n locations; Clone ID: LIB3279-179-Q1-K6-E5
cccacgcgtccgcagaagcggcggcggcggagcaaacgcaggcgaaggcgagggtgtgagggaaggagcaccagccatggtgcacgtcaacttctaccgcaactatggtaagacgttcaagaaaccaaggcgtccttatgagaaggagcgtcttgatgctgaactgaagctggttggtgagtatgggctgaggtgcaagcgtgagctttggagggtccagtatgcactgagcaggatccgtaatgctgcaaggcacttgctcacccttgacgagaagaacccccgtcgtatctttgagggtgaggcacttcttcgccgcatgaaccgctatgggctgcttgctgagggtcagaacaagcttgattatgttcttgccctcaccgctgagaacttcctcgcaaggcggcttcaaacacttgtcttcaaggctggcatggccaagtccattcaccatgctcgtgtcttgatcaagcagcgtcacatcagggttggcaggcaaattgtcaacgtcccatcattcatggtgagggtgggagtctgagaagcacattgacttttcactgtcaagcccatttcgtggangccccgcagnaagggtgaagagaaagatcagaagaagggcagcgtgcngnngatgctgtgatg

SEQ ID NO: 10398 - DNA, 283 bp, Zea mays
  Clone ID: LIB3279-179-Q1-K6-E6
ctcttggcgagtgggccgggctttgcaagattgactctgagggcaaggcacggaaggttgtaggctgctcctgtgtcgtcgtcaaggactacggtgaacaatctgagggccttaacatagtgcaggagtatgtcaagccgcactagatgtgtgacatgttccagcgatactcttgatttggacctgggcttaaaattatgcttttgcatctggggcttgcctaggagatgagaacattccaatgcaaatcatgaagagccgagtttattcttaaaaaagaaaa

SEQ ID NO: 10399 - DNA, 616 bp, Zea mays
  unsure (1)..(616): unsure at all n locations; Clone ID: LIB3279-179-Q1-K6-E7
gctggcttctcctccccctcttaccaagtcctcttcgggttagggttacttagggttttgtggaggggcgatggcggcggctgatgtggagtaccgttgcttcgtcggcgggcttgcctgggccaccagcaacgagtcgctggagaatgccttcgcctcctacggcgagatcctcgactccaaggtcatcaccgaccgggagacggggaggtctcgcggcttcggcttcgttaccttctcctccgagaactccatgctcgacgctatcgagaacatgaacggcaaggagctcgacggccgtaacatcaccgttaaccaggcccagtcccgtggcggtggcggtggcggcggtggctacggcggcggtcgcggcggcggcggctatggtggcgggcgccgtgacggcggttatggcggcggtggcggctacggcggtcggcgcgagggtggtggcggcggctacggaggcggtggcggctacggcggtcggcgcgagggtggtggtggcggctaccgcggcggcggcggcggctggagggactgatgtgtgggcccatcctggctttcgccgagttatcttatctatctatagtatcgngttaccgttcgcttctgt

SEQ ID NO: 10400 - DNA, 595 bp, Zea mays
  unsure (1)..(595): unsure at all n locations; Clone ID: LIB3279-179-Q1-K6-E8
tttttgtgtttcttgagactgccaaattgtgcaaatacacagnaaaaagagctgggtgctagcttgttttttggtctcttcgctatctcctggcttctattgcgtctgatttacttcccattttggataatcaaagcctctagctatcattccatcacattcttgaggaagctggatgaattcccaacaactttgtactacatcttgaacacaatgcttctcacattgcttgtattccatatgtactggtggaaactcatatgtttgatgataatgagacagctgaataataaaggacaagttacagacgatgtccgatctgattctgaggatgaggagtaatgggagattcattctttgacatctgcaacgtggcatttcctcgtcaatacttttctatgcctgcttccagaattgattgcttttaatcttggcaagtctcgggaacgtataggaaagtttaatctctgtatattgccttatgatatcaaacatggctagaccgggaatggatctatacatgatgacgggcatagctagcaagcttacttcaagnttccttaaaaaatttgggttcacctttatttgatatggg

SEQ ID NO: 10401 - DNA, 667 bp, Zea mays
  Clone ID: LIB3279-179-Q1-K6-E9
tttttcagccaaaacctacctagccgccgccgcaggcggccccccatcgccgccaagatgcagatctttgtgaagactctgacggggaagaccatcactttggaggtggagtcctccgacaccattgacaatgtgaaggccaagatccaggacaaggagggcatccccccggaccagcagcggctcatcttcgccggcaagcagctcgaggacggtcgcaccctcgccgactacaacattcagaaggagtccaccctccacctggtgctccgcctccgcggtggcgccaagaagcgtaagaagaagacgtacaccaagcccaagaagatcaagcacaagcacaagaaggtgaagctctccgtgctgcagttctataaggtggacgacgccactggcaaggtgacccgcctccgcaaggagtgccccaacacagagtgcggcgcgggcgtcttcatggccaaccacttcgaccgccactactgcggcaagtgcggcctcacctatgtctacaaccagaaggcgtaattgcttgccccgatttgctttatccgccaacctatcaagcattcagatgttggttactcaaattgtatctcatttagatctgtctgaagttgaaacttaaatggagcagtagtatctatcatattggtaccccctgttactg

SEQ ID NO: 10402 - DNA, 692 bp, Zea mays
  unsure (1)..(692): unsure at all n locations; Clone ID: LIB3279-179-Q1-K6-F1
cccacgcgtccgcccacgcgtccggtgaaggggaaggtggttattgatgcattccgcctcattaatcctcagaccatgatgcttggccaggagccacgtcagacaacatcaaatgttgggcacctaaataagccatctattcaggctcttatccatgggctgaatagacactactactcaattgcaatcaattacccggaaaaatgagcttgaggagaaaatgctgttgaacttgcacaaaaagaaatggaccgatgggctaattttgaagaggtttgacactcactcgaaaaccaacgagcagactgtccaggaaatgctaaacctagccatcaagtacaacaaggcagtgcaggaggaggacgaactgccacctgagaaacttgcgatagcaaatgtgggtcggcaagatgcaaaaaagcatttggaagagcatgtgtcgaatttgatgtcatcaaacatagttcagaccctaggaaccatgctcgacacgggtgtcttttagtctactaataatattgttgtcccaaactgaaacatagccacactatcgaagcatgacacatgcagtgagcttgaggcccgatacatttttggttctaaggtttgtttatgaaatggatctgtctacatttnaattggtggtaaaactncctggcttttctatcaaaagcttcaaggcgttcctattt

SEQ ID NO: 10403 - DNA, 533 bp, Zea mays
  Clone ID: LIB3279-179-Q1-K6-F10
ttttcgcgtgggcggacgcgtgggtgtggaataggtttaaattagctctttgctgaggagtgaggagaattaatagcgtgaagaattgatttagtaatccaaacgattatctgataaggttgtcgtctttgattttgtaggatattttggtggtcaaacctgaaatgtttgattaattgtggacatgtaaaatatgtgaggtgtaaaataaaattaaaataattcttcgtgagcaaagtggtataatttataaagcgagggataagtttagaatttaattagctgataagttgtgtttaggccaattgtattaaatgtgtatagtttgttgtttcgtgatgtttgcgctagattcagttaatttagagaagcgtaattattgcgcgtagtcgtataccgataagtagtatatctgtaggaaatagtacaacgcctcgctgctaggtatttaattcgcggacatgtaataatatttagtctcataccattcctgtctatatgcattcatgtgtatcggacatttcaattaggta

SEQ ID NO: 10404 - DNA, 426 bp, Zea mays
  Clone ID: LIB3279-179-Q1-K6-F11
ctcgccgccgccgccgccgcttcgtcgtctccgccgcatcgtcgtctccgccgcagcgatgccgtcgcacaagaccttccggatcaagaagaagctggcgaagaagatgcgccagaaccgccccatcccctactggatccgcatgcgcacggacaacaccatcaggtacaacgccaagcgcaggcactggcgccgcaccaagctcggcttctgagcgcgcggatcggccggctcctgcgtcggaattctagggtctctacctttcctttggttttatcgatgtctcttgtgtttctgtaagctagcaaacggttccagaaagcttttgttaagattttgatgacgctaagaggattgatgctactatgctgtactcaggattccatgctgcattgcgatgctaaattaaagaacctctgctacctt

SEQ ID NO: 10405 - DNA, 636 bp, Zea mays
  unsure (1)..(636): unsure at all n locations; Clone ID: LIB3279-179-Q1-K6-F2
ggttgacattaaggtcttcgccgcggtgccgtcgaagcctggcgctgagtttcctaatgccgcccgctggtacgagaccgtctctgcggctgtagcctcaagattccctggtaaggctgttggtgtaaatctgcctgcgggatcagctcctgcggcagctgctcctgcggatgaggctgaggatgatgatgaccttgatctttttggtgatgaaactgaggaggacaagaaggcagctgatgagcgtgccgccgctgccaaggcctcttctaaaaagaaagaaagtggtaaatcctccgtccttatggatgtcaaaccatgggacgatgagactgatatgaagaagctggaggaggctgtccgcagtgtccagatggagggtctgacttggggagcatcaaagcttgtgcctgttggatacggcatcaagaagatgactatcatgttgacaattgtcgacgatcttgtgtccatcgacactctaattgaggaccaccttacgcaagagcccatcaatgagtacgtccagagttgcgacattgtggctntcaacaagatctagagttcagtttctgagattgngcaacggcagcggctcagctcgtcaagtttgtgctgggatgccagtttatccct

SEQ ID NO: 10406 - DNA, 394 bp, Zea mays
  unsure (1)..(394): unsure at all n locations; Clone ID: LIB3279-179-Q1-K6-F3
gcagtggtggtgaatgttactgggaatgaataaatgagtccagaaggaacaccgtatgaaccatcagagtacacagtaacatgcagtggtggtgaatggaaaatcgttcaaggcctcccgattgatgagttctcaaggaagaagatggatgccactgcccaagagctgacggaggagaagacgcttgcttactcatgcctcgagtaaattctaccacacccagagagcaattgccaccccaatgttttgaataaaaaaagaaactccaactcgattcatagattctcactcagaactgctgcacgtcgcagtgcaggcgtgttgctggcttcgcccagcttctttttttgcctgtgatttgcacgacatttatatttattgaaatcttgcngaa

SEQ ID NO: 10407 - DNA, 604 bp, Zea mays
  Clone ID: LIB3279-179-Q1-K6-F4
ctaaaatttcccctttccccaactaacacgacaccccccttcccttcctccgatccccccgcctcccccaaaatccgacgcgtaatcgccgccatggccgccgccggcaagctcctcctcctggtcgccgccgtcctggcggcttccctcgtcgccgacgcgcgcccgtgcggccacgcgcagacgctcctcgtctccttctcctccgtcctcaggccgaacccggaccccaccaacccgacgccgctcaccaccacagtcgtcaccgtcctccgcgtccgccgcctcggcccgcaccagatccgccgccccgtggcgctcccctccgtcgagtcggaggtcgccgcctcgtccgcccaggaccgcgccaaggacatcctggtcgtcgtctccggcctcctctttggcttcggctgcggcgccctcaccgccgcgtccatgtacctcgtgtggtcgctcctcgcctccacctgcgcctccggatacgacgacgacgtctacagcgacgacgaggaccggctgtccgactccgagagccccaagaagggccgctacgtcatcatccacgacgctgacgagtacggcgccggtaagaactagggct

SEQ ID NO: 10408 - DNA, 519 bp, Zea mays
  Clone ID: LIB3279-179-Q1-K6-F5
aaagtcatcagcaaaaggtgacaaagggtaaaggagaatccgttgaagcagttcttcccagcaaggatgatctgaggaagaccattactgaaatcctcaagaaagttgacttcaacacggcaactttcagtgacatccttaagaagcttgacaatcactataaaatggatctggccccaaagaaagaagccatcaaagttatgatccaagacgagttaacaagttatcagaggaggacgaaggagagggagccggagacaccgagaagaaacagcagcagcctcaggcgaaggagatcgaggcatctcgttgattatcgccgcaccaactcgagaacctcacccctgatcgtgtatgttatggggcatgatgtgtaggcagcctccacacctttttagctgactgatcggagagttactcctaggcaactcttgtttctagatttgcaaatggtgtctgaaactctgcgtttgctgcggcagaacgtgtacttaattgttcgtgataggtctgaataac

SEQ ID NO: 10409 - DNA, 645 bp, Zea mays
  Clone ID: LIB3279-179-Q1-K6-F6
attggacttgattcttagacaaaagcattggaaaatcgtgcgcctagtccatataaaacaatctaaaacacagggtcaatgcatgttgcaccacacaacgatcttgagaagatcgatcaaatccgttgctagatctcgttgagcaagaagacccaaagcggtcgtctgtgatgaaaggcttctgatgccctacaagatcaccacgagtaaaatattagggatcaagtaacgataactcagggtttcccattataccatcagtcaaaactgatcccctcatatacataatcagttgcatgaatgatgccctctatgaaatccccatcattcaaccatcgagtgaagaagctgttacccttccagcttccatgtgttactgtacagttgcatgaatgatgccctccatgaaatccccatcattcaaccatcgcgtgaagaagctgttatccttccagcttccatgtgttactgtacttggcatcatcaagctgacggtgatggcattcaggtgtccaattttgaaaagcaatgggcaatggcatagaacagatggtaaattactctatgccagttaatagaacatgtcaaaacactgtaggaaatttcctctcatatcaattgcaaaatcaaagcatgatgcatgcc

SEQ ID NO: 10410 - DNA, 620 bp, Zea mays
  Clone ID: LIB3279-179-Q1-K6-F7
cccgctctcgacttcccatcccctgcggccccgccccccgactcttctcgtcgcggcgcgcccaatcggctcggtggcaggcttgcgcaccggctcggctcgggtccggttctaccgccaacgcgggccgccgcgctcccggatctcggtctagtcagagagttagcagacaaagatggcgacttatgagcccaagaacattctcataactggtgctgctggtttcattgcatcgcatgtcgccaaccgtctggtcaggaactatccccaatacaagatcgttgtccttgacaagattgactactgctccaacctaaagaacctcaatccttcacggtcttcaccaaatttcaaatttgtcaagggtgatattgcaagtgctgacctggtgaattaccttctgatcaccgagtcaattgacaccatcatgcactttgctgcccagacgcatgttgataattcttttggcaattcatttgagttcacaaaaaacaatatatatggcacccatgttcttcttgaggcttgcaaggttactggtcagatcaggaggtttattcatgtcagtaccgacgaggtgtatggtgaaactgatgaagatgctgtggttggtaaccatg

SEQ ID NO: 10411 - DNA, 592 bp, Zea mays
  Clone ID: LIB3279-179-Q1-K6-F8
ttgttgtcataaaaaaaaggatgttaatcaattgttcatatgtaagaaacgatgagatgtcgttcctattaccatcagccaatcaaggagtctgctctagggaacatcccgaccattgccttctgcgacactgactctcccatgcggtatgtcgatatcggcatcctgccaacaacaaggggaggaacaacattggatgcctgttctggcttttggccaggatggttctgcagatgaggggcactatcctctctgggcacaagtgggaagtaatggttgatctgttcttctacagagacccagaggaagcaaaggagcaggaagaggaagctgctgcggcccatgagtttgctacagtaactgattaccaaggagatgatcagtggggttgtgaccagtggacctcggatgtggctgcatgtaacaccctgaatttgggggtataaatttttttctctaatatccatcaaattcaggtgttaccctttcttttccttgcttttcttttctttttcctaaatagtgtagaattattttgttttatatacgtttaagcctaataaaataaaacactggaggtggtttgattgtt

SEQ ID NO: 10412 - DNA, 525 bp, Zea mays
  Clone ID: LIB3279-179-Q1-K6-F9
ccgtcgcgcaggccgccatggaccaggtcttcggcgctgagtacgtgtcactccacgtccgccgatccaaccgcgctgccttcaacctctacacctctaccctcgggtaccagatccaggacatcgaggccaagtactatgccgatggggaggacgcgttcgacatgcgcaagctgctccggcagccacagcccaagaagcaccaccaccaccaccatcacggccccggtgggtgctgctcccacgacgcaccagttgcggcgactggttcttctccccagtcttctggttcacccgataagaaggctatcacttgatgtaggactcgtatctacagagaggaatcaccaagccaattgtactcatctttcctctcactgggtatacaatatagtagttgtagcgagcggtctttccgtagtagaacggagaaagacctgtgcagtgagtatttgtgtacttggccgatggctcgaatcgtctgaccgaatcagcgagaatggcaaccaaatatgcttcgtactt

SEQ ID NO: 10413 - DNA, 621 bp, Zea mays
  Clone ID: LIB3279-179-Q1-K6-G1
gcgaccgccgccgcccaagccaggagccaggtcttcgtcggacccttcgctggtgacgaggacctaccagctgcgaataaggttgtctggagcggtcgtggattttgtggatggcaggttctgcagtaacagatgattcagctgctagcacaactggaatgagggatgatgaacgcagtctctctggcgagtccttctccgagtggaggtcctgtgagcgggcagacagtgacaccccttcaacatccccacccttctgggatagcgatggtgatgatgatgatcctggccccaagccttcagaattgtttggacgttacacttggaggattgaaaacttctcgaaggagaagaaaagagaaatgaaaagtgagccatttgaagctggtggttacaaatggtatattcttgtatatcctcaaggatgtgatgtctctaatcatctttcattattcctttgcgttgctaatcatgacaaacttctcccaggatggagtcattttgcacagttcactatagctgtagccaatatagatcctaaaaagatgaagtactcagatactttgcataggttctggaaagaggagcatgattggggatggaaaaaattatggagctatc

SEQ ID NO: 10414 - DNA, 584 bp, Zea mays
  Clone ID: LIB3279-179-Q1-K6-G10
cccagcgtccgaaattttttccctggctccagccctccaccgccgccacccgcacatccatcgtcgccgttcgcgtctccggatcccgagaccggagtccggatcctcgtcccgcgcccgcatattctcccgtccgtgccctcgcgtgcgctctgcccctctggcgtccgccgccgccgccgccctaccccaggtgccgtggtctccatctcccggagcttcgccggcgacgagaatcctccagagccatgctgggcgcgcgtgtgcagctgaaggggtggcaacaggcagctgttgcatttggttctgcgtttggggccttgcttgacccaaggagggctgatcttatagctgctcttggagagactactgggaaaccagcgtttgagcgtgtgctgcaacgaatgaagaacagtgcagaaggcaggttctttcggagtgtccccgcgtggtatcctcgcaggtttcccatgcctgggacctgcctcagaacacatttggcgcggcgtatgctcagttcatgggatcaaggaacttctcaccagacgatcgcccgcctgtccgtttcatggacaccgatgagc

SEQ ID NO: 10415 - DNA, 517 bp, Zea mays
  Clone ID: LIB3279-179-Q1-K6-G11
tttacacaagtgactgtagggacttaaaaacttctttgcggaaagctaagcgaaaccaatcagcactgaacaactttctcttctattctggaccatcagtttactaatagaacaccaagcacttactctagcaacactggcatgtgatgccgagagcgatcatcccatggaccaataatatggaggtctatcgttggaaatgaagggacatgtcatttttctgtccaacaagaataacacttgtcttctggtaatattgccgctggacaaacgaactctgtgcttttatgtgcaagcaatactcgctaatagtctggtcggatttctaatgaaccatgtgtgtatgctgcttttggatcagttatattttgcactgccaacgataatgttttggcaggcatgaatcacagacgcttaatgtaacgtgtggctaaacagaatcattaatgactgcattgtggtccaactaaaaaaaaaaaaaccaaacaacaacaaaaaaaaaacaacaaaaacaaaa

SEQ ID NO: 10416 - DNA, 638 bp, Zea mays
  unsure (1)..(638): unsure at all n locations; Clone ID: LIB3279-179-Q1-K6-G2
cccacccctcagcgcgacgaaggtaagatgttcctgcggaggatcctgaccggcgggggcggcctggcggccctgagggcggcgcgcgccgtgaaggagacgacggggatcgtgggccttgaggtggtgcctaacgcgcgagaggttctggtagggctctacgagcgcacgctcaaagagatcaaggccgtccccgaagacgagggttaccgcaaggccgttgaatccttcaccggtcaccgcctccagatctgccaggaggaggaggactggaagcgcatcgaggaccgaatcggatgcgggcaggtcgaggagctcatcgaggaggccgaggacgagctcaagctcatcgctaaaatgattgaatgggatccatggggtgttcccgatgactacgaatgtgaggtgattgaagacgacaccccaattcctaagcatgttcctcagcaccggcctgttgctcttcctgaggagttcttcaaggcactagatgctgtcaaatctgatcctgctcttcaaggcgatgctcctcctcaagtgaaggcgtaaggatggctgttcctggctaacgtcatttcacattnntgccgcgtgggtagggactggtttcttgtgtcatttgccagcaatgcgcttgc

SEQ ID NO: 10417 - DNA, 572 bp, Zea mays
  Clone ID: LIB3279-179-Q1-K6-G3
gtcgccccggcgcccgaaaagaatcgcggatggattcactgcgcagcgtgctggagtctattcaggcgatgcagatccgccccgcggtcgaccaaatcatcaccctaggtgaggctgggggatactcggctaaccccgctgggctctgatctcccccccctcgcaataggtgcggggccggttccttcctggctgaacattcggcacatactctgggtatttcgcagggatgatcctaacttcggcattgatcctatggaaaggattggtcgtcctaacagggagtgagtcgccggctgaggaggatctatctggaagcatggagcctgcgtttcgaaagggtgatgtcctgtttctgcacatgaataaggaccctgtccgcacaggagacatagctggttacaatgtcgagggccgagatattccaattgtacatcgtgtgatcaatgatcatgagcgccatgatacggtggactctgacattctcacgaaaggtgacaataatcccggtgatgaccgagtcctgcacgcacatgtacagctatggctgcagtgacagtacatcattggac

SEQ ID NO: 10418 - DNA, 615 bp, Zea mays
  unsure (1)..(615): unsure at all n locations; Clone ID: LIB3279-179-Q1-K6-G4
gctgctcccattgaacgagtgaagctgcttattcagaatcaggatgagatgatcaagtctggtaggctatcagagccgtacaagggtattgctgattgcttcaaacgtaccatcaaggatgagggtttctcttccttgtggaggggtaacactgctaatgttattcgttacttccctactcaggctttgaactttgcgtttaaggactacttcaagaggctgttcaacttcaagaaggacagggatggttactggaagtggtttgctggcaacctggcctctggtggtgctgctggtgcttcctctttgttttttgtgtactccctggattatgcgaggacaaggttggccaatgatgccaaggctgccaagggaggaggcgatagacaattcaatggtcttgtggatgtctaccgcaagacactcaaatctgatggtattgctgggctttaccgtggatttaacatatcttgtgttggaattattgtttatcgtggcctgtatttcggactttacgattctatcaagccagttgtcctcactggcagcctccaggacaacttctttgccagttttgctctgggttggctgatcaccaacnngtgctgtcttgca

SEQ ID NO: 10419 - DNA, 684 bp, Zea mays
  unsure (1)..(684): unsure at all n locations; Clone ID: LIB3279-179-Q1-K6-G5
cccacgcgtccgcgcagttcggctgccagacaaaaaccctaaccgccgccgccgccgccgccgctcttcctcgagatgggaggcaagtgcccgcaccgcaaggtaaagaagcgccgcctatcccacaagacggctcgccgcggcaagttcctcctgaaggccgacgatgccgtctatgacgagctcgtcaagcttgccgaccagggcaaggacgctgaaaccaaggagctccccgtcgatgaggacctcccaggcctgggacagttctactgcctccactgcgatcgctactttgcaagtgaaagcgtgaaggatgatcactatcgttcaaagcgccacaagaaaagggttaaggtaatgtctggaccggccccgcacacgcagcttgatgcagaactcgctgcagggatgggaaagcctgacaatggcctgaagctcatgtccatgtgaaggaacctcttgctggtactggtacttgttccgtgcctttgttgctgccgtacacttgaagctgctttgcgcagtaagtaatagcagagttagtagacactntttattgtccgcaagactttcgaagtgggtgatttgttttagaagagtggcagnaggggtggngggtgtcaatgcctgtatcatgaaaccatntatcgacccataccagtgatgatgatgatgatgatgatg

SEQ ID NO: 10420 - DNA, 658 bp, Zea mays
  Clone ID: LIB3279-179-Q1-K6-G6
tttacgcgtggggcgccggcgtgcttgtgatctcaacccaagtcgtgcctccgctccggtcacccgtcgctccacgcaaccatgtcgaggaggaagaccagggagcccaaggaggagaacgtcacccttggacccactgtccgtgaaggagagtatgtctttggtgtcgctcacatctttgcgtccttcaatgacaccttcattcatatcactgatttgtctgggagggaaactctggttcggatcaccggtggcatgaaggtgaaggctgaccgtgatgagtcgtcaccttacgctgctatgcttgctgctcaagacgtcgcacagcgctgcaaggagcttggcattactgcactgcacattaagcttcgtgccaccggaggcaacaagaccaagaccccaggacctggtgcccagtctgccctcagggcgcttgctcgttccgggatgaaaatcggacgcattgaggacgttaccccggtccccacggacagcactcgcagaaagggcggtaggaggggaaggaggctgtaggcgtctctgctgcgtgccatttgctggctcttggcggtggccatcatgaagctagtcctctctgggtggggttgctgttttctgtgtttgtcaagacaagctttaaatttgctctatggggatg

SEQ ID NO: 10421 - DNA, 646 bp, Zea mays
  Clone ID: LIB3279-179-Q1-K6-G7
gtcgccctcaaattcgttccgtccaggcagggaagaaatcgagcagccaaggagaggagaagatggctcgtacgaagcagaccgcccgcaagtccaccggaggcaaggccccgcgcaagcagctcgccaccaaggcggcgaggaagtcggcgccgacgaccggcggcgtgaagaagccccacaggtacaggcccggcaccgtggcgctgcgcgagatccgcaagtaccagaagagcacggagctgctcatccggaagttgcccttccagcgcctggtccgtgagatcgctcaggacttcaagacggatctgcggttccagagccacgccgtcctggccctccaggaagccgccgaggcctacctcgtcggtctgttcgaggacaccaacctctgcgccatccacgccaagcgcgtcaccatcatgcccaaagacatccagctcgcccgccgcatccgcggcgagcgcgcgtaggcgtatctcgcgcccggccccagtggcggcggagggatggaggagtgcaatttgtaactttatgctgtttgttcgcttttagacggcgtggcgaagtagtgtaaaaacggctttacaagtctattttgtgtggtagttcgtgtaccgcttcgtccccgaacgatcttggtaaa

SEQ ID NO: 10422 - DNA, 645 bp, Zea mays
  unsure (1)..(645): unsure at all n locations; Clone ID: LIB3279-179-Q1-K6-G8
cggacgcgtgggtccccttccctccctccctctccccgcgggccgccagaggcaatttcgccctcgattcgaccccgattcgtccgcccgcgaccgggattccctccgccaagcgcggatctgaacgctgcgctccgtgtcgtcgctcgaatccgccatgaagggggccaaatccaagggcgccgccaaggccgatgccaagctggcggtgaagagcaagggggcggagaagcccgccaagggcaggaaggggaaggccggcaaggaccccaacaagcctaagagggctcccagcgctttcttcgtgttcatggaggaatttcgcaaggagttcaaggagaagaaccctaagaacaagtctgtcgctgcggtgggaaaagctgctggcgacaggtggaaatccctgagcgagtcggacaaggctccctatgtagccaaggctaacaagctcaagctagagtacaacaaggccatcgcagcctacaacaagggcgagagcactgcagctaagaaggctcctgccaaggaggaagaggaggaagacgaagaggagtctgacaagtccaagtcggaggtcaatgacgaggatgacgaanagggtagcgaggaggatgaagatgatgacgagtgatggagagctcgctc

SEQ ID NO: 10423 - DNA, 606 bp, Zea mays
  Clone ID: LIB3279-179-Q1-K6-G9
ggtcgaccgagcgtccggtccaacccgtccggcgaagctgctagtgcttgtatctactatcttcatcaggtacttcgcgatcctactgaagtattccccgccgccgctgccatggccaccctcaaccctttcgaactcctcggcgccgacgacaacgacgacccgtcgctgttgattgcggcggcggcggctgctgctcagaaagccgaggcgaagaagtccgccgtggcgcctgctgggaaggctgcccagcctgcggcgaccaccaagttcccgaccaagcccgctcctccctcgcagacggttcgggatgcacgcggcggtggctcatcagctcgtggaggctttggccgtggtgaacgtggccgtggcagaggtggacggggatatggccagaaccgtggcttcagtggtgacaatggcaatgagttccagggaggttatggtggcggaggctatggggatggtgctgtaacctggggatctgaaggagaaagggagagagacactcgtcccccgtaccgtggcgggaggcagacgtgggggttaacaggaatgctgagtttggggatgactctggagaggccaccacggagaaaactatga

SEQ ID NO: 10424 - DNA, 614 bp, Zea mays
  unsure (1)..(614): unsure at all n locations; Clone ID: LIB3279-179-Q1-K6-H1
cggtgtcgtgcgcatgtgagatctagggagaggaagaggaggaagggttgtggggaccgggggtgcgagatgacggattcacctgcaactacaagaaaagaaagagtgagagatttacagaaacctccagagccgcggaggaggaggaggagattaggaggatctctacggcgctgacggattagttaaggaacgaaagatcacatcgtgtccggtaaccagattcagatgtgggcaccatgcgtgggtgaagggccaggccgaggtgaaagagattcgacgattgagaatacatcaaagaataaaaatgtggaactcggattttcagatgaagagcgtgaccaagaacttcctgattttccatcatttattccattcttacctcctctgagtgcagctaacctaaaggtctactatgccacacgtttcaccatcatagttgggataatggtgttcggtggttttcttgcaccaatcattgctttgaatgcttaacaagttgatgtgctctcatgcggctggaagttaaacttggtctaggggcacatcttatgaagactccatccgcagcgttcatctgtcgacgtagttngagagtgcactcaggttataca

SEQ ID NO: 10425 - DNA, 553 bp, Zea mays
  unsure (1)..(553): unsure at all n locations; Clone ID: LIB3279-179-Q1-K6-H10
ggcgtcctcctccncagcgcgcagcgtctccggtggcggggggggggcttccacgagaagatcttcgagacggccgacgccatcgtcacgccgatgacaggggtgacggcgtacgcgctgcaggacgacgcgctgaggacgggggagctggactacatcaacggagctgcgctggtgaggtactcgggggggggcgacttcctggggctgccggcgatcaccgtgcccgtcgggtatgacaggggagggctccccgtggggctccagttcatcggccgcccgtggtcggaggccacgctgctgcacctcgcctacgccatgcaggaggcgtgcgggaagaaggtgcaccggaagcccaaggtgcactacgacctcctcaccaaagagtagctccgattcgtattgtgtcatgcatgatgctggcatgatgctggtgcacatgcatgatgctccgattcgtgtacttctaatgtgttaagatagagaccattcgtgtgccctcgatgtcgtcgtcattgaaacattatgcaagttttgtgtatagtgggcttta

SEQ ID NO: 10426 - DNA, 575 bp, Zea mays
  Clone ID: LIB3279-179-Q1-K6-H11
gtttggcatgggcggcctgcaggtgcgcctgggcaacaacgggcagagcggcggctgctgggtggacatcgctccccggcctggggcgctcatggtcaacatcggtgatcttctgcagctcgtgaccaatgaccggttcaggagcgtggagcaccgggtgccagccaacaagagcagcgacgcggggagggtctccttggcgtccttcttcaacacggacgtgaggaggtccgagaggatgtacggccccattccagaccccagcaagcccccgctgtacaggagcgtcagggcccgagacttcatcgcaaagttcaacaccataggactcgatggccgcgcgctcgaccacttcaggctctagctgcctggctggctacgtttcagattcgtcctttcatttgctttggtctctaattaataattccaaataataagcccgcggatggacctctgtctgtctgtctgtaatttagtttccaagtttagttgttgtggtaataattcctgtatgaattatgtcataaataaaagctagggaaccttgataaataacagagagtagtatgtatacc

SEQ ID NO: 10427 - DNA, 464 bp, Zea mays
  Clone ID: LIB3279-179-Q1-K6-H2
gcgcggctctacgtgcgagtctacgcatcaggtcccctctcatggccggtggatgcgccaccaaccaagctcatacatatgaatagactagtccaactcatggatcaatttggggaccaatcaaactcacaaactaacttacatgcttgatctcataggttcatcttccatctgattttgaatccggttgcagaggcaaatgctgaggactacactgctggcgctggatcaaaggactatgcacacgtgcgtattcaccagcgcatcggacggaacagcctgacgactggtcagggctcggagaaagagtacagctacaacaagatcctcaaggatctcataaaagagctctgctgcaatggctctggagaccatgatccagagctaggcccagacattcaactgcaaagtgatcagcgtagaaatgacgctacttatgtagttcatgccgtaatccagaaaaa

SEQ ID NO: 10428 - DNA, 205 bp, Zea mays
  unsure (1)..(205): unsure at all n locations; Clone ID: LIB3279-179-Q1-K6-H3
gattgctggnttactaagaagcatcctatcaccattccatggcaaacagcccggcatcaataattccttggatcttttttccaaatatttttcttgcctggtagggtgcagcatctgcgcttcagaaaccggttgatttgagcactatctatgagcatgtataaatatggtgcttttcaagcagagtggtgcctttatattgtat

SEQ ID NO: 10429 - DNA, 412 bp, Zea mays
  Clone ID: LIB3279-179-Q1-K6-H4
cagcgcagcacaaacaaacaccgcgccgccgccacagctttgccctacagaatccttttactccgaagattctcaagacgcccctgatggctccccgcgtcgcctccgctctgctcttcgtcgtggccgtcctcgtggcctccgcggcggcgcaggagtccatggcgcccgcgtctgctccggcgccgggaccggtcgctggcgcggcctccgctccggcctccgctgtggccgtggtgtcgtccgcactgctgtccctccttatgacggccctgatgcagtagaagtatcatactagatttgagcgggaatttggttcagtgttgctattcctcattctttttgtatcatatatgtctgcgacatttatatatatgaataaagttggatgatctgctgcataccttttttt

SEQ ID NO: 10430 - DNA, 581 bp, Zea mays
  Clone ID: LIB3279-179-Q1-K6-H5
agacctcaaacaagtgccagcgccctctcgcagtcgccgcaatggagagcaccttcatcatgatcaagcctgacggcgtccagaggggcctcattggtgagatcatcagccgttttgagaagaagggcttctacctcaaggccttgaagcttgtgaacgtggagaggtcgtttgctgagaagcactacgccgatctcgcctccaagcccttcttccagggcctcgtggactacatcatctctggccctgtggtggccatggtctgggagggcaagagcgtcgtcacaactggccgcaagatcattggcgccaccaaccccctggcttctgagcccggcaccatccgtggcgactttgctgtcgacattggcaggaatgtcattcatggaagtgacagcattgagagtgctaataaggagattgccctgtggttccccgagggccctgctgattggcagagcagccagcacccctggatctacgagaagtaaacatggaaagtttcacatcaaaccttgagagccagaggaagcatgtcaccatttgtgctttagcaatgtttttcgaaaagattatgatct

SEQ ID NO: 10431 - DNA, 505 bp, Zea mays
  Clone ID: LIB3279-179-Q1-K6-H6
ctgagccacctttccatgtcgctgagttttcacgggtgctccaggaaagttgtggagctgaaggaaagcgtgaagagtttccagggtgttttggatgggaagtatgatgacctccctgagcagtcattctacatggttggtggcattgaggaagtcattgctaaggctgagaaaattgccaaggagtctgcttcataaggaggcttcttgcttgttcaaccctgtacaagttccatttttggattttaagcgtttatttatgcttttcccagttaggcatgacgagctggagagtccatctcctgctgagagatgtttgttttacccttctttgcttcctccaccttacacccaaataagcaactgcagtgacgttggtttcggctgcacccaaactacatgactgaagaaacttgtggcctgtgtaacgcgaatccatcagaacgccaaagttatggcttctggttgtggcacaaaaaaaaaaaaaataaaacaaaaaaacaca

SEQ ID NO: 10432 - DNA, 560 bp, Zea mays
  unsure (1)..(560): unsure at all n locations; Clone ID: LIB3279-179-Q1-K6-H7
ttcttctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctggagtgccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggcgggtacggtggtggccgtggaggcggcggctacggcggtggcgggcgccgtgatggcggcggcggctacggcggtggcggcggctaccgtggtggcggcggcggctaccgtggtggtggcggcggctacggcggtggcaaccgtgggcggcggctacggcaactncgacgggaactggaggaactgagcggtgggg

SEQ ID NO: 10433 - DNA, 555 bp, Zea mays
  unsure (1)..(555): unsure at all n locations; Clone ID: LIB3279-179-Q1-K6-H8
cggnaacccccgggtcgacccggcgtcctgctcccgagaactgtccgggggggggtgggggggggggtgacgaggtgcgcaacggcgctggaggaggctggctccgactacgagatcgtgcccatcaacttcgccaccgccgagcacaagagccccgagcacctcgtccgcaacccgtttggtcaggttccagctctgcagggggtntgctggggcctcttctaatcacgagcaatctgcaagtacgctgctcgcaaaaacaagccagagctgttgagggaaggaaacctcgaggaggcagcaatggtggatgtttggatcgaggtggaggctaaccagtacaccgctgcactgaatcccatcctcttccaggtcctcatcagtcctatgcttgggggaaccaccgaccagaaagttgtggatgagaaccttgagaagctgaagaaggtgctagaggtgtacgaggcacgcctgaccaagtgcaagtaccttgctggagacttcctcagcctcgccgacctgaaccatgtgtctgtcactctctgcctgttcgct

SEQ ID NO: 10434 - DNA, 608 bp, Zea mays
  Clone ID: LIB3279-179-Q1-K6-H9
tctgttctctacactgtttatatacatgtgggagaggagattaagtgtggtgaagagagcagcagacacgggcaacggcaatgatgggttggggtagagggagacacggagagggacacactgctccgcccactggccactgccaatcatggatccatccgccgctcccatcactcgctctggcgcgcgttccaatctcgatatcttctctttttttttcgcgcgcgcacggcgatggccccagcaatcccggtgaacaacggcggacacttgtcgccctcgtggagctagcactgtgctgacgcgctgtgcgtgcaggtatcgcgccgcagacgacgagcggcgacgggatggcggcgctgctggccggcggcgagggcgagcacaaggaggtgcgcggcatgctggccgcggcgtacgagcggcacattgcgccggcggtgaaactggacgtctgcgcccgggaggcgacgcccggggggcaccaggcggcgtcccggcgcgcgtccaaagcggcgtccgagtgaccaccgggtggtggacccaattcgcggtgctggtgcaacgcgggctcaaggagcggggtgccgagtcgttcaacaagctgc

SEQ ID NO: 10435 - DNA, 440 bp, Zea mays
  Clone ID: LIB3279-179-Q1-N6-A11
ggggaataaaaaaaaaccccttttgggttttgggattaaaaaaagggcccgggggggggggggggaaatccaaaccggggggtaaaaaacccaaaccaaaaaagggggggggcccgtaaagcgaaaaaaccccaaaataaacggccccactccagggggggggccacccttggaggggaactccccaaaaaaggggcctaaattaccggattaaaaaaggccctcaaaaaaacccgggggggcccacaaccaaaaaattttttccccggcgggaaaaacttgggaagaggtttaaccggaaaaaaaaaattggaaccccccctggccctgggggtaaccccgggcttgggcttgggggaaaaccaaacccccggggggccccaaaacggttgtgggtgaaagggcccaacttttggggggacccaaccctgagctttttt

SEQ ID NO: 10436 - DNA, 622 bp, Zea mays
  Clone ID: LIB3279-179-Q1-N6-A12
aactaaagcattgatcttgatgccctaaattagagactattatgggtacagtacaatttgcaaagtgaggatacaaggacttcagttggtcgatatccaaagctcgagatagacatgacaattaagacaacgaaactaaacatggctaaaaactactactacaaatgtctgcagactggcacataggcatacaaacaataaatcaggcctaactgcagctctacaacctacaaagcgacaaacatagcacggcttctttatctgatcgttacaaacttatttgtaccatgcttagcccaaaacgtcttcaagtcaattggattaacaagattgtacccttcaccagcaagcttctcaagcacctttttgaatgcaccttggctcatcttccttccagcaatacgtgcgccccggcgctttgtgttcattggcagtggatacgttgaaatagaagtcgtgcagcatgcagactgccacccacctgcaccccaccggtagcactgctggggagctccggtgcacgagcacactggtgttggtatgttggcaaggtccaactcaataccgttaatcatcatccccacattcttcttaggtcccctccttcgggtcgcgtgcccat

SEQ ID NO: 10437 - DNA, 616 bp, Zea mays
  unsure (1)..(616): unsure at all n locations; Clone ID: LIB3279-179-Q1-N6-B11
gatcccaggcagttattaggagatataanccagaaaaaaaacataatgagcagacttttaagttcaaacatcaaacttcacaaggattcaagccatactgctgcagaagagttttgggtacaacacagaggacacaacaggtccattaaaccaacgaagccacaaccacgattcatgacacacaaaccacagatgtttattagacgacgacgacgcagatacccaggtacagcagcagcttaaatgaaccatggcttactgaccaccacggaggcggagcaccaggtggagagtgctctccttctggatgttgtagtctgctagggtgcgaccatcctccagctgcttgccagcgaagatcagacgctgctggtctggggggatgccctctttgtcctggatctttgccttcacgttgtcgatggtgtcggagctctcaacctccagggttatggtcttgccagtcaaggtcttcacaaagatctgcataccacctcgcaagcggagcaccaggtggagggtgctctccttctggatgttgtagtcggcgagggtgcggccatcctccagctgcttgccagcaaagatcaggcgctgctggtccggtggaatgccc

SEQ ID NO: 10438 - DNA, 591 bp, Zea mays
  Clone ID: LIB3279-179-Q1-N6-B12
ggggggttttttttttttgagagagattcaaatctttaacatttaaactcttccgattgtcaggctaagcaacagtttatcgatatggggaggatgccatcgaagctaacaggaaacggtccagcattttttttttatccgggaaaacatgggggggggcatcaaaatctcgtctaactaaaaactctcttcccaaggggcaacacaaacaaatgttatttgaagtaaatttcgatcaactgattccactagacaatcgcatttgccgcgctggcaatcctaggccacagatcagcacactcctttccgatgggtccagtgatggcagagcctttcatctctccctttgggttcacaatcactccagcattgtcttcaaagtacatgtagacaccatcctttcggcgccatggcttgcgctgcctcacaatgacagctggcatcaccttcttcctaaggtcaggctttcccttcttcacagttgccataaccatgtcaccaacacaggcagaaggaagcctgttaaggcgccccttgattcccttcacagaaatgatgtaaaggttcttggctccagtgttatcagcacag

SEQ ID NO: 10439 - DNA, 162 bp, Zea mays
  Clone ID: LIB3279-179-Q1-N6-C10
gaaaaactcgctctccaccattgatacaccgcctggatctatgtacagttacagcttgttgcaaggaaaggtgcgagggaacccctccgacagccatggcgatatggccgtttctcgcaaatggtttctgccagctccgctcttcgtcagacaggctcccgt

SEQ ID NO: 10440 - DNA, 634 bp, Zea mays
  Clone ID: LIB3279-179-Q1-N6-C11
gacattcagataaaaagtaccttgcggatatcctatgaatgatattcctctggcttcaaaaagcggtccaaaatacaggaaatcagggatagcttctaaacccaggaagtttctagcatatagcgtagcactaagaagatttcaggattacatatttccagacacagtgccacttaagtacttaacaattaacatgacagattgctcagtggttccgttgctcgtgcctaaaacctacaaattacaatcctacaggccagtatctgaggccaaaaagtgtcccgggcattgctaccaatgcctcaacatcaacctagcacatcaccgcatagatgacttatcaaagatggtatgatcgaagtcgaacaatgtgttagccatgatgccgggagtcaagagctgttatcaccgcaacaggatgctattgcaatctcatcttcttgccttgccttgggtcctcatcaaacataacaaggtcatcgttgtcatcgtcttcaacaacttgagtgccgctggaatcaacatccgaaggattctcgagagcatcaaaattctcctttgcctctaacatttcgttcagcttacgcttcattccaggcttcgctgatatatcctcggcagtaccatcaacatc

SEQ ID NO: 10441 - DNA, 464 bp, Zea mays
  Clone ID: LIB3279-179-Q1-N6-D11
gacgcgaaccagtccgccaggaaccggttggccgcgtgcggctccccggccgcggcgcggcacccgaagtcgctcaggaggcacgagtgacgccgagtcgggtggggcgccgccttgccgagcggctgcggcggcggctgcagcggcgaggcggcggggaccgccgcgagctcgcgcgcgttcgcctggatcaggaggcgccgcccgtccagcacggaccgccgcacgccgtagccgtcctggaggcagtgccccagctcgcggagcgcgcccacgtggcccagcgacgccgcgcgcgcgcacagcgcggctccggcgcggaggtcgcggtcgtccttgcccccgccgctgccgttgaactggaccacggccagcgagtagagcgcctcgcggtgcccgcacaccgccgccgccgccatcagcgcagcgcccgagccgcggatccccaggcagtagaaccgaat

SEQ ID NO: 10442 - DNA, 511 bp, Zea mays
  unsure (1)..(511): unsure at all n locations; Clone ID: LIB3279-179-Q1-N6-D12
gcaacagncgcagnccaagacggaacaccgnnacggaaccangnnaannacagngcttttttttttgattctccatggggggggggggggcgcctttttcttgacctcagatccatatttcagaggtggagtccccaccaggatatctcatctcgtgggccagggcaggaccatcaggctcggtgccaaaatcgacgaagaagttggggttgacagccaggcctcctttctcggtgtcgacatcggtctgcaacatgtgggagcccttcttggcaagatcntcaccggnaaactgctcatcccatcggctgaaaagtgagtttgtcacgtgtatcctcttgccgtccaagctcagctggatcatctgtggcccacctctaagtcgctgacccttggcttgaggcacattatactgctgttcctgacgctcnttcgtggcttggacgacatcactgcccttagtgtggaagacccccgacccatacttgttcagccaaggaaggctttgcgg

SEQ ID NO: 10443 - DNA, 209 bp, Zea mays
  unsure (1)..(209): unsure at all n locations; Clone ID: LIB3279-179-Q1-N6-E10
ttcctctaaacggccgccctggggtggggttgtttttttttttcttttggtgggttgtttttttttttttttcttttcttttttttttttttttttttgttttctttttttttttttttgtctgtttgcttcttttccctctctccctcctttttttttcttctnttttttggggggggggggggccccccccttctcggcccccgccc

SEQ ID NO: 10444 - DNA, 650 bp, Zea mays
  Clone ID: LIB3279-179-Q1-N6-E11
ggaaagcaaatgctacatttgtttcttggattggcaaagcccagcacatggtctgatgatgacgaaaagttattcatgaattgaacacaagtatataatgatgatattcaacatccacactgctttgtgcagctcattagattcagcgcctaccaccccttcttttactcttcctccggctgttcttgtcatccgaatcactgtctgacgcagactcagattcagaagatgatgatgatgtgctgtccctcctgtgccttctcttcttctgcttccttctgtgttgccgcttcttgtcttcagagtctgaggaactataacttgaactggttccggaagagtattcagatcccgatgattcagagtcagagtcgaacaccgaagcagcactattgctgctatctgaatcactcggcgatcgatgcttcctcttactctttcccttttttctttcggctttctccttcttctgcttttctttcatcatcttctgctcctcttccctctcctttataatatcaggattctcaaattgataagaaaccggtacgcttttcttaagcttggggttcttaagctgctgcgttcttgaaggccgtgatatgtacacccgctcgtttttgcactcatatgtccagtgaccatgctgg

SEQ ID NO: 10445 - DNA, 613 bp, Zea mays
  Clone ID: LIB3279-179-Q1-N6-F10
ctaacacttagacaagtatattagtacacaaaaccaatgtactaagacttagaaacatacctttactcttgatttgcactttgttcatccatgagcatagattcacacttaagcacttgtgttggcaatcaatcaccaaaatacttagaaatggcccaagggcacatttccctttcacttacccatgatgaggcatgtgaccagttaaaaggtcctcggtcagcaggcctacattctctataatccttaatcaacctgggtagaatatcacttgttcctagcccaagtctcgatttaagtacttccaccgttaggattgtttgtgttccttaggatgaaaagagcattatagggaattttgcagtaagatcccaccactgctcccaataaaaatattcttgcaagcagaagccatccttcctcaggataaccccaaagatagacactaacgcaaaggacaacatctatccgcaagaattacctctaggcaaggctaagcatttttgtaaatcatattttgatactttactcagagtatctataaagggatggatttcaaggtaggcaatgcatcaaagggtttccaagcaactcctataaacctatgcacatt

SEQ ID NO: 10446 - DNA, 426 bp, Zea mays
  Clone ID: LIB3279-179-Q1-N6-F11
aaggtagcagaggttctttaatttagcatcgcaatgcagcatggaatcctgagtacagcatagtagcatcaatcctcttagcgtcatcaaaatcttaacaaaagctttctggaaccgtttgctagcttacagaaacacaagagacatcgataaaaccaaaggaaaggtagagaccctagaattccgacgcaggagccggccgatccgcgcgctcagaagccgagcttggtgcggcgccagtgcctgcgcttggcgttgtacctgatggtgttgtccgtgcgcatgcggatccagtaggggatggggcggttctggcgcatcttcttcgccagcttcttcttgatccggaaggtcttgtgcgacggcatcgctgcggcggagacgacgatgcggcggagacgacgaagcggcggcggcggcggcgcg

SEQ ID NO: 10447 - DNA, 626 bp, Zea mays
  unsure (1)..(626): unsure at all n locations; Clone ID: LIB3279-179-Q1-N6-G10
catcaacattagctcatgattttattccaaaaagaactgagcaactaacagaaaccaaagaagaaacagatagaaagttcacgcagaaaaatgccggcctatacactgctctttttgggactggggcaaggaaggattccccagttccttctcacttcctccaggtcttcgtgaaagtgcttctcgtaatatacagacatcagatcagtacacctgagaccagcttttgttgcccatgggaagtagtgctggaaaaacagcgccctttgtttgtcgctgaacctcgcagagcccccgacgactgacatcatgcacattgggaggaacatctgttcaaactctatcaccttgagggcggtctccccaatcaggttcgtcggaagaccaaacagcacgtgccaaaagtcgtgcacctcgcgagcacgtgtcgcgacgtaggcgagctcatcggtgtccatgaaacggacaggcgggcgatcgtctggtgagaagttccttgatcccatgaactgagcatacgccgcgccaaatgtgttctgaggcaggtcccaggcatgggaaacctgcgaggataccacgcggngacactccgaagaacctgccttctgcactgttcttcattcgtt

SEQ ID NO: 10448 - DNA, 523 bp, Zea mays
  Clone ID: LIB3279-179-Q1-N6-G11
ggggggtttttttttttttttttttttttttttttttttttttttttttttttttagggggaccacaatgcagtcattaatgattttgtttagccacacgttacattaagcgtgtgggattcatgcctgccaaaacattatcgttggcaggggggggggggactgatccaaaagcagcatacacacatggttcattagaaatccgaacagactattagcgagtattggttgcacataaaagcacagagttcgtttgtccagggggaatattaccagaagacaagtgttatttttggtggacagaaaaatgacatgtcccttcatttccaacgatagacctccatattattggtccatgggatgatcgcttttggcattacatgccagggttgctagagtaagggcttggggttctattagtaaactgatgggccaaaatagaaaaaaaagttgttcagggctgattgggttcgcttagctttccgcaaagaaggttttaagtccctacagtgacttgggtata

SEQ ID NO: 10449 - DNA, 570 bp, Zea mays
  Clone ID: LIB3279-179-Q1-N6-H10
gttgtttttttttttttttttttttttttttttttttttttttttttaatctaaagcacactatacacaatacttgcataatgtttcaatgacgacgacatcgagggcacacgaatgggctctatttttttttttttgaagtacacgaattggggcatcatgcattttcaccagcatcatgccagcatcatgcatgacacaatacgaatcggagctactctttggtgaggaggtcgtagtgcaccttgggcttccggtgcacctttttcccgcacgcctcctgcatggcgtaggcgaggtgcagcagcgtggcctccgaccacgggcggccgatgaactggagccccacggggagccctcccctgtcatacccgacgggcacggtgatcgccggcagccccaggaagttgcccgcgatcgagtacctcaccagcgcagctccgttgatgtagtccagctcccccgtcctcagcgcgtcgtcctgcagcgcgtacgccgtcacccctgtcatcggcgtgacgatggcgtcggccgtctcgaagatcttctcgtggaagtacatctgccggc

SEQ ID NO: 10450 - DNA, 572 bp, Zea mays
  Clone ID: LIB3279-179-Q1-N6-H11
ggtatacatactactctctgttatttatcaaggttccctagcttttatttatgacataattcatacaggaattattaccacaacaactaaacttggaaactaaattacagacagacttttttaggtccatccgcgggctgatgatgtggaattattaattagagaccaaagcaaatgaaaggacgaatctgaaacgtagccagccaggcagctagagcctgaagtggtcgagcgcgcggccatcgagtcctatggtgttgaactttgcgatgaagtctcgggccctgacgctcctgtacagcgggggcttgctggggtctggaatggggccgtacatcctctcggacctcctcacgtccgtgttgaagaaggacgccacggagaccctcgccgtgtcgctgctcttgttggctggcacccggtgctccacgctcctgaaccggtcattggtcacgagctgcagaagatcaccgatgttgaccatgagcgccccaggccggggagcgatgtccacccagcagccgccgctctgcccgttgttgccgaggcgcacctgcaggccggccatgccg

SEQ ID NO: 10451 - DNA, 385 bp, Zea mays
  Clone ID: LIB3279-180-Q1-K6-A10
cacctctgcaattgcaagcaaagctccgggctccggatcaggatcacactgaccaccgcgagcgcgtgccggcgtccagtggttacgtcgagggagcctaggctagcgaggaacaagcagccaccagcccgccacgatgctcgtgaggagcgcctccacgccggtcctcggcgcgctgcacccttccggctgccactcgccggcggtctcctccccggccgtgcacttcgccgagtctccggcgtcggccgcctaccacgcgccgcccatctcctgccacctggccgggcccgggtccgggtccgaccacgagcgctcgcgcagccgcggcgccggcgccggcatgcgccgcacgtgctccgaggacaacctcgcgtctctggcc

SEQ ID NO: 10452 - DNA, 350 bp, Zea mays
  unsure (1)..(350): unsure at all n locations; Clone ID: LIB3279-180-Q1-K6-A12
cccgggnncgaccgcacgcgttttttttttgcgcatcccatcccactacccggggggggggggggcgccgattcgatccggttcttccaacccaggggcagtgatggcgacgaagaggagcgtgggcaccctcggcgaggcggatctgaaggggaagaaggtgttcgtgcgcgcctacctcaacgtcccgctcgacgatggggataggaggggtttttctcttttttccgcgccnccgnccccaccatcaaggnccgccgcgagaagggcgccaagggcanccncgccagccaccnggggcggccaaaagggggcaccccaaaggacagcgngaagccncnnnggccacg

SEQ ID NO: 10453 - DNA, 584 bp, Zea mays
  unsure (1)..(584): unsure at all n locations; Clone ID: LIB3279-180-Q1-K6-A2
cccacgcgtccgcccacgcgtccgtggggacaaaaaaaaatgttacatacacaagacatttgcgatgttgttatataatgatccaaacaggacgtgtccncgaaagatgaataatcatcccagacaggttcttgaatcgtatatatatatatcacatacttgaagatacactccagatgactggtctggacaagaagaaagcttctgtctttttcaagactaatgctgatgggaacacaacatgtgccaaggaaatgacaaagctctctggcatctctgaaatcatccccgagatggagatctgcgattttgactttgaaccctgtggctactccatgaatgcgatccatggctctgcattctccacaatccatgtgacgcccgaggacggtttcagctatgccagttatgaggttatgggcttggatgccactgctctgtcttatggtgaccttgtcaagagggtccttcggtgctttggcccctcggagttttccgttgccgtgaccatcttcggcgggcgtggccatgccgggacatggggaaaggcacttggtgcagaggtctatgactgcaacaacatg

SEQ ID NO: 10454 - DNA, 605 bp, Zea mays
  Clone ID: LIB3279-180-Q1-K6-A3
tcagggcaatggagagggcggtgccggttcggaagccgcacaccaacacggccgaccttctctcctgggcggccacgggccctgacgcatctgcctcgccggccgtgtcctcccgccccagcctcaagccggccgccgggattacgcccgcgatgttcggcgcgccggtcaccgagcaggaggccgaggatctgagcaagagtgaaaggaaattttgctccggatcgaagttgaaagagatgagtgggagtgggattttcgctgagaagagtgaaaatggtgactcagaggcttcaaatcctgataacaagacttccttgaggatgtaccagcaaactgtgactggaataagccagatttcatttagcgctgatggaagtgtttcaccaaagaagccgtcgtcaatacctgaggttgctaagcagcgagagcttagtggtaccctggaagatgctgatgctaaaaccaataagcagctttctgaagccaagaccaaggagcttagtgggagcgacatctttggtccgcctcctgagattcctgccaggccattggctgctcgtaacatggagctacaaggaaatgtcgatttttcacttccacag

SEQ ID NO: 10455 - DNA, 631 bp, Zea mays
  unsure (1)..(631): unsure at all n locations; Clone ID: LIB3279-180-Q1-K6-A4
acttaatacttctaacagttggagcagagcacatctatgtcactagcgtttggtctcaggagtgcctttgtaggtttagaaacgaagtctaaccaccttctagttatttgtgagatattggaggtcaccaaacttcgaaatgcagtcatccaaactacaaccacaaagtgctttattaagcgactctcaacgctttgtatccaaggcccaagcataaggaaaagattcccgtagattacgagggatctacctatattttgtttaaatgtgttgtagtgtaatttaaacgagattgagagaatgaattattattgaagggtaattatatatatatacacagggaggggtgcaagcaagtgacaagtccttttggtgagataactgccaccacttggagaattgatcatatgtttattttctaacactcacccttggttaattctaacttcatttgatcatccttcagttgttcttcaaagatattattctccttaaaacccctgtggaaaaaataaggagtataccattcttttggattatgagtaaaactcacactggcttccaaaaaaaatatgtctgtaatcaccattcctaanaacaccgtgggggaaaatnaatgatgaagcatata

SEQ ID NO: 10456 - DNA, 640 bp, Zea mays
  Clone ID: LIB3279-180-Q1-K6-A5
cccacgcgtccgatttacgtatatgcccttgtcccggttcctttccccatccccaactccattatttgcttgatccttgagaagagagaggaagacgagagctagaagcgaaggagaaaagcagttcttcagctaggcaggagggcacaggaaggaggagatggcgtcaaagaggattcagaaggagctcaaggatctgcagaaggaccctcccacctcgtgcagtgcaggtcctgttggtgaagacatgttccactggcaggcaacaataatgggtccatctgatagcccatattctggtggagttttcctagttacaatccattttcctcctgattatcctttcaaaccaccaaaggtggcatttcgcactaaggtgttccatccaaacatcaacagcaacgggagcatttgcctcgacatcttgaaggaccagtggagtccggcactaaccatctccaaggtgctgctgtccatctgttccctgctgactgatccgaaccccgacgaccctttggtccccgagatagctcacatgtacaagacgggaccgcacaagtacgagaacaccgcgaggacctggaccccagagtatgccatgtagtattttctctacctggcctttggggtcgctgctgcg

SEQ ID NO: 10457 - DNA, 429 bp, Zea mays
  Clone ID: LIB3279-180-Q1-K6-A6
cgcgccgccgccgcagccgcaacaatgccgtcgcacaagaccttccggatcaagaagaagctggcgaagaagatgcgccagaaccgccccatcccctactggatccgcatgcgcactgacaataccatcaggtacaacgccaagcgcaggcactggcgccgcaccaagctcggcttctgagcgtcgggattggccggctgctgcgtcggaaggctagggtctaagagctatcttctgttttatcattgtctctgtttctgtaagctagcaagtgatgctgtgatgcttttattaagattctgatgagtggtgacgttaagagaaaattggcagtactgtgttgtaccccaagattccttgcagcattgctatgctaagtaacgaaccctttatcttattatatatgtagtgttgcagtgattgaggtcc

SEQ ID NO: 10458 - DNA, 606 bp, Zea mays
  Clone ID: LIB3279-180-Q1-K6-A7
attggaccccactggccagacactatccatcactagaccaccaccagcggcgggctccagtcgcaactcgcaagacagacgccgccgcccaaagaaagacgtcaactccaggagacaagatagtgagaactgaagagaaggatgggcttcgagaagcagatcctgagatccggcaccggccccaagccgataaagggccagaaggtcaccgttcactgcaccggctacgggaaggatcgtgatctgtccaagaaattttggagcaccaaggaccctgggcagcagccattcagtttcagcattggtcagggttcagtgatcaaaggatgggacgagggagttatgaccatgcaagtgggtgaagttgctcgtatccagtgcacgcctgattatgcttatggagccggcgggttcccagcctggggaattcaaccaaactcagtgcttgtgttcgagattgaagtcctcagtgcccagtaattcgcatctgtcagctatggaaacgttggccatgcttctcaagtaatgaaataattccgttgtcacctcatgctacatacagcagattggtgttacgagttaaatcctgtgaaactttagcattct

SEQ ID NO: 10459 - DNA, 635 bp, Zea mays
  Clone ID: LIB3279-180-Q1-K6-A8
ccggcaaggaccccaacagcctaagaggctcccagcgctttcttcgtgttcatggaggaatttcgcaaggagttcaaggagaagaaccctaagaacaagtctgtcgctgcggtgggaaaagctgctggcgacaggtggaaatccctgagcgagtcggacaaggctccctatgtagccaaggctaacaagctcaagctagagtacaacaaggccatcgcagcctacaacaagggcgagagcactgcagctaagaaggctcctgccaaggaggaagaggaggaagacgaagaggagtctgacaagtccaagtcggaggtcaatgacgaggatgacgaagagggtagcgaggaggatgaagatgatgacgagtgatggagagctcgctcgagacaatggacggtgcttcatccaacaatggagcggctacacaaggccccgtggcgatcaaaaaaaaggagcctatatccatgtactagaattattcagtttcactccacatcgtgatgttttatttttacttttgtcgtgctataacggatagcgctcctcgttggcgccactggcgggtggttctgcctctggtctgggtgtgtttgtgtgtggtcacacttgccagctagcagaggcgcctgctt

SEQ ID NO: 10460 - DNA, 441 bp, Zea mays
  Clone ID: LIB3279-180-Q1-K6-A9
tcaccatgttttgacttccaatgtagaattgataagtaacatgtcttcttgaggatgaagtaggtgttgcagttgctggagtacccaaacctgacgtagctggagacgacgctcaagacgatcgaggccttgctgccgatcgtctttgctagggagacacggcacttgaatgagtgcctcgtcgataccgtcatgggtcgtgccttcctcttctagggtgacaactaagctgaaagcttcaaagagttcaacatcgacaacatatgtggcaccatctgcgtcctcctacagatatttgtcgtgctcacgttcggtacccaaatgcccgtgaaccgtggtcaagataccccatctacaccatgagcagagacaacacgcaaaatgagattcctttcgcttttgatcaaacaatacgataaatgaaattcgatttgaactgat

SEQ ID NO: 10461 - DNA, 606 bp, Zea mays
  unsure (1)..(606): unsure at all n locations; Clone ID: LIB3279-180-Q1-K6-B1
cccagcgtccggcgaaagcgtggtgcgggatgtggagaaggctgcaattgaattgcttgctgccagagctttcactgtctctgagcttaggaagaaactacgaagtaagaagtatccttttgatacaattgatgccgtgattgctgatttcaagtcaaggggtttgttgaatgatggtttttatgctgaatcattttcgcgatcccggtggctaacatcaacatggggtccaaggcgaataaaacaggcacttcaccaaaaaggtgtcccagaggcagaagtagatcaggcaacgagacgagtgttccaggatggtgacgactatggaaaggaggcaacgttcggcatgtccgaagcttccatggatcgtctgtttgctcaggcgtccaaacagtggcagcgtgggcaaagcttgaccctggagagccgacgtgcgcgcatggtgaggtggcttcagtaccgagggttcaactgggctgtgaccaatgccgttatcaggaagctggaggctcagcaccctccaccctgactcttctgactagatgaatggcaacaaacatatcaagttcaaactgagaagttcangcggatgctgcctcgccttct

SEQ ID NO: 10462 - DNA, 624 bp, Zea mays
  Clone ID: LIB3279-180-Q1-K6-B10
tctctttccactccacgtcaagaaggggcacgggcctaactaaaccctagctaagggaagggaaacaagaccatggatgcctccaagctccgcgagcttcgcgacttcgtcgaggcgtgcaagaagaatccttcgctcctcgccgaccccaacctctccttcttccgggattacctccagaggttgggtgcctaatttcccgccgccgccccctctttcgaaagtcccaagagatcttccatggacgacattgatgacgacggtgatgacgacgacgatttggatatgagggatcccactcctgagcgagacgagctcgatgaagagattgttgagtctgatcttgagctcgaaggagaaattgtacagtctgaccatgatgacccaccacagaagatgggaaatccttcagtggaggtgactgaggaaaaccgtgatgcttcccaagaagcaaaaggcaaggctatggaagcaatttctgaaggaaaacttgaagatgctattgaacaccttaccaacgcaatagtgctgaatccactctcagcaatcatgtatggtactagagcatctgtgtttataaaaatgaagaaacagctgctgccattcgtgatgccaatgctgctc

SEQ ID NO: 10463 - DNA, 602 bp, Zea mays
  unsure (1)..(602): unsure at all n locations; Clone ID: LIB3279-180-Q1-K6-B11
cgtgtcaaaccctaagcaggnagttgatttatccgctgcagccatgagtaagttgcagtctgagtctgtcaaggatgccatctcccagattgttggggatgccaaggagaagaataggaagttcactgagactgtggaacttcagattggtctgaagaattatgatccacagaaggacaagcgtttcagtggctctgttaagttgccccatatccctcgtcccaagatgaaggtgtgcatgcttggtgatgcccagcatgttgaggaggccgagaagatgggacttgactacatggatgttgaggctctcaagaaaatgaacaagaacaagaagcttgttaagaggcttgccaagaagtaccatgctttcttggcatcagaggccatcatcaagcagattccccgtctccttggtcctggtctcaacaaggcaggcaagttcccgaccctggttactcaccaggaatccctcgaatccaaggtgaacgagactaaggcaaccgtcaagttccagctcaagaaggtcctttgcatgggcgtcgccgtcggcaacttggcgatggangagaagcagatccagcagaacatncagatgagcgtga

SEQ ID NO: 10464 - DNA, 625 bp, Zea mays
  unsure (1)..(625): unsure at all n locations; Clone ID: LIB3279-180-Q1-K6-B12
ccccgggncgacccagcgtcctttttgcaaaactnnatttttactgcggggggggggggcactatttcgccgcaaggcctctagaagcaatcaggcgagcggcggctgcggcgcgatgggagagcaggtcgtgacggagcgtatccagcggaagctggaggaggccaacgctaccgtccaacagcacctcgccggggggggagggggcacgtcacctccactttgcagcaagcatacttcaagtgcgcatatgattgcttcgatcggcgccgtactcaggaagcgatcaacaattgtgtggagaattgtggtatgcctgtccttgctgtcaacaatgtttttgagagtgagatggccaagtttcaggaacggttgaaccggtcattgatggtctgtcaagataagtttgaagctgccaagctccagaagatgaaaacagatgcaactcaggaactggaatcctgtgtcaacagatctatcgatgacagcatcagggccctcccatatgtggtgcagcagatgaagtccaccctcaatatcaattagaggcattattacctttagcatatgaaccagatatagtttgataatgtttcatattcacattcaaggcataagtctacat

SEQ ID NO: 10465 - DNA, 586 bp, Zea mays
  unsure (1)..(586): unsure at all n locations; Clone ID: LIB3279-180-Q1-K6-B2
ccccgcgtccgaaaccattgttggacgcgttcccctcctgcacgcaacctcatctcgtcctccagatcctggatggccgtcctccttgataccttgcctcgcgagtgctctcggtgagctactttgttttgatttatcaggaaatccgtttgcttcatgttatgcaggctcagatctgattgctggattcggcatcttacgggcttgaatagagctaggactgggagaaaacaacaaacccgcgttggatcctgtatcggttagtccttgccttcaaggttcatgttgttttgttttggtggtcgagcatcgcatgttctgcttctggttccagatctggagaaatttctaagtcgtcgtcgtcgtcgtcgttcggttcggagcggatctgaggcgacgatggctggaggcggcgggatctcttggtctgcagtcctgcttcacctcgatggatgatgtctctgcgctgataattattggatcaatttcgataattattagtagatctatgagatatgccgcctggaagaggcgaggtaagctgcagcatgtaaaagtctgcgtgcgtcgacagcaaaaaaaaana

SEQ ID NO: 10466 - DNA, 511 bp, Zea mays
  Clone ID: LIB3279-180-Q1-K6-B3
gccgccgctgccgcatctaacgcagttccctccgccgcagcccgaggcaagatggttctccagaacgacattgatctgctcaacccgccggcagaactcgagaagctcaagcacaagaaaaagagactcgtccagtcgcccaactccttcttcatggatgttaagtgccaggggtgcttcagcataaccactgttttcagccactcccagactgttgttgtgtgccctggctgccaaactgtcctctgccaacccacaggaggaaaggcaaggctcactgagggctgttctttccgcaggaagggagactagagcggatgtggtcttcaagttttgctctatgccagatactagcgtcatgaactgcctttagctaagattttccataagttgttctcgagcagctatgtgttgcatgttggctacttccaaacttatatctggtttggtttggattgtgatgaactaatggctctttgaatttatattatgatgttgacgatatttggcg

SEQ ID NO: 10467 - DNA, 623 bp, Zea mays
  unsure (1)..(623): unsure at all n locations; Clone ID: LIB3279-180-Q1-K6-B4
gcgggacaaattgggcctactaattatcanncagcccagtaaaaacccacaccacccatccacaaaacccgaaaccccgtgtgctttctagtttctctcccgtataaacccttgaccgggagacggaaaaccccaacgccggcaagaaccgcccctcgcaagcaatcgcttgctcgtcgcgctcgaatcccgcgcgttcgcgggagcggcgaggaggaggaggagcatggccgggaagggaggagggaagtcgctggtcgccgcgaagatagcggctggcatggacaaggacaagaagtcgccggtcaaccgctccgcgcgcgccggcctccatgtcgccgcccccctctctttctccgctcgcttgttcttgttttgctcgtagctccgcttcgtcccacccttgtcgcgacgagggctcgtttcgttcttgggcgtgacgtacgcgcgcgtgctgctttctgtgcgttctttatcatacggngtgtgggttgttggcgcggcctgccgtgtccgcttggagtggaaagcgtgttcgttgttctcttttcaagagatttggcttcttcttcttctttgggttgngccatntcttttgttagtttgcgtagcagtcaggcgtc

SEQ ID NO: 10468 - DNA, 632 bp, Zea mays
  unsure (1)..(632): unsure at all n locations; Clone ID: LIB3279-180-Q1-K6-B5
cccagtcacaatccgccgtgcgcacgccgtgcatcccatcaccgccgtgcagatggagtggtcgctctggtcccgagacatcgagcccgagatcgtgccactctgcagagaattggggattggaattgtggcttacagtccaattggccgtggattttttggtggaagaggagtgacacagcaagtttcttctgaatctagtctgcaaaggcatccaagatttacaacagaaagcttggagaagaacaagcagatttacctgaaaatagaagatttggccaagaagtaccagtgcagcccagctcagctagctctagcctgggttctgcatcaaggggatgatgtggttcctataccagggacaacaaaaacgaagaacctagatgccaacgttgactccttgaaggtgaagctcacagctgaggacctgaaggaaattggcagccagatacgtgcagaagatgtggctggtggaagacaatacaattcctatgcacatacctcctggaagtatgcagatacaccaaanaagtgaagctctggaaaccttgtagcaatcacaggcgtatgcaaatgttgaactatttccctgcatttgagccggaatcgtacgatgatgcatcttgtgaaca

SEQ ID NO: 10469 - DNA, 503 bp, Zea mays
  Clone ID: LIB3279-180-Q1-K6-B6
cccggttccgcgtgcctttccccacctactctcgcggctctcgccagccagtctagggtttcggtcccggcgtgcttatccgcccccgccggccatgtcgaagcaaggagggaaggccaagccgctgaaggcgcccaaggccgacaagaaggagtacgacgagacggatcttgcatatctgcagaagaagaaaagatgaggaaaaagcactgaaggagcttaaggccaaggcacagaagggcgcgattgggggctcgggtctgaagaaaagtggaaagaaatgagactggtcacccgtctccaatacctagaggatgataaggcagctgtctatctgtgttgcgcttcactaagtgtgattgtaacagtggtacctcttgtgttctgtgttccgcgatgttgcagttggttgcttgatcgaaagatgtttcaacctcccatctgctagctatgatacagatggtcccctgataataatgatgacatattctgtgatggatgcc

SEQ ID NO: 10470 - DNA, 607 bp, Zea mays
  Clone ID: LIB3279-180-Q1-K6-B7
cccacgcgtccggtctggtgccaattgttgagcctgagatccttgttgatggccctcatgacattgatcgctgcgcttacgtcactgagacagtccttgctgcctgctacaaggctctcaacgagcaccatgtcctcctggagggtaccctcctgaagcccaacatggtgactcctggctccgactctaagaaggtgacacctgaggtgatcgcccagtacaccgtccgtaccctccagaggaccgtccctgctgctgtgcctgctgttgtcttcctctccggtggacagagcgaggaggaggccaccctgaatctcaatgccatgaacaagctcagcaccaagaagccatgggccctgtccttctccttcggccgtgccctccaggcgagcaccctcaaggcctgggctggcaaggtggagaacgtggagaaggctagagcggccttcctcgccaggtgcaaggccaactccgaggctaccctcggcacctacaagggtgatgctgccgccgacaccgagagccttcacgtcaaggactacaagtactgagttgcttctctttgcgatcccgttgttttggaactcctgcctgcgagtaggttgct

SEQ ID NO: 10471 - DNA, 671 bp, Zea mays
  Clone ID: LIB3279-180-Q1-K6-B8
cggacgcgtgggttccctctctcttctctctaccacgaccgcgccaaggatcaagcgcacgcgacgcccgacgcccgacgccccgactgcctcgacccgccagcgcccaggaagacccgacgccgccaacgcccaggaagactcgaccgaaccctaacttcttgccgccgccacctcctcttactcgcatgccaccgtcgctcccctgggcgcaaacccgctgtcgctcagcccggcgcacgggatcgggcggtccggggacgccggcagtacacacccgtcgtcggtttccgcaggtatgttccaatgtttgtggagatagagtacgatccgaactgctagtacacatctgttctaattgaagagcaactggaggctcttggaagagcaatagttgctggcaagacaggcaattgaaaatgagaattgatcttttttatgggcgaagtgttgaagatggctttggtgaaggaaatgtcttgttagcatcaagtaagtggcgacatcacaacccctacaagcttgtgccttaaaacaagaggatacaagaagttggagtgcttttgtgaagacttttgcgaatcacttgaagcgttagtatttttgtgaatggatttgtaaagtgtttgcaaatatgtgcaaaacataataacatgtgtagggttttggtg

SEQ ID NO: 10472 - DNA, 606 bp, Zea mays
  unsure (1)..(606): unsure at all n locations; Clone ID: LIB3279-180-Q1-K6-B9
tgactgcctcgagcagcagagaacaggnaggccgagggcgggatgacgatccggttcgtgctgttcgtcaacaagcagggccagacgcggctggcgcaatactacgagcacctctccctcgacgagcgacgggccctcgagggcgagatcgtccgcaagtgcctcgcccgcactgaccagcagtgttcgtttgtggagcaccggaactacaaggtcgtttacaggcgctacgcctcccttttcttcctcgtcggcgtcgacagcgatgagaatgagttagctatccttgaattcatacatcttctggtggaaactatggatcgccacttcggcaatgtgtgcgagcttgatatcatgttccatctggagaaagtgcacttcatgctggaagagatggtgatgaatggttgcattgtggagacaagtaaacagaacatcttggcaccaatacaacttatggagaaaacttcctgaaatagtgatatccatttgtgtagttttccatccacttggcacatttgcctgtctgcccctttccataaaatttccctctgtatgtgagagtgcaaaacaatctctgtaaccatggagtattgaattgacctg

SEQ ID NO: 10473 - DNA, 624 bp, Zea mays
  unsure (1)..(624): unsure at all n locations; Clone ID: LIB3279-180-Q1-K6-C1
gcgcgngaaagcgaatcagcaggcaatggttgccgagaagaaaagatggaaccgcggggcgagagccgaggtgtttctaagcagaagtggctggacgacaggaagaagaagatcgggaagctgctggactcaaatggccttgatatgtccaaggcgtacatgctcgatacgcaggagactgcagaagccaagtacaagaaatgggagaaggaacctgctccatatgggtgggatgttttcaatcaaaagaccttgtatgatgcatacaaaaagaggaccaaggatatagaagttgacatggaggcgtacaataaagccaaggaagctgatcctgaattctaccgtgacgcctccagtctccagtacgggaaggtgtccaatgtccctgaagaaaacattgacaagatggtcaaggaactcaaggagcgggaagagaagcggaaatcgttcagcaggaggcgcaagtttaacgaagacaaggacattgattcgatcaacgaccggaatgagcacttcaacaagaaggttgagcgcgcgttcggcaagtacacgctcgagatcaagaacaacctcgaaagaggtactgccttgccggactaaaactgtacacagcagctcggtatc

SEQ ID NO: 10474 - DNA, 532 bp, Zea mays
  unsure (1)..(532): unsure at all n locations; Clone ID: LIB3279-180-Q1-K6-C10
cggacgcgtggggaggtttcaggtgaggaacatcgtggaacaggcggccatcagggacgtccaggaagcatgcgtctatgatggctacgtcctcccgaagctgtacgccaaggtgcaccactgcgtctcgtgcgcgatccacgctcacatcgtccgcgtccgatcccgtgagaagcgcagggaccgcaagccgccggagcgcttcaggcgcagggaggataggcctgctggtggacaaggaggcccccgccctggtcctggtgctgctgctacagctccatctccagcaccggttgctgctcgcccataggctttagcttttcgaccgtgttaagtcttctgcccactcagtttcggagttgtcccctgtgcgtgtgtgaagctgctatattagagttactttttgtctaaagtctgaacattttcgaagaatttgaatatctgaacatttgaatgtttgtgctgagtttttcaaagaatttgaatatctgaacaattgaatatctcanannaaaaaannnnnannnnnnng

SEQ ID NO: 10475 - DNA, 548 bp, Zea mays
  unsure (1)..(548): unsure at all n locations; Clone ID: LIB3279-180-Q1-K6-C11
tttttgaacggcaagnagctggacgggcggacatcaccgtcaacgaggcccagtcccgcggcggccgtggaggcggcggcggcggcgggtacggtggtggccgtggaggcggcggctacggcggtggcgggcgccgtgatggcggcggcggctacggcggtggcggcggctacggtggtggcggcggcggctactgtggtggtggcggcggctacggcggtggcaaccgtggcggcggctacggcaactccgacgggaactggaggaactgagcggtggggcccgcgcggccaagttatcctgttcgctaccgtgttgtttaccctagtccagagtgtttatcttcgttcgtctcgtgtttgttgttgcccatctgtgtttttgattgaaggtcgctctgtgtcagttgttagtgctgtgttcatcctcggctccagcagacccatgcatcaaccagcatggactgcggatcgatgggtgctgttacccccgtcaggctttattctaagttaaatcctaaagaaaaaaatggtgcttcttggtgctgc

SEQ ID NO: 10476 - DNA, 335 bp, Zea mays
  unsure (1)..(335): unsure at all n locations; Clone ID: LIB3279-180-Q1-K6-C12
gccacgggggggcgccnngagaccacanaaacaanggngaaggcngnngccgngcccggnagcagcgaagggggcaagggcaccaccnnaacacccaaagggggggggggggggggcttttttttttttngncncnggccncaanccnggccgccagggggggcangngcangcgcgcggggacaccaccaanggcngcangncaacnggaccacacnacaanccngcgagcaaggaacanggagcaccanaagacgagaaccgccacgccgggganccnggaaangngacagcnggagcagacggggnngcaaacacnaangggaccgacagcc

SEQ ID NO: 10477 - DNA, 609 bp, Zea mays
  Clone ID: LIB3279-180-Q1-K6-C2
ggtacttgtatccaaggcttgggtacatcccttatgctcacacgactgaggaaacagctattgcttcattgaagagatcccttggtgctctgaaacacatcttgccttgaacacgtaccttgttggacattctgttactctagctgacattgtattgacatgcaacctctaccatggaattgcacggatcttgaccaaaagcttcacttctgatttccctcatgttgagaggtatttctggaccatggttaaccaacctaatttcaagaaggtcattggtgaggtcaagcaggcagagtctgtacctcctgttcttaaaaagggtgttcctcctaaggagtcaaaggcaaaggatgtgaagaaagaaactccaaaggaggcccccaagccaaaggtggttgaggtaccagcagaagaggaagcaccaaagccaaagccaaagaatcctcttgacttgctgccaccaagcaagatggtccttgatgactggaagaggctatactcaaacacaaagaccaacttccgggaggttgccatcaaaggtttctgggacatgtatgacccagagggctactctctgtggttctgtgactacaagtacaatgatga

SEQ ID NO: 10478 - DNA, 587 bp, Zea mays
  Clone ID: LIB3279-180-Q1-K6-C3
gtccgcggcgctatcgacggagctccgccacaagtacaatgtgcgttccatcccgatccgcaaggacgacgaggtgcaggtcgtgcgcggcacctacaagggccgtgagggcaaagtggtgcaggtgtaccgccgtcgctgggtcatccacgttgagcggatcacccgcgagaaggtgaacggctccaccgtgaacgtgggcatccacccttccaaggtcatggttacaaagctgaagcttgacaaggaccgcaaggcgctcctcgaccgcaaggcccggggccgcgccgccgacaaggctaagggcaagtttactgccgacgacgtcgccgccgctgctggtggcgccgccgccactggcgcgtctctccaggagatcgactaggcgcttcgcggggatctgatggtggtcctaccgcctattactccttatcgctctagtttttgctatcaatgattatgtgctaggagttttatgttacttataaactgctttgagcctcgatgggagttgaacttaatgtggagtgtatctgagatatgaagaactcattatatggcttaaaaaaaaaaaaaaaaaagggcgg

SEQ ID NO: 10479 - DNA, 409 bp, Zea mays
  unsure (1)..(409): unsure at all n locations; Clone ID: LIB3279-180-Q1-K6-C4
gcccagggnaaagcgccgttatgaccgcaagcagtcaggatatggtggtcagaccaagcctgtcttccacaagaaggccaagaccaccaagaagattgttctgaagctgcagtgccagagctgcaagcactactcacagcacgccatcaagagatgcaagcattttgagattggtggagacaagaagggcaagggcacatctcttttctaagcttctcgtccacctgtctggttgttgagttgaagctgtgggtctactactactgttataaaaacatgtcgccaaatttcaatgttaatgtagcaatgaaagcagaccatgctatgtatccaaattccaatgcctgacatttgttctggggtgttggtcgacttttggctaaatgaaagttttgtagcttgaatcana

SEQ ID NO: 10480 - DNA, 631 bp, Zea mays
  Clone ID: LIB3279-180-Q1-K6-C5
atcaagcttagcagacaatgcgtgcaagacacctgaaggcccgagacctagcggggtgcagcttagcatcacagagttctaccgctcgaagaaagcgcagaacgtagaatctgggaagaagccggcgggagaagggcacgccgcgaggggaggctcgagaaaatcgtccgacagggacctcgacaagagcctgccgaagtctgttcggcgccgcctcctcttcgattgctgaggactaggtagcctggcttttttttggtgagcactgcactgtaatcttggtgccactgctgtagatgacctagggaatgcattaacctattttagccggtgtagattgcgcgcggcccattttgtacagggaacagagcatcgtctttgtctaagaggaaatgaagcaggtcttagttcggaatggtcatctgaacctcatcttctttgtcatagtttcacaagtgcttgggaactcagcttcgattctaggaatgggatgcgtgccgctgctagagcaattgtttttttttttatgtctgcttttgtgccggaacatagctgacagaattgatgtgatactacagattgcacaactttttattcccttatttccaaatttaatttcaaaattattgag

SEQ ID NO: 10481 - DNA, 532 bp, Zea mays
  Clone ID: LIB3279-180-Q1-K6-C6
ctccgtttaaattcgagagttgatgctaaaaaacattagtgacaatattgtttagataaaaatttgagatgtcggaggaagctgctgaaaaggttaactttatctctggggctaagcttcaattcgacatccgcccattcttcagtcttaatgtcgttgccgccgagtacaatagtgattccccggtgcatccacaccaaggatttcatcaccaccagccccatcaacgactacaatggtgaagagtttgtcttctactctacaaggaagtaccgtgccaaaaaactcaataatagagtaccacaccaaccaaagtggctaattgttgccactagagagaatgtatagcctattatgtctggcacttagtgaatcgatagctttaagggcaagttatgcactcgagtgactacaatagggaagggaggccttccaaggcaagaaagtgctcgttgtcggttgtgataacacctttccaaaaataatgttcatgcctacattgtttgttcgtcgttgggtaaaacatttgcta

SEQ ID NO: 10482 - DNA, 644 bp, Zea mays
  Clone ID: LIB3279-180-Q1-K6-C7
ccccgcgtccgccccgcgtccggagcgcagaaacgagagggccggagcagccgcagtcccggcgatcccgccgccggtcgccctcatacttcctcgtcactgccttcgtttctctttccaacaatcaagatgagccgtggcggtagcgcgggtggtggtcaaagttctctgggttacctctttggaagcggtgagccccccaaaccagcagtggcaccagctgtaagtgctccacctgctgctgcaggtgctccacctgctgagaaaccacctgctgcaaagcctgatggcaccagtcagattgctgctggggttaccagccaaaccaataactaccacagggccgacggtcagaacaccggaaacttccttacggaccgtccttcgaccaaggtccacgctgctcctggcggtggctcttccctgggatacctgtttggtggcaactgatgccgctcaccaagctatcaccccccactgtcgccgcatgctttttctgaatcgtgaacagccgttgtcatttcatgtgtacccaaacctcccgtcccgcgtgggcccgtaagctgcgcctagatttcagggctaatcgtgtgcctgaaccctcatcataagtcgtctctgtacccagcttctcgtttcgtttg

SEQ ID NO: 10483 - DNA, 599 bp, Zea mays
  unsure (1)..(599): unsure at all n locations; Clone ID: LIB3279-180-Q1-K6-C8
agtaaagaaactagaacctaaaaccagcgacgccgagcggatctacagccaccttggtcaccggcggcgatggcgagttccaagtccggcatccctatcaaggcagaacaagattcggatggctcggcacaaagcacagctgatatgacggcttttgtgcaaaaccttcttatgcagatgcaaaccaggttccaagctatgtcggagaacatcatttcaaagatagatgaaatgggtgcgagaattgatgaattggaacagagcctcaatgacctcaaggctgagataggcggtgaaggcatgtcgacgccatctaagatgaaggaagagtcaagaccttcggacagctccgcatgagtgcagcagaagcagcatgactcgtttcagaggccgttgctgtgtcttgcgtttattactaacaaatactcctccgttcttttttatttgttgcgttttagttcaaaaatgaactagcgagcgacaaatatttgagaacggagattagtacctgtttaaggtctcatttgagcagagattgtaacctgtgctacttgtgttntgctgaatggtttgccataaactatatccgtcttcgttct

SEQ ID NO: 10484 - DNA, 647 bp, Zea mays
  unsure (1)..(647): unsure at all n locations; Clone ID: LIB3279-180-Q1-K6-C9
tttctcctggctcgcggctcagcttgccactaccagcaagcgctcgtcacccgtcggttctccccgagtagctcgtcgcgtcggcaatggagaatctgagatctcaaaactgccaccaaggtgttgccatggagggagtcaagtttgcgccggagaaggccaacaccaaccggagagccctcagcgacatcaagaacataataggaggcccacaccagcacttggcggtcagcaagagggctctgtcagaaaaaccagctgctgctgctgctgcaaatgctaaagatcaagctggctttgttggacaccgtccagtcaccaggaaattcgctgcaacattggcaacccaacctacagttgcccttctggacccaattggaagtgaaagactgaaaagaaacgctgatacggcatttcacacacctgcagatatggaaagcacaaaaatgacagatgacagtcccttgcctatggtgtcggagatggatgaaatgatgagtcctgaactgaaagagatcgagatggaagatattgaggaggcagcacctgatattgacagtggtgatgcaggaaattctctggctgtggctgactatgtagatgaaatttacangatttacagnaaaactgagggtgcaagctgcgtc

SEQ ID NO: 10485 - DNA, 539 bp, Zea mays
  Clone ID: LIB3279-180-Q1-K6-D1
gttctagcatcgcgacggccgcccgctcagactgtggaaatgttttcgtccatcggttttgcaccatggaaaatctaaggccctcactcctatgctccataatagccatgtttatgattgagcaagcaatatccacaactatcttgctacctttctcatagatagtttgtgcaacccatcatcccaaattaccaaaaatattgaataacaaaattcaactcaagaaaaaactttacatattcatccaatagagcggccttagtagcatgcatcacacctcactattgatgcatccaatcttcctgatgacatagtacactttaattgtatcaccacttaaacatatttatgcggacttgaataattgtgggttaacgggagagggcgttgagagataacgtgactcccaactttgaccttgtcattgtggctttttatatctttttaaatgtcaagatagtgaatcagaaaccttctactagtctggttcattcttgatcacgtcacatgtatgggtatttctcgacctattatgtgac

SEQ ID NO: 10486 - DNA, 544 bp, Zea mays
  Clone ID: LIB3279-180-Q1-K6-D10
tttccgcaaaaaccctagctttacctccccacaagcgcctccaagatgaagctcgtcaggttcttgatgaagctgaacaacgaaacggtgaccatcgagcttaagaacggcaccgtcgtacacggaaccattaccggcgttgacatcagcatgaatactcatctgaagactgtgaagctgacactaaaagggaaaaatcctgttacccttgatcaccttagtgtgaggggaaacaacatccgctattatatccttcctgacagcctaaacctggagactttgctggttgaggaaacaccaagggtcaagcctaagaagcctacttctgggaagcccttgggacgtgggcgtggccgtggtcgtgggcgcggtcggggtcggggacgttgagcatgctagctgcttttggaaattgcattgcgtgcatctgcagtgtaacctacattcctatcaattgtacgaagtatgcctttgattatgcaaccatgtatcaattgttttttttttttgccgtggatttatgttgatgaggttaccatgtgat

SEQ ID NO: 10487 - DNA, 654 bp, Zea mays
  unsure (1)..(654): unsure at all n locations; Clone ID: LIB3279-180-Q1-K6-D11
tcgtctctcagatcgggaggcgnaaaccaaggcatacatatacatatttgtagtggtaccatcataacaagtaaagatggtgaagttcacggctgaagagctccgtgccatcatggacaaaaagaacaacattcgtaatatgtctgttattgctcatgtggaccatggcaagtctacacttacagattcccttgtggcagctgctgggattattgcccaggaagttgctggtgatgttcgcatgactgatactcgtgcagatgaagccgagcgtggcatcacaatcaaatctactggtatctctctttattatgagatgactgatgagtcactgaagaactacaagggtgagagggatggtaaccaatacttgatcaaccttattgactcacccgggcacgtcgatttttcttcggaagtcacagctgctcttcgcatcaccgatggtgctctggttgtggttgattgtattgaaggtgtctgtgtgcaaactgaaactgtgcttcgccaagcccttggtgagaggattaggccagttcttaccgtgaacaagatggacaggtgcttccttgagcttcaggttgagggtgaggaagcttatcagactttctnccgtgttattgagaaatgccatgtcatcatggcaacatatga

SEQ ID NO: 10488 - DNA, 464 bp, Zea mays
  unsure (1)..(464): unsure at all n locations; Clone ID: LIB3279-180-Q1-K6-D12
gggggggggccaaaaaagaagccagcgggagaagaagccggcggccgaggagaaggcggagaagacgaccgcaggnaagaagcccaagnccgagaagcgccngcccgccncgaagncctccggcaaggagggcggcaagaagagagggggggaggggggctttcctctttttggagaccnacaaaancnacancgncaggggggggaggcaggngcaccccgacaccggcancnccnccaaggccangnccancangaaccccnncancaacgacaccnncgagaagcncgccggcgaggccgcgaagcncgcccggggcaacaagaggcccaccancaccncccgcgagaaccagaccgccgngcgccgcgnccncccaggagagcgcgccaaacacgccgncnccgagggaaccaaggccgncaccaaggncaccagcaanggagcagcccccagcggccac

SEQ ID NO: 10489 - DNA, 576 bp, Zea mays
  unsure (1)..(576): unsure at all n locations; Clone ID: LIB3279-180-Q1-K6-D2
cggacgcgtgggcgacgacgcgagcaagcagcaggcgtgcagccgcacgtgcgagtcggaccactgcacgacgccgccgttcctgcggtacggcaagtactgcggcatcatgtacagcggctgccccggcgagccgccgtgcgacgcgctggacgcctgctgcatgcaccacgacaactgcgtccaggcaaagatggactacctgagcacggcctgcaacgaggcgctgctggactgcctggccaagctgcgggagggcacgtccacgttcgaggggaacaggtgcatgatcgaccaggtcatcgacgtgatctcgctcgtcatagaggccgccgtcgtcgccggcagggtgctgcacaagccctagccgcacgcgccggggcgccgggcgtggtgggcgcgcagggacatgtgtagcacagcagcctgcgccctgcggttggtgggtggcacacatctttttcgtgcttggcagggtggcggcgtcctggacggngggccgggctgcgtcggctcacatggcagctcgtgtcgttgtgtgcctactagctggctagctcctagtccctcagcccg

SEQ ID NO: 10490 - DNA, 643 bp, Zea mays
  Clone ID: LIB3279-180-Q1-K6-D3
ctctcatcggcacacccgagctcgcgccctccttccacgtcgaggtccgagtcctgctttgatggcgaccgacgtgactgagactcccgcgccgttggtggatgcggccccagaggcgcccgccgacgccccggcggcgcctgctgccgacgcgaagccggccaaggccaagaaggccaccgcgccgaagaagcgcgccagcccgacccacccgccgtacgccgagatggtctcggaggcgatcacgtcgctcaaggagaggacggggtccagcagctacgcgattgccaagttcgtggaggacaagcacaaggccaagctcccgcccaacttccgcaagcttctgaacgttcagctcaagaagctcgtcgccggcggcaagctgaccaaggtgaagaactcgtacaagctgtcgtccgccaccaagccgaatcccaagcccaaggccgccccgaagaagcccaagaccggcgctaagaagcccaaggccgctgccaagcccaaagctaagacccccgccaaggcgaagcccgccacaaagcccaagcccgccgcgaagccgaaagccgtagtgaaaccgaagacacccgccaagcccaaggccaagccagctgccaaggcgaagcccaaaaccgccggcgct

SEQ ID NO: 10491 - DNA, 589 bp, Zea mays
  Clone ID: LIB3279-180-Q1-K6-D4
gtccttccgggtcctatcgctcctctccgtcgccggtggagctcatggcatcctccatggccgccgccgccaccgccctcccgctgccgtccgggacgacgcagaggccgtctgcccagggccgcctcctcttcaccgccgcacccgcccgctcccgctgccgctccctccgcctccgccccgccggccgccggtcggcccgctcctcgcctcgggccaccaaggctgtggtggcagcgttggctgatcctctcaaggtcatgatatcaggagctccggcgtccggcaagggcacacagtgcgagctcatcaagaccaaatatcaactggcgcacatctccgctggagatttgttgcgggcggaaatcgctgctggctctgagaatgggaagcgggccaaggaattcatggagaagggccagctcgtgcctgatgagattgtcgttaatatggtgaaggaacgccttcggcaaccagacgctcaagaaaatggttggcttttggacgggtacccaagaagctattcacaggccatggccttggaaactcttgaaatccggcctgatactttcattctgttagatgttcc

SEQ ID NO: 10492 - DNA, 597 bp, Zea mays
  Clone ID: LIB3279-180-Q1-K6-D5
acccgcgttcgaacccggactgaactcagtgaagcacaagtaaacatacaagtctactactgcagaaagcaaggaggatgccaacagtaagcagatttcatgtatggatcaggttccaaaagaactagaagtacagattggctgaacttcaaacaaatacaaagagctatgcatacaagtggtggaggcctggtggtaaattgtttatcaagatcgctagagcagttaaatttactcctattatcttctgggatagatttggcacaccattccccttcccaaaacccatgcatgtggtcgtgggtaaaccaattgaagtcaataagattccccatcctacaattgacgagacaattgcaacagtatgcatgttcttggcgggaaaagttgaagaaacacccagacctctgaaggatgtcatacttatttcatatgagatcatccacaaaaaggatcctgctgcagttcaacgagataaaacatgaggaagtatatgaacaacaaaaggaactaattctactcggggaacgtgttgtgctcgtgacacttggttttgattttgatgtgaaccattcttacaagcgcttggttgaagca

SEQ ID NO: 10493 - DNA, 623 bp, Zea mays
  Clone ID: LIB3279-180-Q1-K6-D6
cccacgcgtccgctatgagctacctgatggacaagtaatcaccattggtgcagagagattcaggtgccctgaggtcctcttccagccgtcgatgattggtatggaggctgctggaatccatgagacaacatacaattcaatcatgaagtgtgacgtggatatcaggaaggacctctatggtaacattgtgctcagtggtggttcgactatgttcccgggtatcgctgatcgtatgagcaaggagatcacttcccttgcaccaagcagcatgaagatcaaggtcgttgcaccgcctgagaggaagtacagtgtctggataggagggtcgatcctagcctcgctcagcactttccaacagatgtggatatcgaaggaggagtacgacgagtctggcccggcaattgttcaccggaagtgcttctagggtttcacaagttcctcgtcgttacctagtctcaaattatgtcccctccatttctcgagatatgtgtggcagatttgcatgatacgtttgtttgtttccatcggacctgaagtcttcttggggataggctcccccctttgtatgttgtggctccaatccatgtgcgagcacgctgtgtctgtcgtgacacctggttcgt

SEQ ID NO: 10494 - DNA, 414 bp, Zea mays
  Clone ID: LIB3279-180-Q1-K6-D7
atatctatgctaattcaggtggtgtggtcgttagctactttaattgagtgggttcaggtaaaatgcatgttcgtcgctgcttcattgctcgattggttccttgctctaatctgctttcttgtgccatgttgattgatcgtgcagaacattcaaggtttcatgtgggccgaggagaaagtggacgatgaactagaaaaggacatgagcagtgcttttcaacacatgaaggccatgtgcaaatctttggtgctgccgaagtgtgtcgtgacattggaattgcaggtctagaaaaacaagctcattagatttctgaaaaaacattagaagttattagattggtagcatttttttaagatttaaaattttatagaagtcatcattttcgtttattggaagaaatatttttggaagttg

SEQ ID NO: 10495 - DNA, 628 bp, Zea mays
  Clone ID: LIB3279-180-Q1-K6-D8
caattatatttggtgctcatgtttctcacccttctgttgtagatggttctactggcccttctattgcttctgtcgttgcatcccaagactggcatgaggtgtctaagtataatggtgttgttcgtgcacaaggtcacactgaagagatcggtggccttgaagacattgtcaaggagctccttcatgcatttgcaaacgagtccaaggagaagctccagcagctgatattctacagggatggcataagtgagggtcaattcaatcgaattttggagaaagaaatcccagcgatagaaaaggcttggaacgcactgtatgacaatgagaagccacaaatcaccttcgttgttgtgcagaagaggcataaactgaggctgttccccgtggacgacaactataagatccgttctgctaagaagaaaattgttgagcctggcacagtggttgatagtgagatatgtcacccagcagaatttgatttcttcctttgcagccaatctggtgttatcaaaggcccaaggcgtcctgtgaggtaccttgtactgcgagatgataacaacttcacggcagatgaactgcaggctctcacaataacctgtgctacacttattcaggcggcaatcgttcg

SEQ ID NO: 10496 - DNA, 623 bp, Zea mays
  unsure (1)..(623): unsure at all n locations; Clone ID: LIB3279-180-Q1-K6-D9
cccaaccccaaacctctctcgngagttcctctcgcgtggccggtttcctcaacctccgtgtcggctcgatagtttcgcaagcgggcggggcggggcggggcggggtccgagttcgatggccacttctggcgagcaatcggctggcggtgggtctgcggcgagggcgtcgaagctgcgctacccgctgcggtcggcgagcaaggggaaggccgcggccgtttcctcggcggcggatgcgcctcccaccaccatctctgctccgcgtcgggtaaagccatcttcagatgtcagcaagagcatgtgtttagacctttctgtgaaggataagtctgtcaagcctccacggaggcactcaatacaaaccaagccaggagctagcccaaggccaataccttctggaactgtgactccggtgtctggggttcggtcaaagagatcggacagccaggggaggtttgatactccgacatcagaagtgtccatgtccatgtcaaggcgcaagttcagcacgctttcttcaatctcgtactggatgacacagatcaggcttgcagaggctgcttccaaacactcagtttctctgggcttctttaagcttgctcttgaatcagaatgtgagcctt

SEQ ID NO: 10497 - DNA, 619 bp, Zea mays
  Clone ID: LIB3279-180-Q1-K6-E10
cacggcgtaacgatcaccagaagcgcagatcggaacggcaccagctcatcttggccccagcctaggacaatgtcggcagctgcgtccacgactcttgcgttgggcagtcaccacctgctgctgtctatgggaagaggctccgctaacttaacatcatcgtcagatcaccccatggtgacaagtgaagccctatgctcccggctccagctgcatacgttccaggagctaaacaaagtaaccggcgacatgtgcgctgggaccagaacgacgaagaggatgaagacgccaatggaggggaacggtggcacgccggacttgcacctaagcttgagccccaacgacgacgacatgggaggagctgccgacaagcagatgaagaagatgaagatccaaggtatcggattaagtgaacagcaggaggtggacaacgataagatgctgcctctctcgctctccctgtcactccggggtggcgaggatgccaggaggttagaggcagctacaggcggtagcagcggcaacaagtccgctctggtgcggtgtactttggatctgaccatgtcgatcaaggcaactgagtgacgagataaagttcatggccgttctgtggggtgagtac

SEQ ID NO: 10498 - DNA, 506 bp, Zea mays
  Clone ID: LIB3279-180-Q1-K6-E11
tgctaggctgccaaagccatcgagaagcatgccggtcagctctgcgtgcttgccgaggactgcgaccagcctgattatgtcaagctggtgaaggctctctgcgctgagcacaatgtccacctggttactgtgcctagcgccaaaactcttggagagtgggctgggctttgcaagatcgactgtgagggcaaggtgagtaactttgtaggctgctcctgtgttgttgtcaaggactacggcgaagaatctgaaggccttaacatagtgcaggagtacgtcaaatcgcactagatacagtctgtcagtatctggaagttgtgttcaacactacattttgcacctgagttaaaatatgtgcttggttcttgggctttgctaggagattagaacagttttcaagtgagcctaggatccatgtgaacgatttgaatatctcgcctcttgtcttgcaagtgttctcatctgctgttaatacaaaatcagcaagagctagtattttgttcttc

SEQ ID NO: 10499 - DNA, 268 bp, Zea mays
  Clone ID: LIB3279-180-Q1-K6-E2
cggacgcgtgggtttagttttccatgctctacatattgtatcaaattgttgcatggatgaggtttccatgctctctagattgatgtaaagatgaaagttaccttacctggagtacatgatgcctctggatttttctagctacttatcagtagcacattgtataccgagatgtgtttgtgatgttattttagtagtgtgataagtgttgtctgttatgctcttaaatggaggcatttgaccatccaatttagcttttctatgtgaagtc

SEQ ID NO: 10500 - DNA, 659 bp, Zea mays
  Clone ID: LIB3279-180-Q1-K6-E4
aagagagtcattgatgaggatggttggttacatactggagacataggtttgtggctgcctggagggcgtctaaaaattatagataggaaaaagaacattttcaagttagctcaaggagaatacatagctccagagaagattgagaatgtctatgctaagtgcaagttcattgctcaatgctttatatatggtgatagtttcaactcttccctagttgccattgtagcagtcgaaccggatgtgttgaaggcttgggctgcatcagaaggaatccagtacgaggacttgagacagctctgtgctgatcctagagcaacagctgctgtcctggctgatatggattccattgcgaaggaagcacagctgagaggtttcgagtttgctaaagcggttactcttgttgctgagccattcacattggataatggccttctcaccccaacattcaaggtcaagaggccgcaagccaaagcatactttgcaaaagaaatctcagacatgtattcacggttgctagagacagagttagctaggtcgaagttgtaacttgtgcggtatcagtatcaggagaaaagtcatcaatacagccgtacaggagattggattctgcaattgtttatttcacctcacgaaataagtagtaaaatctttttactgat

SEQ ID NO: 10501 - DNA, 595 bp, Zea mays
  Clone ID: LIB3279-180-Q1-K6-E5
tatcaaaccaatctctctctctctactaatgacactcaagcgcctagggctgctaccctagaaccaagcctgcggtagaggggtataacctcgccggagaagacagctatccccatggaccgaaggtccatgacagcaaccacccgtccacctgtgccgtcgctcctgcaggcgccgaaacggttgcagaagaaggcgctggattcgcagtcagatgggatggtccggcgggccacccagcagccaccagaacgtgaccagctccataggctcacttgccccaggtggagcagcagatgctccgctatgcctgcgcctgcagccggacggttagtctgcagtaccagcgagctgttgtgtctctggccacgatagaagagaagctaaggaaccaagaggaaatgggcctgcagaccaagactagaattgaggacgaccttaatatgtgctgaatgaatatacgagtggccccgagcgcacactaccggacggaggaagaaggaaatgacaggtaggccaaggaagaagactgaaaaacctgctaccggatttgtttcgaaccgttttggacctaacagagacccgaacagcgatt

SEQ ID NO: 10502 - DNA, 630 bp, Zea mays
  Clone ID: LIB3279-180-Q1-K6-E6
ctggctccaccgcctgcctccctggctctgtgaccgtgacgagacacgtcgccgagaggccaccccgcttgggattgtgaggtaaagcgtgatggcagcgccaccggcgagggcccgagccgactacgactacctcatcaaactgctcctcatcggtgacagcggagttggaaaaagttgtctcctgttacggttctcagatggatcattcaccactagctttattaccactattggcattgacttcaagataaggactgtcgagttggatggcaaacggattaagttgcagatctgggacactgcaggccaagaacgtttccgcacgattactactgcttactacaggggagcaatgggcatcttgcttgtgtacgatgtcacagacgagtcatctttcaataacataagaaattggatcagaaacattgagcaacatgcttcggataacgtgaacaaaattctggtggggaataaagctgatatggatgaaagcaaacgggtttggaatctatctattctgctgtgcccacttcgaaggggcaagctctcgctgacgaatacgggataaagttttttgaaacgagtgcaaagacaaacctgaatgtcgagcaggttttcttttccata

SEQ ID NO: 10503 - DNA, 600 bp, Zea mays
  Clone ID: LIB3279-180-Q1-K6-E7
cccacgcgtccgccccgcgtccgtgaatccttcctctaatcctctccgatggcgcttctccgtccgtcctctagagcctagcttggccgcccacatgcatgcatgcatgcatgagtcaagcacaagcatcgtcttcccatgctactcgcgtgaatatgaatcgatgcttatctcgcatcaatcaatcgacgctcttccgtctcttctatcaatcaacgttctctagtgaaagaaccggcccttgagtggtatatgtattgttgcggcctgcgacgagttgagcagctaagttatgttgctatcttttgtttttatcttcggagatcttttattagctatgacaactggacaagtggttgtttgtttgtgctgcagatgctggtgttctaggatgcagtttgattcactagacctgatcccctagactagacggtctggtcttaaggcggtgctcccttcaaaccaataaacggtcgatctgatgggtggtacagctgctcgttcatggttcccactgtcctatctcatcagagagagagagagagatgcttgagatgggcttgtggtttgcatgaaccgagagctgcatcgtccccttcg

SEQ ID NO: 10504 - DNA, 391 bp, Zea mays
  Clone ID: LIB3279-180-Q1-K6-E8
taaattctcaccataccatacatatgtgggtgaacctttgggatatacataaattattatttgggtcaagcccaaattctctaacacattctctaacacatggacttactaagtggcacggagcgtgggtcttcctaacgcagagcattggattggggacaatggagcctgcatgtatatgatttgtgtgacatccattgttcagtcttgtaataggtcatcagagtctatcatctatactctaatttttcacttatgatatacaaacaatattttacacattctttttacatcgtagattattgtagtagagcatatacattttatactggaagctaataacaaacaaagaactggtaccatcatctataattcaaatttctctttattt

SEQ ID NO: 10505 - DNA, 651 bp, Zea mays
  Clone ID: LIB3279-180-Q1-K6-E9
ggttttggctgatggtggagtagtttgtatcgatgaatttgacaagatgcgacctgaagacagagtggcgattcatgaggccatggagcagcagacaatatctattgccaaagctggcattacaacagtactcaattcaaggacttcagttcttgcagctgccaatccaattgcaggacgctatgatgatcttaagactgcacaagataatattgatctacagaccaccattctttctagatttgatcaaatctttattgtcaaagatatcagaatgtatgaccaagataagcgaatagcaagccacattatcaaggtgcatgccagtggtgcagcagcgtcatccgcaaacacagagggaagtgaaggagagaattggcttaaaaggtacattcagtactgccgtgcaacatgcaaaccacggctttcagaaaaagcagctgagatgctgcagaacaaatatatcgagattagacagaaaatgaggcagcaagctcacgagacagggagggctgcagcaatacccatcactgtgaggcagcttgaagccatcatacgtttgagtgaatctcttgcaaagatgagattgacaagcgtggctacaccagagcatgtcgaagaggcattcagtctgttcaatgtctccaccgt

SEQ ID NO: 10506 - DNA, 608 bp, Zea mays
  Clone ID: LIB3279-180-Q1-K6-F1
cggacgcgtgggagcaactgatgcagccacagcttccgatgagaggataactgtactggtcattggtggcggaggcagggagcatgctctttgttatgccttgaaccattccccatcatgtgctgcagttctatgtgcccctggcaatgctggtattgctcagtcccgggatgcaacatgtatcccagatttggacatctcgagtagtgatgatgttatctcattctgccgcaagaggggagtgggaatggttgtagtgggccctgaagcccctcttgtcgcgggtcttgcaaatgaccttgtcaaagttgggataccaacctttggcccttcatcagaggctgcagctttagaaggatcaaaggacttcatgaagaagctgtgtgataagtataatatccctacagctaagtatcacacatttacggatgctgtggaagctaaaaaatatgtaaaaaatgaaggagcacctattgttgttaaagctgatggactggctgctggaaagggtgtggttgttgcaatgactttggatgaggcgttggaagccatagattctatgttggttgaaggctcattcggttctgctggttcacgggttatcatcg

SEQ ID NO: 10507 - DNA, 630 bp, Zea mays
  unsure (1)..(630): unsure at all n locations; Clone ID: LIB3279-180-Q1-K6-F10
gcgttctttctcgcgtccggcgtcgcatccgctccacagnatcctctgcgccaccgcaaccgtgtgaccgcccgtgccgccggcgatcccgatccgccgacccgtcccagccccgctcgcagccatgtcgccgtcggagccgacgcgggaggagagcgtgtacatggccaagcttgcggagcaggcggggcggtacgaggagatggtcgagttcatggagcgcgtcgcgcgctacgccgggggcgccggcggcggggaggagctctcggtggaggagcgcaacctgctgtccgtcgcctacaagaacgtcatcggcgcccgcagggcctcgtggcggatcatctcctccatcgagcagaaggaggaaggccgcgggaacgaggcgcacgccgcatccatccgcgcctaccgctccaagatcgaggccgagctcgcccgcatctgcgacggcatcctcgcgctcctcgactcccacctcgtcccatccgccggcggcgccgagtccaaggtcttctacctcaagatgaagggtgactaccacaggtaccttgctgagttcaagtcaggtgcagagaggaaggatgctgtggagagcaccatgaatgcctacaaagctgctcaggatattgc

SEQ ID NO: 10508 - DNA, 296 bp, Zea mays
  unsure (1)..(296): unsure at all n locations; Clone ID: LIB3279-180-Q1-K6-F11
ccccccccccccccccccccaccccccccccccccccacccccccccccccaacccccccccccccccccccccacccccccccccccccccccccccccnnaaaaanacccccacccccccccccccacccccccccccaccacaccccacccccaccaccccccccacccccccccccacccccccccccccccccccacaccccctccccccccccccaacctccccccccccaccccccacccccccccaccaccaccccccccctccccaccccccccccccccccccccc

SEQ ID NO: 10509 - DNA, 245 bp, Zea mays
  unsure (1)..(245): unsure at all n locations; Clone ID: LIB3279-180-Q1-K6-F12
ggggggggggggggaggcaagacaaaggcgagnccgacaccccggcagccaccgggagaaggaagggcaccncngaaaaggagancnnggaaagcacacacgcggnacncaccggggaagaacccaanaaaaaaanggagcaaggaggggggggggggggaattttttcttttaccaccnnnngncnancananncggggggggggggggggcacgnccccacaccaagagncaccanacagcag

SEQ ID NO: 10510 - DNA, 603 bp, Zea mays
  Clone ID: LIB3279-180-Q1-K6-F2
ctcgccgccgccgctgccaacgccgcctgctgccgcagccgccatgggggcgtacaagtatgtgtcggaactatggaggaggaagcagtcggacgtgatgcgcttcgtgcagcgcgtgcgctgctgggagtacaggcagcagccgtccatcgtccgcctcaccaggcccacccgccccgacaaggcccgtcgtctcggctacaaggccaagcagggatatgttgtctaccgtgtccgtgtgaagcgtggtggcaggaagaggcctgtgcccaagggtattgtctatggcaagcccaagcaccagggtatcacccagctcaagttccagaggaacaagaggtctgtcgctgaggagagagctggacgtaagcttggtggactgagggttcttaactcctactgggtgaatgaggatagtacctacaagtactttgagatcatccttgtggacgttgcccacaaagccatcaaaaccgacccgaggatcaactggctatgcaaccctgtgcacaagcaccgtgagctccgtggcctcacctcagcaggcaagaagtaccgtggcctgcgtggcaggggccacacccaccacaagaacaggccctc

SEQ ID NO: 10511 - DNA, 655 bp, Zea mays
  unsure (1)..(655): unsure at all n locations; Clone ID: LIB3279-180-Q1-K6-F3
ctcgcctccctcgattcagggttcagcgaattcggacagaacccggcgtgtccgtgtcgaccgacccctccccctgcgagtctgcgacgagtctcctgccgctcttcccggccgggcgaaatggacggtgtcgttgtcaggagggtcatcccttcggataacagttgcctcttcaacgctgtgggctacgtgatggagcacaaccgaaataaggcttctgagctcagacaggtcatagcagcaacagtcgctggtgatcctgagaaattcaatgaagtgtttcttggcaaaccaaatgaagcgtattgtgcttggattttggatcctgaaaagtggggaggagccattgagctctctattctatctgaatactacgggcgtgaaatcgcagcatatgacattcagaccacccgctgtgatctctatggtcaggagaagaattacagtgaaagggccatgctcatttatgatggtttgcattatgatgctctcgctatgtctccggctgaaggtgcacctgaagaatttgaccagacaatcttccccgtcaatcgtgaccgttccattggtccagcagaaggccttgccctcaacttagtgagggaggcgcaaaggaagaggagctacactgacaccgcanacttcactctgcgct

SEQ ID NO: 10512 - DNA, 618 bp, Zea mays
  Clone ID: LIB3279-180-Q1-K6-F4
atccccttccctcccttggcagccgtcgccatgctgcgcgtccgaaatcggctcctccctctgctcggcgccgcctccccgcttccctcccccatccacatccacctccgcgtgtgccgcctcctctccacctccacctccacctctacggccaccgtccccgcacccttctcccttgagaactacctcgtcgccgcctgcggcttcgcacccgcccaagctcgcttggtgtccaagaaggcgttcaacgagttgtccagggaatccaagagatcatcggaggagcactcctgcagacgcctcatctccgcctccaacccagatgccatcctcgcgctgctgtccggcgccggcctctcccgcgccgacatcgctgccgtcgtctttgcggacccgctgatcctccgcgcttccgtgagtaaaatcgcaccccgccttgtcgctctccgcgaccgcgtcggcctgtctactccccagatcgctcgcttcctcctggtcgcctcacgcgctctccgccggtgcgacgtcgttcccaaggttgagttcttcttgtccttcctcggctcctttgatcgggtactggcggtcgcaaaggcaaacttgggcatcttcaacgcg

SEQ ID NO: 10513 - DNA, 660 bp, Zea mays
  unsure (1)..(660): unsure at all n locations; Clone ID: LIB3279-180-Q1-K6-F5
ctgaaacgaggctattgagaagcagacccttggctcttgtacctgtcagcaaggccaaggctaccattgaaccaacctcaagtgatgagctcctagggaagaagtttcgagaacccttgagtatcaatcttgcaacatttgagcatgcacttctgagggtcaccgcagatgatattcagaaagccacggagaatttcagtaaggtgcacattattggggatggtgggtttggcactgtctacagggcagcacttcctgaaggtcggagagtagcgatcaagaggcttcatggtggccatcagttccaaggtgatcgtgaattcctggccgaaatggagacaattggaaaggtgaaacatcctaaccttgttcctctacttggctactgtgtatgtggtgatgaaaggttcctgatatacgagtacatggagaatgggagtcttgagatgtggctcaggaaccgggctgatgccatcgaaacacttggatggccagaccgcctgaagatatgtattggttctgcccgcggtctttcgttcctgcaccacggttttgtgccccatatcatccaccgtgacatgaagtcgagcaacattctattggacgagaactttgagccaagggtctctgattttggccttgcangataatcagtgcatg

SEQ ID NO: 10514 - DNA, 655 bp, Zea mays
  unsure (1)..(655): unsure at all n locations; Clone ID: LIB3279-180-Q1-K6-F6
ttttacatcccttgggcctccctagcagtacaccaaatggggcgaccgccctgccgccggggagcattcaatcgtcggcggcacaccgtccccattcttcccgttccccaacgtgaagtggcaccatggtcgccacgcgctcgccgcaggagcaggagcaggagcagcgactgcgggccagccagcctccggttgggtagctgttctgcgcaacagtccgaggggcgcggatggaggagggaccaaacaggagcggaggggaaggcgggcggtacaactgatgagccggtacctgttctacgatagcggtcgcttcagacacgaaagatgttcttgcgagggacatgctgatcatcgccttcgagtaagatgctccaaccatgaggagcataggcacaactagcagggagagcaggccgacctcccaacagcacgcgaaggcaacaatgatagcaactaagaacgtggagaagtttgacatgaagtgacccatctggaggataagccaaacttttaagatctctgttatcatcgagcagtttttttttgtttttttgggggtacttcttctctttggttagttagtgactcttgcaagtgacatgttatgaggaggccgnacgaggaaaatcaattaccttttcaccaattgcgt

SEQ ID NO: 10515 - DNA, 678 bp, Zea mays
  unsure (1)..(678): unsure at all n locations; Clone ID: LIB3279-180-Q1-K6-F7
ctcacccgactcgtcagacgtcagccagcagttcngaaaccaaggatcgatccaggagcttccggaaggcgaggcgcgcgcgcagcgtcgaggtgctggtgccggtgccgcccatggatcgggctcgcggatccgcgttcctgctcggcgtcctgctcgcaggatccttgttcgcgttttcagttgctaaagaggagaccaagaagctcgggaccgtgatcggtatcgatctcggtaccacctactcctgtgtcggtgtctacaagaacggtcatgtcgagatcatcgccaatgaccagggtaaccgtatcacaccctcatgggttgccttcaccgatagcgagaggctcatcggtgaggctgccaagaaccaggcagccgtcaaccctgagaggaccatctttgacgtcaagcgtctcatcggaagaaagttcgcggacaaggaagtccagagggacatgaaacttgttccctacaagattattaacaaggatggcaagccctacattcaggtcaagatcaaggatggggagaacaaggtcttcagccctgaggagatcagtgccatgattcttggcaagatgaaggatactgctgaggcataccttggcaagaagacaatgatgctgtcgtcactgtccctgcgtacttcaatgatgcgcagaggcagcaaccaag

SEQ ID NO: 10516 - DNA, 643 bp, Zea mays
  unsure (1)..(643): unsure at all n locations; Clone ID: LIB3279-180-Q1-K6-F8
cccacgcgtccgcggacgcgtgggcgagtacagtcggctaggtaatctggtggtacgacgactgacgacgacatggcggccaccagcagcaagtcgtcgtcgtcctcgagctcggcgcagcgggcagcagctgccgccctgctcgtggcggtgtccgtcctggtggtgggcgcggcggcggtgtgcgacatgagcaacgagcagttcatgtcgtgccagcccgcggcggccaagacgacggacccgccggccgcgccgtcgcaggcgtgctgcgacgcgctggcgggggcggacctcaagtgcctgtgcggctacaagaactcgccgtggatgggcgtctacaacatcgaccccaagcgcgccatggagcttccggccaagtgcggcctcgccacgccgcccgactgctagcagtgtgctagccaagccaagccaagcaggaaggcccccggcattgctagctgtacgtgtctgtgtgtgcatctgcagcagggtgcaggcaggggcccgtacgtacgtgtctctttctctctctcatcttgncaccgtacctatctagagtgtgtgtgttcgtactaattaaaatgttcttgtcgtcgtcgtctgtgcatgcatgtaccatgtcgtcgngcatgtctattat

SEQ ID NO: 10517 - DNA, 594 bp, Zea mays
  Clone ID: LIB3279-180-Q1-K6-F9
tttttccgccgtcatgtcgaagcgaggtaggggaggttcggctgggaacaagttccgcatgtcactgggtctaccggtggcggccacggtgaactgcgcggacaacacgggcgccaagaacctctacatcatctccgtcaagggcatcaagggccgcctcaaccgcctcccgtccgcctgtgtcggcgacatggtcatggccaccgtaaagaagggaaagcccgacctcaggaagaaagtgatgcccgccgtcatcgtccgccagcgcaagccgtggcgtcgcaaggacggtgtctacatgtacttcgaagataatgctggagtgattgtgaatcccaagggtgagatgaaaggttctgcaatcactggacctatcggcaaggagtgtgctgacctttggcctaggatcgccagtgcagcaaatgccatcgtttgagagcttgttggaatgtgtttagacttgagtatgatcatctcaattgtgtgttgcaggtgttgtaagggtgctattggacttgatggctccttttatgtttggtcactcaattctgtagtgaacagaaatttctggttgcctcaagtttgctgtctgag

SEQ ID NO: 10518 - DNA, 646 bp, Zea mays
  unsure (1)..(646): unsure at all n locations; Clone ID: LIB3279-180-Q1-K6-G1
cccacgcgtccgcctctctccgataacgctagcatccgccgccgccggcgacgaatccggtaagcctcctcgcttctgctagatacacggctgccagatcggtgcgccccgcgattagggaaagggtcgattgcgatcagccgttcctctgccttaggtcatcgtagttgattagtcggcggtcactgctcggattgggcacccaccgcgcataggtgggggctccaccgtgngaaaaactatccttttcctcttcagttatttttgggtaatgcttgcaattgctacccgatgagtttctcgaattagtttgtgaaatgacgttgttccagctgctgttttgtctagcaggcgttttgagtttctgttgccagtgcagccatgtccatgttcaacaggatcttcgggaagcccaaggagcaggccaactccagtgccttggccactctcgacaagttaaatgagactcttgatatgctggagaagaaagagaaggtgctggacaaaaaagcagccgctgagcttgagagaagccaagagttctccaaagctaagaataaaagagcggctatccaatccttgaagaggaaaaaacttatgaaacacannnatgagcactcggaaatttcagttgagaattcatgat

SEQ ID NO: 10519 - DNA, 585 bp, Zea mays
  Clone ID: LIB3279-180-Q1-K6-G10
ctcatcttttcgcgtttagaacctctaaaatttcccccactcgccagtcgcagcagcacctgtagccatggacgccagcggagccggtagcaaggggaagaagggtgcggccgggcgcaaggcaggcggccccaggaagaagtcggtgacgcggtccgtcaaggccgggctgcagttccccgtcggccggatcgggcgctacctgaagaagggccggtacgcgcagcgcgtgggcactggcgcccccgtctacctcgccgccgtcctggagtacctcgccgccgaggttctggagttggcagggaacgcggcgaaagacaacaagaagacgcgcatcatcccgcgccacgtgctcctggcgatccgcaacgacgaggagctcgggaagctgctggcaggcgtcaccatcgcgcacggcggcgtcctccccaacatccactccgtgctcctgcccaagaaggcggcggagaaggcggccagcgccggcagcaaggagcccaagtcccccaagaagggcgccaagtcccccaagaagcttagaaagtagggacttcatttgcactgtgtgctgtagcatgctcgtgt

SEQ ID NO: 10520 - DNA, 642 bp, Zea mays
  unsure (1)..(642): unsure at all n locations; Clone ID: LIB3279-180-Q1-K6-G2
cggacgcgtgggcggacgcgtggngaaaggaaggaggggagaggtggaagtccatgacagacgaggtaagtcctgaatctgaatctgtcgagtttccaactcttgctcttcattcattcattcacgctatgctgttcatttttctggaccaggagaagaagccttacattgaaaaggccgcggagctcaaggctgaggccgagaatggcgagggcagtggtgagaacaatgttgccactaagaaagccaagacagatgaccaggaggtggatcagccagcaaagaagctcagaaagtgcaaggctcttcacgaggacgaggatgacgatggtgaccaggaagacgaggatgagaagaacgagttggatgacgacatgtagatggcagaggccactctcccatctctgtaaatggatggcagatgtgagcgtcttgttagaaatgtcacttgtttcaagctagagggaagagggagagtagtcagtagtgaatatcccccgttatcgttgctacatgaatgaactattctatgatgcagttctgtctgctttcatctccatccaacacatgtactcaatgcctntttcttttctggattntctatattacatccattgctccctgaagttggntcatgtttgg

SEQ ID NO: 10521 - DNA, 634 bp, Zea mays
  Clone ID: LIB3279-180-Q1-K6-G3
aaatcccctgcccttcctcacatctcctccctgttcgtccgtaatagtcgtttccgaaccttgcgtttcgtgggatttatcgaggcgagggcttcgattggacccaggaatcgcccaaatccgcttgtcttcgacttcggttcatccccacgaatttctagggttttagtgttgattttatcccccttcattacatttgattggcggtgaattgggccccgttttgatgattccttgggttcgttggacggcaggaaacgagatcctctagaggtttgtgctgtttggcgtgggttttttggggccgatttgctttgctcgcatgggggatcatgtcgcggtggatgttggggagctcgtagcgtcccgagtcggtgaggcagcggggctagtgtccggcgccaaggaggaaacagagacgctgattgggatggtggagtgccgcatttgccaggaggaggacctcaggaagaacctcgagagcccctgcgcttgcaacggcagcctcaagtatgctcacagagaatgtgtgcaacgatggtgcaatgagaaaggggatacaatctgtgaaatctgccatgagttgtacaagcctggttacactgccccaacccagtgcatcatgatgaaacta

SEQ ID NO: 10522 - DNA, 652 bp, Zea mays
  unsure (1)..(652): unsure at all n locations; Clone ID: LIB3279-180-Q1-K6-G4
cgtaacactttgtgggttccaatttgttcttacacatctggacaacaggcaacttctcatcaaatcagaccctggtgaagttgttaaacctgaccaattcaaggcgattaacgatgaggggatgccaatttaccagaggcctttcatgaaggggaagctgtacatccatttcacggtggagttccctgactcgctggcaccagagcagtgcaaagctctcgagacagtacttccaccaaggccttcatccaagctgacagacatggagatagatgaatgcgaggagacgactatgcatgatgtgaacaacatcgaggaagagatgcgcaggaagcaagctcacgctgcccaggaggcgtacgaggaggacgacgagatgccgggcggagcccagagagtgcagtgcgcgcaacagtaagcagactatcatcaaggcaattgggaggggtggtgcccttaaagcgtgggagtgatctctggttttgctgtcgccgagctgggaaataggaagctgaatcgacctcttaagcggggaatgtattcttttttgctgcaacatanaaaatgctacccaggcatagcttgggtaccttntaacttctgtttggggatttgctagagtgatggtttcgatatataggggggacttgaa

SEQ ID NO: 10523 - DNA, 640 bp, Zea mays
  unsure (1)..(640): unsure at all n locations; Clone ID: LIB3279-180-Q1-K6-G5
tggatttcccagtgttggaaagtcaactcttttaacgatgttgactgggacacattctgaagctgcatcatatgagttcacaacgcttacttgcattcctggaattgttcattacaatgataccaaaatccagcttcttgatcttcctggtatcattgaaggagcttctgaaggcaaggggcgtggtaggcaggttattgctgttgcaaagtcatcagatcttgtgctgatggttctggatgcctcaaagagtgaaggacatcgtcaaatattaactagagaactggaagctgttggactccgtcttaacaaaaggcctccccagatatacttcaagaggaagaagacgggtgggatttctttcaataccactgttcctttgactcatattgatgagaagctgtgctatcagattctgcacgagtacaaaattcacaatgctgaggtgttattccgtgaagatgctactgtggatgatctcattgacgttatcgaagggaaccgaaagtacataaagtgcgtctacgtatataacaagatcgatgttgttggtatcgatgacgttgataatctttgctcgcaaccaaattcactagtgatcagctgcaatntgaagctgaacttgnacagactacttgcg

SEQ ID NO: 10524 - DNA, 653 bp, Zea mays
  Clone ID: LIB3279-180-Q1-K6-G6
tttccgcgtccggttctagaacgcgagcgggcgcctcagcccgccgcaaggagaggtaagttcaggagacatcttcgagaagctgaaatggctcctaaagctgctcctgccaagaagggtgatgccaagacccaggccttgaaggttgccaaggctgtgaagtctggggcagccaagaggaggaccaagaagatccgcacgtctgtgacatttcaccgccccacgaccctgaagaaggctagggaccccaagtacccacgaatcagcactaccggaaggaacaagcttgatcagtaccaaattctcaagtacccccttaccacagaatcagcgatgaagaagattgaagataacaacactctggtcttcattgttgacctcaaggcagacaagaagaagatcaaggctgccgtcaagaagatgtatgacatccaggcaaagaaggtcaacaccttgatcaggcctgatgggaagaagaagcttacgtgaagctgactcccgactatgatgctcttgatgtggccaacaaaatcggcatcatctaagtgctgcattaggcatcctagttcatctgttgggtcctagttctatgtgaaacccgagttttgtagctatggctctcaatcggtccattaccatgtgttatgcacact

SEQ ID NO: 10525 - DNA, 604 bp, Zea mays
  Clone ID: LIB3279-180-Q1-K6-G7
cttgacctgattaagaagttattggagaatatggcattaactgacaataacacatcacatgatagttctgaatcatgcacccctggaaccacgtcgattaggcatgttcttggagatggtaaggcggagcctgcatcaaaggctacaccaaatacaacaaaaatagattcagggttacaggaacatgaaattcagagtagaagttcctcttcaaatttgtctcaaggagcagaggatgttgtgaagtttgacaataatgaagagagcaagaacttggagaattgcgatgaggaaatggaatcgccaacaaagaacaatttgaatagcaacaatagcatcaaagatatttctcaagagcacaagaaattagcaaatggattcaaccttttccagaaggagctggaaagactgaaagatgagaatctgtctcctcttcttcccctagacgtcaatctaactgacccatcactcagtggtttggaaaggacattgtcacaactcgatatggcaaatgagcatttgcaaagtatttttccatcatttaaagagcttcctggttctggcaatgctttggaaagatactcgccttggaactcgagcttgc

SEQ ID NO: 10526 - DNA, 589 bp, Zea mays
  Clone ID: LIB3279-180-Q1-K6-G8
gttgcgccggcctacaaccgttttcgtgctcacacacccaaaccttagtcgcgatcaggccccaaggactcgagatgaagtcgagggcacggtccaccgccggcgactccaggctctcggtgaggaagaccaaggctgagaaggacccaaacaagcccaagaggcctccgagcgcgttcttcgtcttcatggaggagttcaggaaggactacaaggagaagcaccccaatgtgaagcaagtctccctgattggcaaggctggtggtgacaagtggaagtccctgtctgatgccgagaaggctccctacgtgtctaaggcagagaagctcaaggctgagtacaccaagaagatcgacgcttacaacaacaagcagtctggagaccccacggcgtctggtgattccgacaagtccaagtccgaggtgaacgacgaggacgaggagggtgacgagtgatgtatgacggatgaaactctgtccaagtgtttgcagtcagggaaaaaatctcgtcgttgtcggcctaaccgggttttctcgaaggactttctagatgcagtagattagtgccgtcttctgagtagtttccttgc

SEQ ID NO: 10527 - DNA, 639 bp, Zea mays
  Clone ID: LIB3279-180-Q1-K6-G9
ttctaccgtttcttggtcaggaggaccaaggagcatttcaacgctgtcattctcaagaggcttttcatgagtaaaaccaaccgaccaccaatctccatgcgccgccttgtcaagtttatggaaggaaaggagaagaacattgctgtcattgttggcacagtcacagatgacaaaaggatccaggaggttccagcaatgaaggttactgccctgaggttcacggagacagcaagggccaggattgtcaatgctggtggcgagtgcctcacatttgaccagcttgctcttcgtgctccacttggcgagaacacggtcctcttgaggggccccaagaatgcccgtgaggcagtgaggcactttggcaaggctcctggagtgccgcacagccacaccaagccgtatgtgcgctccaagggaaggaagttcgagaaggctcgtggcaggaggaacagccgtggattcaaggtttaaaacaaattgtggccctccgtgttgccatcagcatagtgcaaccgttgtgtttgatcagtcgacagtaattagtcatcactctgtaccgagattagtagcacaatttggtgtcctggtttgaattttgggaagaatttgatgtcgtctccttattatctactcgttact

SEQ ID NO: 10528 - DNA, 635 bp, Zea mays
  unsure (1)..(635): unsure at all n locations; Clone ID: LIB3279-180-Q1-K6-H1
gtactacgtccgcggtccctgtccctcgggcatccggtacgtcactcgtcgtcacacgcgtacacgagtgctgctttcagcatgctccccggccggccgctgggcgttggccctgcccatctccggccggccatctcaatatccgcggcgcactcgctctgggcgtcccacacaattaaggtctatttaaagaagcccgtgccgtgccttgccttccccctccagctcgtcgtcgtcttcttttgcactgcactgcgctctcgctcttcttcctcgttcacctacctagctacctccgcatgaaaagatgaaacaaacaaaatggtgagtgctgccgcgccgcctgctgcttctcttcacattgttccttccttccctcagcagctagctctctagcgagttcgagcaacgatccactgtctatctagtaaacgggatattggcgcggttcaatcagaaagcttgcgctccaggcccgaggggctccactctttgattgagccgtgccaatatcacgtcccggccggccagctttattttcccatgcatgcatcctcatcgtatcctctctcgttctgcatatgcantctncttcttttttcgatcctgtgcgtcggggggggtgttttttttta

SEQ ID NO: 10529 - DNA, 637 bp, Zea mays
  unsure (1)..(637): unsure at all n locations; Clone ID: LIB3279-180-Q1-K6-H10
agctcgcacgcnatgggagcgcaagcgtttcggctgctgctgcttctgctgctcgcggcggcggcggcggaggcgcgcttcgttgtggagaagaacagcctgatggtgacgtcgccgacttcgttgcggggacgacacgacagcgctatagggaacttcggaatcccacagtacggggggagcatgtggctgctttcgtctaccctaaggacaacgccaaggcttgcgacgatttcgacggcaggcaccccttccgtgccaagcctggcgcgatgcccacgttcctcctcatcgaccgcggtgagtgcttatttgcgaagaaggtttggaatgcacaaaatgctggtgcctctgcagtacttgtagttgatgacaaggatgaaccattgataacaatggatttacctcgtgaagatgacgaggcttcaaagtatatacaaaacataaccattccttctgcattaatagatgaaaaatttggtgaccagttgaagaaggctgttaaagatggggaaatggttaatgttaatcttgattggagggaggctgntccacatccagatgaccgtgttgagtatgagttatggaccaaacagcatgatgaatgcgggcctaaatgtgatatgctgatgaattt

SEQ ID NO: 10530 - DNA, 316 bp, Zea mays
  unsure (1)..(316): unsure at all n locations; Clone ID: LIB3279-180-Q1-K6-H12
ggcaaaaaagattgaccgggttggagccatcaaggttgacgaatattctcgtacttctgctcctagtgtatgggctgtgggtgatgtaacaaaccggattaattaaacacttttttcattagaagaggcattttgttttgctngggtgtttttttttgccagcaagntaagcctgatcacagagatggtccttgtgctgntttctccattccaccactatcctgtagtggngcctcagnngaanaacaggcccttnnaggaaagccaatggtgatatncctntttntcacctcatcattccaaccaatgaagaaca

SEQ ID NO: 10531 - DNA, 377 bp, Zea mays
  Clone ID: LIB3279-180-Q1-K6-H2
gtaacaaagggtgtctcaccactgtcgattctggacagcacgaggcgtctgattctcacagctcagtggagtttacccagtctttccaagagggctattgtgaaaatatcagaactcgatgactgccgggagttaactgaagctgttactgatgctgacagcagcagcagccactgggagagagagaagcctgaggaagatggggataacgatgactagcttggaggagattttgccttcagagaagaaggtcgaactaactatcgggccttgagattgagatccaacagagaaaaaggctcaaaacatccaatgtgccatagtctggaaacgatggtgaaatactactaggttggaatggaaacaaagctgcgcgg

SEQ ID NO: 10532 - DNA, 623 bp, Zea mays
  Clone ID: LIB3279-180-Q1-K6-H3
gtgtaatccccaagcaaacaaacaggtagagggagaggagaggagaggagaggagaggttgggtctgggacaccatggctccgatgaagctgtacggggcggtgatgtcgtggaacgtgacgaggtgcgcaacggcgctggaggaggctggctccgactacgagatcgtgcccatcaacttcgccaccgccgagcacaagagccccgagcacctcgtccgcaacccgtttggtcaggttccagctctgcaggatggtgacttgtacctcttcgaatcacgagcaatctgcaagtacgctgctcgcaaaaacaagccagagctgttgagggaaggaaacctcgaggaggcagcaatggtggatgtttggatcgaggtggaggctaaccagtacaccgctgcactgaatcccatcctcttccaggtcctcatcagtcctatgcttgggggaaccaccgaccagaaagttgtggatgagaaccttgagaagctgaagaaggtgctagaggtgtacgaggcacgcctgaccaagtgcaagtaccttgctggagacttcctcagcctcggcgacctgaaccatgtgtctgtcactctctgcctggtcgctacgccctacgcatctggg

SEQ ID NO: 10533 - DNA, 582 bp, Zea mays
  Clone ID: LIB3279-180-Q1-K6-H4
aaacaggcaagagttctcggcttctcgcgagtcgcgagtcgcgacagcagagagaggcggagttgcggagaagatgcagagcagcagcatgaagagggagatcagcgaggcccacgacaccattcgcttcggcatcaacgccggcgtcaaagccgacctcgccccgccgcacccgctccagtctaccatccaatcggagaccaagttctgggcggacaagaagaagttcgggacagatgccatatacggatccgccctcaacatccgcaaggatctcgatgcccaaatcctctccaggctccaaaggccccctggggcttggccgccatctctgcttggatacgaggcactgacaggttccttggatgattttggatttgaagattatcttaacatgcctcatgattctgacaggttccggcaacctgacatgcaccatggaatggaggttcgccttggcttgtgcaagggacctatctgtcctagcttcaattgaggcagcaatgcaattctgctgcaagtgcacctctcagtccagtacttcagtcaatagaccatattaagatggcgaaatatgaaaac

SEQ ID NO: 10534 - DNA, 599 bp, Zea mays
  Clone ID: LIB3279-180-Q1-K6-H5
cccacgcgtccggttctagatcgcgatctagaacctagttctagatcgctcgcgatctagaactagttcgccgtcgctctctctgctctccaccatcctcctccccctcccctcgacctctcatcctcctcctgcttccccgcccggtcaacccataatccaaggcatccctgtgctgatggatcgattggaaatgcaggacgactcgaagagatccaataggcccaaatattctaagtttacgcagcaagagcttccagcatgcaagccactgctaactccagcaattgtcatttccgccttcttactggttggcatcctattcgtcccaattggtctcgcatcgctttctgcgtcacaagagattgtggagctggtagatagatatgatacaagttgtgtgaccgtggctgacaaagttgggttcattcagaacactaaaacggacaaatcatgcacaagaactctaactatccctaagcatatgaagagcccaattcaaatatattaccagatcggggacttctatcaaaaccatcgacggtatgtgaaaagtcgcagtgataaacaattgcgatataaagatgctgcacacttga

SEQ ID NO: 10535 - DNA, 648 bp, Zea mays
  unsure (1)..(648): unsure at all n locations; Clone ID: LIB3279-180-Q1-K6-H6
cagatctgatcctgcggactccacccgaccccaacatctcgcaacggtagttttgattgaccctgcctgtacccttcctccttatcgcctcgcatcccaactcgacagggtgacagtcgggcctacgtcaggtgttccaggcctacattttcaggccttatccagcgatgaacaccctatgtacgccccacctcgtctcctccgttcgaccaccacggagcaccagatgcagcgaaagggtagcgacttcaatatgaagagtaccatcgtgggcaaagttgttgacgaaatgatcggtgtgcttgtatcgagaaaagttcgtaccatcgtgaaaacgcggattttttggtctcccggactgtttcatccacatgtctgatgacaataattttgcttctgctcttttttgagccatctacctccgtctcccatcttgctcgtgttcgctaacttttttctattcggttttgcctctcataaaccacttggtggcgatggaagccacgacggtccaggaccaacgcacgttcccagcaccttcaataatcccgtcacaatcgcaccgtcgaagattttgatgtcgccgtctttcatgcaagagtagatcgaggtcactgaggtgctattcgggctcagntctcgtgcatg

SEQ ID NO: 10536 - DNA, 588 bp, Zea mays
  unsure (1)..(588): unsure at all n locations; Clone ID: LIB3279-180-Q1-K6-H7
gaaatgggtcctaaaagggagtgattagtcagtctgtgaaagagtggtgcaaagcctggtggatgatgatcttgtcttgaaggataaaattgggacttctgtgtacttttggagtcttccaagttgtgctgggaaccagctgaggaatacttacaacaagctggaatctgacctttcaaactctagaaagcgttacatggaccttgttgaacacagagataacttgaaaagaggccgggaagactctgaagagagggaagctgctttggaggagctgaagactgtagaactacaccataagaaactcaaggaggaactggctgcatatgcagatagtgatccagctgcagtagaagcaatgaaggatgctactgatattgctcattcagcagctaacaggtggacagacaacattttcactttgcaacaatggtgttcaaccacattcccagaagcaaaagaacaactggaacatatgtacagggaggttgggatcacagaagattntgagtatttgcagtgatgtccaacagcctattacagcgtcgaaaatgtgccacgggatgttggatcgaccacagatgcaag

SEQ ID NO: 10537 - DNA, 630 bp, Zea mays
  unsure (1)..(630): unsure at all n locations; Clone ID: LIB3279-180-Q1-K6-H8
cgtatctccccccaccccccccccccgtggggcgcggggggcaacccgacccgagacgagttcctccagatcagcgggcagagggtgccgtagcaaggatctcgccgggccccggccatgaccgaggtcgccgacgcgtcccctccccctccgaccgccggcggcggagaccgcaagggggggggggcctcgcccgtgcccccgctgccgggccagcacaagaggcgtagggaggagggcggcggcggcttcaaccggcgccggctcggcccggttggcggcggagggcacgagcaggacgacaggaggtatggaaatggtcttggtggcatangaggaagaggtggtgatggtcgatatacaaatcgtgcaccagattctggacgcggtggatggaatgagggttctgggaacagtcgtagggaaggactgatgtcatacaagcagttcattcaggaacttgaagatgatgtttcaccagttgaagctcaaagcagatatgaggagttcaagtcagagtacatcacaactcaaaagaaagcttactttgccctccataagatgaagattggttaagaaataattccatcctacaaaccttgaaaatgtctttgaaagaaggaatgaact

SEQ ID NO: 10538 - DNA, 629 bp, Zea mays
  unsure (1)..(629): unsure at all n locations; Clone ID: LIB3279-180-Q1-K6-H9
ggcgtattaaacggtaaataagaagaggggaggaagacagttgctgctactcggcacaccaaaccactccagtggagtccaacaccgcctcttctcctcttctcgattcgaaatcgagtacgtccgaatgctctagaaccttccgggcctagggatctcgatggggcccgagcaggaggaggccgtgctggagaccatctgggacctccacgacaaggtcagcgacgcgatccacgccctctcccgcgcccacttcctgcgcgccgttcgccgccgctcctcggcctccgcccccggcctcgtggacgtcaagggcgggggtctgggtctcggcgcgcgcggcggagacgaggtcgtcgccctggcggccctggctgaggaggccaggagcctgcacgccatccgcgccgcgctggaggacctcgaggaccagttcgagtgttttctcgccgtgcagacacagcaacaggccgaacgagatttcgcgatggcgaggctggagcaaagccgcatcatgctcgcgataaggctcaaagagcatcacggngagaaaccacaaggtcatagacgaggcgtctgccttcgtccgcgatgtctaccaggacgtctggccttncctgtcagctacc

SEQ ID NO: 10539 - DNA, 207 bp, Zea mays
  unsure (1)..(207): unsure at all n locations; Clone ID: LIB3279-180-Q1-N6-A10
gcgtggnagggcgcctcnnctcacgatgcatcnnngtggcggnngctggtgnngctgcttnngttcctcgcttagggcctaggctcccnntcgacgtaaccacntnnggacgccggcaccgcgccctcgcggnntggtcagtgggtgatcctgnnnatccggaggggccggagnnctttgcttgcnnaattgcagagggtgcggacc

SEQ ID NO: 10540 - DNA, 517 bp, Zea mays
  Clone ID: LIB3279-180-Q1-N6-A12
ggttgggtttttttttttttttttttttttttttttttttttttttttttttggggaacaaaaatattatacaaatccacgggggggtttgttagttccaaatttccgaattccaggcacttcacccacattatgtgaggaagtaaaaggttgtggggggggttatttttcaaaacacggggggaagcctatccccaaaaggccatgtgcggaggagtaaaccttagccttggagggctacaccaagggccgaaacaagatgacacgcaaaggtgggagaacctgggtagcagcagcagcagcggatttaggggtcattggggggaaggacaccaggtagagttttgccttccaagagttccaagcttgcaccgccgccgggcgaaatgggggtcattttggggggcagcccagcctttttgacaggagcaacagagtcgccgccgccgatgatgggagggacacccttcgggggtggaagctcagctagcttcttggcaatcgcctcaggggcagg

SEQ ID NO: 10541 - DNA, 624 bp, Zea mays
  unsure (1)..(624): unsure at all n locations; Clone ID: LIB3279-180-Q1-N6-B11
caagcaatacttagagcgccaggatacttatagtagtaccaccattctgaaacatagtagcgccaggacgaaatataggatcgtccaaaaacatatccttaacaagagtttaattcaataaaacctcggtgccagaacctagcagacttcacaaaagagcatacttagaacaccctgtatggcttccccatggtgctcttgacgtagaggcatctcacattctgccagttcttcttcagaagggaaacaaggaagttcacgctcatctggatgttctgctggatctgcttctcctccatcgccaagttgccgacggcgacgcccatgcaaaggaccttcttgagctggaacttgacggttgccttagtctcgttcaccttggattcgagggattcctggtgagtaaccagggtcgggaacttgcctgccttgttgagaccaggaccaaggagacggggaatctgcttgatgatggcctctgatgccaagaaagcatggtacttcttggcaagcctcttaacaagcttcttgttcttgttcattttcttgagagcctcaacatccatgtagtcaagtcccatcttctcggcctcctcaaatgctgngcatcaccaagcatgcaca

SEQ ID NO: 10542 - DNA, 539 bp, Zea mays
  unsure (1)..(539): unsure at all n locations; Clone ID: LIB3279-180-Q1-N6-B12
accccggtttttttttttcaaaaaactcgaaacaatcgatatcggtaagagctctgcatagttctaagggtttttccnactgaaaatgtagacttatgccttgaatgtgaatatgaaacattatcaaactatttttgttttttttgctaaaggtaataatgcctgtaattgatattgagggtggacttcatctgctgcaccacatatgggagggccctgatgctgtcatcgatagatctgttgacacaggattccagttcctgagttgcatctgttttcatcttctggagcttggcagcttcaaacttatcttgacagaccatcaatgaccggttcaaccgttcctgaaacttggccatctcactctcaaaaacattgttgacagcaaggacaggcataccacaattctccacacaattgttgatcgcttcctgagtacggcgccgatcgaagcaatcatatgcgcacttgaagtatgcttgctgcatggtgaagttgacgtggtcctggatgccggcgaggtgctgttggacggtagc

SEQ ID NO: 10543 - DNA, 506 bp, Zea mays
  Clone ID: LIB3279-180-Q1-N6-C10
gagatattcaattgttcagatattcaaattctttgaaaaactcagcacaaacattcaaatgttcagatattcaaattcttcgaaatgttcagactttagacaaaaagtaactctaatatagcagcttcacacacgcacaggggacaactccgaaactgagtgggcagaagacttaacacggtcgaaaagctaaagcctatgggcgagcagcaaccggtgctggagatggagctgtagcagcagcaccaggaccagggcgggggcctccttgtccaccagcaggcctatcctccctgcgcctgaagcgctccggcggcttgcggtccctgcgcttctcacgggatcggacgcggacgatgtgagcgtggatcgcgcacgagacgcagtggtgcaccttggcgtacagcttcgggaggacgtagccatcatagacgcatgcttcctggacgtccctgatggccgcctgttccacgatgttcctcacctgaaacctccccacgcgtccg

SEQ ID NO: 10544 - DNA, 548 bp, Zea mays
  Clone ID: LIB3279-180-Q1-N6-C11
gcagcaccaagaagcaccatttttttccttaggatttaacttagaataaagcctgacgggggtaacagcacccatcgatccgcagtccatgctggttgatgcatgggtctgctggagccgaggatgaacacaggactaacaactgacacagagcgaccttcaatcaaaaacacagatgggcaacaacaaacacgagacgaacgaagataaacactctggactagggtaaacaacacggtagcgaacaggataacttggccgcgcgggccccaccgctcagttcctccagttcccgtcggagttgccgtagccgccgccacggttgccaccgccgtagccgccgccaccaccaccgtagccgccgccgccaccaccgtagccgccgccaccgccgtagccgccgccgccatcacggcgcccgccaccgccgtagccgccgcctccacggccaccaccgtacccgccgccgccgccgccttcacgggcgccgcgggactgggcctcgttgacggtgatgttgcggccgtccagctccttgccgttcatgc

SEQ ID NO: 10545 - DNA, 377 bp, Zea mays
  unsure (1)..(377): unsure at all n locations; Clone ID: LIB3279-180-Q1-N6-C12
gccaggggggtgggcagacttgtnacacatgctcaggcgaaccagctttatccaacagtccaacacagttcatctcatcggttgccacaggtgctaaatgtttttttttttttgnncacatgtttggggggggggggattttttttttccnangcctcttttttttaggggggggtggttttttattttgacggcactcccaggcgcccccgaaggccagcgaccattcgtttctgttcagccctggtgttccgtgatccctcttgcatccctgtcgtccgcgtttccggtgctcttgctgggctcgtgtcctcccttttcaagatcatcggggtccgtgtggtcgtccgctgctctgccattggttgagtttggcc

SEQ ID NO: 10546 - DNA, 474 bp, Zea mays
  unsure (1)..(474): unsure at all n locations; Clone ID: LIB3279-180-Q1-N6-D10
aaaaaaaaaaaaaaaaatgggaaaagggggggggttatataataaagaaaaattttttttccttttgggggggggggggggggggtttttttttttttgggggggcccccccctttttgtttttttttaaaaaaaaaaatttttttttttttttttaataaaccccccgccccccggggggggggggaaatttaatataaagggggggggcccaccccnnggggggcgggggggggggggtttgataaaaaaaaaaaaaanattttttttttttttttgctgttgggcttntttttccttnccccccctcaaaaaataaaaaaaaaaatttttttttttttttttttgtggggagggagaaaaaaaaaaaaaaaaaaaaaaaatgtttttttctttttgtttccctccccccccccccctcgcggngggggggggggaggggggaggaaagattttattttttttttttttttt

SEQ ID NO: 10547 - DNA, 620 bp, Zea mays
  Clone ID: LIB3279-180-Q1-N6-D11
accaactgttacatcacgattgatagaaaaagtgtctcaacagcacttggatagtacagtatgaccaatgatgttcagaaacatgcacttgacaactaaaaagaaacaagatataaatagttcccagactccgagtgacaattaaaaccagtaacagtagcaaaaacgaaaagattagagcttgtcctcaaactcagaaagaggagtcatctgttctttcagacccttcctcttgcggatatccagcaccagctgggcagcctgggagccagcctccaaaggatccgagcccatcatgtcccagtggtcaaacacacactgggggaacgcctgaccagaggttgcagccctcagctggcttgagaacccaaaggactcgatgacagggaggaaagccttgatgttgtagagcggggtaccaggcctttgcatctcctcgaatacatgtcctctcttctggttcagaacaccgtatatgccacccagtgcattttctggggcctggatctccaccaggtaaactggttccagcagccttggcttggctgtgagctgagagcataaatgaccctcctggcagttggaatgacctggccaccacccctgtggatagcatcagc

SEQ ID NO: 10548 - DNA, 531 bp, Zea mays
  unsure (1)..(531): unsure at all n locations; Clone ID: LIB3279-180-Q1-N6-D12
gcaagcngggngggggcgggtccaactntnttccaaaacaggggcgccaaatctaagaggcccattacaatccggcacgatttatgaagcaggcaagctagctactggctttttttttttttacgagaacattaggggggggacagcacattcatttgcggggaggggaggggtngaggggaggaggaagaacccttgtnagaaggggagacctaacaaatccgtggacgctggaggctgctcaattgctggtgaacttggtgacggccttggttccctcggagacggcgtgtttggcgagctctcctgggaggacgaggcgcacggaggtctggatctcgcgggaggtgatggtgggcttcttgttgttccgggcgagcttagcggccttgccggcgagcttctcgaagatgtcgttggtgaaggagttcatgatggacatgggcttgggggagatgccgntgtcggggtgcacctgcttcagggccttggaggtggtgatttttgtggtctccacgctctttttgggct

SEQ ID NO: 10549 - DNA, 614 bp, Zea mays
  unsure (1)..(614): unsure at all n locations; Clone ID: LIB3279-180-Q1-N6-E10
atcttgcagtgcagtaacaccatgattttccacacaaaaaaacacaataacggatgcatgaaagcatgatgttaactatgcgtacacagtgaaaaacaataagtgcatctcattgaacatatagatatgtgtttatatgtggtctggtctggacgcatgcatggttaacttaaactaacactcatattacttaatataaccgcatggtgcagtgtgcaagttttggaaggccttggggacaagtacttgaaagatctcactccaatgccttgatcgatcgacatggtcagatccaaagtactcaccccacagaacggccatgaaacttatctcgtcactcagttgccttgatcgacatggtcagatccaaagtacaccgcaccagagcggacttgttgccgctgctaccgcctgtagctgcctctaacctcctggcatcctcgccaccccggagtgacagggagagcgagagaggcagcatcttatcgttgtccacctcctgctgttcacttaatccgataccttggatcttcatcttcttcatctgcttgtcggcagctcctcccatgtcgtcgtcgttggggctcaagcttangtgcaagtccggcgtgcca

SEQ ID NO: 10550 - DNA, 504 bp, Zea mays
  Clone ID: LIB3279-180-Q1-N6-E11
gaagaacaaatactagctcttgctgattttgtattaacagcagatgagaacacttgcaagacaagaggcgagatattcaaatcgttcacatggatcctaggctcacttgaaaactgttctaatctcctagcaaagcccaagaaccaagcacatattttaactcaggtgcaaaatgtagtgttgaacacaacttccagatactgacagactgtatctagtgcgatttgacgtactcctgcactatgttaaggccttcagattcttcgccgtagtccttgacaacaacacaggagcagcctacaaccttcctcgccttgccctcagagtcgatcttgcaaagcccagcccactctccaagagttttggcgctaggcacagtaaccaggtggacattgtgctcagcgcagagagccttcaccagcttgacataatcaggctggtcgcagtcctcggcaagcacgcagagctgagcggcatgcttctcgatggctttggcagcctcac

SEQ ID NO: 10551 - DNA, 503 bp, Zea mays
  Clone ID: LIB3279-180-Q1-N6-F10
gggagccaattcatattattccggggacattaaaccaaacaaacaggtttgcaaagccaccggaacaaaataccaggcaaaggggggggattctaaacaacaacgctgcaaaaaggggagggctttttttccctggaaaaagcagcaggcttggagcacgaaaaccagcatccagccattatttataaacttgagaatcgaaacatagcatgggggcataaaatctaaagggggggcttaattaaaaacagcggcaaaggcaatggcaatgggaggcagtttcagcgcacgcccaccggggccgggacaaaaaaaacaacacgagggggactaaaagataagctatcaaaaatcaaaaacgggacaggcctgggaaactccccgacatcagcagacacccattagggggggagaacggatccgtcttactggccctcgggggcggattctttgggggcagcaactggttccttgatctcatccccgccggcctcgttgggggc

SEQ ID NO: 10552 - DNA, 485 bp, Zea mays
  unsure (1)..(485): unsure at all n locations; Clone ID: LIB3279-180-Q1-N6-F12
cacgcaaacgtaattttttttcctctngagcttaaaaccccggggttttttttggnttttttatcaacgggtgggggaacatataacgggtgagtaatcaccgagatgggccttgcagccgcatcatagtacagtcatacaacatcaacattacaacaagnacaagttttttctctttttgccnantgattgttggggggggggcactttttatatgcgnattgcatatgggcctggggggggtgttttattaatcccaccagcactacgcgactgaaggggaaagaggacacagcccccgaaagaacatacatttaatcgcgataagctaggctcggcccacaggagaaagaggtggacggtggggcacatngctggtcggggctcttccttggctggctgccatggccttgtcctcttgaccagcaagggggtcatgctcctgcgctgcttgcgaaccatcttgccgccctgtcggggtcctc

SEQ ID NO: 10553 - DNA, 525 bp, Zea mays
  Clone ID: LIB3279-180-Q1-N6-G10
ggggaacattagtacacaacgagctctgattgctgaagatcttctcgatgaagacgaacatacaataagacacaaggacgaaactagagcaggacacatcccatccacagatctagacacgagcatgctacagcacacagtgcaaatgaagtccctactttctaagccttcttgggggacttggcgcccttcttgggggacttgggctccttgctgccggcgctggccgccttctccgccgccttcttgggcaggagcacggagtggatgttggggaggacgccgccgtgcgcgatggtgacgcctgccagcagcttcccgagctcctcgtcgttgcggatcgccaggagcacgtggcgcgggatgatgcgcgtcttcttgttgtctttcgccgcgttccctgccaactccagaacctcggcggcgaggtactccaggacggcggcgaggtagacgggggcgccagtgcccacgcgctgcgcgtacgggccttcttcagtagcgcccgaccgggcgacgggaact

SEQ ID NO: 10554 - DNA, 558 bp, Zea mays
  Clone ID: LIB3279-180-Q1-N6-G11
aacatataagtatatggtgtattgctgtattacaatggaagcttaaaaacagattcacagcaggtctggtgtccattacaggcgaactgactccaagtacacaagttatatgttcgtcacaacctgggcatacatccttccaggcacaacaaatttgtgaatccgagcaaagtccgtccttatttcagataagacaggtaggtcgagtgcaaagaaacgtagcaagcgagcaacagcagaagcatgcttcacttggtccaccagtgaaggaaatccttacgcctgttgatcttcttttggagctgaagaacaccgtacagcagtgcctcagcagttggtgggcacccagggacgtagatgtccacggggactatacggtcacatccacgtacaacagagtaggagtaatggtagtatccaccaccgttggcacagctgcccattgaaataacccatctaggctcaggcatttggtcataaaccttgcggagggctggagccattttgttggtgagcgtgccggcgacgatcatgcaatcggactggcgcggcgaggga

SEQ ID NO: 10555 - DNA, 598 bp, Zea mays
  unsure (1)..(598): unsure at all n locations; Clone ID: LIB3279-180-Q1-N6-H10
gctaactaaaaacctatgaatactggtcaacaaaaatcgtaagatgtgcattctcacaaattacagtcatatgtaaaatgaaactgctccagataaactatcaggcaaataacagatttttgtactctaaaaatcaagctattattggcctgtagcttctgtttgtagagctcacgacgatctgcattggtgtcagattaggccatatgggcccaccacgtaatgatctgcacacttatgaacgatcttcgtcatgtgtatgatttgggacctctccttgattgtcaagtggcatatactgcgccatgatagctctaatctcagagtccatgtatgaccttagtctgtatttgtacacaacataacttcccgctgccacaacagcaacaactatcaagataccccacactgcagcccatgctgctttagcctgaactgctgtcttgcttatgcaggtgtcatgctctctgatgtacaaaaggtcaccactgcaagtgcagtcatagccaccccatgtatctttgcagttgcattcaggacactgacaagcttttttctccttgcactcatcaatgtcttcacattntttaacgccgtc

SEQ ID NO: 10556 - DNA, 429 bp, Zea mays
  unsure (1)..(429): unsure at all n locations; Clone ID: LIB3279-180-Q1-N6-H11
ccggggggaggcccaannangaagcgagggcgcaggggacaacaaacaaaacanggcagnccagacaggcanncgggtttttcttgtgagnnaaattttggggggggtgaaaattttttattaaaccagagaataaagtcgggggggtgatttttttccagcagggggtccgctttctgatctcttagtgagctttggctggcagatgcagcgtccactttctcagtccaaaacttcggtggttgcgaaaagaaatgtccctacatctctgtngctgctgggggatttttggaatggcagctttgaccacattgggctgttttaagatcaattttcttctgagccttgagctttgtgttttcctaattcgggagctttggtccactgaaacgggctttcccatattaggcccnggtttttcgtgggagg

SEQ ID NO: 10557 - DNA, 583 bp, Zea mays
  Clone ID: LIB3279-181-Q1-K6-A1
ctcctcctccgcctccgcctctctctctctctctctctctgcgccaagaaagagaaggcgccacgttgacattgcggatgccgtagcgggcgcgcgcgcgccagccatgcgctcgtgatgatccggccgttccagaagatcagccacggtctcgaaaggttctcgtccaggcgccggaggccgtcgtcgccgctgtcgttggcctcggacggcacgggcgcctgcctcctcgatggacacgcaggcgcagcctttcaccaggcgggcgctgtccaagagctgcgggtccaaggggacccggctgtccgttgaccatctgccgccgccgctggccggcggcccttcggacaagggggtggcagggagctcgtcctcgctcgcggtgccgcccaggccggcccgtcgtgagggcccgccctcagacgcggagaaggtgagggagaagttctccaagctgctgctgggggaggacatgtccggcaccggcaaaggggtgacctctgctctcgccctttccacgccatcactaatcttgcagcttctgtgtttggtgagcagcgccgtctgcagcccatggccgacg

SEQ ID NO: 10558 - DNA, 628 bp, Zea mays
  unsure (1)..(628): unsure at all n locations; Clone ID: LIB3279-181-Q1-K6-A11
ttctcgttccaccaaatctctcaacctcaggggtgggagggtaagaaacctcagctatcagtacagtactggagcagatgggcgcatcgagatgatctctaatgctgataatgaccgcaaatacccagcaccacgtggctacttcttcaagcttctgaaactgaagcacctgaatgggctgggcgggattttggctcncttttctgncctctcaggatttattggcccaacttttgccatcgttatgggtgaaatgctcgacgtgttctactatagggaccccaatgagatggagaagaaaaccaagctatatgtgttcatctatattggcacaggcatatacgccgtcgttgcttatcttgtgcagcattacttcttcagcatcatgggagagaatcttacaaccagggtcaggcggatgatgttgtctgcaatacttaggaatgaagttggttggtttgacgaagaagaaaacaattcaagtcttgtggctgcgcatctagctgttgatgcagctgatgtgaagtcggccatagctgagaagatatcggtcatcctgcagaacatgacttccctcatgacttctttcgtggttggatttatcattgaatggagagtggcaatactt

SEQ ID NO: 10559 - DNA, 607 bp, Zea mays
  Clone ID: LIB3279-181-Q1-K6-A12
cctccgcgtccgtctcgagctggatcggtgggggggggggggacagcagtggctctctctctccctcgtggcgacgactgggcgaccgctgccgctgccgctgcccttgtgccccggtctccgtcggtccgttcgccaggtctcctgcgggctcttcgtcgtcgacaagctccgccgggttgctgtgggaattttttgttgtcacatggattcagcacaagatttccaacccaggacattctctataaagttgtggccaccaagtgaaagcacacggatcatgcttgttgacaggatgacaaacaatctgtccacagagtccattttctctcgcaaatatcgccttttgggaaagcaagaggctcatgagaatgcaaaaacgattgaagaactttgctttgccttggctgatgagcatttcagagaggagccagatggtgatgggagttctgctgtccagctatatgcaaaggaaacgagcaagatgatgttggaagttctgaaaaaaggccaaggactactgcagaactggaggcacctgtagctgacacacctcttgtgtctgctgatactgtactagatatatctgggggcaagcgtgctttta

SEQ ID NO: 10560 - DNA, 628 bp, Zea mays
  Clone ID: LIB3279-181-Q1-K6-A2
aaccattgattgcaataagaattacttcatgttacagaggtggctcaaaagatgatcaaacaaactccagatgtttctccaattgatgacaatatttattgttttaattggatataagttggaaagagaagcaagtagttttgcaaacacaattatttccatttgctaacccattctgtcgatatttctgactcagagcagtccattatgagtctgcaaaatgttagcaacgaaagactattgaaacaacatgtcaaagaagtcgttgaaaatctatgagttatgccaacaagacgacatcgtaaaaaatgttatttatttgataaatctgtttaaatctacctttagaaatcattcccttttagacactataaatataaaaaatcgtgtatataaatatgattttcatggaaaggttgtggaattgttatgtttatgtagatgcattttagggggcgtatttatttagtcaactgtacctaaatacaatttctaagaatattttgtaagatatatgttgggcacttgttttttattactgattcataaaacaagacaacacaattgttaaatgttaaggacctttgtccttcgaagcattaattcccttcgggcataatggttcttg

SEQ ID NO: 10561 - DNA, 592 bp, Zea mays
  unsure (1)..(592): unsure at all n locations; Clone ID: LIB3279-181-Q1-K6-A3
gttgttcccaaggnatgtcaatgctgcagtcgcaaccatcaagaccaagagaactgtccagtttgtggactggtgccccaccggattcaagtgtggcatcaactaccagccaccgtctgttgtccctggaggcgacctggcaaaggtccagcgtgccgtgtgtatgatcagcaacaacactgccgttgctgaggtgttctcgcgcatcgatcacaagttcgaccttatgtacgccaagcgggcgttcgttcactggtacgtcggtgagggtatggaagagggtgagttctccgaggcccgtgaggacttggctgctcttgagaaggactatgaggaagtcggcgcagagggtgcagatgacgagggtgacgagggcgatgactattgagtagccggttaataattagttcgctggtgcttaatggttgagttattttgagtatactctgtatgggtccactccattgcgtgctgctgctgtgtgtttccattttgtattttgtgataaattgttcgtagccccctattggccatgattgttgttcatatcatcctgttttgatttgcaatgctattcatcgaagttcgatgt

SEQ ID NO: 10562 - DNA, 495 bp, Zea mays
  unsure (1)..(495): unsure at all n locations; Clone ID: LIB3279-181-Q1-K6-A4
atattatgttgttttcaacctgttttaggaacgctaaccatagtagacggtgtcgagatactcaatatgaaacaacaacgtagctattagttcgacaacagagagctaatcaagtctagctccgtgatgaagttaccacaatgtaggggtagttcgacaatagggagccgatcaagtatacctctgtgacaaagtcggcacaatgtacaggtagttcatcaatagggagccgatcaagtctagccgatcaagtccaactccatgatgatgttggctgctatcacctgtcgcagttgtattatgggggtaggacaggcctgtgggtacggcggcggagcccgaacaagcaccccaaatggggcatggtcggtgcgcgcgtacgagaacatggttgtggtttgtcttgtattgataagctcaactgcagtggagtgtcatgtcgatgagcattgtaagatctaagatttcataactntattgtgggtatttatactg

SEQ ID NO: 10563 - DNA, 670 bp, Zea mays
  unsure (1)..(670): unsure at all n locations; Clone ID: LIB3279-181-Q1-K6-A5
ttttcgcgtgggcggacgcgtgggttaccatctctacctgtgccttagcaatgttgttacttcagaaagtgggaaattcctcttatcagctaaacgacaccgcaaaaccacatgcaccgagtacactatatcaatggattctggcaacatctcaagatcaaaaagaacctacattgggaaaaataaggtctaacttccttggcacaagatttttaatttatgatacacaaccgccctataatggggctgtagttcctcctgccggaaggacaagcaggaggttcaactccacaaaagtctctccaaagctgccttcagtcagttacaacatcgcacaggtatcgtatgagttaaatgtccttggcacgagaggtcctaggcggatgcgttgcatcatgcactccatacctgcatcatcagtggagccaggtggcacagtgcctggacagccagagcagattgtacctcgagccctggaggattcattccgcagcacggcttccttctcgcagtcgttccgtagcactgcctcattctccaagtccatcatggactcatccatggatttcaatagcgctcgcttctctgacatcgctggcagcagcgctcgcttcacggcgtncctggtagcagcgctcgcttcgcgggcgttcctggcagcagcgctcgc

SEQ ID NO: 10564 - DNA, 263 bp, Zea mays
  Clone ID: LIB3279-181-Q1-K6-A6
ttcactcgtccggttggtgccggggttgtctccaagttattagctgatgagtttccactttcttgcccgtagcaatttagtaaagaaatgaatgctgacatgtttcttggaatgcatgggcaaaaaggcagagctggctggtctggccgccattcattctggacagtaccttgtgctttcttgttgaggtggctcatcataaagcatattttgtagccacttttccgagttgatattagtgggttcttaccaaatttaccgcg

SEQ ID NO: 10565 - DNA, 625 bp, Zea mays
  Clone ID: LIB3279-181-Q1-K6-A8
atccagccggcacaccatcggcgaagaagagccggagagaggatgatactggccgtgctcttcgccaactccgatggaaacatccttgtcgagcgattccatggggttcccgcggaggagaggctccactggcgctccttcctggtgaagctcgggtccgagaacctcaaagggtccaagaacgaggagctccacgttgcctcccacaagtctgtgtctattgtttataccacggtcggggatgtctgcctctacattgttggcaaggatgaatatgatgagcttgctttggctgaggtgatctttgcaattacatcagcagtcaaggatgtttgtgcgaaacctcctaccgagcgcctcttccttgacaaatacgggaggatctgcttgtgccttgatgagattgtttggaaggggttgcttgaaaacacggagaaagacagagtgaggaggttgattagactaaagccccctgtggagccataatttgcatgtaaagcttatgttggcgttgctgtaatccaaatccaatcccatttgcatttgtaggcaaattttcagagttttcatctgcactttgtatctacagaattatcatcacttattggaggattgcgtgtgtgac

SEQ ID NO: 10566 - DNA, 639 bp, Zea mays
  Clone ID: LIB3279-181-Q1-K6-A9
ggcagcagcatttgcaacgcgccggggggtatgtgcaagccaagcgtttgatgtaatacattgctcacgctgccgaataaattggacccgtgatgatggtatcctgctcctggaggttaatagattgcttagagctggaggctactttgcttgggcagcccaacctgtttataagcgtgagagaggcccaacaagaggcatggaaagagatggagaacctcactgcccgactttgctgggagtttgtgaagaaagagggatacattgctatgtggaggaaacccttaaataactcttgctacattaaccgaggtcctgaaggaaaacctccactttgtgatgctgatgataacccggatgatgtctggtatgttggtctgaaagcatgtattagtcggcttccagagaatggcgaagcaccaactcctgttcaatggcctgcacgcttaatggagccaccaaagaggcttcaaggcgtcaaaatggatgcctactcatcaaagaatgagcttttcaaagcagaaacaaaattttgggacgacataattgacggttatatccgtatctttaagtggaggaagttcaaagtcccgaatgtaatggacatgagggctggatttggagggtttgcagctgctt

SEQ ID NO: 10567 - DNA, 558 bp, Zea mays
  unsure (1)..(558): unsure at all n locations; Clone ID: LIB3279-181-Q1-K6-B1
agagtggttcaggtgacgaaagatataaagagcaagatcatatccttgtggatgcacacaggcagtcttcggatcatggtgataagtttgaggctgggtatgctgctgaagtggatgcagaaggaaaacaagaggcagatgactatgaccagagagagggcgagtccgacgactacgagacatttgaaggccatgactacaaatctgaagatgaaaatgtgtaccaagacgacgaggatttcgatgataacgatgactttgctcggaaagtaggggttttattgccttagacgccgcggtgtcattggttctgttgcttgaggcaacgagctctagtttttgccatcggttctgttgcttgaggcaaagctgaaatgccgatcataatcgatttgaggtttacatgtagactgctgtgtggtgttcagcacatctgacctctcctcggactttgttgtattagtttccgtactaacagcaggatatattccttaatcaatttgtgcccggaatgaaatataatcaactccacaatgggggggcgttttgcttaanaaa

SEQ ID NO: 10568 - DNA, 468 bp, Zea mays
  Clone ID: LIB3279-181-Q1-K6-B10
cccacgcgtccgatttaaggccaaaattgtgttcctctcaagccacatactcagagggagcaatctatattatagaactatgataaagcttaattgacatatcttttgatcttatatatctctttcagttggtacttgctctatattcacatttctgcttataccaaggttcaatatgtggaatgtgtatcctcggaccgtacatgttctaaagtacattaatctacaaatattcatcacttgtatgcacaagtttagggggagcaattctctacacattaaatctttgagactaaccattcttccagtatatgttgtgcttagtctcaaaggaaaagcatttgaaacagggggagaattttcaaaatcttgaaaatgccttttgaaatcatatccttataccattggctattgtaatactcaaaagtgcaatgatgagaatagagataatctcaataatttgtggcc

SEQ ID NO: 10569 - DNA, 633 bp, Zea mays
  unsure (1)..(633): unsure at all n locations; Clone ID: LIB3279-181-Q1-K6-B11
cctcaaganaagacgaacctgagtttgctgaggaggtggcgtgtgttgctgacctttatgtcaatgatgcttttggcacggcacacagagctcatgcttcaaccgaaggagttaccaagtatttgaagcctgctgttgccggcttcctcatgcagaaggaacttgactaccttgtgggaggtggtgggaaccctatttatttttttgccgctattgttggtggatccaaggtctcaagtaagattggtgtcattgagtccttgctggcgaaggtcgatatcctcatccttggtggtggtatgatctacacattttacaaggcacaaggatattctgttggaaaatctctcgtggaagaggataaacttgagctcgcaacttctcttattgagaaggcgaaggcaaagggggtttctcttttgcttcccactgatattgtagtagcggacaagtttgcagctgatgctgagagcaagattgtccctgccactgctatccctgatgactggatgggtcttgatgttggccctgatgccaccaaaacattcaacgaagcattggacaccaccaagactgttatttggaacgggcccatgggagtgtttgagttcnagaagtttgcagctggcactg

SEQ ID NO: 10570 - DNA, 216 bp, Zea mays
  unsure (1)..(216): unsure at all n locations; Clone ID: LIB3279-181-Q1-K6-B12
ggggggggggggggaaaaaaaaaaaanncggggcccgacggggcccggnaagagacgcgcgcaacgacgggggncnngcggcaacgcngcgcgnngggcnnccgnagnggaacaaagaaccgcgcccccnaacccgcacacaaaaaacaaagggggggggggggggggagttttcttttttttaaaaaaaanaaaaaggcggccgcggcggggggg

SEQ ID NO: 10571 - DNA, 621 bp, Zea mays
  Clone ID: LIB3279-181-Q1-K6-B2
ctctcatcggcacacccgagctcgcgccctccttccacgtcgaggtccgagtcctgctttgatggcgaccgacgtgactgagactcccgcgccgttggtggatgcggccccagaggcgcccgccgacgccccggcggcgcctgctgccgacgcgaagccggccaaggccaagaaggccaccgcgccgaagaagcgcgccagcccgacccacccgccgtacgccgagatggtctcggaggcgatcacgtcgctcaaggagaggacggggtccagcagctacgcgattgccaagttcgtggaggacaagcacaaggccaagctcccgcccaacttccgcaagcttctgaacgttcagctcaagaagctcgtcgccggcggcaagctgaccaaggtgaagaactcgtacaagctgtcgtccgccaccaagccgaatcccaagcccaaggccgccccgaagaagcccaagaccggcgctaagaagcccaaggccgctgccaagcccaaagctaagacccccgccaaggcgaagcccgccacaaagcccaagcccgccgcgaagccgaaagccgtagtgaaaccgaagacaccgccaagcccaaaggcaagccagctgccaaggcg

SEQ ID NO: 10572 - DNA, 457 bp, Zea mays
  Clone ID: LIB3279-181-Q1-K6-B3
ggcgcccggcgcgcccccgccctacgccggcgccgtcgactgcgccctcaagaccgtcaggtcggagggacccatggcgctgtacaaggggttcatccccaccgtgatgcgccaggggcccttcaccgttgtgctcttcgtcacgctcgagcaggtgcgcaaggtcttcaagggcgtcgagttctgagaccggcgacgaggaaagatgatgacgacaacaaacgttgcgctgccagttcgtcaccgcgttcgctgccaagaataataacccgctgccaccctagaggccgcgactactattacgccctttgcttgcattgcatcccgtgttagacttgtgctcatgcgcttcactgcatcctgttgtatctggatggatttgaccaaatgcaaattgccaacatttttattatttaaaattgctaaaaaaacccacgcgtccggttctagatcgcga

SEQ ID NO: 10573 - DNA, 653 bp, Zea mays
  unsure (1)..(653): unsure at all n locations; Clone ID: LIB3279-181-Q1-K6-B4
cctatcaaggctttgcaagtggaagtcttgacaaagatgctcagtcagtgcgtatgtttgttgctgatggtggtgaacttctcatggctcagagctacgctaagaacatgggattgtatggagagcgtgttggcgctttgagcattgtatgtaaaagtgccgatgtagctgttagggttgaaagtcaactcaaacttgtcatcaggcctatgtattcaaaccctcctcttcatggtgcctctatcgttgctaccatactcagggacagcgagatgttcaacgaatggactctggaactgaaggccatggctgataggatcattaacatgaggcaacaactatttaatgcgctgaaatccagaggaacccctggtgattggagccatatcattaagcaaattgggatgtttactttcactgggctgaatagcgaacaagtcgcattcatgaggcaggaataccacatttatatgacatctgatgggaggatcagcatggccggtttgagcatgaggactgtgccccatcttgcagatgccatacacgctgcagttactcaactgaaatgaggatagtatcgcagctttcgtgaataaacctgaatcancacaacaatgtctagtactcaccagtggtattactggttgactact

SEQ ID NO: 10574 - DNA, 636 bp, Zea mays
  unsure (1)..(636): unsure at all n locations; Clone ID: LIB3279-181-Q1-K6-B5
ccccgcgtccgttttgttttagcgnaaaaaaaaaaggagctatgtaaattcagatggtacagcatcatagccaaacgctgttcaatggctttctagtgttacacaatcaaccaaatgtgctgggatacatttatcatgctagttcgacgttcattagcagtaccccatcttcaagtacttcgagaactggtgccaggacgagaacaggcacggcgacttcttctctgccctgctcaaggctcagccgcagttcctcaatgactggaaggccaagctctggtcacggttcttctgcctctcggtgtatgtgaccatgtacctgaatgactgccaacgcactgcattctatgagggaattggtctggacaccaaagaattcgacatgcatgtgatcatcgagaccaaccgcacaacggcgaggatcttccctgctgtcctagacgtcgagaaccccgagttcaagaggaagcttgacaggatggttgagatcaaccagaagatcattgctgtcggagagtccgacgaaatccccctagtgaagaacctgaagaggttcctcttgtcgcctctctagtgtccgaagacatcggcggctacctcatgcccccatcgagtctggctcggttggttttcgcg

SEQ ID NO: 10575 - DNA, 663 bp, Zea mays
  Clone ID: LIB3279-181-Q1-K6-B6
ccccgcgtccgcccagcgtccgcccacgcgtccgcccacgcgtccgcccacgcgtccgcccacgcgtccgcggacgcgtgggcgcgcgggcggagccatggcggacgacgattacaacgagaatcgacatgggctatgaggatgagcctccagaacctgagattgaggaaggggccgaagaagagcttgagaacaacgaagatgcccctgatgatgtcataggtggagagggtgaagataaggaacaggaaaagaccaagcgtgagcgcaaaacaacaaaatatatgacgaagtatgaacgtgcgcgcattcttggtacacgagccttgcagataagcatgaatgctccagtcatggttgagcttgagggagaaactgaccctcttgagattgcgatgaaggagcttagagcgcgcaagatacccttcacgatcagacggtacctacctgatggaagttatgaagactggggagtagacgagctcattgtggaggactcctggaaacgccaggttggtggagactgaagatgctgatctacttggcatggaaaggatgtgtagttacaggtcttcgttgcctctgagtggatgctgaacagtgaatgaaccaagacgaaacgatgctatgctagatgttaccttgacgtctgtgggtgccttg

SEQ ID NO: 10576 - DNA, 547 bp, Zea mays
  Clone ID: LIB3279-181-Q1-K6-B7
agccgctagatgagttcaccacaccaccctcaagtcctgacaacagcaagagcccagcagtgcagccttcttcaagttcctggattcagtggatcaaggcgccctacctccagaacttgtcgacggcacctggcccaagcagccgcgtggaggacatccaggacccattcgccattccttccaattacgtgtggacaacacctgaagagaagaaaaagaagacacaagaaaacaagaacaagtcgaagaaaggcaggagcggcgcatagatagtacgtaggtgatagcattggtgggggggggggagttaaagttatgctgtgagtgggtgaaaagggctatactcttcaggatctaacaggagggatgattggaagatttggagatttcggctgctctgacgtcgaatattgagaagcgaccgcttgtcttctttcattgtgataacagatctgctgtcaacattctttcgtttaacccatcgtttgggtcctgattatcattgcaatctactgtattggtagattttgaggtgtggcgccttctg

SEQ ID NO: 10577 - DNA, 199 bp, Zea mays
  Clone ID: LIB3279-181-Q1-K6-B8
ttcgatttccttcatcttccttcaattcaggcaaagctcggttctaaggtgtccgcatgatgaccacatggattcagaagaattgcttgtttactcggccctcttcccgcactccgttgttcctttgctcatgtagtatagatgatagacttgaacaacatcaataaacgacattcaaaggccatgcagttagctcttc

SEQ ID NO: 10578 - DNA, 500 bp, Zea mays
  Clone ID: LIB3279-181-Q1-K6-C1
cccaaatccaccaccgccataccagcgcgacagcgattccgtcgagttagaccaagcgagagagtagtctcagacgagaagaggtgaatatgagttccggcggcggcaggggcaagcccaaggggtccaaggctgtgtcgcggtcgaccaaggctgggctgcagttccccgtcggccgcatcgcgcgctacctcaaggccggcaagtacgccgagcgcgtcggcggtggtgcgcccgtctacctctccgccgtcctcgagtatctcgcggcagaggtgttggaactggcgggcaacgcggcgcgcgacaacaagaagaaccgcatcgtgccgcgtcacatccagctcgccgtgcgcaacgacgaggaactcagcaagctgctcggagctgtcaccatcgccgccggaggtgtgttgcccaacattcatcagacgctgctgcccaagaaggccggtgggaagggcaaggccgacatcggttccgcatcccaggagttctaa

SEQ ID NO: 10579 - DNA, 583 bp, Zea mays
  Clone ID: LIB3279-181-Q1-K6-C10
tattttccatcactgatcgaatggagggtaagagagcagtacagtcgggtaatgttcaggaggcgatcgagaaaataacgaccttaaccccacgattttggacacgaatccccaactatactttcatctccagcaacagaaactaatagagttgattcgcgtgggaaaaataaatgaagctgtggagtgtcgctcaagaagaacttgcaccgagaggcgaagaaaatcaaacatttctcgaggaaatagaaaaaactgtagcactactggtttttgaagatgtaaaaaattgcccttatggggaactattggatgtttctcaacgtttgaagactgcaagtgaagttaatgctgctattcttacaagccaaagtcatgagaaagatccgaagcttccaagcttgttaaagatgttgaaatggacccaaaatcaactggacgaaaaggcggcttatcctcgaatcaacgacttcaccactgccgcgctggaagatccatcgatatgaatctgctgtgaaggaactgagggtatgcaccaagcctgcctggtgcctacacgtgggtgccccggatctgtcaatag

SEQ ID NO: 10580 - DNA, 607 bp, Zea mays
  unsure (1)..(607): unsure at all n locations; Clone ID: LIB3279-181-Q1-K6-C11
tcctgtcctccctcgccttcgccttcggcttcgccggcaggagatttccaccaccaccgccggaccgccccgaccctcctcccctctcgcgctatggcccagactgttgtgctcaaggttggcatgtcctgtgagggctgtgttggagctgtcaagcgggtcctgggcaagatggaaggcgtggagtcctacgacgtatacatcatggaacagaaggtcaccgtgaagggcaatctgacacctgacgccgtcctgcaaactgtttccaagactggcaagaagacttcgttctgggaggctgaggccgtgacaagtgaatccgccacacctgccggtgccaccgcctgacaggttcgatgatcaggaagtgcccggcaaggcggcaaagaaaaaaatgtgaatgtatttagcttggatctgttacaaataattgcaaactgctagctcggtctgtacattttacagttgctattcgtgtactgtgatgttctcgtaagtttggggagatgataaaccaatatttgtatgatatatgtgtcgtgttccataaggtaagggtttgacggtgtgctatcatcancctgagtgactntagcatcaccaggct

SEQ ID NO: 10581 - DNA, 625 bp, Zea mays
  unsure (1)..(625): unsure at all n locations; Clone ID: LIB3279-181-Q1-K6-C2
tgactggcaagaccatcaccttggaggtggagagctctgacaccattgacaatgtgaaggccaagatccaggacaaggagggcattcccccagaccagcagcgtctgatctttgctggcaagcagctggaggatggtcgcaccctcgcggactacaacatccagaaggagagtacccttcaccttgttctccgcctcaggggtggtatgcagatctttgtgaagaccctgactggaaaaaccataaccctggaggttgagagctcggacaccatcgacaatgtgaaggcgaagatccaggacaaggagggcatccccccggaccagcagcgtctgatcttcgccggcaaacagctggaggatggccgcaccttagcagactacaacatccaaaaggagagcaccctccaccttgtgctccgtctccgtggtggtcagtaagtcatgggtcgtttaagctgccgatgtgcctgcgtcgtctggtgccctctccatatggaggttgtcaaagtatctgctgttcgtgtcatgagtcgtgtcagtgttggtttaataatgngaccgttgtgttgtgtgtgcgtactacccagaactatgacanatcatgaataagttttggtggtttg

SEQ ID NO: 10582 - DNA, 431 bp, Zea mays
  Clone ID: LIB3279-181-Q1-K6-C3
cgcaggtgaaggctggtgactctactccagaggagcttgccaccgctacccaggtccagggtgactacatgccatttactcgtggtgagaaacgttcagttgaggttgtgaaggtcacagatgagatgaagtcatttgctgcctatggcaagctccgccttgagcggatgaacaagaaacatcttggtgcccgccagaagaaggcagctgaggcagagaaggaagataagaagtgaagcggttgaagatagtaccctgttttgttctattcagtcattagtgaatgctactacttaaagtgcttgttctatgtttttttgcggtaatggaaatagagcccagacaaacattttggtgtcctactgtttgatgccttgtacttgtttgcgaactcagctatctaatgggttattggattgttgcccaccttc

SEQ ID NO: 10583 - DNA, 434 bp, Zea mays
  Clone ID: LIB3279-181-Q1-K6-C4
ggagcaaggagctggcttcggcgattacgacctcggccgcggcgacctgtggatggatctcaacccgggagggttcctgagcttcttggaggaggagggcgtgttccagggcctggctgctgctgaccacgacttctttcagccctttggctcgtccaggatggatttggttggtgaaatgcacgcgtcttgacaatggagaagcaagtgtaagcaagtgtgcttatatttcagacagtggagaaagtaagtgtaagcaacaccaatataaggggaagaaatcggaaatttgcatgccaacaatttaattatatgtttgtaaggaacactggtgaaatcatagaaggaactgaaaatcagtttggggaggtgtagtggtccaacttgtaaggaactgaaaatcagtttgtgtaaaatatctgccgagctttgtg

SEQ ID NO: 10584 - DNA, 644 bp, Zea mays
  unsure (1)..(644): unsure at all n locations; Clone ID: LIB3279-181-Q1-K6-C5
gtttgcgcgggcggacaagnagcaggcggaggaggagctgtgccaagccacaatgggtatctcgcgtgactcgatgcacaagcgccgggccaccggtggaaagcagaaggcctggaggaagaagcgaaagtatgagcttggtcgccagccagccaacaccaagttgtcaagcaataagacagtgaggagggtccgtgttcgtggaggtaatgtgaaatggagggctcttcgccttgatactggtaactactcatggggaagtgaagctgttacccgcaagacccgtatcctcgacgtggtctacaatgcatcaaacaatgagcttgtgaggacacaaacccttgtgaagagtgccattgtgcaagttgatgctgccccattcaagcagtggtacctcactcactatggagttgacattggtaggaagaagaaaacccctgctgcaaagaaggataatgctgagggacaagaggttgaggcagcagctgaggaaacgaaaaagagcaaccatgtcacgaggaagcttgagaagcgcaaggagggacgtacccttgacccacacattgaggagcaatttggcagtggacggttgctggcatgcatttcttcccgccctgnnacagtgtgccgagctgatgggtaca

SEQ ID NO: 10585 - DNA, 581 bp, Zea mays
  Clone ID: LIB3279-181-Q1-K6-C6
ctcccggtcccggctcccgctatctttggttctgaagaaatatttggaacttccaaaatttacttgtttgctaatttaggttgtgagtattttttttgatacatctattcaacccctctctagacattgttaattctttcgccactggtagcttactaattaagaataccctttttattttatttttattttgtctatatataaatcaagcaaagaaaggaatatactcaagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggggcccttttaagggaccaaattttccttcccggggcttgcaactaaaaattttttttatggggccccaaaaataaaatacatggcccgggttttaaaaccgctgggaacgtgaaaaacccttgggttccccaaattaaatcgctttgaaaaaaatccccttttcccaattggggtaaatacaaaaaagccccaacccattgccctttccaaaaat

SEQ ID NO: 10586 - DNA, 604 bp, Zea mays
  Clone ID: LIB3279-181-Q1-K6-C7
aacctctaaaatttcccccactcgccagtcgcagcagcacctgtagccatggacgccagcggagccggtagcaaggggaagaagggtgcggccgggcgcaaggcaggcggccccaggaagaagtcggtgacgcggtccgtcaaggccgggctgcagttccccgtcggccggatcgggcgctacctgaagaagggccggtacgcgcagcgcgtgggcactggcgcccccgtctacctcgccgccgtcctggagtacctcgccgccgaggttctggagttggcagggaacgcggcgaaagacaacaagaagacgcgcatcatcccgcgccacgtgctcctggcgatccgcaacgacgaggagctcgggaagctgctggcaggcgtcaccatcgcgcacggcggcgtcctccccaacatccactccgtgctcctgcccaagaaggcggcggagaaggcggccagcgccggcagcaaggagcccaagtcccccaagaagggcgccaagtcccccaagaaggcttagaaagtagggacttcatttgcactgtgtgctgtagcatgctcgtgtctagatctgtggatgggatgtgtcctgctctagtttc

SEQ ID NO: 10587 - DNA, 572 bp, Zea mays
  Clone ID: LIB3279-181-Q1-K6-C8
gagattatgaatttgaagattgaggctattgcagatacaccctcctttgtgttcctttgggttggtgatggtgtaggccttgaacagggtcgtcagtgtttaaagaagtggggattccgtaggtgtgaagatgtttgctgggtgaaaacgaacaagaaaaatgcagctccaagtctgcggcatgactcacatacattgttgcagcactcaaaggagcattgcttgatgggcataaaaggaactgtgcggcgtagcacggatggccatgtcatccatgcgaatattgacacagatataataatagctgaagaaccaaccgatggttcaacaaagaagcctgaggacatgtacaggatcattgagcattttgcgcttggaaggaggcggctcgaactctttggagaggatcataacatccgcccggggtggcttacccttggaaaaaatctatcctactccaacttcaacaaagaggcatacattaggagttttgcagacaaggatgggaaagtatggcaaggaggcggtggccgaaaccctcccccagaggctccccacctcgttgtgacaca

SEQ ID NO: 10588 - DNA, 658 bp, Zea mays
  Clone ID: LIB3279-181-Q1-K6-C9
ctctgctcccggctcccccaggtactccagccgctagcctgcgattccgccagtacgccaccaccaccgagcctggactaccgccgccgcccttcgccgatatcttcagcggcgaacagcgcccaccagatcccgcccctgcgatggagtccgtggtgaacccgaaggcatacccgctggctgatgcgcagctgacgatgggtatcctcgatatcatccagcaggccgccaactacaaacagcttaagaagggagcgaatgaagcgacgaagaccctgaataggggcatatcggagtttgtagtgatggcggcggacacagagcctctcgagatcctgctccacctccccttgttagctgaggataagaacgtgccatatgtgtttgttccatcgaagcaagctcttggccgtgcttgtggtgtgacaagaccggttattgcttgctcagtgaccagtaatgagggtagccagctgaaactacagatacagggtctcaaggactccattgagaagcttctcatctgatctgccgaagacctttcagtgtgatgggcctcatcgacacttttttcagaggcttggactggtgatggtgtcttgtttactttgcgcttttcaaactatatttgaacactggtaagtcgatcatacttgaa

SEQ ID NO: 10589 - DNA, 583 bp, Zea mays
  unsure (1)..(583): unsure at all n locations; Clone ID: LIB3279-181-Q1-K6-D1
cggacgcgtgngaaagatcctccacttcgcactttcgccgccgcctctctccttcccgagcaggaggcggacaaggtaagcagcaatcgcaggaaccctagcgccgccgcacccgcaggaatgggtatcgacctcgtcgccggtgggaggaataagaagaccaagcgcactgcgcccaagtctgacgatgtctacctcaagctcctcgtcaagctctaccgtttcttggtcaggaggaccaagagcaatttcaacgctgtcattctcaagaggcttttcatgagtaaaaccaaccgaccaccaatctccatgcgccgccttgtcaagtttatggaaggaaaggagaagaacattgctgtcattgttggcacagtcacagatgacaaaaggatccaggaggttccagcaatgaaggttactgccctgaggttcacggagacagcaagggccaggattgtcaatgctggtggcgagtgcctcacatttgaccagcttgctcttcgtgctccacttggcgagaacacggtcctcttgaggggccccaagatgcccgtgaggcagtgaggcactttggcaaggctcc

SEQ ID NO: 10590 - DNA, 618 bp, Zea mays
  Clone ID: LIB3279-181-Q1-K6-D10
cggaaacccccgggtcgacccggcgtcctcctcagtcttcgagtcctcgttgtgccgtgtgttgagctcctcgcgtccatggctcctgtgcgaggtgccaagaagaggaagcggccggagaagcccgccccggcgcctactccagggttgccgctgccgccgctgccggacggtagcgattggtggggcgtcttctaccgaagggttggggggggggcccctttttcatgagaacaccagaacatggagtctgtcctgaagatgtcaagaagaaccttcgactacatctgctcacttgttaagaaggacctgacaacaaagacatacggtttcagaaacttcaggtttggtgacaagaaagtccttggggtggaggatcaggtggcggtggctctgatgaggctgactactggtgagtcgctgcagaacataggaatgtggtttggcatgaaccactctgccatctcgaacatcacatggcggttcatcgagtccgtggaggagcgtgccatctgccacctgaaatggccgagccctgaggagatggcgaccatcaagacaaggtttgacagggttaccggctcccttactgctgcggcgccattgacaccacacaca

SEQ ID NO: 10591 - DNA, 165 bp, Zea mays
  unsure (1)..(165): unsure at all n locations; Clone ID: LIB3279-181-Q1-K6-D11
ctttcaaaaaaaaaaaagagggggggggggggggggggggattaaaaaagggacgagtggtggcatgtgaagatggtgaagttcacggttgtnnatctccctgccatcatgtgacataaagtaacancattcgtnntatgtctgttattgctcatctataaccat

SEQ ID NO: 10592 - DNA, 610 bp, Zea mays
  unsure (1)..(610): unsure at all n locations; Clone ID: LIB3279-181-Q1-K6-D2
gtcagtgccacatcagtggaaaaatcctttgagtggaatcagaaggctaatttggccagtttcagtagttgagggctgttggatgtcagtattatacttcagtggcagtttgagggtgtaaaatgtgctttaccctagatttaagacaaaattagaaaacatgtttttccagagagtgaaaataagatttcatcgactttcctttcctcaacattttcactttacgtttggaagaactgttgcttcggtttctagccagtatggtaaatatgataggatcgccttacctattatgagttctcctaagaccgtatccagcagtttacccatagtttaccaaaatcattgatttacaatgttctgcactgtagacttcactgttcatagagtgaatgggtatgaggatgaataagctattgaagatagtctaagtgattagaaaacttctgttgattttgacctttagtggtctgtgcatccttcagttagttgtaaggttgtttcataatgtcacatggaactgcagttaatcaagataaatttgaaaaatataggaacttctagnaagtaccatttttgcaggtaattgtggggaaacacccagtgtcct

SEQ ID NO: 10593 - DNA, 543 bp, Zea mays
  Clone ID: LIB3279-181-Q1-K6-D3
ctcacgcttacctagctctttgcgtccgcgcctgcgcatcgacctattggcatggtgcactccaccatcattgtagcctgttggattgacggcgtgctggcgctcactcttgggtggcacggccagagcatccggtccctggaacaagtcgtgcgtgatggggcgcacctgcgccagcgtggagcagtggctacggtggcgcaagcaccagcgccggcactggcggggcccttggcgccgacaccttccggtagcaggtgcgcccgagccagggacgacattcgcgcggccgttgagagggacgcggatggcaacccacgcatgggagcctatgtgatgatcctccatgtccatgactggttcgtcaatggctgccacggctccgttcttctggaccagaagctgctcttcatcgactagaagacggatgtgtgcaacggctactcacttatgggctacaaggtcatttacatcatcaagaccaagcttgagcgcaagtgcccatatacaaggggctgtgaggacctccttgccatcgctacc

SEQ ID NO: 10594 - DNA, 628 bp, Zea mays
  unsure (1)..(628): unsure at all n locations; Clone ID: LIB3279-181-Q1-K6-D4
gatcgagccgccgtgcctgaagcgaccggccaagggcagcacatcgagcgcgggcgaggaggggttggattcagacgccgaataccaggaggcagaggaggaggacgagatggagacgccgcgcccaaagcgaccggtgaagggcagcacatcgagcgccggcgaggaggggttggattcagacgccgaataccaggaggcagaggaggaggaggaggacgacgaaatcgagacgccgcgcccgaagcgaccggcaaagggcagcaacagagtacggaaaggaaaggttgatctggccgccgcacgatctcgacgccggaagtatgaggaggacgaggactacgaggaggaggttgacgaagacgacgaggtggaggaggagtaccatgatgaccttgaggaggccgatgaggaggaagaagtggcaccacaacggccgaagagcattgtgaaatgcggtgcccgtggccggaatgtgaagctgtctctggcagcgaagcgatctcatcagcggaagcaggaagatgatgaggacatggattntgacccagagttggatgacgaggaggtcgagatagatgangatattgattntgatcccgatgtcgatggtgacgaggaggatgag

SEQ ID NO: 10595 - DNA, 385 bp, Zea mays
  Clone ID: LIB3279-181-Q1-K6-D5
gccagtacggggtccggagcatccccaccacgatgatcttcaaggatggcgagaagaaggattcggttatcggggccgtgccagagagcacactggtcacatgcatcgagaaatttgtcgagaggtagaatgcgtagtggatctcttgagcggtttcctttaaatcaaaaggtcatttcgagaccacttgggccatacagaacaattctataactgcctctagatgatgggattatatgtatattatatactctgttattattgtttgaagaaagcggcatgaaatttgtgtccaaaaaaaaaaaaaacaaaaaaaaaaaaaaaaaaaaaaaaaaaaaaaaaaaaagaaaaaaaaaaaaaaaaaagggggggcgtttttaaggga

SEQ ID NO: 10596 - DNA, 667 bp, Zea mays
  unsure (1)..(667): unsure at all n locations; Clone ID: LIB3279-181-Q1-K6-D6
gaggaggagacccaccgtcggctcgcccgtgtcccgattcccactcacgacatcaacctgtccccatccatctcgcccgcgacgtttgatggagtctctcctcgcctcgcgatccattaggtcttccttctccgccgtcgccagcatcaggggcgccgcttcccccaggccctcgcgcgtcgccaccctcgccagcgcctgcgccggcgcccgctcccgcgcgctccgtgctggccacacggactcaatccttgaggtgctggcacaggacgatatgctgaacgcaaaggagctggtccaatgggagaatggcttgtcattcaatgacatagcggctaggcaggggattcgcatccgcagacactgccgccccactgcctccttgaaggagatagaggaggagctgggagccccccttaacatcctagagaagatcatttgggacaaggagattgaagtagctgaggggcatgctaagaagcctcttgaggaggtgattcaggctgcaacgaaagcccctccttcaagagacttctatggcgctttagaagctgcctacaagcgtaatggggtgcctgcattgattgctgaggtcaagaaagcatccccgagtaggggtgtgctcagggagaactttaatcctgttgnaaatgctcaagcttatgaa

SEQ ID NO: 10597 - DNA, 579 bp, Zea mays
  unsure (1)..(579): unsure at all n locations; Clone ID: LIB3279-181-Q1-K6-D7
ttgtgacgcaggatcagcttcaggcccttggcggcctcggactcggagggcctcgcagccaccagaaccctccgcttcatcgcgtggtggcggctgttgtagtagttctccgccagcgcggacgcgtccaggcaggaccaggccgacccccgtggggcgctggccgcccacatgaaccgcctggaggacgggtccacgagggactcacggaactccttggctccctcgcatggcaggccctgcgccgcgtgcaacgcaacacaaccaggttcagttcgaacgcacacagcaagcagggtgccagggtttggtggttaccgtactaacctctgccatggctttgatcttgagcgtgacgctgttggacagcacgacgaccttctcgttgctccggaccctactgacgaggagggcgcagtcgaggacgcggtcctcgggtctgggagatatcatatccgcgagcgcggcggagcttcgagggccgaacaacgccatcatcgggttgaaggagccggagctgatctcgatctcctcgtcgatgcgctgcgctngaagggtcgcgggcggggttggtgctac

SEQ ID NO: 10598 - DNA, 544 bp, Zea mays
  Clone ID: LIB3279-181-Q1-K6-D8
gttcttgcagcctggagcatatgatctggttggttacatagtgtatgagatcgaccagcacccttaccagaatgtattctacaatggcactatcgaggttgttgaggctggaggcttactcagtgttgagtctgtgttcctcatcacccttggatttgcacttcttggtctgtttggattgtgggcatatggccaggttcagcagctctcgaagaaaacaaagaaggcacccaaggtggagctcggaactggaacaactgatgccaacatcgatgagtggctggagggcacttcgtttgtgcagagaagcaaatccaagaagaagcagacctgaggctctccaggctagttaaatccttttgaggatctagaatgagacatttgagggtagcccttcacaagtgacttttgcagaaagatagatgcgtaaggaggtgctgaaaaccgtaaacatcttcgttgacattttcgaccttgtgtactttacatggaacaaaattttgttaaaagaaatatatgctgttgccgctgtggtttctgatct

SEQ ID NO: 10599 - DNA, 380 bp, Zea mays
  Clone ID: LIB3279-181-Q1-K6-D9
cccagcgtccgaggatccccaatcctgttggtcccctcaaatataaaactgaggagcgtcatcaaaagcaggaactgaccccagcaccagtttttccgcttattgttggagtttctgtggttgcactggtgatcagtatgccaaggttaaatgacttataccagagcgctgtagggatgacttctctgggttcagggatggcaccgaccaaaaaggagccacgcaagaatatattaagaaagagagtgtaaatggcatattagcttagccttaggggtcgagaaatgagacatgacaaattgagcaatttcaacagtggaatagcttctggtttccccctcgggtaattttgccgacgaaaaggaatgccagttttgttg

SEQ ID NO: 10600 - DNA, 625 bp, Zea mays
  unsure (1)..(625): unsure at all n locations; Clone ID: LIB3279-181-Q1-K6-E1
cttacaacaatttcatatgactgcaaagaagcacctgttattcatgaatggacctatgatgcaatgtgccatgatctactcgaaatggatggcaacaaatacatttatgaggtatcaaagatgggttcggaacctgaaaagaaggaatctttattagaggatcatgatcctctttggcttgaacttcgccatgctcacatagctgatgctagtgagaggttgtacgaaaagatgaacaattttgttgccaagaataaagcagcacaactttcaagatggtggtgaagtctcaacacgggatctgcagaaaatcgttcaagcattaccccaatacagtgatcaagttgagaaattgacgctacatatagagattgctggaaaaatgaacaggtgtatcagggagtatgggctccgtgatattgggcaattggagcaggatttggtttttggagatgcgggagcgaaggaagtcatcagtatcctcaggtcaaagcaggatatgagcccagaaaacaaaatgaggttgctgattatatatgcaattgtatatccagagaagtttgaaggtgacaaaggggaaaaagtgatgcagntagcgaagcttccacatgatgatatggatata

SEQ ID NO: 10601 - DNA, 662 bp, Zea mays
  Clone ID: LIB3279-181-Q1-K6-E10
tttttttctcaaaccaacctaggcaattcgccgcagcctctcaccctcgcgagtcccgacctcccgcagccgtcgcacagatggcacccaaggcggagaagaagccggtggccaagaagcctcgcggaggagtgagcgccgacgacagcagaaggtggagaaggctccggcggggaagaagcccaaggccgagaagcgcctcccggcgggcaagtccaaggagggcggcgagggcaagaaggggaaaaagaaggcgaagaagtccgtggagacctacaagatctacatcttcaaggtgctgaagcaggtgcaccccgacatcggcatctcgtccaaggccatgtccatcatgaactccttcatcaacgacatcttcgagaagctcgcggccgagtccgccaagctggcgcgctacaacaagaagcccaccatcacctcccgcgagatccagacctcggtgcgcctcgtcctccccggcgagctcgccaagcacgccgtctccgagggcactaaggccgttacgaagttcacctcgtcttaggatccttgtaatggtcatgtgggcgtccgcggtaggcgtggctcagtttatgtgatactgctagcgatggatgatgatgatctgcgtgtaatggaattaaagaatgtgctgatctttctac

SEQ ID NO: 10602 - DNA, 611 bp, Zea mays
  unsure (1)..(611): unsure at all n locations; Clone ID: LIB3279-181-Q1-K6-E11
ctccaaagccactcccaaacccccgcttccagaaccttctcgaagctccccgccgcctcctccactcgcaccgatggcgaaggaaccaatgcgcgtgctcgtcactggcgccgcaggacaaattggatatgccctggttcccatgattgctaggggtgttatgcttggtgcagaccagcctgttattctgcacatgcttgacattccgccagcagctgaagcccttaatggtgttaagatggagttggttgatgctgcgtttcctcttctgaagggagttgttgctacaactgatgttgtggaagcctgcactggggtcaatgtggccgtcatggttggtggattccccaggaaggagggaatggaaaggaaagatgttatgtcgaaaaatgtttcaatctacaaatcccaagcatctgcccttgaagcccatgcagctcccaactgcaaggttctggtggttgccaacccagcaaacaccaatgctcttatcttgaaagaatttgctccatctattccagagaagaacgttacttgcctgacccgtctggaccacaacagggctcttggccagatttctgagagacttaatgtncaagntagtgatgtga

SEQ ID NO: 10603 - DNA, 507 bp, Zea mays
  Clone ID: LIB3279-181-Q1-K6-E2
gttgtgttagggtttcgtctcgtgtataaggcgttcggagctcgcaaatcctttcctctctcgcgttcgaggctaggtagccgtcaccatgagccgctcggggcagcctccggatctcaagaagtacatggacaagaagcttcagattaagatgaatgcaaaccgtgttgttatcggcacacttcgtggattcgaccagttcatgaatctggtggtggacaacattgtggaggtcaatggaaatgacaaaacagatattggaatggtggttatcaggggaaacagtgttgtaatgatcgaggcactggagccagttgcgaggtcacagtgaatcattgttctttagcactagcagcgtgaaaactgatgtaaaagatatcagtggaccctgttgtatttgactaatgcttttgcacagcaacataacttcggaggtggaatgtctatccctttttctatgggatgcttgtagctatacaatcatcgagctcttaaattacatgatct

SEQ ID NO: 10604 - DNA, 582 bp, Zea mays
  unsure (1)..(582): unsure at all n locations; Clone ID: LIB3279-181-Q1-K6-E4
gcggttggtctctgggctggcctagtcattggttttgttactgagtactacacaagcaatgcctacagccctgtacaagatgttgctgattcctgcagaactggagcagctactaatgtcatttttgggcttgctttgggttacaaatcagtcattatcccaatttttgctattgcgtttagtatcttcctcagcttcagccttgctgccatgtatggtgttgctgtggctgctcttggaatgctgagcaccattgccacaggtcttgctattgatgcatatggccctatcagtgataatgctggaggaatagctgaaatggctgggatgagccataggattcgtgagagaactgatgctctagatgctgcaggaaataccacggctgcaattgggaagggttttgccattggctctgcagccttggtttcccttgcactatttggtgcgtttgtaagccgggctgctatctccactgttgatgttctgactcctaaagtattcatcgggcttattgtncgtgctatgctcccgtactggttctcggcaatgaccatgaagagtgtgggcagtgctgcgctc

SEQ ID NO: 10605 - DNA, 462 bp, Zea mays
  Clone ID: LIB3279-181-Q1-K6-E6
ttggcaacctgtatgggctccaaagtagaataaatgctcatttgaatggtcaacctccacaacttcgctagcgtctgatgacgtgctatcgcgctgctctatatcttctctacaagagatctacctctatactacttgttctggattatatggggtcataccaagactgctgatgggcatcaacacggctcttacccgtatcaaggagcctaatctctgcgtgctaaaaattaacgcatgctgggttgcatctattgctgcattgatatccattatcggaagcatgaagatcacgactttctgtcgcacctcccacaatacgctgtcggcctggacctatctgtatctacctggggagcttgcaaaacacacttgagaccaccctgaatggcgatccatctgaggaggcctccaatgcaaccttctatcgtgaagccgccagagcatccatctacccaatag

SEQ ID NO: 10606 - DNA, 453 bp, Zea mays
  Clone ID: LIB3279-181-Q1-K6-E7
cccacgcgtccgcccacgcgtccgcggacgcgtggggtcgacgagctcgcggaggtcgcaaggacatggaaggtagaggcgatgccaacgttcgtgctggtcaaggatgggaaggaggtaggccgtgtgattggggctaagaaggacgagcttgagaggaagatcaggatgttcgtcacgtcatcttcctcgtcctaacttagcagtgcatacactcccaccttctctggtttctcgactccagtggttcgcctgggacggggttgctgaaatggttcccttctctgaatactgaaaaatcaaaaaaagaagtatatgaaaaaatgatggtagacgtgtctgggtcaataagagtttctgaaacttggatttgtatgtgtcagtctctgtgttctgtttccaaggaatggatcatgtgagtttggaatatagctggaaatatgttgtgctgtt

SEQ ID NO: 10607 - DNA, 635 bp, Zea mays
  Clone ID: LIB3279-181-Q1-K6-E8
cccacgcccgtccgcgaaaatcaatatgtcaccatacagcagatgttcatgtatacagggaatttgtgttgcttggttccggatttctaccatcatctgaagaatcgggtgattcacatgttagtggagagtttgcggcttttattagtgcacttcctcagcaagaagcagaaacttcgaatcaatcatcttcacagaataccagacaaaaaaatttagcaccaactggctgtggttgccccccactgggaaacttccagcctagttctgcttcagccaatgttattgcagtacttcctgatggcttccatggcaaatcaacgtctgggcagccgttgcctttgattgagaggtggaagtcaggaggagcttgtgactgtggcggatgggatgaaggttgcatgctgagtgtcctcactgatgcggccgaagaaaatgatgccgttcaggctaaccaggcaaaggatggcagccagcgatttgaacttctagctcagggtggatcacgagaagataggcatgccttcagtatgacttcattcaaagaggggctttatacagtggaattcagatcatccattgcattacttcaagcttttgcaatgtgtatagtgatgctacatgggaggtaccct

SEQ ID NO: 10608 - DNA, 572 bp, Zea mays
  Clone ID: LIB3279-181-Q1-K6-E9
gttagctcggcgcgtggaagccgctcggcattagcgctcgcaagcgcgcccgcctccgcaaggaggtgctcctcgccggcgaggactggagctacgatcctccccgcggggagatgcgtaccaagcgcaagggccacaagtgcgaccgcatctccgccgagaagcgagcaaatactgttgagctgatgaagaagatgccccagatgctgctcgactacaagaaacgtaggtgggagaagaagatgaaagtggaggagagcggcaagaattgataccacgcggctcgtccagggtgcttctcttcctaaataaggtccaaactttatccaggagttttgcaggacggctagattctgacgcgtcattcccttggtggattccttctctcctgtgatgcgactttggacgcactatcctgattgtgatgctttccaacacttgtgccactggatcgtgatttcagtgagccccaacttctgcagcactagtattttgttgagacaaatcagctataagcatgccatctgcccaataaacttgttcatcatgtaagatcaatgctgttagttttt

SEQ ID NO: 10609 - DNA, 578 bp, Zea mays
  Clone ID: LIB3279-181-Q1-K6-F1
ctggacgcttgccttgctgaggaccctgacagcaaggttgcttgcgagacctgcaccaagaccaacatggtcatggtctttggtgagatcaccaccaaggccaatgtcgactacgagaagattgtcagggagacatgccgcaacattggtttcgtgtcgaacgatgtcgggcttgacgctgaccactgcaaggtgcttgtgaacattgagcagcagtcccctgatattgctcagggtgtgcacggccacttcaccaagcgccccgaggagattggagctggtgaccaggggcacatgtttgggtatgcgactgacgagacccctgagctgatgcccctcagccatgtccttgccaccaagcttggtgctcgtctcacagaggttcgcaagaatggaacctgcccctggctcaggcccgatgggaagacccaggtgacagtggagtaccgcaacgagggtggcgccatggttcccatccgtgtgcacacagtcctcatctctacccagcacgacgagacagtcaccaacgacgagattgctgctgaccttgaagagcacgtcatcaagccagtcatccc

SEQ ID NO: 10610 - DNA, 158 bp, Zea mays
  Clone ID: LIB3279-181-Q1-K6-F10
tgtttcgttgatttgttcgaagtgcccccaagtccatcagatgcaaatatgagaaactggtcgtgtggttgtagtggttgcacactgattgatggttctgaacttagtattggcttgtgaaaaggttcacggaggcgaaatctagttctagatcgcga

SEQ ID NO: 10611 - DNA, 379 bp, Zea mays
  unsure (1)..(379): unsure at all n locations; Clone ID: LIB3279-181-Q1-K6-F11
ggggggggggggggcncaaaaacggagcgggccggccgccgggcgaggngcgcgnaccngccgncgancgncgccgggaccaaccaccangggcggcggcaacggccagaagnccaaagaggcccgcgagcgcaacaaagaaaaaaaaagggggggggggggggctttctcctttcaccaacangaaggccangagcagccaggggggaggngcangcccaccccccgngnaccacgacngaagngaagngcagggagcacgccgaggccaagcancccaagacagacgngcaccagngcnncccccanccgaagaagggaaaggccngaacnnagcaaccagngcnnggccggccaggggggcgcccnggggcggagg

SEQ ID NO: 10612 - DNA, 579 bp, Zea mays
  unsure (1)..(579): unsure at all n locations; Clone ID: LIB3279-181-Q1-K6-F12
ccccgggnncgacccacgcgncctttttggacgcgggcggccaccaccccggggggggggggggggggcanagcaaaacaaagaaaccgcngggcgcggagggagccagcgnngaacaggggaacggggaccanaacggnagaannnaaaagggaaancccaacaaanncnncngggaccacagggacaaaggggcaacnggccaaaaccccnnaagaggacgggccgacggggcattttttttttttcnaaanaaaccnaagggccaanccagccgaaccgagcnagcnagacgcancaacacnnagcaaccggcagggangaaccggggcnggaggaagggggagacacaagcancgcggcancagcacccgaaaggccgncaacggcagggacgagcacaccngcgacangaacagcagcaaagggggcaccaaccgngcgagnncaaggcannngccncnaaaagcaccccnngngcacaanggacggccccggcncancanacccgcccnngggcacangcgggggnngagggaaaacgaccnnagccaanancgcaccacccaaccaggccga

SEQ ID NO: 10613 - DNA, 551 bp, Zea mays
  Clone ID: LIB3279-181-Q1-K6-F2
gctacttgaacctttataccaacctggtacacaatggggaatggaatagtgaatggagatggggttggtgatgaaccgtgcaatgaaactaccggtgagggtacatgaaccaggcgcatagaacgagacgctgactgtgggcttacatttcatgattactgacgtggtatacaaacgaggagatgcatgagggcattcaagaccgtgatgaatctgttatggatattatgagggatatcatgtgggctactatcggtgatactctgggttttatgttggattcatactcatgtttcaaacacttctttcatgacttatgcgctcgcacaatggctgaccacattgaccctgaatatgacccagctatggagactgctatcgagactgatactgagtggaatcttgcgcaaaacctactacagaagattcttaaaaaggtcctaagaatggttcacctattactaaaactatcgactgtgccagtgactgtaacagtttctataactctttcgatcctgcagatgatcatgacattgatgatgacactgatg

SEQ ID NO: 10614 - DNA, 490 bp, Zea mays
  Clone ID: LIB3279-181-Q1-K6-F3
cggacgcgtgggctcgtccgtgagatcgcgcaggacttcaagaccgatctccgcttccagtcctccgccgtcgccgcgctgcaggaggccgccgaggcctacctcgtggggctctttgaggacactaacctctgcgccatccacgccaagcgcgtcaccatcatgcccaaggacatccagctcgcgcgccgcatcaggggagagagggcctgagcgaggcgagctcctctcaccgcaggcggcgtcgttgttgcttcgggcctgcttgtaggacttgtgcttctcttggtttcctttctggtggcagtggcatcttggtaccattgtgcttgttcttagaatcttagggatagagagttgttcagttgctgggtaacctgattgtttatcttgcattcctgcctctgtaatggttgtctgctgtcttaatggaaatgatatttgctttttaaactgagaattaacccacgcgtccggttctagatcgcga

SEQ ID NO: 10615 - DNA, 563 bp, Zea mays
  Clone ID: LIB3279-181-Q1-K6-F4
gttatctcctctcctagcaacacatcaaccaagttcagcctgcggatggctcggacgatgaccacagcaacgccggcctctaaccttgccttctggcataaccaggatctgcatggtgcttcaacagaaacgcgggatccaatcctatttcctttatgacctgaggtgacatgcccatggcgttcataactatctataacggacatgctcatgtcttctcatttgataccgtgacgtactaaatatttaacctggggctcccacactgggatgctacctgcggcaaagaacattggaggcggggggtgcccctactcatggcactgtgaggtatgaggatgtgccacactacaccgaattgaacactggtgataggactcaggacttggaggctatgatggctgagcccacatggcacaatgaggaatattctgattgggcctgtgttcagagaaccaatcatctgcaaaaacatcccacggcttgttccagggtggacaaatcccatatgcatctggaggcatgcattcggtgatcagtaccgggcaactgatgcagttatc

SEQ ID NO: 10616 - DNA, 657 bp, Zea mays
  unsure (1)..(657): unsure at all n locations; Clone ID: LIB3279-181-Q1-K6-F5
tcacaaccccactcaaccggcaggnaggccctcttcgtcggcggaggccatggtttccctcaagccgcagaagaggctcgccgcgggagtcctaaaatgtggcaaggggaaggtgtggctcgaccccaacgaggtctacgagatctcgatggccaactcgcgtcagaacattcgtaagctggtgaaggatggattcataattaagaagccacagaaaatccactcaaggtcccgggcaaggagggcccatgaggccaagcagaaggggaggcactcgggttacggtaagcgcaggggtaccagggaggctaggctccccaccaaaatcctttggatgcgcaggatgcgtgtcctcaggcgtctgctgcgcaagtaccgtgaagcaaagaaaatcgacaagcacatgtaccatgatatgtacatgaaagtaaaaggaaatatgtttaaaaataagagggtactcatggagagcatccacaagtcaaaggccgagaaggccagagagaagactctctcggatcagtttgaggccaagcgggccaagagcaaggcttcccgtgagagatagatcgcaaggagggaggagagattggctcagggccccaagggaacctgcgcagcaccagtatcagctactgctncngctgcagctgcacc

SEQ ID NO: 10617 - DNA, 662 bp, Zea mays
  unsure (1)..(662): unsure at all n locations; Clone ID: LIB3279-181-Q1-K6-F6
cccggngtcgacccgacgcgtccttttttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctggagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggcgggtacggtggtggccgtggaggcggcggctacggcggtggcgggcgccgtgatggcggcggcggctacggcggtggcggcggctacggtggtggcggcggcggctacggtggtggtggcggcggctacggcggtggcaaccgtggcggcggctacggcaactccgacgggaactggaggaactgagcggtggggcccgcgcggccaagttatcctgttcgctaccgtgttgtttaccctagtccagagtgtttatcttcgttcgtctcgtg

SEQ ID NO: 10618 - DNA, 605 bp, Zea mays
  unsure (1)..(605): unsure at all n locations; Clone ID: LIB3279-181-Q1-K6-F7
actagttctagatcggagcggccgctcgcccacgcgtccgcggacgcgtgggctgccttctataagagcttgacaaatgactgggaggagcatctggctgtgaagcacttctctgtggagggtcaactggagttcaaggctgttctctttgttcctaagagggccccctttgatctctttgacaccaagaagaagcaaaacaacatcaagctctatgtgcgcagggtgttcatcatggacaactgcgaagagctgatccctgagtggctgagcttcgttaagggtattgttgactctgaggaccttcccctcaatatctctcgtgagactcttcagcagaacaagatcctgaaggtgatcaggaagaaccttgtgaagaagtgtgttgagctcttctttgagattgctgagaacaaggaggactacaacaagttttacgaggctttctccaagaacctcaagcttggcatccacgaggactcgcagaacaggaccaagatcgccgagcttctgagataccactccaccaagagtggtgatgagctgaccagcctcanagactacgtgaccaggatgnnaagaggacagaatgacatatactatat

SEQ ID NO: 10619 - DNA, 618 bp, Zea mays
  unsure (1)..(618): unsure at all n locations; Clone ID: LIB3279-181-Q1-K6-F8
cggacgcgtgggtctgtacaccctgtcattgccggctccgtcggccgtcttcccgaggatgctgcggctgcgctggcgtgccgtcctccccccactcccactccctccgccgcctggcttgcttcgccgcctgcctccgcaccggcgcgccctctcgtcctcttccggcactatcccgcttccaccgccggtgatggaggcttcctacaagtttgggccctacaaaatcgacgccagggaggtcttccacgccacgcccctctcctacgccatggccactttctattgattgctcactgcagtatagttcatgaaactttacttacctttgtgttggttctcttctttttagacctggttatcttgtctgtctagggaggatcaagtttgctttaggtactcatttagtgagggctctgttttgttgagccactgacttcacttcatatttggttcatctttccatggagaccatctacaattctatgacatgattatttctttttcacatcatgcaacagttccacttccagaatgattgtatgcctgcaactcaagttgactntgtgaatcaatttctactgtgttgtcattcggggcagagctgtcataactcat

SEQ ID NO: 10620 - DNA, 647 bp, Zea mays
  Clone ID: LIB3279-181-Q1-K6-F9
ttttagttttccatgctctacatattgtatcaaattgttgcatggatgaggtttccatgctctctagattgatgtaaagatgaaagttaccttacctggagtacatgatgcctctggatttttctagctacttatcagtagcacattgtataccgagatgtgtttgtgatgttattttagtagtgtgataagtgttgtctgttatgctcttaaatggaggcatttgaccatccaatttagcttttctatgtgaagtcaatgaagcagaacctcttttttttgtgtgtgcacgtaatgtacctgggccttgtaaagtacggagcgtttgggattatgtcggtttacattttgttttgctctttacattacagaaccacggcaatcctacgagccataaaccagagctagtactgaacaatttcactacacgccttggtcatcgtgttggaaggatgatccagtctctcttccctcaagatcccaatttccgcgggcgccgtgttgtgaccttccacaaccagcgagactacatatttttccgccatcacaggtgggcatatcgaaatgcagtcaggagttaactttgtccggcgaggggtgcctgggtatatgggtgtatgtatagtctagttatctggggcctgcct

SEQ ID NO: 10621 - DNA, 615 bp, Zea mays
  Clone ID: LIB3279-181-Q1-K6-G1
agcgggatctcttgatcaggcagattgtggagcagacagagggcaatgacaatttgctggcaatgatgaaggaccagtatgcgaattacgtggtccagaagatactcgaaacatgcaatgagaaccagcgggaactcctggtcagccgtgtcaagggccacatgcaagcattgaggaagtacacatacggcaagcacattgtaagccgagttgagcagctctgcggcgacggaaccgccgagccggattcttgaaatgaacccgcctaattcttcccaggccaggggtgtgagggtgtcttgttcttttgctcagtccatcagtggagaaagcagaacagatcaagtccacctctggtgcttccaaacagactaacaaaactgtcatcgaagattgtataggtgtgactcgcttcaggatagtcttgaggttctagaacaggaacttagtggtgtgcatcagtgtatctatgttagggtgtgcctatttacagaataacagtggttggctagctgtgtgcagaaaggagtttagcgttatggtttgtatgtgatacatattatgcctggtaatgtatttgctttcttgcatcgccaagtgtggggtaaaatgcat

SEQ ID NO: 10622 - DNA, 628 bp, Zea mays
  unsure (1)..(628): unsure at all n locations; Clone ID: LIB3279-181-Q1-K6-G10
tttttggacgttttccattaggccttccaatgtcttcataatcccctaaatagacttgtgaacaatggacaagcatgtctaaattttcatgtctgaacctatgtgctgcttgttctgttcatactactaggcctatgagtattaatttttatttgattggattagatcaagactctcactcccctgttcagattaatactaaattttatttgatttgattagatcggattggttgggtgtgcatttgttgcagctcgagctgtgtgtgtaattgatgcagctggttcgcttaatttactaatgacctcgctcgttacacttgatgctctgcagtagattaaaggagccctagctttcggaggacaacccagatgccttcaaagttcaaaatgacggtgatgaaggtggacaagaaacaaaattttggatggttcaaaattttgctataggtcctagcaacgcttatgtgttgctataggggggttattttgtagtgaactcccaggccatatgctagcttactttgaggagtgcccactatttgtgcatgctacaggcgctatcattacatttccatgacctgtaaagtggtgacatctntaaatacagaatgaccacattagcgaac

SEQ ID NO: 10623 - DNA, 349 bp, Zea mays
  unsure (1)..(349): unsure at all n locations; Clone ID: LIB3279-181-Q1-K6-G11
ccgccgagnacaanagngannccccggggcacccacaccaaggagnncancaccaccagccccancaacgacnacaanggngaagaggnngncnncnacgcgacggggggggggggngcttttttttttttnaanagagnaccacaccaaccaaaagggggggggggggccacnagccccaacgganagccnannangncnggcacnnagggagaccgaagcnnnaagggcaagnnangcacnagagngacnacaacagggaagggaggccnnccaaggcaagaaagngcncgnngncggnngnganaacaccnnnccaaaanaaaggggcacgccnacanngggnggg

SEQ ID NO: 10624 - DNA, 623 bp, Zea mays
  unsure (1)..(623): unsure at all n locations; Clone ID: LIB3279-181-Q1-K6-G12
tatgttacgtctgctcaataaatccgcggggtggggggggcttggtgaagcaatagataggacattacttagtcatcttctgaagatgcttactgctcttggaatgtattctgagagttttgaaaaaccctttcttgaatgtacttctgaattttatgctacggaaggtgttaaatgggggcggcaatcngcttcccttatacctgaagcatgtggagtcgaggttgcaagaagaacatgaaaggcgtattctatatttggaagctaacacgaggaagccactgattgcaactactgaaaagcaattgctagaacgtcatacatctgccattattgagaaggggttcactatgctcatggatgccaatcgtataaatgacctctcgaggatgtacaaccttttccagagggtgaatgctgttgagctgctaaaactagcgcttagttcatatatccgggctacaggccagggcattattatggatgaagaaaaggacagagaattggttccatttcttcttgattttaaggcatccctcgacaaaaattggaagaaattttgccaagaacgaggctttctccataccataaaagatcatttgagcaccttatcaatctacgac

SEQ ID NO: 10625 - DNA, 630 bp, Zea mays
  unsure (1)..(630): unsure at all n locations; Clone ID: LIB3279-181-Q1-K6-G2
gttgtggcggcggagcaaacgcaggcgaaggcgagggtgtgagggaaggagcaccagccatggtgcacgtcaacttctaccgcaactatggtaagacgttcaagaaaccaaggcgtccttatgagaaggagcgtcttgatgctgaactgaagctggttggtgagtatgggctgaggtgcaagcgtgagctttggagggtccagtatgcactgagcaggatccgtaatgctgcaaggcacttgctcacccttgacgagaagaacccccgtcgtatctttgagggtgaggcacttcttcgccgcatgaaccgctatgggctgcttgctgagggtcagaacaagcttgattatgttcttgccctcaccgctgagaacttcctcgcaaggcggcttcaaacacttgtcttcaaggctggcatggccaagtccattcaccatgctcgtgtcttgatcaagcagcgtcacatcagggttggcaggcaaattgtcaacgtcccatcattcatggtgagggtggagtctgagaagcacattgacttttcactgtcaagcccattcggtggaggcccccgcagaagggtgaagagaaagaatcagaagaaggggcagcgtggcggngatgcctgtgatg

SEQ ID NO: 10626 - DNA, 617 bp, Zea mays
  Clone ID: LIB3279-181-Q1-K6-G3
cccacgcgtccggtccatccagtgctgtagaattttctttggtctgttggcaaggcagccatgaaaccccctcagctgccggcaggggagggggcctcctgggctcacgaggtcaagcaggccctccgtgagaaactccggcgctcctacggcgccggagctgcctccgccacaccggaggccaggccggccggcgaaccaagccgtggcgctgagtgccgcggctcggcggccgaggaccccataaggagagtcatgttcttggctccctggggtcacacataagaacacaaaccggccggccgagatctgggcatgcaagcttgcatggccatgtcttggtcagtcagatctgcaaacaaccaaactgtaaaaaagaactggagcctgtcttgtaaatcatggagcttgctgctgcttgcacccatgaaaaacatgaacgcatggagagctggttaactagctaggtagatagatatatcatatatgggtatgatggtgtggatgagaataaaaaacaagtacgtagtccatgtctctggtcttggggagtggctgtgagcctgtgagatcctgggaagttcatgcatggcatgagtcatgggtgtggtgggctc

SEQ ID NO: 10627 - DNA, 516 bp, Zea mays
  Clone ID: LIB3279-181-Q1-K6-G4
catttccttccttgtgaagcagttcggcaacggcaatgccaaggtgcagttcaccaaggagccgaacaacctctacaacatccactccttcaaacactcgggtttggcgaacaagaagactgtgacgatccagccagctgcaaaggactcggctgtggtcctctctactaccaagaccaagaagcagaacgcacctgcgaagctcagccacaagtctgtgatgcgcaaggagttccgcaagatggccaaggctgtgaaaaaccaggttagtgacaactactacaggcctgatctgaccaagccagctcttgctaggctaagctcggtgtaccgcagcctccaggttgccaagtccggtgtcaagaagaagaacaggcagtcctaagcgctaagtttgtgttctgtcagggggcatgttggtgctcgtagtcccagcttatatttatctatgttccaacagttgagacttgttagaactgagcaaaccatgttaagatgctgctgtgtgtcattcct

SEQ ID NO: 10628 - DNA, 490 bp, Zea mays
  unsure (1)..(490): unsure at all n locations; Clone ID: LIB3279-181-Q1-K6-G5
cgtccgnaaccaaatgtcaggcagtaaagtatgtgcgttaccagaaacactgaacaatcatagcctcacgtctgtcctggtgaataactcactcgcacctcactctctgatcacttactgcctctctgctctgtcatgnngtttcaaatgcccattatagcaccagacccagaatacctgatacacttcaacctgcaccctattcatacgtgcgtgcgtgtggagcaataataataagtatgactctnntttgcttgtttcgcttaggtgtgccctgtggccccggtcacttactgccactaggtgttttaccacttgtcgtatgtgtcttgactaaatgactggactggtgacctgggctttgttggtgtcaacctgtcataactanttgtgcattttntggacgctatatgtgtagccttgatatgaatagatttactgtnnncnaaaatnnnnnaanaanctnngctttcanattctacaccaatac

SEQ ID NO: 10629 - DNA, 561 bp, Zea mays
  Clone ID: LIB3279-181-Q1-K6-G6
tttcacgggacgaaggaggtggaagtgtggctacaaacatttggtccaggtcaaaggaccccaatccacaggcattcttgtgaagaggttttcattgtcctcaaggggaaaggcacgctcttactcgggtcgagctcgctgaagtacccaggacagccgcaggaagttcctgtctttcagaataccacattttcgatccctgtaaatgatccacatcaggtctggaattctaatgagcacgaagatttgcaagttcttgtgatcatatcgcgcccaccggtcaagatatttatatacgatgattggagtatgcctcatacagctgcaaagctgaaattcccctacttctgggatgaggactgcttgccagcaccaaaagatgaactctaggttaagtggttcctgcaatttgtcagcttcgtgttcatccacaatcctggtggactacgactcacatctacaagttgaaaaccattagtgtactcttcatgtgtagttttgtgttgtgactctgggaaatccatattgacaacgtttataaaattaagcacttctggagct

SEQ ID NO: 10630 - DNA, 363 bp, Zea mays
  Clone ID: LIB3279-181-Q1-K6-G7
cttacgcgtgggttcatgattctgtcagtatacgcctttactttatgcatggttactggccttacccatttttgtggtgttaggatgaaattctggtgaattgtaagctaccatttgatatgatgtattcattcattaacttgtcaacaaactggtagctagcttgcttgaaatataatactacgtctgatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggccgcccctctaaaggggtcccacttt

SEQ ID NO: 10631 - DNA, 650 bp, Zea mays
  unsure (1)..(650): unsure at all n locations; Clone ID: LIB3279-181-Q1-K6-G8
ctttcgcgtggngtggagacacatcttacagcattatgtttggaccagatatctgtgggtacagcaccaagaaggttcacactatcctgaccaaggatggcaagaaccacttgatcaagaaggatgtgccttgtgagactgatcagttgactcatgtttacactttgatcatccgtcctgatgcaacatacagcattctcattgataatgaagagaagcaaactggcagcatctacgagcactgggatattcttccccctaagaaaatcaaggacccagaggctaagaagcctgaggactgggatgacaaggagtacattcctgaccctgaggacaagaagccagagggctatgatgatattcccaaggaaattcctgaccctgatgctaagaagcctgaggactgggacgatgaggaagatggtgaatggactgcccctaccattcccaacccagaatacaagggaccatggaaacaaaagaaaatcaagaacccgaactaccagggtaaatggaaggcacctatgattgacaacccagattttaaggatgatccatacatttacgccttcgacagcttgaagtacattggcattgagctgtggcaggttaaatcgggcactctgtttgacacatcatcatcactgatg

SEQ ID NO: 10632 - DNA, 485 bp, Zea mays
  unsure (1)..(485): unsure at all n locations; Clone ID: LIB3279-181-Q1-K6-G9
ggcggacgcgngggcgagggcaccccaancnacccaagnangggcncactgggcgcngagcagaaggaaccccaangngctgtcccaggagggcttattggtgtgggaacaaccatggacccaactctaacgcgtgctgacaggctggttggccaggttcttggtgaaggggggggactacctgatgtttacgtagagcttgagatcaatttcttcctactccggaggctgttgggtgtgaggacgaaaggtacacgagaaggcagggaaggtgtcgaagctcaccaagggtgagatcctcatgcttaacatagggtccatgtccacaggcgcccgtgtggtcgctgttaagaacgatcttgccaagctacagctcaccgcgcctgtctgcacgagccgaggagagaaggttgctctgagccgacccgttgagaagcattggcgcctcatcgaatggggccagaaccaggcagggacaacacttg

SEQ ID NO: 10633 - DNA, 688 bp, Zea mays
  unsure (1)..(688): unsure at all n locations; Clone ID: LIB3279-181-Q1-K6-H1
tgaagaccctcgtgtgtcattacacattggagatggggttgnnccttcttgaaaaatgctccagagggtacatatgatgcagtaattgtggattcttctgatccgataggtcctgctcaggagctttttgagaagcctttcttccagtcggtggccagagctttgcgtccaggtggagttgtatgcacccaggcagagagcatatggctacatatgcacatcattgaagatattttcgtcaattgccgccaagttttcaaaggctcagttaactatgcttggacaacagtacctacataccctagcggagttattgggttcatgctttgctccaccgaagggcctgctgttgatttccagcaccctgttttcaacatcgaggaggatgaacattctacgaaatcaaaaggaccccttaagttctacaactcggagatccacacggcatcattctgtttgccctcttttgcaaagagggtaattgagtcaaaggcaagctagacgtgaggatacttcaccaagtccagtcgattgggttaagtaccttaggcgcaacacanaatttgttgtcgtgtgaaaatgggatgcctncctcccccacccnccacttgatgaataagcacatgagatgagatgcaacgggtattcggattgtcagtctatacgaattctgtctgtgtatgtgccc

SEQ ID NO: 10634 - DNA, 611 bp, Zea mays
  Clone ID: LIB3279-181-Q1-K6-H10
tcctagttttctccccaccctcctccgtgggtggcgggggcgcgggagcgacacgcgcgctgctctacggtcgccgcgcgccgttcgcgggagcgctcctgtttttcagcatcggcgccgtcagcgctgcggtcgcgttcaggacagggtgcgccatctcacaccgacgtccccccttgctgggggggagagttccctccttcactagaatggagtcagcttcgaccacagtgccatccattgtcgtgtatgtgacagttccaaatagggaagcagggaagaagctgtcacagagcatcatcagcgagaagcttgctgcttgtgtcaatatagtacctggcattgaatccgtgtactggtgggagggaaaggtacaatctgatgctgaagaattactcatcatcaagaccagggaatcacttctggatgccttgactgcacatgtcaaagccaatcatgaatatgatgttcctgaagttattgctctgcccataactggtggtaacaccaagtatttggaatggatcaagaacagcacccgggacaagtgatctcttttttttttggagctcgacataatgcgatgatcgaagtgcccatggctccttacc

SEQ ID NO: 10635 - DNA, 423 bp, Zea mays
  unsure (1)..(423): unsure at all n locations; Clone ID: LIB3279-181-Q1-K6-H11
ggggggggggggggacaaaaaccgncgaagcccggcgcngagnnnccaaacgccgcccgcgggnacgagaccgncncngcggcggnagccccaagaaacccnggnaaggcggnnggngcaaatctgcctgcgggaacagcaccggggggggggggggttttttctccttttgaggangangangaccnngancgggggggggaggaaacngacgccgccacgaggcagccgangagcgngccgccgcngccaaggccccnncnaaaaagaaagaaagaggaaaanccnccgnccnnanggangncaaaccangggacgaggagacnganangaagaagcnggaggaggcngnccgcagngncccagaggagggncngacnnggggagcancaaagcnngngccngnngganacggcancaaga

SEQ ID NO: 10636 - DNA, 609 bp, Zea mays
  unsure (1)..(609): unsure at all n locations; Clone ID: LIB3279-181-Q1-K6-H12
ncttctctcacgcgtgggtcccagatattgggtgtggtgaggacgtagctcaacagttgggtcaggctgngaaatcagcaaacttgctataaaatctacagagattatcgtgcttcagcactagaggtgagccttcggaagttaggagtgggaaaaacttactaaagatgatgtacaaaaaatgcgggggggggctttttttttcttaaattggaaactggatacattttatgcgaatcgcggtcaaattattactagcaggagaaagaaaaatctgtgatcagatttttggtggtgtgaattttaacaaaggccattgttttgctgaactcacagcaaatagtattataactcttttcagctttggagatgctgttgctaaaagcaaaaggtctcctgaaaagctgtttgtgttgcttgacatgtatgaagtaatgcgtgaacttcaaccagagatcgatgaaatatttgaaggcaaaccttgcactgagatgcgggaagctgcatcaagcttaacaaagcgcttggcgcagactgcccaggaaacatttgcagattttgaggaggcagttgaaaaagagcttcaaaaacattggtcaggatggaaca

SEQ ID NO: 10637 - DNA, 536 bp, Zea mays
  Clone ID: LIB3279-181-Q1-K6-H2
aaacaatccgcctccgcctccgcctccctagggttttgctctcggctcgtcggatccagttcgggggatcctccatggcgtcgcgtccgtcgctgaagtcgaagcccaagggcaagggcgggaagaaggccaccgctgacgacgaggacgccaccgcggcggcgaccacggtgaggctcatgaaggagtggaccacgtggacgatgaagaaggcgaaggtggtggcgcactacggcttcatccccctcgtcatcgtcatcggcatgaactccgagcccaagccctccgtcttccagctcctctcccccgtctgatcggatcatgacagggcccggatgaggtcggtccgtagtagtttgtagctggtacttcatttgcttacatatgtccgagatcgagttgaagaaggtggatcatgctttctgggcgaatttgaaggatttggtttaataattttgtagtggcggatgtcttctatacatcggatcaaaaatgtcttggttatgtgatctgcagtgcttatgattgtatgaact

SEQ ID NO: 10638 - DNA, 336 bp, Zea mays
  Clone ID: LIB3279-181-Q1-K6-H3
cttgtctgcgtggggcaagaaggcacacccacgaagcagttccacaacttcggcgatcaagttcccgctcgtgtaccgcaaggtgaggccgcccaccaggaagctcaggaccaccttcaaggcgtccaggcccaacctgttcatgtgatgggcctcggcgggcgggcgggctgttgcacctgtgtttggtgtcttattttttttttagataaaggtttttgcctctgcaagctttgctgccccgtggactgatgatttttttggatgatggtattgtattgcaaacccttgactttggtcctactagttatgagaaggctgctgtgttacttgccc

SEQ ID NO: 10639 - DNA, 436 bp, Zea mays
  Clone ID: LIB3279-181-Q1-K6-H4
tcgaccgcgcgtccgtttttcggcacctacatcagccgcgccgccgcgctgcccagcaagtgcggcgtcgccctgccgtacaagatcagcaccaacgttaactgcaacacgattaattaaatgaggcgtcctgtgcgcgtccgggcgaggaatgcatgcatggcggagagtaataaagtaatgctactggtattttaagctagatcgatgtttgcctgtctctagtcatttatggtgtttagcaatcgtctacacagttcgtaaacggtgtatcgtggatgcatgttgccgcgagcagagtacgtaggcatgaaccgatgtgtgcgcttctgtctgtgtactctctctatgtagtaatgtgtggccagtgggtgctttgatccagatgtattcgctcgtgagtggtgagtcgtggaagttgatcgtttcactatca

SEQ ID NO: 10640 - DNA, 604 bp, Zea mays
  Clone ID: LIB3279-181-Q1-K6-H5
tgtctctcctctcctcgcggcgcgcctccatggcggcctcgtccgcctccctcctcgcccgtcgcctcatcatgtcccgccgcttcctgtcatccccactcggctccctctctaccacaaccgcgacgcgcagtttctcgatctcttctcccgggtttaaaagcttcgttgtggagtccggccttgagaacgagcactaccagccccccgcggaccagaaccgccagcagacgtcgaacagcccgcgcccgcccgacaccacccgccctctcgagaacggcctcgaccccggcatctacaaggcgatactggtggggaaggtcgggcaggagccgatgcagaagcggctgcggagcgggaagaccgtcgtgcttttctcgctcggcaccggtggcatccgcaacaaccgccacccgctggatcgcgaggagccgcaccagtacgccgacaggtgctccgtgcagtggcaccgcgtctgcgtctatccagatcgcctcggcaccgtcgcgctcaacaacgtcaagactggcactattctctatttggaaggaaatcttgagaccaaagtgttctgtgatccaattactgggctagttagacgcat

SEQ ID NO: 10641 - DNA, 486 bp, Zea mays
  unsure (1)..(486): unsure at all n locations; Clone ID: LIB3279-181-Q1-K6-H6
gtgggttttatcgagcccgggggcgggaacctattatctcaatagtttctaatgctcgaagtggctatctttctcaagacctcttctcaggcaacagttctggacgcgaagggaagtcagttgggttttgactacacggcctaattgttaatgagatttgcactgatgggggaggggggggtatgttttctttgacgaagaaagccacgcgaaatccactcatgtgactgatggagtggcctaatgcagtctagtctgcgacgatcaatctctgtccacccggtcgaaaagttcatgagcttcatggcagttngaatcaggattgagctgatattcatcccgcttgatgtgtagcttgcattcttgttactggaattgtgtgtgttatgcagatcatgggcgcattagactgtgctgaagaaaagtcagggctgcgcctttagaatgcagcttgctcactttttgagtttagtcctgagactgggc

SEQ ID NO: 10642 - DNA, 558 bp, Zea mays
  Clone ID: LIB3279-181-Q1-K6-H7
cgggtcgaccgcgcgtcctcgtcttcccagttcgcttcggtggcgggggggggtgggcctccgtccccgcgtgtaagcgagagcatggacacccacgtgaagcttgctgttgtggtgaaggtgatgggcaggaccggctccaggggtcaggtgacccaggtcagagtgaagttcttgcgatgaccatgaaccgtctcgatgggggggggagcgtcattttttctgttcgtgagggtgacatcctcaccctgctcgagtctgacagggaggccaggaggctgcgctgaagccctggtggccttggatgtaattctgttcattttgttctatttttgtcgaacttgccgtgtgaccttcacaacatctgctttgcgatttactcagcctggattgcagttttattttatgttcctgctggaaagtgacttgccgcgacatagttatcattggctatctataatagctcaatcgacgcgtgcaatctgaaggctttgttctttgtgggaaggtcgtctatgtggttgtggcatagttgatgtcccgttggctcaaatctga

SEQ ID NO: 10643 - DNA, 605 bp, Zea mays
  unsure (1)..(605): unsure at all n locations; Clone ID: LIB3279-181-Q1-K6-H8
tctctcgcgtccgcccancgttcgggcgggggggcgggcacgcctccacccgccgggtgtggatttatgcccattaataaacccatgtggtatacataaattcgacgcggacaacccgtgaccctcaatgtgagtaagaaacctatcgggtttcgggtacccattgtcatatctagcctgcacgaggagggggaggggggagcctttctatcaaacaccaccttgtttctatgcttccagatcatccatgcccctaaggtaatgagagagtccaatcctttcttccccagaccaaagacctgagctgaagctctctcccaccactcaaagaaagaagcatcagcttgttgaggggataagctgggtagcccaaactttcttaaaaggttctaccagaaaactcttgaaaacacacaggaaaccaacaaatgattgatgttttcaggttcttgatcacacagggggcatctagtcgggtggttcatgcctttttttccaagccgatcagcagtctagcatttgttatgagccaccagccacagaaagaactggcacttggaaggtgtccaagatttccagatccttttatgatggtgaaaggagct

SEQ ID NO: 10644 - DNA, 610 bp, Zea mays
  unsure (1)..(610): unsure at all n locations; Clone ID: LIB3279-181-Q1-K6-H9
gttctttttgttctcagtgcgttgccttgaacatctgtgctgaggggcactttgcagaagcatgacaacttggtgagctttgctgagcatcacaaggtccagttgctggaagcctcatcatcatcatcatcagggttaggatcatcacctagcccatcatcatccaccccncaggagaagaccatctgctgaccacagttataagccaaaacccagagccaagaaggaacggacggaggaggaaaagaaattcaggcgaagagcaaagtatttcctggccacacaactcgttgcagttcttgtgttcctttcgctgatgggtggggttgatagttccgagctagacgacgaagatggcttggattatgatgattagatcctccctgtgctgttacacttgattagttccaaggacaaactgcctggttggttcggggtgctgtgagaatttgttccaacactggaaaatgtgttacgcttgattttagctaggaattcactgagttggtcacccatcggcagtttcataagctacttcggctgtaaacatacttgtctctgaaggtttttttttttgggcttcagtgaaccaaacttgtaagcaaattcg

SEQ ID NO: 10645 - DNA, 593 bp, Zea mays
  Clone ID: LIB3279-181-Q1-N6-A11
ggaccaaaagagttgcatttcatggtagtacatcccatcccagggagaagatacagatcacacatgttccaagtttatgcataagaacacagcacggtctggcctagttttttctttcgcacgacaggaccaccggccaacccaagaaaccgaagaagaacccgccacctcgcccaggcctccaaaccgaagatttttatcatcagagggaggagaggctcgtcgtcgtcagacacgctggtgctgcaactgcagcagccgcgagtacgcgccctccggccgggccaggaggtcggagtggctgccgtgctccacgacccgcccgtcctgcacgaccgcgatgcggtccacccctcggatcgtcgacagccggtgcgccaccaggacggtggtccgccccttcatcagccgctccagcgcctcctgcagcacgcactccgactccgcgtccagcgcgctcgtcgcctcgtccagcagcaggatggccgggtccttgagcaccgccctggcgatggcgatccgctgcttctgcccgcccgacagctgcatgccccgctcgccgaccgcggtcctgtacccgtcgggcagctggc

SEQ ID NO: 10646 - DNA, 603 bp, Zea mays
  Clone ID: LIB3279-181-Q1-N6-A12
atcaacgagagggcaaaacatcctctttaccggggacccaaaggctacagacaatgtaagtatgacccttgcaaaaggctcaggacaatggaaaagcctcagtacattctttttaattaaaagtttgcgtgggggaggggcatccaaatgattactgagtagctaaagatatttaacctaaggatcgtcaatcatcctcatcctgctcaaccttaacactctgcagcttcaaatccagctcgtcctcatcgtcctcggcatcctcatcatcaggctctccatcaggttcattctcatctagtgggcccagcacatccagagatttcttaccagccttcagaatttccttcacctcatcaaccccttcatcagagataaaatttccattgatgttcagctgcacaaaatctggtttatttgcgactgcccgcgtaaagcaccgagctccaaccctctgcagcatgttcgtgctcacatcaagttccttgagatctgagtggccatcttccaatgattttgcaattatcacagcaccattgtccttcagttcattttcagccaaggtcagcttcttgagtgactgcattactgctaggaattcag

SEQ ID NO: 10647 - DNA, 469 bp, Zea mays
  Clone ID: LIB3279-181-Q1-N6-B10
ggccacaaattattgagattatctctattctcatcattgcacttttgagtattacaatagccaatggtataaggatatgatttcaaaaggcattttcaagattttgaaaattctccccctgtttcaaatgcttttcctttgagactaagcacaacatatactggaagaatggttagtctcaaagatttaatgtgtagagaattgctccccctaaacttgtgcatacaagtgatgaatatttgtagattaatgtactttaaaacatgtacgggccgaggatacaaattctacatattgaaccttggtataagcagaaatgtgaatatagagcaagtaccaactgaaagagatatataagatcaaaagatatgtcaattaagctttatcatagttctataatatagattgctccctctgagtatgtggcttgagaggaatacatattttggccttaaatcggacgcgtggg

SEQ ID NO: 10648 - DNA, 634 bp, Zea mays
  Clone ID: LIB3279-181-Q1-N6-B11
gtcagaacaaaacataccataccagataccacagtgaaagatgggacgcaaactgtcgaacaaaacatatcatacaaatccacggggggttttgttagttccaaatttccgaattccagtcacttcacccacagcagcgaggaaggaaaagcttattccacgactcatctagcaaaacacggtggcaagcctatccccaaaagtccatgtgcggaggagtaaaccttagccttgcagtgctacaccaaggtccgaaacaagttgacacgcaaagctggcagaacctgagtagcagcagcagcagcggatctaggcgtcatcgagggcaaggacaccaggtagagtcttgccttccaagagttccaagctcgcaccgccgccggtcgaaatgtggctcatcttgtcggccagcccagccttctcgacagcagcaacagagtcgccgccgccgatgatggtagtgacacccttcgtggttgtaagctcagctagcttcttggcaatcgcctcagtgccagctgcaaacttctcgaactcaaacactcccatggggccgttccaaataacagtcttggtggtgtccaatgcttcgttgaatgttttggtggcatcagggccaacatcaagacccatc

SEQ ID NO: 10649 - DNA, 505 bp, Zea mays
  unsure (1)..(505): unsure at all n locations; Clone ID: LIB3279-181-Q1-N6-C10
aatccaactattttcacttttaacttannaaaagggttnncaaacatttctttctttacatcatgtaccaggtagaaacacaaggtgagttgttttcggatcaaaattgcttgcattttgagcttaaacacttagtgcaagggggtgnaactcgatcgctgcagacgatgatctattgacagatccggggcaaccacgtgtaggcaccaggcaggcttggtgcataccctcagttccttcacagcagattcatatcgatggatcttccagcgcggcagtggtgaagtcgttgattcgaggataagccgccttttcgtccagttgattttgggtccatttcaacatctttaacaagcttggaagcttcggatctttctcatgactttggcttgtaagaatagcagcattaacttcacttgcagtcttcaaacgttgagaaacatccaatagttccccataagggcaattttttacatcttcaaaaaccagtagtgctacagttttt

SEQ ID NO: 10650 - DNA, 566 bp, Zea mays
  unsure (1)..(566): unsure at all n locations; Clone ID: LIB3279-181-Q1-N6-C11
agcctggtgatgctaaagtcacctcaggtgatgatagcacaccgtcaaaaccttaccttatggaacacgacacatatatcatacaaatattggtttatcatctccccaaacttacgagaacatcacagtacacgaatagcaactgtaaaatgtacagaccgagctagcagtttgcaattatttgtaacagatccaagctaaatacattcacatttttttctttgccgccttgccgggcacttcctgatcatcgaacctgtcaggcggtggcaccggcaggtgtggcggattcacttgtcacggcctcagcctcccagaacgaagtcttcttgccagtcttggaaacagtttgcaggacggcgtcaggtgtcagattgcccttcacggtgaccttctgttccatgatgtctacgtcgtaggactcaacgccttccatcttgcccaggacccgcttgacagctccaacacagccctcacaggacatgccaaccttgagcacaacagtctgggccatagcgcgagaggggaggagggtcggngcggtcccgcggtggtggtggaaatct

SEQ ID NO: 10651 - DNA, 494 bp, Zea mays
  Clone ID: LIB3279-181-Q1-N6-D10
ggatccatgtttttatattaatgggtgcaaaaagcaaagggtgacggtgagtgtttactcgccggcggggacatggggagacagatcgtctttccgcttgattgcattggggggggggggagacaggtcgtctttctgcttgattgcattggcatctggggggtcactgaactgctgcttgtagccaaggtcatggttgcctgaaaccagttcgtctctgcagggagtcccttccatgtcgatgatgatgttggttatcaagcagcagacaaagatgatccgtggcagccggtgtttgtcaggcctccacagctttccctggatgacacgccacctccctttgagcgtcgccaatgcggtctgcaccaccgccgccgcggccgtgtgccgcttgttgaattccaccttggccgcctggaggccatgttcccggtacggggtcatgagccagggaagtagcgggtagcttgcatctccgactagggactccctaa

SEQ ID NO: 10652 - DNA, 428 bp, Zea mays
  unsure (1)..(428): unsure at all n locations; Clone ID: LIB3279-181-Q1-N6-D12
ggaaanttnaanagttanaagttagagnnnanaaaaggttttttngaaaattatagaaatgttatttgtnatttgatggatnagatatgattatttttttttatntnatgngtttttggtggggggggttttttttttttntaaaggnntgtnnttggaggggttgtgaatttattttgtattattaattatttggaaagaggnatttgatgnatgtagtttgtttatggatacattagatggtgaaaatttttttaaatattntnaagaanatttntttggtaagagtggnnatttanttatgattgttgtnnaaagattggattttatttngaggggttgtattttttnntgggttgaaagtgggttnttgaaggtatatgatngtgnagagaagttttanattgtttaggggaaagtgtggttag

SEQ ID NO: 10653 - DNA, 593 bp, Zea mays
  Clone ID: LIB3279-181-Q1-N6-E10
gtagaaagatcagcacaattctttaattcaattacacgcagatcatcatcatccatcgctagcagtatcacataaactgagccacgcctaccgccgacgcccacatgaccattacaaggatcctaagacgaggtgaacttcgtaacggccttagtgccctcggagacggcgtgcttggcgagctcgccggggaggacgaggcgcaccgaggtctggatctcgcgggaggtgatggtgggcttcttgttgtagcgcgccagcttggcggactcggccgcgagcttctcgaagatgtcgttgatgaaggagttcatgatggacatggccttggacgagatgccgatgtcggggtgcacctgcttcagcaccttgaagatgtagatcttgtaggtctccacggacttcttcgccttctttttccccttcttgccctcgccgccctccttggacttgcccgccgggaggcgcttctcggccttgggcttcttccccgccggagccttctccaccttctctgtcgcgggctcctcctccgcgggcttcttggccaccggcttcttctccgccttgagtgccatctgtgcggcggctgc

SEQ ID NO: 10654 - DNA, 633 bp, Zea mays
  Clone ID: LIB3279-181-Q1-N6-E11
agcaacaaaagtatgctaccactttcatcgtcaagcgattctgcaagatttcaataaatataaatgtcgtgcaaatcacaggcaaaaaaagaagctgggcgaagccagcaacacgcctgcactgcgacgtgcagcagttctgagtgagaatctatgaatcgagttggagtttctttttttattcaaaacattggggtggcaattgctctctgggtgtggtagaatttactcgaggcatgagtaagcaagcgtcttctcctccgtcagctcttgggcagtggcatccatcttcttccttgagaactcatcaatcgggaggccttgaacgattttccattcaccaccactgcatgttactgggaatgaataaatgagtccagaaggaacaccgtatgaaccatcagagtacacacccatggaaacaaatgtaccctcaggtgttccaagaacccaatcacgaatgtggtcacaagcagagctagcagccgagagagcactggagaactttctcgctttaatgattgcagcaccacgctgttggacagttgtgatgaattcaccattaagccactcgtcatcagagacaagctcacgaacaggcttctccccagtggaagtcttcactgtggcatg

SEQ ID NO: 10655 - DNA, 161 bp, Zea mays
  Clone ID: LIB3279-181-Q1-N6-F10
tcgcgatctagaactagatttcgcctccgtgaaccttttcacaagccaatactaagttcagaaccatcaatcagtgtgcaaccactacaaccacacgaccagtttctcatatttgcatctgatggactttgggggctacttcgaacaatatcaactgcctg

SEQ ID NO: 10656 - DNA, 553 bp, Zea mays
  Clone ID: LIB3279-181-Q1-N6-F11
ggggtgggtttttttttttttttttttttttgtttttttttttttttttttttttttttttaaagggcccaaatcccaaggaccaaaaatttgttttgcaaacaaaaataaatgttctgaaaccaaacagtttttaaaaacaaacagtggttggggggggaggggacaccaaataacttttttatggagggtaaaaaaggaaaggacgcatgaatgacgggaaaataaaacggaaagaaaaccctcaaaaaaaggaaagccccctggccaaaccaaaactgggtggtaagttcaagcctttcactttttcaaatgggggaaacactgggacaagtttgtcttgggaagcttggcctcggggggctccctggacttcaattaaagggggggacaaaagaatgtttgcatgcacactttgcactggaagctcaaggcctttttggtgggctcgagctggctccccttgggccccttggtcttttccaaagtgggctcgggggccaatttggacttttggccggtgccaccggccatgggggatggatccggggaa

SEQ ID NO: 10657 - DNA, 305 bp, Zea mays
  unsure (1)..(305): unsure at all n locations; Clone ID: LIB3279-181-Q1-N6-F12
cttctggtctcggctgttggtggtgcgtttgcttggtcgtttctcnnccgctgtgccngggcggtttgtggctggccgccttgtttttttttgttnnnngtctttggtggggctgtttttttttgcnccntttgctgctgttcgtgtgggtggtgttctcttncctgnncgttgcggcctttcgggtgctgttgccgcgntgcttgtgtcttcccctttcttcccgccccgttccttcctgncgggtgctttgtgttgttgcttctggcttgctcggttnggttggtttggcccttnggtttttt

SEQ ID NO: 10658 - DNA, 635 bp, Zea mays
  Clone ID: LIB3279-181-Q1-N6-G10
ctcacacacaatcacataacaatatttaaatccatagtctcatcaattacatcacaaaagtctcatccatagtcataataagacacatctcatccagtactaataagagacaatatctaatacatagtcataataaaagtctcaagtatcacaacccataacatggaagctcacgatcgccgatcgccatcggggtacagtgacgagtgatggtcgatacctccactagcgaagagggtttcgacaaagtctaactcgtcttctcgttcatgcgtcggcaaggtagctggagaggtctgatgttcggtaggtgaagatgtaggtgaagaccaaggatcgctattgtaggaccagactgcattagcgtgcttgaattaccctcacgagctgctcggcgatggggacggctccagcactgcttcacaagctgcatgtccttggcgacagccccactgccccagcacacgccgtgacagttgtgctggagcagcggctgtgttagtatgttaatttctcagttatcacggagtcaagggtgatatcacaattcatgaaatgtgcaaccttattcatgacctcatggtgacaattattcattgtgccaggtttagaaacatgtcttgtgagcttttcaa

SEQ ID NO: 10659 - DNA, 423 bp, Zea mays
  Clone ID: LIB3279-181-Q1-N6-G11
aacaaacaatgtaggcatgaacattatttttggaaaggtgttatcacaaccgacaacgagcactttcttgccttggaaggcctcccttccctattgtagtcactctagtgcataacttgcccttaaagctatcgattcactaagggccagacataataggctatacattctctctagtggcaacaattagccattttggttggtgtggtactctattattgagttttttggcacggtacttccttgtagagtagaagacaaactcttcaccattgtagtcgttgatggggctggtggtgatgaaatccttggtgtggatgcaccggggaatcactattgtactcggcggcaacgacattaagactgaagaatgggcggatgtcgaattgaagcttagccccagagataaagcggacgcgtggg

SEQ ID NO: 10660 - DNA, 556 bp, Zea mays
  Clone ID: LIB3279-181-Q1-N6-G12
gcgggggggtttggttttttttttttttttgggggggggttttttttttttttttttttttttttttttttttttttttttttttttttttgggcgaaaaaacggcctttttaaaccccgggggggttttccctcctttttcccccccgggggggggggggggggaatatccccaacccgggaaattttttttggggggggggggttttttttttttaaggaaaggggaaccacctttttcgggggccccccaaacgggggcaaccccggtggggggggggcgggggggtccttttgggggccccccgggccccccgggggggcaaggcctttttttttttttgggtttcaggggggttaacgggggacctgggccggggggaaagcccggttttttagagggggggggggggggccccccgggggttctttttttgaacctggggcgcggctccccggtgcggcgcggccggggaacctttcttggggggggggggggtttcctcccccccgtcttttcttgggggggccctcccccgtttgcgggggggggggg

SEQ ID NO: 10661 - DNA, 640 bp, Zea mays
  Clone ID: LIB3279-181-Q1-N6-H10
aaaaagcgaacatgttatagtaattgaacagtcggtgacgcaacgtcagtttcaggcacaccagcagaaaactcggcccaaatatcgatcaaagaccaacaatacgcatgtttggattctatttggtttggacttacacgttacactagccaacctgtcaatactcagagcaatgcatgcatttggattacccacacgggacaccaaatcacttgttacctgaagatggtagatatggattcggtacagcaacgtaattgagatgtccaggtcaagagaggatactcccttgtgtgcaagccactggaagaggtaaggagccatgggcacttcgatcatcgcattatgtcgagctccaaaaaaaaaagagatcacttgtcccgggtgctgttcttgatccattccaaatacttggtgttaccaccagttatgggcagagcaataacttcaggaacatcatattcatgattggctttgacatgtgcagtcaaggcatccagaagtgattccctggtcttgatgatgagtaattcttcagcatcagattgtacctttccctcccaccagtacacggattcaatgccaggtactatattgacacaagcagcaagcttctcgctgatgatgctctgtgacagct

SEQ ID NO: 10662 - DNA, 620 bp, Zea mays
  Clone ID: LIB3279-181-Q1-N6-H11
ggggggttttttttttttagactcagaaccattgcaaactcattaactttagacaaaaaaacatcagtaccgctgtttttaagataaatgtatattggaaaaaaactggcaccactcaacaataaactcagaccatgatgtttataatagactgggggggggacaacatttttgtaatagactagaagggataaactggcatcccagcacaaacttgacgagctgagccgctgccgttgcccaatctcagaaactgaactctagatcttgttgaaagccacaatgtcgcaactctggacgtactcattgatgggctcttgcgtaaggtggtcctcaattagagtgtcgatggacacaagatcgtcgacaattgtcaacatgatagtcatcttcttgatgccgtatccaacaggcacaagctttgatgctccccaagtcagaccctccatctggacactgcggacagcctcctccagcttcttcatatcagtctcatcgtcccatggtttgacatccataaggacggaggatttaccactttctttctttttagaagaggccttggcagcggcggcacgctcatcagctgccttcttgtcctcctcagtttcatcaccaaa

SEQ ID NO: 10663 - DNA, 543 bp, Zea mays
  unsure (1)..(543): unsure at all n locations; Clone ID: LIB3279-181-Q1-N6-H12
gtttttntaagggattnnngttttnttaaggaaaatgaatgaatttnnnttgaaaatgaaaatnntttggaaaatggaattatnaaattttttttttttgttggaactgctgtttgggagcgcacaaggctcctaccgtagaggtctcgttcttgtgccgggggtggatcaacactaataagtttaggaacctccagcaagaaagttccaccaacacttttttgccgttagctttccgttccagccacccaaatggcgagaaaagaaacttaggcgcgctttttctgagaaaagaaaactaggtagtgcctgcacagcagacgtttatgtcactatatattatatgtagtgcgagaaggaactggtggttgcttcggaagaaatctgtgctgttgaacttactggcttctggctgtnctcatgccgtcactctcactctatgttgctcagcgcttttgctccgcccattgctggccttcgaagaactggcctagaagttggtccactgcttctgggctgtaccgcacgttcttttgcgggttc

SEQ ID NO: 10664 - DNA, 655 bp, Zea mays
  unsure (1)..(655): unsure at all n locations; Clone ID: LIB3279-182-Q1-K6-A1
gacgaaaggagggagttttgagaagcataaatggctcctaaagccgctcctgtcaagaagggtgatgccaaggcccaggccttgaaggtggccaaggctgtgaagtctggggcaggcaagaagaagaccaagaagattcgcacatctgtaacatttcaccagcccaagaccctgaagaaggccagggacccgaagtacccaagaatcagcactactgngaagaaacaagcttgatcagtaccaaatcctcaagtaccccctcaccacagaatctgcaatgaagaagattgaagataacaacactctggtctttattgttgacctcaaggcagacaagaaaaagatcaaggctgcagtcaagaagatgtatgacattcaagcaaagaaggtcaacaccctgatcaggcctgatgggaagaagaaggcttatgtgaaactgacacccgactacgatgcccttgatgtggccaacaaaattggcatcatctaagttaataggcaactggattcgacatctatgtcctactagttctgagcataccaacagatttttctatgttactagtaattntgtttgtcatattgggttgtttttttgcaactaagtctttgtcgcagtcgcagactacatatgcctgtattgagttcctggttg

SEQ ID NO: 10665 - DNA, 649 bp, Zea mays
  unsure (1)..(649): unsure at all n locations; Clone ID: LIB3279-182-Q1-K6-A10
tttgttgcaggactacagccatcagctcaaactttgcatccaagnaaacaagcactgctggaccagtagataaccaatcagctaccagcaacaatttctctatgcaggctttcttgcaaggaaaacctagaaggtttcttcaggaactatgcagttatatttttagacataacttttaccacttgatatctggttccttatttgaagatcacattgaaaatattgctgaaacggttgaaaagcatggatttgtacagtggttatgaagttctacatcatgcctgtattttcttatcatgataacggtgtaaagttatctagtacacatgtgtcttgctattgtttcgtgcacatttaattgcttactccacactcatgtacttgtgattgcatgtaggtgattatgacatgtacgcatctaccattttggtaacatattaagaacatcatgtggctggaataattgagcattcctttgtcccctgctttggtgctgtgcaggtttcatgcatgctattatcttacaaagttacaattaacatgtcatttgttactttgtagaagaaaccaatctgctgaaatattgccatctgaagtagatgaaaagacgactgctactgataataaaaattatgttgatgatggggga

SEQ ID NO: 10666 - DNA, 641 bp, Zea mays
  unsure (1)..(641): unsure at all n locations; Clone ID: LIB3279-182-Q1-K6-A11
tctgtgcgtgggcgcaaaaaaaaccgggagagtgggggtgttctcatactcatcaatgataaatagattttgtaagggatggaagaacacatgatgcaaatgaggtatataagaatatgatgaaggatggttgcaaaccgaattctcatgtttacattgcactaataaatggtttctggggagcatgcatttaccctcgatgccnggnaaaatttacattgaaatgaccggcaatggttgttgcccaaccaccctcacatataacactctgatagatggtttgtgtaaggctgaaaaataccaagaagcttcaagcttaacaaaggaaatgttagagagaggttttaaaccagatatcagaacttatggttctttgattcgtggcctttgtcgagtcaagaagattgatgctgccctttgtatttggaatgaaattcttgatgcgggtattcaggttgatgtaattgtgcacaacatcttaattcatggtctttgttctgctgggaaagtaaatgatgccttttgtatatatttggagatgaaagaaaagaattgttccccaaatctagtgacctataacacattgatggatggattttatgagattggttctattgatacagcagcatctctttggactg

SEQ ID NO: 10667 - DNA, 602 bp, Zea mays
  Clone ID: LIB3279-182-Q1-K6-A12
tcttctcgtccgcggacgcgtgggtgctcaggcgggacggcaggcaaaacggtgccgcggctgccgatctcggcctcgctatcagagctgaatccgatgcaaagaggacgtcgacggacatggaaaagggggagacggggaaggagaccatggatctcttcccccagatcgctggattgggcgggggggctgtcactaagatagcccctgatgcgagggagccagagaagcgccaactgactatcttctatggcgggaaggtccttgtgttcgatgacttccctgctgagaaggcaaaagacctgatgcaaatggccagcaagggttcatccgtagcccagaaccctggcctgctgcctccttccacagctgcaaccgttactgacagcaccaagatcgcagcagtgccagccgcaccaattgctgtggccaacgcccagaagagtgcagcagatataccgcaggctcccaaggcatctcttcgcaggttccttgagaagagaaaggatcgccttactgcgaaagcaccgtacccgggttccccttcagatgttacacctgtgaagaaggagatgtcggatggtcagcccatggcttgggct

SEQ ID NO: 10668 - DNA, 640 bp, Zea mays
  unsure (1)..(640): unsure at all n locations; Clone ID: LIB3279-182-Q1-K6-A2
gtccccgtccgcgccggccgacgccgccttttcgtccccgcgtcagcgtcgcggctccactgagcgtgcgtgtcaccggcgggaggcaagggcaggcggtggtggcgatggcgtccgctgacgcgcgcttggcggggatcgcctcctccatccgcgtcatccccgacttccccaagccagggatcatgttccaggacatcacgacgttgctgctcgatcccaaggcgttccgtgacaccatcgacctctttgtcgagcggtacaaggaccaagggatcaccgtggttgctggtgttgaagctagagggttcatttttggtcctcctatcgctttagccattggcgcaaaatttgtgcctttgaggaagccgaagaagttgccaggcgaggtgatctccgaagagtattctttggaatatggaactgacaagatagaaatgcatgtcggagctgtacaggccaacgaccgggctcttgtagtcgatgatcttattgctaccggtggaacactatgtgcagctgtcaaacttattgaacgtgttggagcaaaggttgttgagtgtgcttgtgtcattgaattgccagaactganaggccgagacaagcttggggacaggccagtttttgtccttgtggaagc

SEQ ID NO: 10669 - DNA, 629 bp, Zea mays
  Clone ID: LIB3279-182-Q1-K6-A3
gcggaattatgaaccttcggatgtaccttttgatatttcatctgtttcgaaggaaacaaaatcccaaccccttgcggagaaaaagtctacaggcaagaaatcagcaggtccagcatctgctgtcagtggctctgtttctacagttgatgcttcgtatgagaagcttctttcgtctattccggaattcgctgattttggaaagctttttaagtcatctgcacctgtagaattgactgaagctgagaccgaatactcagtgaatgttgtgaagcatatttttgatcgacatgttgtgctccaatacaactgtaccaatacaattcctgaacaattgcttgaacaggttattgttttggttgatgcttctgaggctgacgaatttttagaagttgcttcaaagcctttagaatcattaccatatgattctcctgggcagacctttgtggcttttgaaaagccagaaggtgtcattgccaccggcaagttctcaaatatcctgaaattctttgttaaggaggttgatccatccacgggtgaagctgaagatgatggtgtcgaggatgagtaccagcttgaagatcttgaaatcgtttctgctgattatatgttgaaggtgggagtatctaact

SEQ ID NO: 10670 - DNA, 595 bp, Zea mays
  Clone ID: LIB3279-182-Q1-K6-A4
cggacgcgtgggcagtgctcgtgttcctggtgctcttcgtagtgaagattgtgaaagaggaaacctgggaagcagtaattgctgactcgttgctttatgcgaagggtttattgctggcagttactttggttattgattgttggctggcctttgcctactttctgggatttcttgttatatatgctgtagctcaacagccaccttatgatggcctaggccattcaaatcatttgaccccattgcaacttgaaagtctgctaactgaagagccaacatcacgattttggctgaattccgaacttcattttcagcaaaatgtgtacaagcaagcagcattctgcctgaactttctatcacgtactccaacaagaacatctcttttggaacaattgaccttgggcatttcccaaatgctgcagcaaagtttgggatatccatgtgggatcatctccccacttacatattgtttgacaaggttactgaagtttctcggtttccagaaatcacaagtgaatcaaaagtatttgtgccaaaagttactaagaaacttctttgccagcattttgatctcgacagacgattgattggataccta

SEQ ID NO: 10671 - DNA, 393 bp, Zea mays
  Clone ID: LIB3279-182-Q1-K6-A5
ttttgatctgagcgtcaatcactgcaaggtgtatcggcggcggtgctctctgcgacagcatggacgatccgcgacctaggaccggacagtctacgacctgcggcaggagcgggttcttctctacgctgacgccggacggtccgctcctggtggcaggttgatccgtgtgtgcgcagaggcgacgacgttcaccaacaacacctggattgacccctggggagggaccccgtcaagaaggagagattctagggtttgtcttagaatcggcaatccaccaagacgcctctagacgacgtagagccaaagagaggtgaaatcggggatgagaaggctaagttactgctactcctagggcatgaaaagtataagaacaataaattgattgattggttc

SEQ ID NO: 10672 - DNA, 626 bp, Zea mays
  unsure (1)..(626): unsure at all n locations; Clone ID: LIB3279-182-Q1-K6-A6
ttttcgcgtgggcggacgcgtgggccggtagcaggagcgcagccagcaagctcagccccccagccctactgccaccgcgccgaacgccatggccgagccggcagagcaccgtccagcggaggaggaggaggccgcggcggccggcgaggatgaggacaccggcgcccaggtcgcgcccatcgtgaagctggaggaggtcgccgttaccaccggagaggaggacgaggacgcgctcctggacatgaaggcgaagctctaccggttcgacaaggaggggaaccagtggaaagagcgcggcacaggcactgtgaagctgctcaagcacaaagacaccgccaaggtccgcctcgtcatgcgtcaggcgaagacgcttaagatctgcgccaaccatctcgtggtggcgacgactaagatgcaggagcacgcggggagcgacaagtcgtgcgtgtggcacgcgctggacttcgccgacggcgagctcaaagaggagatgtttgctatccgttttggatctgtcgagaattgcaagaagttcaaggacactgttgaagagatagctgaacagcaaggaaagagcgaggagaaagaaaatgatgaagtctncactgccgcttctgatttggcac

SEQ ID NO: 10673 - DNA, 598 bp, Zea mays
  Clone ID: LIB3279-182-Q1-K6-A7
actcaaacgcagaacaaagagagaaatggttgctgcagagagacgccaagttgatgaacgtgtcaaacagattattgaattgaaaaataaggtttgtgctggaggcgataaaaactttgtggtgatcaatcagaagggcattgaccctccatctctggacctccttgctagagcggggattattgctcttcgaagagcaaagaggagaaatatggagaggcttgtgctagcatgtggtggtgaagctgtcaattcagttgatgagttgactgaagattgtctaggctgggctggtcttgtctatgagcatgttcttggagaagaaaagtacacatttgtggagaatgtgaaaaatcctcgctcttgtactatactgattaaaggacctaatgaccataccattgcacaaatcaaggatgctgtccgtgatggtctaagatctgttaagaacacagttgaggatgaagcagttgtgctgggtgctggtgcttttgaggttgctgcaaagaagcatcttatcgacaatgtgaagaaaaccgtcaaaggacgagcacaacttggggtggaggcgtttgcggaagctcttcttgttataccc

SEQ ID NO: 10674 - DNA, 625 bp, Zea mays
  unsure (1)..(625): unsure at all n locations; Clone ID: LIB3279-182-Q1-K6-A8
gcgagcagatcctcctccctttctgcttcctggcctcctctctgcctccccgcgccgatctcgagcacctggggagaccgcgaggcgtgcgcctgatttttctcatcgcagcagccctcaagttccccacctcttttttcttgcagctttcaattaatctgattatttagctacatctttattttactttcattttgcctttaatctgtttagttccattgcagcttctgcggttgcggttagtattgctgtttcttgctccttgtttcttgttcttttgcttctaaccatggacgcaggaacctactccatctcatcagagaagagccacacggcggcagcggcgcggccccctcttcaggaggccggcactcggccctacatgccgtcgctgagcacaggatcgcgcaacccgtcggccaagtgctacggcgataggttcattccggacaggtcggcgatggatatggacatggcgcactacctgctcacgaagcccaggagggacaaggagaacgctgtggcagcgtccccatccaaggaggcgtaccggaggctgctcgccgagaaagtgctcaacaaccggacacgcatncttgccttcnagaacagccgnctgtgtctg

SEQ ID NO: 10675 - DNA, 634 bp, Zea mays
  Clone ID: LIB3279-182-Q1-K6-A9
cgcgcaccttccaccacgctctggaagctggttcccctttctcgagagtttagaaagctggtgcagagatggccggggagagctgcgtccccaagcccctgttcggcggcgccatcttcaccaccttccccgaccgcttccaggacgtgagcaacatccgggaggtccccgaccatcaggaggtgctcgttgatccatcccgcgacgagagcctcattttcgagctacttgacctcaagggcgaggtggacgacgccggcagcgcgctctggttcctgcaagacatcgccaacgagcaagacgccggggacaacttggtggtagagcattctgggacacttgaactggctgctttgcatctcggagaagctcctgcagtggctgcaactgcagttggccagctggccgtctcaaaagggaggcagggcagagaagcacaaaacattgttcgaatttacctggcaaacatacgccttaagaatgcggcaaccgatgtacttatcaccgcatatgagccattgttgataaaccccctgagtgaaagtgctgtggcagttgcagctggtcccgcaatacctgctgaacaagtagggtgcttgccaatgtctgaggtcttcaaacttgcagtgacgaa

SEQ ID NO: 10676 - DNA, 579 bp, Zea mays
  unsure (1)..(579): unsure at all n locations; Clone ID: LIB3279-182-Q1-K6-B1
ggcggcgagatgaacggcggcggggaggacgggaagcagcagccgcacctggtactggcgcacaagctgttcctcctgtcgcactccgacgtcgacgacctcgccaaggtcgacctacgcgctgacgtgttcgcggcagtcaaatccgatgacatggcagctctgtacgagtcgttggcggcggacggcgtactggagacggacgcggcgctgctggccgagatgcgcgccaggatcgacgaggagatccggaagctcgacgagaagattgctgatgcagaggagaacttgggtgagagtgaagtgcgtgaggcccatctcgccaaatccttatatttcataagggttggggagaaggagaaagcactggagcagcttaaagttactgaaggaaaaactgtagctgttgggcaaaagatggaccttgttttctacacactacaaataggattgttctatatggactntgatctcatctcgaagtccattgacaaagcgaaaaacttgtttgaggaaggtggtgattgngaaaggaagaacagattgaaagtatatgaaggggtgtactgcatggcaact

SEQ ID NO: 10677 - DNA, 636 bp, Zea mays
  unsure (1)..(636): unsure at all n locations; Clone ID: LIB3279-182-Q1-K6-B10
gaccttgatgtcaaccagcacgtgaataacgtcaagtacatcggttggattcttgagagtgctccgatcgcgatcctggagaagcacgagctcgcaagcatgacgctggattacaggaaggagtgcggacgcgacagcgtgctgcagtcgctcaccaccgtcgcgggtgaatgcgtagacggcgacacagactccaccatccagtgcgaccacctgctccagctggaaacaggagccgatattgtgaaggcgcacacggagtggcgcccgaagcgggcgcatggtgaggggacccccatggggggtttcccggcggagagcgcgtgaatccatatttggcagggtgagggggacggctgtgaagcacagatcctatgtttatgggtacactaacgcccaactgagttgagtgtgttttggttggttggttggtcgcgacaagtatggcaggcacatgggggagcgccgcattacccacacccaacctggggatttggccaagacaaaagcccagcggtatgaggatcgaggaagcagaccanaattgttgcggagcgagaggactgggatcagtgtgtgttgtgggttgctgggcaggatacatgcagggggagctgatggtttgcaggggatgat

SEQ ID NO: 10678 - DNA, 602 bp, Zea mays
  Clone ID: LIB3279-182-Q1-K6-B11
tctttctcgtgggctggcgtgcagcttcgcctgggacgccgtgccgggctacctcttcccgacgctgacgtccatctcgtgggtgtgctgggtcttctccaggtccgtgacggcgcagcagctggggtcgggcatgagcggcctcggcctcggcgccttcacgctcgactggtccaccggctggtgcttcctctttatttttctcatctcgcccttcttcgccaccgccaacatcttctttggctacgtgttctttgtctacgtcatcatgcctgcagcgtactgggggttcgacttgtacagcgccaagacgttccccatcttctcctcgcacctgttcatgtcgaacggcagcagctacgacgtccaatcgatcgtgaacaaccggtttgagcttgacctggacgcttatggtaagaacggcaaggtcagcctcagcgtgttctttgcactcagttatgggttcagcttcgccaccattgccgccaccatcactcatgtcgggctcttctatgggaaggaaatctactaccgtttcagatcgtcgcagaaggagaagcctgacatccacacgaagctgatggagaggtacagcgaaatcc

SEQ ID NO: 10679 - DNA, 606 bp, Zea mays
  Clone ID: LIB3279-182-Q1-K6-B12
tcctagaacgctttagccgtagccggagggcgggggaggggagtgagctagctggtgcacaccggcatggcggccacggcgtactccgtggcgctcctcggcggcgcgcgcctccccgccgctccgcgctccgccctcctccctcggcgcagcgtctgccagcttcgcttccaagatggggggggggggtcctcgctcgtgcgaaggccgcttccgaggacacatcggcctccggcgacgagttgatcgaggacctcaaagcgaagtgggacgccgttgaggacaagcccaccgtcctcttgtacggcggcggcgccgtcgtcgccctctggctgacgtccgtggtcgtgggcgccatcaacgccgtgccgctgctccccaagatcctggagctcgttgggctcggctacaccggctggttcgtgtaccgctaccttctcttcaaggaaagcaggaaagagttggccgccgacattgagaccttgaagaaaaaaatagctggaacagaataaacgctcatggaaagttttagagcgtcctttcttctttggaaagagatctattcgatcggagaaccaatgcaactacttgagtactattattgcc

SEQ ID NO: 10680 - DNA, 318 bp, Zea mays
  Clone ID: LIB3279-182-Q1-K6-B2
ccccgcgtccgaaggaatccgtcctcgcccagatggccgagctgaagaagaactgtacgggaagttcaaggacgccatcaacctggaggaagattaagagtagtactggagttgtgacaacgtggctgtctcgttctagttcaggtcctgtttttgttcccctgctccccccacagaagcgcttggcccgctcgtgtaatggaagcttgagtctctcagtctttcagaagctcttttcaccaagaacccagaatagttttcattctgcgggtttatacggattgaagctaatggcgctgagcccatgaatccttttcc

SEQ ID NO: 10681 - DNA, 611 bp, Zea mays
  Clone ID: LIB3279-182-Q1-K6-B3
ggagagggtcgacaccatccttagctattttgatctcccgcctaaccaaatgccacagttcatgacgctgtactttgaggatcctgatcaccaggggcaccaggtgggtcctgacgatccctcaatcaccgatgcggtcgtacatatagatgagatgctcgggaggctcattgctggtttggaggctaggggaatgtttgaggatgtgaacattatattggtaggtgaccatggtatggttgggacctgcgataggaagcttgtgtttctcgaagagttggctccatggatcgagttgaagtcagattgggttctgtcagtgacgccattgctggcaatcaggccgccagatggtgtgtcgccagctgaggttgtggccaagatgaatgaggggcttggatctgggaaggtgaagaatggggaatatttgaaaatgtacttaaaagaggagttgcctactcgcctgcattattcagagagttacaggatcccaccaatcatcgggctggttggggaagggtataagatcgagatgaagcgctccaagagaaatgagtgtggaggagcccatgggtacgacaatgccttcttctcaatgaggaccatatttg

SEQ ID NO: 10682 - DNA, 567 bp, Zea mays
  unsure (1)..(567): unsure at all n locations; Clone ID: LIB3279-182-Q1-K6-B4
cacactcgtagagagaagaaaaattccccaaaccctagctcccgatctcgatggcgaaccctcgcgtcttcttcgacatgaccgtcggcggcgccccggcgggccggatcgtgatggagctgtacgccaacgaggtgcccaagaccgcggagaacttccgcgcgctgtgcacgggcgagaagggcgtgggcaagtccgggaagccgctccactacaagggctccaccttccaccgcgtcatccccgagttcatgtgccagggcggcgacttcacccgcggcaacggcaccggcggcgagtccatctacggcgagaagttccccgacgagaagttcgtgcgcaagcacaccgcccccggtgtgctctccatggccaacgccgggcccaacaccaacggctcccagttcttcatctgcaccgtcgcgaccccttggctcgacggcaagcacgtcgtcttcggccaggtcgtcgagggcatggacgtcgtcaaggccatcgagaaggtgggcacccgcaacggctccacctncaaggtggtcaaggtcgctgactgcggacagctctcct

SEQ ID NO: 10683 - DNA, 604 bp, Zea mays
  unsure (1)..(604): unsure at all n locations; Clone ID: LIB3279-182-Q1-K6-B5
gctcggcgctctcctctcccgacgacagctacacctcacaaccgtgagctcgcgaaggaacgctgttcgcaattccggcgccggcaccatgagtaagctgcagagtgattctctgagggacgcgattgcctcaattaccaatgattcccgtgagaagcagcgcaaatttgttgaaaccattgagctacaaattggactgaagaactatgaccctcaaaaggacaagcgcttcagcggttctgttaagctgcctcacatccctcgccctaagatgaaggtttgcatgcttggtgatgctcagcatgttgaggaggcagagagaatgggtatagacaatatggatgtggaagccctcaagaagatgaacaaaaacaagaagctagtgaagaagctggcaaagaagtaccatgctttccttgcatctgaggctatcattaagcaaattcctcgtcttcttggtcctggtcttaacaaggcaggaaaattccctaccttggtgacacaccaggaatcccttgagtccaaggttaacgagacaaaggctacagttaagttccagctgaagaagtgctttgcatggggtgtgctgntgcaactgcggcat

SEQ ID NO: 10684 - DNA, 608 bp, Zea mays
  unsure (1)..(608): unsure at all n locations; Clone ID: LIB3279-182-Q1-K6-B6
gtacttgtggacgcacgggctgatctctgacgaaacctacgagaagctgcggcttgcctgccagttcgacgtatctgagcatgcgtcgaaggagtgcaacaaggtcttcgacatcgccgaggccgaggaaggcaatatcgatgcgtacagcatctacacgccgacttgcaagaagacttcactccacaagcgcaggctaatcagaggaagaacgccctggttgcccagagggtacgatccctgcacggagaagtactccacgaagtactacaacttacctgaggtgcagagagctctacacgccaatgtcaccggaataccgtatccctgggtaacctgcagtgacccagtgtatgatttttggaaagattcgccgaggtccatgcttcctatctaccgtgaactcatcgccgcgggcataaggatatgggttttcagtggcgacgctgattccgttgtcccgctcaccgcgacaaggtactccattgacgccctctttctaccgactatcacgaactggtatccttggtacgacgacgaagaggtcggtgggtggtgccaggtgtacgaggggctgnacactgtgacggtccgaggcgcagggcacg

SEQ ID NO: 10685 - DNA, 575 bp, Zea mays
  unsure (1)..(575): unsure at all n locations; Clone ID: LIB3279-182-Q1-K6-B7
ggctgcaggaggtgctgcggtcgtcggacctcaacaccacgaccaccgctgccctgcgccgccgcctcgaggaggacttcggcgccgacctctcccacaaaaaggccttcattcgggagcaggtcgacctcttcctcgccgaggtcgccgctgtgatgacccgtggccgcggctagagttcgccgggcgtgagtcggtagcagaccggtgaaaagaacgaagccaaggacaccggggtaatgatggcaaaaagaggggtggtggctttacaaaattatgcagtctttcaccggcacttcaagagtttgtcggtgcctctgagttagccaggacagaggttgtcaagaagctttgggcatatattcgagaaaataatcttcaagaccaaaacaataggaggaagattttgccggatgagagattgaagaagatcttcaatgtcaattccattgatatgtttcaaatgaataaagctttgaccaagcatatctggccattgaattctgagggtcctgtctctcctgatagatcaacacccaaagagaagccacanaagagagacaggagtgaaggaa

SEQ ID NO: 10686 - DNA, 593 bp, Zea mays
  Clone ID: LIB3279-182-Q1-K6-B8
caggcaggcaggtcggcgaggagggcaggaagaccgaagaccgagccgtgcgggggctcgggacgggaacgggacaggaccccaaaatctcagatccttcctgcccgcccgcccgtgcccgtcgacgcgtcgttcttgccggccgcgccccacctccgccctctcctcctccaggggatcggatacgccacaggctgcgcgatggtgctgtgggtcttcggctacggctccctcatctggaaccccggcttcgacttcgacgacaaaatcctcggcttcatcaagggctacaagcgcacctttaatctcgcttgcattgaccacagaggcacaccggagcatccggcgaggacctgcacgcttgaaaccgacgacgaggccatatgctggggaattgcatattgtgtcaagggtggtccagaaaaagagctaaaagcaatacagtacttggagagaagagagtgtgagtacgaccagaaaatatccattgatttctacaaggaaggagatcccttgaaaccagctgtgacgggcgtcttagtgttcgtttccactccagatccaattgggcacaagtactatcttggccctgc

SEQ ID NO: 10687 - DNA, 529 bp, Zea mays
  Clone ID: LIB3279-182-Q1-K6-B9
ccccgtgtccgcccacgcgtccgtccacgcgtccgggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctctatcgggagacgcataggtcccgcggcttccgcttcctcaccttctccacggaggaggcgatgcggaacgccatcgagggcatgaacggcaaggagctggacggccgcaacatcaccgtcaacgaggcccagtcccgcggcggccgtggaggcggcggccgcggcgggtactgtggtggccgtggaggcggcggctactgcggtggcgggcgccgtgatggctgcggcggctacagcggtggcggcggctacggtggtggcggcggcggctactgtggtggtggcggcggcta

SEQ ID NO: 10688 - DNA, 624 bp, Zea mays
  Clone ID: LIB3279-182-Q1-K6-C1
cccacgcgtccgggactggcccatccacagtggagcgagccatcctagtttccttcctcttccgactcacacctcacctccggcgacgcacgctgccgctgccgccgccgtgcgcccgcctatctacaatcttttaccgtgctgccgcagaggtctcgtcctcaccatccccgtaggaagccgaagtacagccagaagcgtcgtcacaactcacaagcactgatcatggccgactacgatcaggagcaagagatggaggtggaggcgctgcaggccatcctcatggacgacatcaaggagatcgacccaagtgagagtgggatcgctaccaccgcccggtgcttccagatcctactctctcctcaggatgatgattttgacgagtcagcttatgtcccagttcaactggccctgatttttgcgcacactgagaagtaccctgatgaacctccggtactgaatgtcaaaagtgtacgagggattaaaccacatgatcttgcatccctaaaggaaaagattcagcgagaggcaacagagaatcttggcatggctatggtctacactcttgtttcatcagccaaagagtggctaagtgagaaatatggtcagaatggtgctgatgag

SEQ ID NO: 10689 - DNA, 568 bp, Zea mays
  unsure (1)..(568): unsure at all n locations; Clone ID: LIB3279-182-Q1-K6-C10
cgcggtgatgacggngaactcgggcggggccgttgcgcacgatgcaagcgcgtatgcgccatctgtacctctgctaactaggataaaaggacaccggtgctaacccttcgggacctaacaacttcgcccacccaagccgcgccacgcagacaaaagtcgccgccgtgaggaagagagattacgacgttagtctttcctcggttcctcggcgaatcagctctgttgaagcgtggttggtcgttgccaggagtcgttggagtcaatttgagtaccgcgggtggctgccttcgcctcgtgtgcagctaattgctcaccggagcccatctccaccacgggatctgccgcttcgtgaaccggccacgccacgacccgagtgcagacgagcaggctactgaggatccaggggttcagcaggtggagactgccgagcagaagctcgttgaagctgagctatcaccgctgccggagccgtacaatcccctggccgatctggagatgaaggaagcactggacgttatgagccttgccaattctattatcaacgaagttgtcgacaaattattaaacg

SEQ ID NO: 10690 - DNA, 632 bp, Zea mays
  Clone ID: LIB3279-182-Q1-K6-C11
ttttactgttggcaatgctcgatctggtgggttcgttgctcctacaccaggtattcctgtcagccaaatttggacccagagatcttctctggctggggagcaagcggcagcagggaacttcgacacagcaatgaggttgcttagccgccagttgggtatcaagaactttgttccactgagggggggggttattgatctgcacatgggcagtcatacatatatgcgtgcgtttgccgctgcgcctgttatatcagttgcagtagagaaaggttggaatgagtctgcaagtcctaatgtgaggggccctcctgcacttgttttcagcttctcacaaatggaagatagactcaaggctgcctacaaagccacaactgagggcaagttccccgaagcactgagacagttccttagcatcttgcataccattccagttattgtggtggattcgcggagagaagttgatgaggtgaaggaattaatcgagatagtgagggagtatgttcttggtctgaggatggaactcaagagaaaggaattgagggatgatgtgacccgtcagcaggagttggctgcttacttcacgaactgcaagcttcagaaagtcatatgaggcttgtgctcgcaagcgctat

SEQ ID NO: 10691 - DNA, 416 bp, Zea mays
  unsure (1)..(416): unsure at all n locations; Clone ID: LIB3279-182-Q1-K6-C12
cgggnncgacccacgcgnccttctctaggggacattattagataaccggggtaggggggggtttttttttgcccgtgacaaactttatcagccactgtagtagggtctacagaccttatccttcgtttagattcagatttcagagggacggtttatatttgcaattaggaggactatgtagcttttacattggttgggccgcnagggggttccctcncttctgnannggaannnaaaaactgaggaggccactatcactttcaaacccccacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggccgcccaaggggacccaagcaaacgaccgcggg

SEQ ID NO: 10692 - DNA, 674 bp, Zea mays
  unsure (1)..(674): unsure at all n locations; Clone ID: LIB3279-182-Q1-K6-C2
ggggtgagagagagaggcgaggaaggagggagagagcacgggggcttgatcgaagatggatgccggagcaaaggtggtgaagaaggccgcggcggggcgtcgcggcgggggcggccccaagaagaagccggtctctcgctccgtgaaggccggcctccagttccccgtaggccgtatcggccgctacctcaagcagggtcgctactcccagcgtgtcggcaccggcgcccccgtctacctcgctgccgtcctcgagtacctcgccgccgagctcctcgagttggcggggaacgcagcgcgggacaacaagaagaaccggatcatcccgcgacacgtactgctggcgatccgcaacgatgaggagctcgggaagctactggccggcgtcaccatcgcacacggcggggttctgcccaacatcaaccctgtgctgctccccaagaaaaccgctgtcgctgctgccaaggaaggcaaagagaagaagtcacccaagaaggccgccgccgccaagtcgcccaaaaggtggccgcctcgtaggtccctggcaatgctgatgcactgtctctctctgtcctctctgaactgaaacgctcctaactgtcgttgtcggtcatggtcgttgttgtttgatgcgcttttattgtggnntgtcgtgtgtaattgcttgcctttcg

SEQ ID NO: 10693 - DNA, 612 bp, Zea mays
  Clone ID: LIB3279-182-Q1-K6-C3
gcgctcgtcacctccaatcaacaaattcccaatccgccgcttcccatcccgcgttcgccgctccatttgatcgaattcccgatggcgcccaaggccgagaagaagcccgcggagaagaagccgacggaggagaaggccgagaagaacccaggcggagaagcgcgtgccgggcaaggagggcggcgagaagaaggggaagaagaaggccaagaagagcgtcgagacgtacaagatctacatcttcaaggtgctcaagcaggtgcacccggacattggtatctcgtccaaggccatgtccatcatgaactccttcatcaacgacatcttcgagaagctggctgccgaggccgccaagctcgcccgctacaacaagaagcccaccataacctcccgggagatccagacttcggtgcgcctcgtccttcctggcgagctcgccaagcacgccgtctccgagggcaccaaggccgttaccaagtttacttcctcttagatcgccgccgcacggagcgacggctctgtttcgtttcctcgtacttttaggccagtgctaataggttgctcgaggaacaatgtagtgtggaaatttctaatatattccaaattgtgctg

SEQ ID NO: 10694 - DNA, 78 bp, Zea mays
  Clone ID: LIB3279-182-Q1-K6-C4
cccagcgtccgcccacgcgtccgttttgttgtattaagtcttcttgttagcccattaaacgatgagatcgtatacttg

SEQ ID NO: 10695 - DNA, 642 bp, Zea mays
  unsure (1)..(642): unsure at all n locations; Clone ID: LIB3279-182-Q1-K6-C5
ccgtaaaaccgacaanacgatagcaaatcgaaggaggacacggctgctggtggccgcattcggtcgggggaggagcacgaggagccatggcctgcctgcacgaccacagctgcgaggatcacaactgcgccgccgactggtcgctctacaaccacatcgacgtccccaaggtggtggctctcaacgaatcggtgcccgggagcgtcaagtccgtcttcaagccctgggagcagcgccttgacacctcggggggttttctggagagtaatgagggtgaccctgagctacttattttcatcccgttcacatcagatgttaagatcaagagcatttctgttgttggtggtgctgatggaacaagcccgtcaagaatgagagcgtttatcaatagagaaggtattgacttttccgatgctcaaaacatgcagccagtgcaggaatgggaattagcagagaacctgcaaggagctcttgagtaccaaacaagatattcaaggttccaaggtgtggctaacctaactctgcatttctctgacaactttggtggtgatacaactaanatttattacattggactacgtggtgaagccactcagaacaaaagggatgtagttgcaacaattgtatatgaagtcatgccca

SEQ ID NO: 10696 - DNA, 602 bp, Zea mays
  Clone ID: LIB3279-182-Q1-K6-C6
ctagcctccactgtctcccagtccccaggtcctcatcggcctccggtcttctggtctccccagatctcccaccggggaaccctacccgagcatcagccatggcgatcgcggcgcgcgtcctgcgccgcctcccgctccacctctacccctcgctcgctcgctctttctgcgcagtttccccggccgccgcctcggccgccccggcgtccgcctcggccgccccggcgtccgccaaggtcgccgatcgcatcgtgcgcgtcctcgccatcgatctcgagggggcgcgccgcgaggtcgtcggcctctccgggcagacactcctccgcgcgctcgccaacgcggagctcatcgagccggcctcccaccgcctcgaggatatcgacgcgtgctccgccgagtgcgaggtccacatcgcgcaggagtggctcgacaagctgccgccaccgtcctacgaggagcggtacgtgctcacgcgcgcgtccaggaaccgcgagctcaacaagcacgcgcgcctgggctgccaggtcgtcctcacgccggagctgcatggcatggtcgtcgctgtccccgagcctaagccgtgggacatcccgtaatggcct

SEQ ID NO: 10697 - DNA, 613 bp, Zea mays
  Clone ID: LIB3279-182-Q1-K6-C7
gtttgtctctgcctcctctggcccattcagtcagttaccctcaatggccgacgaccccctggactcgtccccgtcggcgtccgccgccgccgctgctggcggagtctcctccggcccccgcccagcgctccggccccggcgggaggcatttgagtacgggctcctgccgatccccaagctggtcttcccagaaggcgcgctgacgcaaaccctatcccagctgaaggagaggctcgcgccgggggggccgcgggtgggcgccgcagcgctcgctgaggcgctgcagatccctgccgagcaggcagcgctggcgctcggaacgctcgctgcggtgctacccgcggaggattcggcgctcggcgaggacggctcggggagtgctgacctccgcgacctgcttcttttcctctacatccaatcctacaagcgcctcgtgccgcgcgtgcacaaggactcgcccgccgtcacggatgtttggccgtcgacctccgccttcgatggatacctctccgcgctgtcgccgatccagtttgtacggagcaatagtcgccgttttatgccttcacaagcagatgaagaagctcatcagctatcgtatttacaaaagcatatg

SEQ ID NO: 10698 - DNA, 668 bp, Zea mays
  unsure (1)..(668): unsure at all n locations; Clone ID: LIB3279-182-Q1-K6-C8
cggacgcgtgggtgcttctgcccatctcatcacagtggaaaaggggaaggcgttaggtagcggcacatttggtcaggtttacgttggattcaacagtgaaagcgggaagttttgtgcaataaaggaggtacaagttattttggatgattcaaagtcaaaagaacgcctcagacaattgaatcaggaagtagatatgcttacgcaactcacacaccaaaacattgtgcaatactatggaagtgaactgactgatgaggcactgtccatctatcttgagtatgtttctggaggttcaatcgataaattgcttaaatactatggtccttttaaggaacctgtgattcgtaattatacgaagcagattctttctggacttgcctacttgcatggtaggaaaactgtgcacagagacgtaaaaggtgcaaacgtacttgttggcccaaatggcgaagtcaaacttgctgattttggcatggctaaacatataacatctttagccgaaatacactcattgagaggaagcccatactggatggctcctgaggttataatgaataaaaatgggtacagttttgaaagtgatatctgnagccttnggtgcacaattatttgaatgggaactgggagacattctgggcatcagtttgaacatgtacacgcaatgttta

SEQ ID NO: 10699 - DNA, 618 bp, Zea mays
  Clone ID: LIB3279-182-Q1-K6-D1
gtttagtctaatcaagccatggtgttgaaacttgaccatacttgtctcaatgagactttggagtgaaccaaatgagcttatgttcttatatgactactagctagaagttagagcctagatgatggctgcttctgttggcgtgaaagctcgagtgctcctaaatggtcgtcgtattagctgatacgacatctacccgatgcaatagataatattgtttacacgcgtgagtccaaaattgttggctttgggtcggagcagttaatgcgagaagtgtattttatcacttctgagtgcaaccttttttttattatttttccgagcttctgcctcttgcatatgttgtagattctcgccgagaagggagtagtagtattacctgatatctatgctaattcaggtggtgtggtcgttagctactttaattgagtgggttcaggtaaaatgcatgttcgtcgctgcttcattgctcgattggttccttgctctaatctgctttcttgtgccatgttgattgatcgtgcagaacattcaaggtttcatgtgggccgaggagaaagtggacgatgaactagaaaaggacatgagcagtgcttttcaacacatgaaagccatgtgcaa

SEQ ID NO: 10700 - DNA, 420 bp, Zea mays
  Clone ID: LIB3279-182-Q1-K6-D10
cggacgcgtgggtgcttctggggcgtggagctcgcgttccagcgcgtgccgggagtcacgcgcacggaggtcggctacagccagggcaacatccacgatccgacctacgaggacgtctgcaccggcaccacaaaccacaacgaggtcgtccgcgtgcagtacgacccggccgcctgcaagtacgacgacctcctcgacaccttctgggcgcgccacgaccccactactcccaaccgacagggcaatgatgttggaacacagtataggtcagggatatactactataacccagagcaggagaaggcggcaagagagtccctggagaagcagcagaagcttctgaaccggaagatcgtcaccgagatcgttccagcgaagaggttctatagagcagaagagtaccatcagcagtacctggag

SEQ ID NO: 10701 - DNA, 564 bp, Zea mays
  Clone ID: LIB3279-182-Q1-K6-D11
ccgggctcgacccaggcgtcctttatattatgggagtgttggttggggggggggggggtgcgggaacgtttttaggataacaccaccgttgtgcttcaccaaagagattccgacttcttcattgaggtgatggacattgcgctctccaagctgtgaggcatgcagggcgaagatgatgtgcaaaccctgataccgtcgcgcgggggggggggggcccatttttattattaagattaatgagacagcacctcgttgtctcttaatctaagacgatgccatgtcatccggtggcatggtattcctaatcctacctgcccataaataagggacgagttgtgagacagcacctcgctgtctcgtaatcagacccatggcgcaatatgattcttgttaactctagcttcatccaatctgttcctcctgatctaacctagtctgaatagcagctgtccgcttgtgaccaatatcaactttttttcagatgctccatatattcctgctctctgtaaaccaaccattatcactgttcaaatacatgccggaaatgtggatttacacatttac

SEQ ID NO: 10702 - DNA, 427 bp, Zea mays
  unsure (1)..(427): unsure at all n locations; Clone ID: LIB3279-182-Q1-K6-D12
cgcgcgaaaaaaacgcgggggggggggggggggcggcaacacagcgggccctggccccggccgcggcgaccgccgaggcgaggaacaccaagacgacgaccggagaagaaggacgacgcggcggggcagccgcagacccacccgccctacgaccgccccagaggggggggggggggggggttttccctcctttccggcgggagcanaccgggcagcagggggcggggngaagnacgccgcccccgngagganggnnngngggnnnaaggngcccggnagcgggaggaagcaccaaaaaaaaaaaagcaccccgggccccagcggcnccggcggcacgcccggggcccccaccggcgggnccgnccccgagcacgccaacaagcccngaacnccggcgggccggccgaaccgacgccggagcgagggc

SEQ ID NO: 10703 - DNA, 621 bp, Zea mays
  unsure (1)..(621): unsure at all n locations; Clone ID: LIB3279-182-Q1-K6-D2
ggccattcctggcctccgttatcggtgcccgaaccctccactccatccctccacggctgaggtaccattcccgtcgcagcgaattgcgccaatgagggtggctcttgtcgaggcctgatccggagacctaaccaccgggactttttgtcggcgccgtcgggttcgagcggcggcggcgatgttttggaaggatagcggcagccggagcagcagtggcagcggtcgggatcagaacggcgtcggccccttcggccaagtgcgcgtcctcatcgtcggtgattcaggtgttgggaaatcttcattggtgcatctcattttgaaaagttctgccattgctcgaccatctcaaacagtaggatgcactgtgggcattaaacatgttacttacggaagtgcaggcggttcatctaataacatcagtgacgctgaaaggaacttctttgttgagctttgggatgtctcaggacacgaacggtacaaggcatgccggtcgattntctatacacaaataaatggtgtcatatttgtttacgatctctcccagaggaagaccaagacgaatctgaataaatgggcagttgaagttgctgaaactggcaccctttcagctccattgggatc

SEQ ID NO: 10704 - DNA, 594 bp, Zea mays
  Clone ID: LIB3279-182-Q1-K6-D3
ccgcccttttttttttttttttttttttttcagaaccacaaattgtgctaaaaagtttgacatcaaggggatacagtaacaatggtttctcaaaacaggtaatgtttcacaaaactaagccccgaaactaattccagaacttaggtacgaggagcagcagcagctgcagctgcaggagctgcaccgcctgggcgcggcgggccctgaccaggccttgggccatcatcccggcgtctgaagcgctgcgggggctcacggttcctcctgttctcacgagagcggacacggacaatgtgcgcatggattgcgcatgagacacagtgatgaacctttgcatacaatttgggtagaacatatccatcatgtacacaggcctcctgcacatctctcacggcagcctgctcaacaatgttcctcaccaagaaccgcttgatagccttatccttgggacagcacttggcgcagttggagcagcggatgtacttgacgtggccgcgcccgtgcttgttgcgtccgccattcctccgcttgaacgtcatggctggatgagctcgaagccgccgctgacgagggctagggtacggtgcgcgaaac

SEQ ID NO: 10705 - DNA, 518 bp, Zea mays
  Clone ID: LIB3279-182-Q1-K6-D4
cggacgcgtgggtggacggccatttcctccactgttcaactttaaacaggaactagcaaatgcctccccagagctcatcaacaggttgatcccagaccatgctaggcggcatcttgggctcacattattgcccgctactggaccataggcgaaggctctatggtggtgcggaaggcaacctgcatgttcccacattcaaggtgtagaatctgacaattattggaaggtcaaacatgagctggcgcgtaaggagaggtggtatgttctcgtgcagccatccttaatttgtcgcatgtcttaatgcaaaaatctgatttttgcccaagtagtgagaggagggaagggggtggtcggtgtattgttaagctattgaaggaattcgatccctgctattgtgttactttctccaacgtttaaacgttgtagtgcgcctgtaagtgttccatatatcccctgttgtcagtcagtgtaattctgtaaatgttattaatgggaaattatttcgtgcttttccaacc

SEQ ID NO: 10706 - DNA, 582 bp, Zea mays
  unsure (1)..(582): unsure at all n locations; Clone ID: LIB3279-182-Q1-K6-D5
ctcccggcgcaataaacaagtcgaggcgaggcgaggcggcagcggcggcggcggcattgccgagatttccgtgattcttgcgcttgttagttgtgctgtgtatagttgggccggccgggggtggttccgttcagttccttatctgttggagtagtcgtcggcggcgatgggtatcctcgcgctcatcaccggcaaggcgggcgccagcgggttcgggtcggcgtccacggcggagcaggtcaccgacggcgctgacgccagccgcctcaccgtcgctatcacaggaggagctagtggcattggtctggagacatcaagagtcttcgccctgagaggagcccatgtggtcatcgctgctagaaacacagaggctgcatcagaagcaagaaagaccatcatggagaagaacccaacggcacgtattgatgttctgaagctagacctcagctccctcaagtctgtcagggcttttgtggaccagttcaactcgatgaaactccctctaaacatcctgataaataatgcangcgtcatgttctgcccttttcaactgtctaaagacngngtcgagatgcagttcgc

SEQ ID NO: 10707 - DNA, 435 bp, Zea mays
  Clone ID: LIB3279-182-Q1-K6-D6
accagttacaaggactacgaaccctcaggtgaaactccggtgaggtctgagccgaacgtgccaagcaaaggctcgattgaatcgctgcgagccatgcccgtggagaccatgatgaatgagttccgtgagaaccatccgtatgaacatgaatcgagcaaagaatctaagttatctcagatacctcgcttgccgctcgcgacaatcaactgagacattcacttccctatgtgcagtgtacttttattagtagggcgtcaatttgccggttttggtgtcccttgtgcacttgtgctaggttaaccatggggtgtgagctgccttggctctctccagtgcatttcccttttttcccgcattcaattatctgtaatgttctgttgtgccttgtacgatactgatattgtacagcatcagatatgtgccaaagctagcttg

SEQ ID NO: 10708 - DNA, 650 bp, Zea mays
  unsure (1)..(650): unsure at all n locations; Clone ID: LIB3279-182-Q1-K6-D8
ccccgcgtccgcgagtctccatccattctctccgctcatccgcagctctctagtctccagctctagctagccttagcctcgtccaagggacgaaggggccaccatgagcgtggtgatcctggacggctccacggtgcgcggcttcgtggcggacgaggcggccttcgcgcgcagcctggacgcgcggttcgccgcgctggacgccaacggcgacggcgtgctgtcccgcgccgagctccggcgcgcgctcgagtccttccgcctcctcgacggcggcggcttcgggtccgcccagccggcgccgctccccgccgaggtcgccgcgctctacgacgccgtcttcgagcagttcgacgccgaccacagcggcgccgtcgaccgcgccgagttccacgacgagatgcgccgcatcatgctcgccgtcgccgacgggctcggctcccagccgctccaggtcgccgtggacgacgagggcgggagcttcctgctcgaggcagccgagcacgaagccgctgggatcgccgctaagatcgaagccaaccgcaaggccccagcggaggcngnnagcgccaagtgacgacgtgtccctcgtgcgggccctgcgcttgattttctgggtgtttgctactacgtactagtactacttacct

SEQ ID NO: 10709 - DNA, 593 bp, Zea mays
  Clone ID: LIB3279-182-Q1-K6-D9
ctatagagtcggagaagaggctgcagaagctgtccatgaaagattcgtcagaggactcaaatgtccggaagaatgtccagcgttctcttgctacagacctgcaaaacctgtcaatggagttccggaaaaagcagtcgtcgtatctaaagcagcttcgtcaacaaaaagagggtcaggacggtgttgatttggaaatgaatataaacggagcaaagtctacatttgaagatgatgagtttgacgatgtgggtttcactgaggttcagatgtcaaaacttaagaaaagcgaagccttcactagagaaagggagagagaaattgagcaggttgttgaatcagtcaacgaacttgcacagatcatgaaggatctttcagttctcgtgattgatcagggaaccatcatcgatcggatagactacaacatacagaatgttgcagcttcagttgaggagggttacaaacaattgcaaaaggctgagaggacccagaagaaagggggcatggtgatgtgtgccactgtccttgtcattctaatcttcatcatgatagtccttctgattttgaaggagatcattttctgacatacataccta

SEQ ID NO: 10710 - DNA, 509 bp, Zea mays
  Clone ID: LIB3279-182-Q1-K6-E1
gttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggcgggtacggtggtggccgtggaggcggcggctacggcggtggcgggcgccgtgatggcggcggcggctacggcggtggcggcggctactgtggtggcggcggcggctacggtggtggtggcggcggctacggcggtggcaa

SEQ ID NO: 10711 - DNA, 575 bp, Zea mays
  Clone ID: LIB3279-182-Q1-K6-E10
attgtctattacaacgacccccgtcgtcccccataggcagagccaaggcgacgaggttggtacctcccccctcccgctccccagcctcaccgtcgccagagcgtcctgccgagaggctcacatgggcatgaggatggcggcaacggggagctgctctgctcttccctctcgcacacatgcaccccctccacggccctcatcctatctcgactgtggcttcgccagcacattgaggttcgacggatctaggccccatcggcttagatcttgccctccctcgccggatctacaccatggaggtggtggtccttctggggaggagagctgaaacctgcttgggcgttaggaggctacatggatagagagatgatgtaggtaatttagccttttcgccccaattatgctccagtatttgctgatgtaccaccaaatgtttttgaggagcatgcctcaccatcacctgagcagatattgcaacgcgggctggtgaaataggggaactaggcaattgtttagattctggtaaaatggaatgagctaccagcagaaatggctttctgggaagactaccatgt

SEQ ID NO: 10712 - DNA, 601 bp, Zea mays
  Clone ID: LIB3279-182-Q1-K6-E11
gttccactactattccattggcccttgccctcgtatagcacgatgccgccgccgccgcttgagttcgcgatcctcgccgctgcctgcaggttcagcaagccccttaccgttctcaggaggcttggcgttcttggcccaccaaccgttcgacgcaatgccttagaggcgttcgtgccttcaccgtttcgccaggttgtcgttcagagtggaaagcttcttgggacaccaaggttctgccacgccactgctggcatgtcagaatgtctcccggacgtctacgccagtcaggtactgaaggttctcaagtccaccagtgctgacaacgcggatctcagcggtgctcttcatcagttcgcggtccacatggatgaggatattatcctcatggtcctccagaagcagcggtccaactggcaggtcgccctggcattcttcaactgggcggcaaccctgccggggtatgcccacgggtcaagggcctacaccgagatgctggacattcttgggcggatgaagaggtcagacacatgaggcagctgtttgacgagattcctgaggagcgacatcaggtggtcgtgacgaataagatgtttgccgtgct

SEQ ID NO: 10713 - DNA, 583 bp, Zea mays
  unsure (1)..(583): unsure at all n locations; Clone ID: LIB3279-182-Q1-K6-E12
tcctgagcccggncgcggacgcagcgggcgggggggagctcgtcttcggcggcgtcgaccctgcgcacttcagcgggaaccacacctacgtccccgtctcccgcaagggatactggcagttcgacatgggggaccttctcatcgacggccactccaccggtttctgcgccaaggggtgcgcgggggggggttnctggttttccttgctcgctggcccaacggccataattgcccaggtgaacgaagcgatcggggctgacgggatcatcagcacggagtgcaaggaagttgtgagccagtacggagagatgatcctcgacatgctcatcgcacagacggatccacagagggtgtgcagccaggttggtctgtgcgtgttcgatggcgctcgatctgtcaggtgagaggctctgttttgcttgacacagcaagcatgttcttgttcttctcatgctagtggtaaactatcatcagatcacgcgaaaactttctgcagcgaggggattgaatctgtcgtcgggaaagaaaactgggctcagatgtcatgtgctcggcctgtcagatggctgtcgtgtggatagag

SEQ ID NO: 10714 - DNA, 643 bp, Zea mays
  unsure (1)..(643): unsure at all n locations; Clone ID: LIB3279-182-Q1-K6-E2
cgccctctagccttcgtgccgtctgcccgcccgccgtctagtcctctcttcgttctcttcctctcgcgctagcagagcggaggaggaggagaccaaccgggttggtggacgtgggcgggaggtgtgtgcgtgtgtcgtttcatggggcggacgccgtgctgcgacagggcggccgtgaagcggggcccgtggtcgccggaggaggacgaggcgctgcgcagctacgtccagcgccacggcagcggcggcaactggatcaccatgcccaagaaagccggtgagcgatcgagcgtgtgctccccttagcttgtgtgtatgtgccatatgtagctagcaagagccatatatgcacaggtgcactgacgacgggtcgatcgttgccggtcggcgtcgcgtgcagggctcaagaggtgcggcaagagctgcaggctgcgctggctcaactacctccgcccggacatccgccacggcggcttcaccgccgaggaggacgccgtcatcatgtccctctacgcccagcttcggagcaagtgagtactgatcgtacacatgtgaatncgagaagctcttcttncttcttcgatcctncaatatcttgagccgagcgcatgccatgccatgcccaaagcgtctccttaatttg

SEQ ID NO: 10715 - DNA, 628 bp, Zea mays
  unsure (1)..(628): unsure at all n locations; Clone ID: LIB3279-182-Q1-K6-E3
cacatatctacagaactctgggagagaacttcaatgagagagttttgccttcaatcatccatgaaacactgaaagctgttgttgctcaatataatgctagtcagctgatcacacagagagagactgtgagtagggagattaggaagatactgactgagagggctagattcttcaacattgctcttgatgacgtctccatcacaagcctgagctttgggaaggagtttactcatgccattgaagcgaagcaggttgctgcacaggaagctgagcgtgctaagttcattgtcgagaaagctgaacaagataagagaagtgcaattatcagggctcagggagaggctaagagtgcggagctgattggtcaagccatagcgaacaaccctgccttccttgccctgaggcagattgaagctgcaagggagatctcccacaccatttcggcctcagccaacaaggtgttcctggactccaacgacctgctgctcaacctccagcagctgaatgtatcgagcaagcagaagaaatgatgtcacaacgttatcccctttcttctgagtttgcagtcagtagtggatgcctttgtaccagacattgtgaggaacgctncgttttggatgtagtttcg

SEQ ID NO: 10716 - DNA, 637 bp, Zea mays
  unsure (1)..(637): unsure at all n locations; Clone ID: LIB3279-182-Q1-K6-E4
cccacgcgtccgcgcagcgctgggaaggacacgggggagcggagcgaggcgggggacccgcggttttgtcgcccggatggcggcggagcgatgacactggcggcgggtgcggcgcggcgttgggatgcggacgatctgcgatgtgtgcgagagcgcaccggcggtgctcttctgtgcggccgacgaggctgcgctttgccggccttgcgacgagaaggtacacatgtgcaacaagcttgctagtcggcatgtgagagttgggcttgcagaccctaataaactggcacgttgtgatatgcgagaattcacctgctttcttctactgtgagatagatggcacctcactttgcctgagctgtgatatgactgttcatgttggtggcaaaagaacccatggtagatacctgctcctaaggcaaagggttgaatttccaggagataaaccgggccatatggatgacgtgcctatggagatcaaagatcctgaaaaccagagagagcaaaacacgcccaaggagcaaatggcanaccaccataacgtcaatgatccagtctctgatggcaattgcgatggccagggtaacattgattcgaaaatgatcgatcttaatatgcgcccggctcgtactcatgggca

SEQ ID NO: 10717 - DNA, 544 bp, Zea mays
  Clone ID: LIB3279-182-Q1-K6-E5
cataccttctggcttctgcactgctctcctccacccctcaacgaagcctctggtgcctcggccaccgaagcagcctggccctgccccggcccccgggcgtggtgtcaggtctcaaggtgtggtggcgctttctcctctccggcacggtggccgcgtcatcccagctctcccgcgcggcggcggcagccgtttcctctcctgcgctcctcctgccgcacacagccagaaaattgcagctgaagtttgtttgaggataagcgacagctttgcgagtccttcgtgttgaaggagaaattgtagctgaagtgaaaaaaaaacagcagggaacaatggcactatcacgaagtatgagagcatgtttgcacagtggaagacttgcacttcttgccatattggtctctggtggaattgtattgcaaatcttggcttgtgctctctataacaactggtggccaatgctaacagttctcatgtaccttatcctaccaatgcccctcatatttttactgggttctgatacttcctccatgatgtccaatggggg

SEQ ID NO: 10718 - DNA, 479 bp, Zea mays
  Clone ID: LIB3279-182-Q1-K6-E6
cgctgagaacttcctcgcaggcggcttcaacacttgtcttcaaggctggcatggccaagtccattcaccatgctcgtgtcttgatcaagcagcgtcacatcagggttggcaggcaaattgtcaacgtcccatcattcatggtgagggtggagtctgagaagcacattgacttttcactgtcaagcccattcggtggaggccccgcaggaagggtgaagagaaagaatcagaagaaggcaagcggtggcggggatgctggtgatgaggatgaggagtgaggatggacaagtagtgttacaccaatataataatattatctagttttcttgaacttgttcgaatgatgagtgcttagctgtgtgatctgacgcagagtcccctgtgctgactctgtgtcatggatggtccattttatcttgtggtattatcagcctttacataactgctatgtttggatatgttcaattctgttgcaattt

SEQ ID NO: 10719 - DNA, 580 bp, Zea mays
  unsure (1)..(580): unsure at all n locations; Clone ID: LIB3279-182-Q1-K6-E7
gttggacatccgactcctcctctcattcttcccccctcccaccccaagttgaccggcgaaatcagcagtccgagaaccgcgagcttctgcctgatccagcctcatcccgccatggacgaatctgaggagcacagcaacggcggcgggcacccccacccgcaccacgggtacgagtggaagttcccggcggcgctgagcgcgaacacgacgagcgtgcacgtgacggcgctggacggcgtggtgaacgtgaactcgctgttcacggtggccgtgttcgtggggctgtcgctggcgacaccggggcagctgcggagcctggcaggggacccgcggtgcgacgccggcccgggcgtggcgcggtcgctgctggtgctggaggtggtggccttctcgtccttcctcttctccagcctggtggcgcagggcctgaagctggcgctcaacctcatcaactccaaggacccgcacgacgcggcgcgcgcccacatcgacgcccgcgtgctccgcctcggcatgctcgcctccgccgtcggatccgtcgtcggctgcgtcttcctgatgacgtncatggtcatggtcg

SEQ ID NO: 10720 - DNA, 623 bp, Zea mays
  unsure (1)..(623): unsure at all n locations; Clone ID: LIB3279-182-Q1-K6-E8
ggattcaaaccagcactggtttgtgctgatacatttagggctggtgcttttgatcagttaaagcaaaatgcaacgaaggccaagattcccttttatggaagctacatggaatctgatccagtgaaaattgctgttgagggtgtggagaggttcaagaaagaaaactgtgatctcatcattgtggacacaagtggaaggcacaaacaagaagcagcactctttgaagaaatgcggcaagtttcagaagcaacaaaaccagacctggtgatttttgtgatggacagtagtattggtcaggctgcatttgatcaagcacaggcatttaaacaaagtgtttctgttggtgctgtgattattacaaaaatggatggtcacgcaaaaggcggtggtgcccttagcgcggtcgcagcaacaaaaagtcctgttatattcattggaactggcgagcacattgacgagtttgaagtttttgatgtgaagccatttgttagtcgcctgttgngtatgggagattgggcaggctntatggacaagattcatgaagtggtacctacggatcaacagcctgagcttctgcagaaactgtctgaaggaagctntactctcaggcttatgtatgagca

SEQ ID NO: 10721 - DNA, 552 bp, Zea mays
  unsure (1)..(552): unsure at all n locations; Clone ID: LIB3279-182-Q1-K6-E9
tccatcgcgtccgggnaacccccactgggctatgctgataatttgttggatgttgaaccacttgaagctatacagttggagttggatgaggaggaagatgcagctgtctatgaatggttctatgatcacaaacctttgatgaagacgaagctcataaatggccctagttacaggaaatggcatgtatctcttcccataatggcaacactatatcgccttgctggccagctgttgtcagatctgatcgataggaattatttctacctatttgatatggagtctttctttactgccaaggcccttaatatgtgcattccaggtattcatgattgttttaagtgttgtaagctatggtcactgtcctgcttttggtcaccttgcacttgagagaggttagcacagagttcgtagacttttgtgggctatgcagctttcgagttaatggttacaccaaatttagcccaccaagtagtgaattagtgatgtttatctgttgtactatactactattgacatgatctttggataatgcacgtgataaagcattttctt

SEQ ID NO: 10722 - DNA, 585 bp, Zea mays
  unsure (1)..(585): unsure at all n locations; Clone ID: LIB3279-182-Q1-K6-F1
nncgtccgtgaaaatccagctaacccaaanattcactatgagactactgggcctgaaatctggaaagctacagcagngaaaaattgctggccttgtatctggtatcgggacaggaggtaccatcaccggtactgggcgatacctcagagagcaaaatcctaatgtcaagctctatggtgtggagccagtggagagtgctgttttgaatggtggaaaacctggaccacacaagattcaaggaattggagctggttttatccctggagtcttggatgttgatctccttgatgagactctacaggtttcaagtgatgaagctattgagactgccaaggctcttgctctgaaagaagggttgttggttggaatctcttctggtgcagctgcagctgcggcagttaggcttgctaagaggccagaaaacgccggaaagctatttgttgtcgtgttcccgagcttcggcgagcgctacctctcatcggtgctgttccagtccatcaagaaggaagcggaaagcatggtggtcgagcccttagacacacagttctgggcttctggcaaactatntcctgagacgttcatcat

SEQ ID NO: 10723 - DNA, 403 bp, Zea mays
  Clone ID: LIB3279-182-Q1-K6-F10
tttttattcgacattcgcccattcttcagtattaatgtcgttgccgccgagtacaatagtgattccccggtgcatccacaccaaggatttcatcaccaccagccccatcaacgattacaatggtgaagagtttgtcttctactctacaaggaagtaccgtgccaaaaaactcaataatagagtatcacagcaaccaaaatggctaattgttgccactagagagaatgtatagcctattatgtctggcacttagtgaatcgatagctttaagggcaagttatgcactcgagtgactacaatagggaagggaggccttccaaggcaagaaagtgctcgttgtcggttgtgataacacctttccaaaaataatgttcatgcctacattgtttgttcgtcgttggat

SEQ ID NO: 10724 - DNA, 604 bp, Zea mays
  unsure (1)..(604): unsure at all n locations; Clone ID: LIB3279-182-Q1-K6-F11
gggggggggggaagcagagccacnncnnccaaagaagaaagcnccggccaaagagcagaagccnaaggaagccaaaaggaggccccgaagcccaaggaagcngagaaaccagcagaggaagaggaggcnccaaagccnaagccaaagaaggggggggagtttttttttttttgcaagnnganncttgacgattggaagaggctgggttctaacaccccccccaacttccgtgaggttgctattaaaggtttctgggacatgtatgacccagagggctactccctgtggttctgtgactaccagtacaatgacgagaacacagtgtcgtttgtgactatgaacaaggttggtggcttcctgcagcggatggatctgtgccgcaaatacgcctttggcaagatgcttgtggttggctctgagccccctttcaaggtcaaggggctctggctcttccgtggccccgaaatccccaagtttgtcatggatgaggtctatgacatggagctctatgagtggaccaaggtcgacctctctgatgaggccccagaaggagcggtcaatgccatgatcgaggaccaggagccttttgagggcgaggccttgc

SEQ ID NO: 10725 - DNA, 377 bp, Zea mays
  Clone ID: LIB3279-182-Q1-K6-F2
ctaagactcacatctaaaactctcatcgcaggtggaagatcacgaggtgctgacctgttgcctgtcttattgcatagccgatcccattgccgatctacgttgttggatgtagagtaaagggcagagcagaaaaggtagactgagtaatgcattgtgtagagcacagtcgggtagcgcctacagataggcctgcttaaacgcacattgaggcaaacgctgtggatcatgctatctactagtctagctacgtgtcgagagacaattacccctactcatatcactcatcatataaagattcaacacaagcttactctcaagctctctgtgaacaactgagtgaagcattgaacattgcaaatgacaatacaagtgatgaa

SEQ ID NO: 10726 - DNA, 588 bp, Zea mays
  unsure (1)..(588): unsure at all n locations; Clone ID: LIB3279-182-Q1-K6-F3
tcggcgcatccagcgccagcgtcgcatcctcaagcagcgcctcaggtgcctccggcgctcaaccagttcacccgcaccctcgacaagaacctcgctaccaacctgttcaagatgcttcttaagtaccggcccgaagacaaggctgccaagaaggagaggcttctgaagagggcccaggctgagaatgaaggaaaaactgttgaatccaagaaaccaattgttgtgaagtatggccttaaccatgtgacttacctcattgagcagaacaaggctcagctcgttgtcatcgctcatgatgtggatccgattgaactggttgtttggcttccagccctgtgcaggaagatggaggtcccatactgcattgttaaaggaaaggctcgccttggatcgatcgttcacaagaagactgcatcagtcttgtgtctgaccactgtcaagaacgaggacaagcttgagttcagcaagatcttggaggctattaaggcgaacttcanatgacagtttgatgaagtcaggaagaagtggggaggtggcatcatgggctccaagtcgcaggccaagaccaaggccagggaaaagttgctg

SEQ ID NO: 10727 - DNA, 582 bp, Zea mays
  Clone ID: LIB3279-182-Q1-K6-F4
ctcgccacggcacagcaatggcgccgctccccgcttccctcacgccctgcctctggctcttcctctgcctcctcgctgcgccgtgccccgcggcgcgggcggcgcggttcgcgtgcaacgccacggcgccgcgagcgtccacgtgccaggcgctcgtctcctacgcgccgcccaacgggacggccacgcccacgctggccgccgtgcgggcgctcttccagctccgctcccaccgcgcgctgctggccgccaacggcctcccgctctccacgccgcccacggcgcccgcgcccgtgccgctgcgggtccgcctgccctgcctctgctcggggggcgccggggccacgttccagcggcccacgtaccgggtccgcgccggggacacgctcgacgccgtcgcgcggggcgtcttcgcggggctcgtcacataccaggacatcgccgccgccaacaacgtctccgaccccaacagggtcgccgtcggccagcagctctggatccccgtgccctgcagctgcgaccccgtgggcgggcagcccgttgtgcacttcacctacgtcgtgccgggccggggctccgtgt

SEQ ID NO: 10728 - DNA, 642 bp, Zea mays
  Clone ID: LIB3279-182-Q1-K6-F5
ggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggcgggtacggtggtggccgtggaggcggcggctacggcggtggcgggcgccgtgatggcggcggcggctacggcggtggcggcggctacggtggtggcggcggcggctacggtggtggtggcggcggctacggcggtggcaaccgtggcggcggctacggcaactccgacgggaactggaggaactgagcggtggggcccgcgcggccaagttatcctgttcgctaccgtgttgtttaccctagtcccagatgtttatcttcgttcgtctcgtgtttg

SEQ ID NO: 10729 - DNA, 674 bp, Zea mays
  Clone ID: LIB3279-182-Q1-K6-F6
ctctacccgcgcctccaaaatccaaatccgatcgatctccgcggcctccagatcccccggcgggcggagacggcgagctccaggcggccaagaagccccccctcgcagcgctcctctcctctgcctctccgaatcccttaccagggggaaaaacattgcctgaaagttcttcaggccctggtgtagcagctgaattacccagtttaatggcgaagaacgagctttagatggtctaaagatggagattttgagatagaagcaccagaaagtgtacagtggggtagcaaggatatgactgtcatgatgcctcagcgccaccgggctacagccaagaagcccatgtggataatcgtgctcttgtgcatggtttgcatcgtgctgattggggcttacgtcttcccaccgcggcgcttctctaactgctacctctctgcttcaagtgtatgcgcacctttcaaggattggctcccttctatgggccgtcgggagagaactgacgaggagattatttcatctgtagttattagggatatcctttcaatgcccatgcctatgccaaaaaatccaaagattgcccttatgttcttgacaccaggttcattgccctttgagaaaatgtgggagaagttttacagggacatgagggaagaactccatctatgtgcatgcatcac

SEQ ID NO: 10730 - DNA, 444 bp, Zea mays
  unsure (1)..(444): unsure at all n locations; Clone ID: LIB3279-182-Q1-K6-F7
cccgggtcgacccggcgtccgttttgtggcacctacatcagccgcgccggcgggctgcccagcaagtgcggcgtcgccctgccgtacaagatcagcaccaacgttaactgcaacacgattaattaaatgaggcgtcctgtgcgcgtccgggcgaggaatgcatgcatggcggagagtaataaagtaatgctanctggtattgtgagcgctagatcgaggtgtgcctgtctctagtcatttatggtgtttagcaatcgtctacacagttcgtaaacggtgtatcgtggatgcatgttgccgcgagcagagtacgtaggcatgaaccgatgtgtgcgcttctgtctgtgtactctctctatgtagtaatgtgtggccagtgggtgctttgatccagatgtattcgctcgtgagtggtgagtcgtggaagttgatcgtttcagtatc

SEQ ID NO: 10731 - DNA, 673 bp, Zea mays
  Clone ID: LIB3279-182-Q1-K6-F8
ctcgcaccttccaccacgctctggagctgtttcccctttctcgagagtttagaaagctggtgcagagatggccggggagagctgcgtccccaagcccctgttcggcggcgccatcttcaccaccttccccgaccgcttccaggacgtgagcaacatccgggaggtccccgaccatcaggaggttctcgttgatccatcccgcgacgagagcctcattttcgagctacttgacctcaagggcgaggtggacgacgccggcagcgcgctctggttcctgcaagacatcgccaacgagcaagacgccggggacaacttggtggtagagcattctgggacacttgaactggctgctttgcatctcggagaagctcctgcagtggctgcaactgcagttggccagctggccgtctcaaaagggaggcagggcagagaagcacaaaacattgttcgaatttacctggcaaacatacgccttaagaatgcggcaaccgatgtacttatcaccgcatatgagccattgttgataaaccccctgagtgaaagtgctgtggcagttgcagctggtccggcaatacctgctgaacagtagggtgcttgccaatgtctgaggtcttcaaacttgcagtgacgaatttcaatgtgcgtgattggaaccttttcgatggtggccctt

SEQ ID NO: 10732 - DNA, 620 bp, Zea mays
  Clone ID: LIB3279-182-Q1-K6-F9
cattaccaattcacgatctcctttcccgcaccgcgccccggatcgccggctcgcaattccggagttaaatttccctccaccgcaaccgtcatgggcggctcccacagccgcgaggacgtcgatctcacctcctccgacgaagaggaggaattcgaggacgactatgacgcccgatcacccatcgcggaggccgcagcgagcgcggggcagcgcgacgacgacctcctccgcaccgccacaccttcctcgcttgaggccatcgacgccaagctcaggtcgctggatctcaagtaccagagacctaccgccgccaagctctacctccacgtcggcggggcctcgccttccgcgcgctgggtgcccgccgagcgccgcgcgacctacgcattcgtcgacaagtcgagcgacgacgcctcctcccccaggtggttcctagaggttgggccggggccgcgggtctccgcgcccgtggactcggcgctccagctgaagacgatccccgcgcagcgccgggcggacttcgccgcgagcggctccgtatgggctctgcgactacccaccgacgccgaattgcgccggttcagggtggagtacgagcgctgtcttttcgaggacacgta

SEQ ID NO: 10733 - DNA, 332 bp, Zea mays
  Clone ID: LIB3279-182-Q1-K6-G1
gcagcggcggctcctaagaaggtggcaaccccgaagaagctgctgctgctgccgccccggccaggaagggcgtggccaggaaggccaagaagtagtctgcctgccttgtcgctggcgagatccccccctcaattccgcctatagattcccctctttcatggattttgatccaatcgtaatattgtcagtagctctagattcgtcggtagctccagcatgagtgtcggtggtagttctgtgcctgtaaaaacttgggatagttgatcgcgtgtgatcagccgtcatgctcctccagtctctatgaacaagctaagctataatagtattttgct

SEQ ID NO: 10734 - DNA, 617 bp, Zea mays
  unsure (1)..(617): unsure at all n locations; Clone ID: LIB3279-182-Q1-K6-G10
cagcagaattgagctcacattgtcacaaaatttgtatacagcagatagatagattcattcatagattcattcatcagaatccaattcccatgtacaagaataggacacacgcaccacacactaaatcacgcaactgcagctctgcgcaaggcttatatacactgcaagaacactatatacaggcagactgaacaatcacgccactgcagctctgggcaagactatatatatacactgcaagaacataatgtacatgcagtagaattcgaggtccacgagcaagtgggacaaattaacaatggaatagcagttcatctctacgtgttatcaatcatcaggttagcactccgcacatatcaggacggcaaaatcatttttgatggcgtgcagtttgtgtagttcagctttcgcattgctttgcaagagtagaatggcctgngaacacctcaggaaggacatacccatttggtgccgcttcagaatcccactgctcctcatttttctttttagatttccttctttntttagggcttttccatgtcttccttcatcgatacattctgcgactaggacaaacgtagtagaacaaaacagagtgatactatttacagggtagc

SEQ ID NO: 10735 - DNA, 358 bp, Zea mays
  unsure (1)..(358): unsure at all n locations; Clone ID: LIB3279-182-Q1-K6-G11
agaaagagcccannggannnggaaagggaggcaangaagtctactncagggananacggccgggggggggaagaaatttttttttttgnccaanccagngngcngccngacaggggcaggggcaccnangaggcccccacaaaaggcaacccaagggggaaccagcnaacngncccagaagcgncacncnacncangggannccaaanccacnnacanncangagcccccnnacnnnaaggacangaccangnccccaccnggccccncnacagngaaagacgccnacngcnngcngaacnncggggacagcancacnacagancacannncaccngcaggaagcanacacaaagaca

SEQ ID NO: 10736 - DNA, 400 bp, Zea mays
  unsure (1)..(400): unsure at all n locations; Clone ID: LIB3279-182-Q1-K6-G12
ccgacggcgcccaaggccgagaagaagcccgcggagaagaagccgacggaggagaaggccgagaagaagcccaggttttttttacgcgagccgggcagggtggggggggaggtttttcctccctttangccaanaanancnncnagacgngggggggggggggngnnaaggcccccacccaggngcacccggacaggggnnncncgcccaaggccanggccaccangaacaccaaaaacaacgacancnncnagaagcnggcngccgaggccgccaagcncgcccgccacaacaagaagcccaccanaaccncccgggagagccagacgncggngcgccccggccccccnggcgagcncgccaagcacgccgncnccgagggcaccaaggccgncaccaa

SEQ ID NO: 10737 - DNA, 530 bp, Zea mays
  unsure (1)..(530): unsure at all n locations; Clone ID: LIB3279-182-Q1-K6-G2
catcttcctccgtgatccaagttctagcagcgcagcgctcggtttcgacaatatgtcggggcgcggcaagggcggcaagggtctgggcaagggcggcgccaagcgccaccgcaaggtcctgcgcgacaatatccagggcatcaccaagccggcgatccggaggctggctaggaggggcggcgtcaagcgcatctccgggctcatctacgaggagacccgcggtgtgctcaagatctttctggagaacgtcattcgtgacgccgtcacctacaccgagcacgcccggcgcaagaccgtcaccgccatggatgtcgtctacgcgctcaagcgacagggccgcaccctctacggcttcggcggctaggtcgcttcgtcatctggtggcgaactgcatgtgtgtcggcggtggtcgtgttgtgtgcctaatctagtgtagtccgttctctatatcgtcgctgtgttctgtggtgtcttgtatcccatttcctgcaataccaacttgccattatcaatggaaaaccctcgttntc

SEQ ID NO: 10738 - DNA, 264 bp, Zea mays
  Clone ID: LIB3279-182-Q1-K6-G3
gtgcggtaccttgcacgaaaggcaagaatgacaatcgacacgtttaactgatcgctcagcatccttctggtcagcctgaagcttctctgaagatcataccgaggaaccattcgtgttattgtgggtggtgtatgcttcaacgtgcacaaacaagagaatttcttatgtaatcttttgtttgaggactctaaccttttcttttatttggcattactgtgatgtgaccttttccttgggccgaaatattttacaggcttttctgca

SEQ ID NO: 10739 - DNA, 572 bp, Zea mays
  unsure (1)..(572): unsure at all n locations; Clone ID: LIB3279-182-Q1-K6-G4
tttttcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggcgggtacggtggtggccgtggaggcggcggctacggcggtggcgggcgccgtgatggcggcggcggctacggcggtggcggcggctacggtggtggcggcggcggctacggtggtggtggcggcggctaccgcggtggcaaccgtggcggcggctaccgcaactccgacgggaactggaggaactgagnncgtgggcccgcgcg

SEQ ID NO: 10740 - DNA, 590 bp, Zea mays
  Clone ID: LIB3279-182-Q1-K6-G5
cagcaccagaacagaaggtagtagatcaaggaacgccagtgcggcgacaatgaccggcagtggaagcacgggcgccaatggcaagagccagagatccagggccaaggcaatgctgctcgccttgggcaagagctttcctgaccaagttctgcctcaggagaaggttgtggagagctacctccaagaaagcagctgcgacgatcccgccaccagggccaagcttcagcgcctttgcacgactacaacagtgaagacaaggtacactgttatgtccaaggagctattggataagcacccagagctgaagatggagggtactccgacactgacaccccgccttgacatctgcaatgccgcggtgatcgaccttggtgctgccgcagctcgcgctgcccttgacgaatggggtcgccctgcagctgatattacccacctcatctacatctcatccagtgaccttcgtctcccagggggcgaccttcacctggctgctcgccttggccttagcccaaacaccgtgcgcacttcccttctcttccttggctgctccggtggtgctgctgcccttcgcactgccaaggacattgctg

SEQ ID NO: 10741 - DNA, 673 bp, Zea mays
  unsure (1)..(673): unsure at all n locations; Clone ID: LIB3279-182-Q1-K6-G6
cccggngtcgacccagcgcgtccttttttcgcgnntgggtgcgcctctacatcttgcttctctcttctggctcnnctccgccnnnccgcctgggatccatccaagnacagggnnnatcgccatgtcggnacctcggnagggagnccaccacttnncgaatcgaagggccgacnngctggggcgtccataaaccctacccgcagcaggcttggcacccgtcccgtaagaacggcttcatgcgtgcatcaagaaccgttctctgcaagggttgtggaggtttctacctccaagactggtaagcatggccacgccaaatgccactttgtcgccatagacatattcaatgggaaaaagcttgaagatattgttccttcatcacacaactgtgacattccgcatgtgaaccgtactgagtatcagctgattgatatttctgaggatggatttgtgagccttcttacttcagatggcaacactaaggatgatcttagactcccaactgatgagactcttgtggcccagattaaggaagggttcgaaagcgggaaggatcttgttgtgactgtccagtctgcgatgggggaggagcagatctgcgcgttgaaggatgttggccccaataacttccttggcttttgagacgaaccctactgtatctcaacttaaatcggaa

SEQ ID NO: 10742 - DNA, 572 bp, Zea mays
  Clone ID: LIB3279-182-Q1-K6-G7
gttggagcggcgggcgctgcaggcgctcgaggccggcgagggggcgcgctgcggcggccacgggcacggcgaggaggcgcgcgtggtcctgcagcagcccgccgccgccccggcgcccgtggaggtcctggagctgcgcgtgtcggaggtgggcgaccgcgtgctggtggtgaacgtgacgtgcagcaagggccgcgacgccatggcccgcgtgtgccgcgccgtcgaggagctccggctccgcgtcatcaccgccagcgtcacctccgtcgccggctgcctcatgcacaccatcttcgtcgaggtggattcggaccagacgaatcgtatccagatcaagcacatgatcgaggccgctctcgcccagctagatgatgcctccgcgagcccgccgagcgtgatgagctactattagaatcggacaaccgtcacgctgacatgcacgagccggcctagctactgtggccgaccggtactgttccgtgcgcgtatataggaactaggaagaagtgggtgctttgtttgctatatatgaggcactaggtcaggggctttatgcaactttgatgtaa

SEQ ID NO: 10743 - DNA, 632 bp, Zea mays
  unsure (1)..(632): unsure at all n locations; Clone ID: LIB3279-182-Q1-K6-G8
ctttcgcgtgggctgctcgcatttcctcccaatccatcccgcctccaaacccgaactccaagtcgccccgcatcgatggcgcccaaggccgagaagaagcccgcggcgaagaagccggcggaggaggagcccgctgccgagaaggcgccggccgggaagaagcccaaggcggagaagcgtgtcccagcaggcaagtccgccggcaaggagggcggcgagggaaagaggggccggaagaagggcaagaagagcgtggagacctacaagatctacatcttcaaggtgctgaagcaggtgcacccggacatcggcatctcctctaaggccatgtccatcatgaactccttcatcaacgacatcttcgagaagctcgccgccgaggccgccaagctcgcgcggtacaacaagaagcccaccatcacctcccgtgagatccagacctccgtgcgcctcgtcctccccggggagctcgccaagcacgccgtctccgagggcaccaaggccgtcaccaagttcacctcgtcctaggctgcgtggcctccgcttgcaggcttccctcgtatgttcgcgtgtcttgctgtagttaggtgctgctgtgtctggtctcctccggtagcaactgntatctgatg

SEQ ID NO: 10744 - DNA, 630 bp, Zea mays
  unsure (1)..(630): unsure at all n locations; Clone ID: LIB3279-182-Q1-K6-G9
cgtccgcccacgcgtccgcgggcgcgtgggggaactggctcacggcgccaacgcggggctggacatcgcggtgcggctgctcgagcccatcaaggaggagttccccaccctctcctatgccgatttctaccagcttgccggagttgtggccgtcgaggtcaccggtgggcctgagatccccttccaccccggcagggaggacaagcctcagccgccacctgagggccgtcttcctgatgccaccaagggttctgaccacctgaggcaagtctttggcaagcagatgggtttgagtgatcaggacattgttgccctctctggtggccacaccttgggaaggtgccacaaagagcggtctggttttgagggggcctggactacgaaccctttggtctttgacaactcttacttcaaggaacttctgagtggcgacaaggagggccttcttcagctcccaagtgacaaagccctgctgagcgaccctgtcttccgccctcttgtggagaaatatgctgcagatgagaaggcattctttgatgactacaaagaggcccacctcaagctctccgaacctgggtatgctgatgcttaaatggtccatatcctggaacggnacacaaactgctgcct

SEQ ID NO: 10745 - DNA, 504 bp, Zea mays
  Clone ID: LIB3279-182-Q1-K6-H1
gaggaatcttgcaacatttaattgaagaattggtgggaaaggaaaaggaaagaaaatcctaccacttccaagtctcaatcaacgccaagcagcattagatgccctccctctaaatctgatgaaagacctgctacttaaggctgtagcctttcatacattggtcatgcaatggaggtttggagtttggaggttgcagcttacaagttacaagatcacaaaaagcctggaggttgcagcttaccagtccacggtcagcaaagagttgtgtgaggctgtgagcctgtgactgtgagctgtgtgcctgtgtgtaataacttgacagttgagaacttgagactgtatgtctgtatgtgtgatttgcctgtagctgtttgtctcactgtctgtagcattttattgcttgtaggctgtagctgtggacctgtggtttttttattgctgctgttgtgctgtctgtagctgtgttaaatggatttattgcctggaaagacatgttattgctaa

SEQ ID NO: 10746 - DNA, 452 bp, Zea mays
  Clone ID: LIB3279-182-Q1-K6-H10
ggggggggggggggggggttttttttttttggaaacaaagacaagcccattcttacgttaaaaggaatagaaaaacatgatggaacaagcatatcgtacgacgtaacttgctaccaaacgggacagcttgagaaaaatagaacacaaacctaaggggggggggggaacctttttttttaccaggtgcttaggggccaaaaacactcgaaggctgaccaacttgggcgcccctaaaccataatacccctcaaaactagggtaatgagcatcccgctacatcgagaaacagcgtgtaatatcacatcctatcctctcttctgcgcggggcacaggttatgatctcatcgaccctgaggatcatctccgcagcctctgttgcagacagaaaaatggcctgcttcaccttgaacgactcttgaatccccaacttttgcatgtcaccaacagggcct

SEQ ID NO: 10747 - DNA, 415 bp, Zea mays
  unsure (1)..(415): unsure at all n locations; Clone ID: LIB3279-182-Q1-K6-H11
ggggggggggcgaggaccacacgaagcagacggcgcgcaagncgacgggcggcaaggcgccccgcaagcagcnggccaccaaggcggcgcgcaaggcggcgccggcaaccgggggcgngaagaagccncaccgcgnccgccccggggcggggggggggcttttttttttttttnaccagaagagcacggagcnggcaggcggggcggcccnnccagcgccccggccgngagaacgcgcaggannncaagaccgaccnccgcgnccaggcccccgcngacgccgcgccgcaggaggccgccgaggcccaccncgnggggcgcnncgaggacaccaaccncngcgccanccacgccaagcgcggcaccagcangcccaaggacanccagcncgcgcgccgcancaggggcgagaggg

SEQ ID NO: 10748 - DNA, 333 bp, Zea mays
  unsure (1)..(333): unsure at all n locations; Clone ID: LIB3279-182-Q1-K6-H12
agggcaacgaacaaaccnacnanaaacgacagggggggcggggggatatttttttttccgaagccctaccatccggcagccattgatccatacccaaaatgttcctgccactggtgttcctgtcccaacacttgatcaacgtgcaagtaaaaatgatgcctggagtcaaaggatgcgggagaagtatggtctggacacgagccagttcacatacaacccttcagacccaagcaggtaccaacaaaatggcacgccacgggctgaacaaaggagtcgatgcactataatgcgaacaattcttcatgagggcctaccaaataataaactttcttg

SEQ ID NO: 10749 - DNA, 653 bp, Zea mays
  Clone ID: LIB3279-182-Q1-K6-H2
gagccgcagatggtctcacccggccgcagaggcttagcgttgagagccacatgttgagtgaacagacggcggctagcactagcagcggcgagcatcaggagaggagcgtcgtcgaggacaggcggctacagccggtgggggagaacgaggaggcgggggaggaggaggaggagttcagggacatccacgcgctgagcccgccgctgagccagccttcgtcgtaccgccggagcatgcacgcgtccgtcgggagcgacaccgcgcccagcgagcccttcccgaccatgagcagggatttctcggccatggtcgccgccgcagcagccatcgccaacggtgccgccgccgacagggtcggggaggccgaggacgaggagaccaacccgctggccatcgtgccggacagcaaccccatcccgtcgccgcgccgggcccggggcccgcccaccccaggcgctggcgccgcccacggcaacggcgacggtggggtgtccgtggggcaggtcaggaaggaggaggtggagtccaagatcgcggcgtggcagatcgccgaggtggccaaggtcaacaaccgcttcaagcgcgaggaggtcgtcatcaacggctgggagggcgaccaggtggagaagggccgcgcctggctcaacagtatg

SEQ ID NO: 10750 - DNA, 597 bp, Zea mays
  unsure (1)..(597): unsure at all n locations; Clone ID: LIB3279-182-Q1-K6-H3
ttttctcttcctgtttccgcgcgcgagatcgccgccccgggtgggctctagatcccgatggcctcgcgccgccgcaccctgctcaaggtcatcatcctcggcgacagcggggttgggaagacgtctttgatgaaccaatatgtgaacaagaagttcagcaaccagtacaaggctacgattggggcggatttcctcaccaaggaggtgcagttcgaggacaggctcttcactctgcaaatatgggacactgctggtcaggaaaggtttcagagtcttggcgttgcattctaccggggagcagattgttgtgtcctagtctatgatgttaattctatgaaatcgtttgataatcttcacaactggcgtgaagagtttctaattcaggcgagcccatcagatcctgacaatttcccttttgttctgttgggtaacaaagttgatgtagatggtgggaacagccgtgtggtgtcggagaaaaagcaaaggcatggtgcgcctctaaagggaacatcccgtactttgagacgtctgctaaggatggaacgaacgtggaagatgccttccagtgtattgtaaagaatgctctgnagaatgaac

SEQ ID NO: 10751 - DNA, 524 bp, Zea mays
  Clone ID: LIB3279-182-Q1-K6-H4
cccacgcgtccggccactcgttgtgagtacacagtacactcgcgaaccgctccatcaacactaggccaccgggaggcggcaggccccggaggggattggcagacgcgcgcagaggcacgtaccactaccgcagcagcgcgggagcagggaccagggacccgggccggcggcatgggcgtccttcggagcacgcagagccttcaggcggaggtggacgagctgcgcgccgcgctcctggcaggcggcgggcacgaggccgcgggcgggtggcgccggtcggcgggccacgcggacgccaagcgcagccccggcggcgacgccggaggggccgcggcgcgcgccgtgtgcgtcacgggagggatctccttcgtcgggttcgccgtcgtcgaccgcctcctccggcacgggtacaccgtccgcctcgcgctggagacgcaagaggacatggacaagctgcgggagatggagatgttctgcgacgacggcagggacagagtgtggacggtgatgggcaaactgatgga

SEQ ID NO: 10752 - DNA, 606 bp, Zea mays
  Clone ID: LIB3279-182-Q1-K6-H5
cccagcgtccgcggacgcgtgggaaaaacaggactatggaggcgaacccttcataaatgggcaagctgttccttatgatcctaaatatcatgaagagtgggtgagaaacaatgcccgtgccaatgacagaaaccggcgcaatgataggcctcgcaactttgacaggtcaaggaactttgacaggagaagggagaacatgcaaaactaccagaacagagatgggcctcctgcccaaggtttcaatggccccccacctccacctggccagaaccagatgccatcccaccatagtcagggcaacatgtctccgcaaccaccacatgctggtggtggccaaccaaactatcagccccaaatgcaaaacccacagacgggctacaaccctggcggtgctcctcactaccagcaaggtgctgctcctggctaccaaggtggacctccggggtatcaaggtggttaccaagggaacccaggccctgcctaccaaggtggtaacactggttatcaaggtggcaacccaccacctccctaccaaggaagcaacccaccacctccttaccagggaggcagcccaccagggccaccacctccctaccgaggaggcag

SEQ ID NO: 10753 - DNA, 536 bp, Zea mays
  Clone ID: LIB3279-182-Q1-K6-H6
ttttattggtgaacaccaagcagaatcatggtgggaaagacacactgtgagaaagtgtacgacaagtacaatgtctgcggaacagatcgtctctcttcggtaacgacagcctagcgtaggccctgcatgcatgacatccaaagaggagggcaaagccagtgcgcctgtagcatcgttgtgccctgtgtctttctctccatcatttgaagagacggaggcatccagcttggttttggaacgtgcgctgcttaatcgacttgtttatctttttctgtcacctgcttggattcccctctctctcgttgtcgttgtatagaggagatgatggaaccaaagcagttgttgctcctttgactgagatatactatatacacgtagctgggcgtaaatcgtaatgcaagccccgttatcgtcgccttgtgatgtatctcttctgtcagtcgtcatgcatactctgtctgtaacacctggtacactctcgtattgatggtacatatttgctgacagtcctttttaaaaccatagatcatccatat

SEQ ID NO: 10754 - DNA, 596 bp, Zea mays
  Clone ID: LIB3279-182-Q1-K6-H7
attccctgttgatgataaaggaacaagagagactgtagtgcagtacttcttggacaaatatgactacagattgaagtatgtctcttggccttgccttcaggctggcagtgattcacgacctgtatatttgcctatggaggtttgcaagattgtagaagggcagagatactctaagaagcttaatgacagacaagtgacgaacatacttagagcaacttgtaaacgtccccaggagagagagaagagcatacgtgatatggttctgcataacaagtatgcagatgataagtttgctcaggagtttggcatcgaagttagcagtgatctagtgactgttccagcccgtgtgctgcctccacccctgttgaaatatcatgactctggtagggagaaaacttgtgcaccaagtgttggacaatggaacatgatcaataagaaaatgatcaatggtggaactattgataactggacttgtttgaacttttcacgcatgcgccctgatgaggtacaaaggttctgtatggatctgactcatatgtgcaatgccactgggatggttgtcaatccacgcccgtttattgaagtccgtctgctgc

SEQ ID NO: 10755 - DNA, 591 bp, Zea mays
  unsure (1)..(591): unsure at all n locations; Clone ID: LIB3279-182-Q1-K6-H8
gcctccacgcgagctgcgaaagaagagcaggggcaggccaaaccaacgaaacaccagctgcgtgcaccaccccctctacggacccacccacccacccacccggagcgaaggggagacagcagcagcagcagaagccgcgcgcgtgcaaactgcaatgggcaacagcatcggcgggcggggcaagggcgccaaggtgatgcagctggacggcacggcgttccgcgtgaagccgccggcgtccgcgggcacggtgctgcgcgaccacccggggttccagctgctcgagtcggaggaggtgaagctgctgggcgtccgcgcccggccgctggcgcacgacgcgcagctccgcccgggccgcctctacttcctcgtggcgctgccccggccggccgccccgccgcgccgcgcctggtccggcgcgctccacgtcggcgcgcgggagcggctcgagtcgctcatgctcacgcgccggtccacctccgacctctccctcgccggctncgcgggcacgggcacgggcacggggccgccgtccccgctctccacgggctccgaggggggcgggcccgtccgcctccggagcgcctgccc

SEQ ID NO: 10756 - DNA, 472 bp, Zea mays
  Clone ID: LIB3279-182-Q1-K6-H9
ctcatcgctccgtcttgtggggactctaaccatgcaccgatcggtcccacccctgctccggctgcgcagcaagacccgagcaagggagagaatcctcctaccgtggatggtagcgatctgggtgacatcgactcgggctgggttatcctcaagaactcggatgtcgttggcggggatttggcagccgccgccgtctgtggcggtcagcgtctaggctcttctacgattcctagctgggcacggggggttctcggaggtgtggtttacacgctcgtgccgttctacaacagagttaggcatctcgaagacgagacggtgggattcgtggagaatgctgcggaggttgtggagcatttagctgaagtaacagagaagctagctgtgaatgtggctaagcaacttcctgaagatgggtctctgcagaaagcagcggaagaggttgaacacattgctgaggtagcggatgatgatg

SEQ ID NO: 10757 - DNA, 465 bp, Zea mays
  Clone ID: LIB3279-182-Q1-N6-A10
gacaagagaagggggcagaccaccttcgtttctttcctcaaccaatccacaacagagaattttcaatcaaattggcaatcctaaactcgattaatagagtcgttcttctttttctgcatttcagtaacttttaaccggatatataatccgtatgctgttccaatccagctagcaacccgagaaaccggtcccagcaaatgcgcgtcatggagatcctagctaaccctattagtgcacatcaggactgcctccttcaactcttctttgccaagtgccgtctccaccatcacctcctggacgctgttcccataccgcgcctggagcttgtttttcggaccgaccacaggtgccatgtagacctgaaacgtcggagctaaccctgggctttggaagaaccgtcctttatagacatctcttacaccctctgttctccgcatctcttccatgagggcgtcttccttgggc

SEQ ID NO: 10758 - DNA, 599 bp, Zea mays
  Clone ID: LIB3279-182-Q1-N6-A11
agagcataaagaaaattggtaagttagatccataagaagttttcagtatgataatgtcaatcctagtagttagatccataagttctcataccatgaagaattacaaggtgtcatatctgaattggaccggatctgattacagctcttactaatatgctccaggtaatgacagatggcataatacctgttgcaagcacctcattcaataacaggactccttcaggtgtcctattacaagagcacaggcccttaattcttgtattgtaagtaacaatatctggtttcaaaccattatctaaaatggcagtccaaagagatgctgctgtatcaatagaaccaatctcataaaatccatccatcaatgtgttataggtcactagatttggggaacaattcttttctttcatctccaaatatatacaaaaggcatcatttactttcccagcagaacaaagaccatgaattaagatgttgtgcacaattacatcaacctgaatacccgcatcaagaatttcattccaaatacaaagggcagcatcaatcttcttgactcgacaaagccacgaatcaaaaaccataagttctgatatctggtttaa

SEQ ID NO: 10759 - DNA, 506 bp, Zea mays
  Clone ID: LIB3279-182-Q1-N6-A12
aaaaaaaacatcatttagcatgtatctgggaaaataaatagctttgtgacactgacacgcaccagtgccaaagccaaacaacacagaacattcctttttgccaacttgttctagggactgcgacattacattttcatctttctaaaatggccacttggggcaggccagcaaaggctgatcagccaaacctgccccagcgccggtaatccttactgaagtccgtcattagctgggttctttactttcgtacaacctatttatccatgcgaaaaaaaacccggaatgataggggcccaaaacagaacacttccacacatggctgttgagtatcgcagttttgaagatggtgatgctggatcatcgatcactggctcgcctccttggacaagctcagatcaggattggcgatctgaggtcccagcccaagccatgggtgaccatccgacatctccttcttcacaggtgtaacatctgaaggggaacccgggtacggtgctttcgcagta

SEQ ID NO: 10760 - DNA, 619 bp, Zea mays
  Clone ID: LIB3279-182-Q1-N6-B10
cgatcaatcaacaagacaaagatgatggtaagaatgtacagattaggctgttacaaaggggaatgaatgccttctacacaccccaaccaaccaaccagctacacaacatcatcccctgcaaaaccatcagctccccctgcatgtatccttgcccagcaacccacaacacacactgatccccagtcctctcgctccgcaacaactctggtctgcttcctcgatcctcataccgctgggcttttgtcttggccaaatccccaggttgggtgtgggtaatgcggcgctcccccatgtgcctgccatacttgtcgcgaccaaccaaccaaccaaaacacactcaactcagttgggcgttagtgtacccataaacataggatctgtgcttcacagccgtccccctcaccctgccaaatatggattcacgcgctctccgccgggaaaccccccatgggggtcccctcaccatgcgcccgcttcgggcgccactccgtgtgcgccttcacaatatcggctcctgtttccagctggagcaggtggtcgcactggatggtggagtctgtgtcgccgtctacgcattcacccgcgacggtggtgagcgactgcagcacgctgtcgcgtc

SEQ ID NO: 10761 - DNA, 493 bp, Zea mays
  unsure (1)..(493): unsure at all n locations; Clone ID: LIB3279-182-Q1-N6-B11
gacaacaaccaaatacaatccattgcatctcacgatgcaagcaccagcaaatacaacacggattgttttctgcacctgataaatacatgagaatatggcctttacacataagaaaagtgttgcattaccctccacatatacaccacaaatctaatggcagcataactgcaaaccgatcacagcttaacctgtcgatgtacctgaagtgaagacatggaactccaagctcgatcagaacactgggcagacgccgtcacccaagtccacccctttcgcgggtggggcacctggcgagagggcagngctctcctgcggggccccaccagncgaggctcttgttctgcntggtcnacgngaagtacagcaccacccccatgaacgcgactccggcgtcgagagcggcggagaggatgtatttgtaccgcgtccaccactttttccggtnccggaacacgaagaagttgaagactgtgccgtcgagcagccacgagtt

SEQ ID NO: 10762 - DNA, 592 bp, Zea mays
  Clone ID: LIB3279-182-Q1-N6-C10
gtatgtgtgcaaatttcacacatcgtaaagaaatatattacagtaatttacatgtcttgtcaattgttccatacatcaaatgttacaaagtacttttacaataaagttacaaagtattattacaacaaagtctactcttctctaaggatcttttctgcggcttcgtttaataatttgtcgacaacttcgttgataatagaattggcaaggctcataacgtccagtgcttccttcatctccagatcggccaggggattgtacggctccggcagcggtgatagctcagcttcaacgagcttctgctcggcagtctccacctgctgaacccctggatcctcagtagcctgctcgtctgcactcgggtcgtggcgtggccggttcacgaagcggcagatcccgtggtggagatgggctccggtgagcaattagctgcacacgaggcgaaggcagccacccgcggtactcaaattgactccaacgactcctggcaacgaccaaccacgctttaacagagctgattcgccgtggaaccgaggaaagactaacgtcgtaatctctcttcctcactgcggcgacttttgtctgcgtggcg

SEQ ID NO: 10763 - DNA, 604 bp, Zea mays
  unsure (1)..(604): unsure at all n locations; Clone ID: LIB3279-182-Q1-N6-C11
gggttgttttttttttttttaaagaaaaaaaacttgataaaaactgtataatacttattccttacaatcactaaactccctggtaaaatatatgattaagtcttggaacttaagacactangaaagaatataggggggctctaactaccatgggggatgtcgattgtgtaggagagcagaggagacctgaagcatctgccccaaccgcaccaagctcacatatggtacaaagctgcccttcgatggaaggaacaaatcgggatccacagtatgggcaggaaacgtccttttggccacgatagataggaacatatgtagcaccacaaacaacgaatggatttctgaagtcatagttcagttggtgagaatcgtccttgtcctggcaggcttgcagcacctgtcgagccttctttgcttgggcctcctgagggctattctcaagaagcatccttgcaaagtgtgctgcagttgcatagtttttctgcttgaagcaaagagccatagcgcttgcgagcacaagcctcatatgaactctctgaagcttgcagttcgtgaagtaagcagccaactcctgctgacggggcacatcatccctcaattcctt

SEQ ID NO: 10764 - DNA, 573 bp, Zea mays
  Clone ID: LIB3279-182-Q1-N6-C12
gtgtttggttttttttttttttttttttttttttttttttttttttttttttttttttttttttttttttttttttttttttttttttttttttttttttttttttttttttaaaaaggaaggggggtttttttttttttaaaattcaatgggggggggggaaaaaaatttttttggggaaaaaaatggaaaaggggaagggggcctttaattgaaaaaaaaaaacccccctttaaaatttgaatttaaaaaaaggaaaaggggtggaaaccctattaaagggggttaaaaaatttggcagggggaaaaaaaaaaaatatttaaggttttttaaaaaaaaaagggccaaaaaacgggggcggggggggtgccccgggaatttcgggcggggccctgggggggtacaaatttttttttttgggggggggtttaaaggggggggaaaaaaggggaaagaggggtcccggggggaaaaaggttcccgtccaaattcccaaaaaaaaaaaggccgggaaaaaaaagggaaaaaacggggggggccaaaggggggggcaaacaaaataaaatgggggg

SEQ ID NO: 10765 - DNA, 419 bp, Zea mays
  Clone ID: LIB3279-182-Q1-N6-D10
ctccagtactgctgatggtactcttctgctctatagaacctcttcgctggaacgatctcggtgacgatcttccggttcagaagcttctgctgcttctccagggactctcttgccgccttctcctgctctgggttatagtagtatatccctgacctatactgtgttccaacatcattgccctgtcggttgggagtagtggggtcgtggcgcgcccagaaggtgtcgaggaggtcgtcgtacttgcaggcggccgggtcgtactgcacgcggacgacctcgttgtggtttgtggtgccggtgcagacgtcctcgtaggtcggatcgtggatgttgccctggctgtagccgacctccgtgcgcgtgactcccggcacgcgctggaacgcgagctccacgccccagaagcacccacgcgtccg

SEQ ID NO: 10766 - DNA, 582 bp, Zea mays
  Clone ID: LIB3279-182-Q1-N6-D12
gggtggtttttttacatcacatgcatgtagcattattgatgcctgaagaacatcaccaccggaccaccgctggctacaaccaggcacaaacggctaaataaattaaacaccaagtgtccacaaacagatactgacctaatagtaaagcaaacaccgggggaggaaacagatccaactgtgcaatgcaggcaggtgattaaactaaaaagcagtagaacacaagctatatatatagctagctagacgtacggtacgtgcaaggcccaactactgctcgtatggagctaggggaaaccacgaaccacgcatgcatgaagacgacgacgtactacagtaccatcactgtactaccacgcacgctggctagcccgacctcgctccagcgacggatcggacggacagacggagttcagggcttgttggcgtgctcggggacggagccggcggtgggggacccgggcatgccgccgaagccgctgaagcccggggagccgccgccgaagagggcatgctggcggtgccgggcaagctgaacccgggaaggctgctggcgctgccgggcatgctgaacccgggaatgct

SEQ ID NO: 10767 - DNA, 364 bp, Zea mays
  unsure (1)..(364): unsure at all n locations; Clone ID: LIB3279-182-Q1-N6-E10
caaggcacanccnngcccnananangccncnacaaggggcnagcacacacaccanganacaaggccacacggcccaacacagcaagccagacaggggaaccgcaagcancaaanccggnacncnnnagccancggacgagccggagncaccgnagggacaanaccccgcngaagaaccgccnggncnccagancggnganggaggaaannnagccnngagaacanggnagncnncccaggaagccannncggcnggnagcncannccannnnaccagaancgaaacaanggccnaggnccccganggcaccagcccgcggggcannanccgcccaggggagggggaggcangccccccaaaaac

SEQ ID NO: 10768 - DNA, 526 bp, Zea mays
  Clone ID: LIB3279-182-Q1-N6-E11
gacagggacagacttttttattggaggggttgatgtatatatacaaaagttcccaaggggggggtcccttgggaataactgttacaaatggatggatagggggggatcactgcgcaatattttgaaaaacttttgtccgcgtttgttcgttttggggtttggggctgacaaccttttgaagctatttggtgcataatgggctggcaaaaacctggcactgtaagtttgagcaaaagttactgaaaaataatattgccaatgattttatgctgacgattttttttagcccaaggggcagccattgggatttaaacacccataaaaaaaaacttttttttttttcaacccataaacctatatgcaaagcatcccctggtcaaattatagaacaaagacctggaagcagactatttatgaacattgaatagtcttgatcgatgatccaattttaaatgcttccctgccatacttgccgagtcattttcagggggagccccgtccttctttatgtgcataggtttcgcca

SEQ ID NO: 10769 - DNA, 634 bp, Zea mays
  Clone ID: LIB3279-182-Q1-N6-E12
aacaaagaaagcctgttcacgtttctggtttcagcattcttggccaccgatttatttgcagcgtactgtttacacatccctaatacatagggtatctttatgcatgaagagcatattgttctccacactcatgcagattgcgggaagccaatcctgtcgttgccgaagtcgaacaccgtgtggtaagctcccatgaagacgtccccaagaatccagagaggaccacgcggcggtggcaggtcatacgccatgaacccactgatgcagacggtttggcctccttgctccagcttcacaatgtactgctcgggtgttagggtgaaggtcttgtttgcgatggtgaacgcaaggctgggcatcttggagatctcctggcagctgactgttgactctccgttggggctcggcagacgctcacacagctggttagcgtactgcagtatgagctccttggtcttgttttcgcggagctggttctctatccacacgacagccatctgacaggccgagcacatgacatctgagcccaggttttctttcccgacgacagattcaatcccctcgctgcagaaagttttcgcgtgatctgatgatagtttaccactagcatgagaagaacagaacatgcttgctg

SEQ ID NO: 10770 - DNA, 403 bp, Zea mays
  Clone ID: LIB3279-182-Q1-N6-F10
atccaacgacgaacaaacaatgtaggcatgaacattatttttggaaaggggttatcacaaccgacaacgagcacttttttgccttggaaggcctcccttccctattgtagtcactcgagtgcataacttgcccttaaagctatcgattcactaagtgccaaacataataggctatacattctttttaggggcaacaattagccattttgggtgctgggatactctattattgagttttttggcacggtacttccttgtagagtaaaaaacaaactcttcaccattgtaatcgttgatggggctgggggtgataaaatccttggggtggatgcaccggggaatcactattgtactcgggggcaacgacattaatactgaaaaatgggcgaatgtcgaattgaag

SEQ ID NO: 10771 - DNA, 599 bp, Zea mays
  unsure (1)..(599): unsure at all n locations; Clone ID: LIB3279-182-Q1-N6-F11
ccaatgcgataatccataatattgcacgcgcctaaaaccttccccgattcccttaccatgaccaaaagtctcaacacagcacagaaaataaccccagatcaaaactaacattcatagctgttttagaattagacccaaaaacctaaacaactctttcctgagcagcactccaaagagatgaggctcacttgaagcattttgcatctagcaaggcctcgccctcaaaaggctcctggtcctcgatcatggcattgacccgctccttctgggcctcatcagagaggtcgaccttggtccactcatagagctccatgtcatagacctcatccatgacaaacttggggatttcggggccacggaagagccagagccccttgaccttgaaagggggctcagagccaaccacaagcatcttgccaaaggcgtatttgcggcacagatccatccgctgcaggaagccaccaaccttgttcatagtcacaaacgacactgtgttctcgtcattgtacttgtagtcacagaaccacagggagtagccctctgggtcatacatgtcccagaaacctttaatagcaacctcacggaagttggttntcgtg

SEQ ID NO: 10772 - DNA, 630 bp, Zea mays
  Clone ID: LIB3279-182-Q1-N6-G10
gcgcgcgcccgaggagggtcaggaaccggcgccgcagccgcggtgagccccgtgtcgaccgggagtacgacatggtcatcgtcccgtccgacggcggtgggtgcctctccggctctgactcggacgactccgactggtccatcggctggctcgagccacaggcaccggagcttcagacggatggcgaccccgagaactgcttcgccgtcctcgtgccctgctaccgccacggccgccaagagcagcagcccgggaggcacgagggcaggtttcttggcgccggcaccctcaccaatggtggattctctgatggaaagaattttgtagagcagtggctttcttctctccagaactaataccgtccgacctgtcctagctaccctgtaaatagtatcactctgttttgttctactacgtttgtcctagtcgcagaatgtatcgatgaaggaagacatggaaaagccctaaaaaaagaaggaaatctaaaaagaaaaatgaggagcagtgggattctgaagcggcaccaaatgggtatgtccttcctgaggtgttcccaggccattctactcttgcaaagcaatgcgaaagctgaactacacaaactgcacgccatcaaaaatgattttgccg

SEQ ID NO: 10773 - DNA, 626 bp, Zea mays
  Clone ID: LIB3279-182-Q1-N6-G11
agatgaaacctgaagggctacagcataatcaatttgtcgaaacgaaagtaacagcacaggaagcatttacaccatgctctacacatctgtgaaacagatatttcatgtaaccaaacacaggcaaaactgttgcctcaatcagcaggttcctgcctccacctgcggcttttatttcacactttatttatgggctgaatcgacaaagagacccctagatccatcacaaatgtcactacattgagaaccaggtcgctagccctgggaacatggagcctgccactgccattgtgggtcaaacggtgtgttgaccttgcctcagttatgcgcagctgccaagttgcggatgacataagggaggatgcctccatggttgaagtacgccagctccacctcagtgtcaaagcgaacgatgcaagtgaaagatttcccattgtcggtagtaacagtcacatcctggccgggacggatctcactgaggttggtagggagatcgatgctgtaccgctcatgtccagtgaggccaagcgaatcagcatcctcaccagctttgaagcacagaggaatgattcccatccccaccaagttgcttctgtggatacgctcaaagctcttggcaattacagctt

SEQ ID NO: 10774 - DNA, 314 bp, Zea mays
  unsure (1)..(314): unsure at all n locations; Clone ID: LIB3279-182-Q1-N6-G12
caacccannagcacgggccaaaaaggccgaggaaacgaaacaaagccgncgccccgggggggggggggccaagaggaagnaaaccgggnaacggcccgggggcccggggagacggcgggccnggcgagcccgccaggaaggacgaggcgcaccgaaggcgggaccccccgggagggnagggggggccccngggggnagcgggcgagcnggggggccccggcagccagcnncccgaagagggcgnggnggaaggagnccaggagggacagggcccgggacgagaaaccaagggccgggggcaccggcgggagcac

SEQ ID NO: 10775 - DNA, 632 bp, Zea mays
  unsure (1)..(632): unsure at all n locations; Clone ID: LIB3279-182-Q1-N6-H11
aaagcacattccatttccattaagatagggggaaacgccacttcagaggcaccggtgcaaggaacaagcagattagaaaatgcaactcctaacactacgaacaccatcatgcgaacagaaggaaccgaacagaagcaagggttgtggaagcagagacacagaggaaaggcccaacaacgtggacgacaacaacgggagatcaagccctctcgcccctgatgcggcgcgcgagctggatgtccttgggcatgatggtgacgcgcttggcgtggatggcgcagaggttggtgtcctcgaagagccccacgaggtaggcctcggcggcctcctgcagcgcggcgacagcggaggactggaagcggaggtcggtcttgaaatcctgcgcgatctcacggacgaggcgctggaagggcagcttgcggatgagcagctccgtgctcttctggtacttgcgaatctcccggagcgcgacggtgccggggcggaagcggtgaggcttcttcacgccaccggttgccggcgccgacttgcgcgccgccttggtggccagctgcttgcgnggcgccttgccgcccgtcgacttgcgcgccgtctgcttcgtgcgggccatcgnagattcggtgcttggcgcg

SEQ ID NO: 10776 - DNA, 665 bp, Zea mays
  unsure (1)..(665): unsure at all n locations; Clone ID: LIB3279-183-Q1-K6-A1
gcctgcccgggcggtagataggagaggtcaagaactacggcacgaccgccgacgtagcagagggatctgttcgcctcccgtaccgagacccccctaccctttcgtcgacgactaggcttgcggcgaccgcccttggcttcgccgtcggcgagcatcaccagggactgacgattggcgggggagcgaatgcggagatgggctgatcagaactgcgacaaggtccggttttctctctaaaccgcggtctctggaggtgggtttgctttttccgtagtcacagatggacgacgacgacggcagcctgggcattcggaactggggcttctatgacaccgtgaaaggcagcctcggcctgcagctcatgtcgcccatgccacctgatcgggacacgaagccactgctcccgagagctggtttcttgcagcagcatgggcatcacaatgccccacaccagctccacgcacagcagccgcagcattaccgtgactccgctggtggcggagtctctggtggcacacctgccgagcagcaccctatccacatggacttctcgcgcaatgaagcttggctgcacccatcacaccaccagcatccccatgaacagaaggtccttcattctcgccctatcggnaccagctggcatgttggggcatccagccatgttg

SEQ ID NO: 10777 - DNA, 631 bp, Zea mays
  Clone ID: LIB3279-183-Q1-K6-A10
cgccgccgctgcagtgtccatagccaccgcaggagactgagatggggggttttgtcaagacccacaagagcaatgcgtacttcaagcgtttccaggtgaagttcaagagaaggcgcgctggcaagacagactacagggccaggataaggctgattaaccaagacaaaaacaagtacaatacacccaaatacagatttgttgtgcgatttaccaacaaggacatcacagcacaaatcatctctgctagtatagcaggtgatatggttcttgcttctgcttactcgcatgagttgccacgatatggtcttgaagttggtctgaccaactatgcagctgcctactgcactggccttctgttggctcgccgtgtgctcaagacccgtggtttagataaggaatatgagggcaatgttgaggccactggtgaggatttctctgttgagccagctgatgagaggaggcctttccgtgctctcttggatgttggccttattaggactacaactgggaaccgtgtctttggtgccctcaagggagctttggatggtggcctggatattcctcacagcgagaagaggtttgctggtttcaagaaaggatgacagcagctggatgctgatatccatcgcaa

SEQ ID NO: 10778 - DNA, 216 bp, Zea mays
  unsure (1)..(216): unsure at all n locations; Clone ID: LIB3279-183-Q1-K6-A11
ttctatcgtacgnggtcgcgtgggggggggggggggggggggctatatacccggggcggggcccgactgcatgttcgacacacttatacactgtcacaatgatcgttcggtcgttctttcatcgttcctccccctgttcttattttgtttgttccttcatcctatcattcataaggggggggggggggggtcctattcttccatcnttcatccctt

SEQ ID NO: 10779 - DNA, 622 bp, Zea mays
  unsure (1)..(622): unsure at all n locations; Clone ID: LIB3279-183-Q1-K6-A12
ttctcnttcggtctctaccaaaaaagcggggggtggagcggggagctagctctttgtgtcagcgcctgagcatcgagctattggcatggcgcactccaccaccttggccctggtgattgtcgttgtgctggcgctcacctttggtgccacggtcatgtgtctccgctcccataaacaaggttgctggggcggtatcgccggcgccagcgtgagcattggctacggcggggcaagagccagcgccggcgctggcgtgtcccttggcgccgacgcgtaccggagcacgtgcccccgtgccgaggagatcatccgtgcggccgttgagagggccgtcgctgccgacccacgcatggcagcgtctctcctgcgcctccatttccatgactgcttcgtcaacggctgtgacggctccgttcttctggacgacaagccgttcttcatcggcgagaagacggctgtgcccaacgccaactcaatcagggggcttcgaggtcattgaccccatcaagaccgagctggagcgggagtgcccagatacagtttcctgtgccgacctccttgccatcgctgcccctgacttcctcnttgtgtctggccggccgagctgggagattgaggtcgg

SEQ ID NO: 10780 - DNA, 638 bp, Zea mays
  Clone ID: LIB3279-183-Q1-K6-A2
gcctccacgagccttcacaaattgccctctcagctcttctcctaatctcactctagccctagccaaatcccagacccatcccagccctagcgacaccaaccagctcgccagcgaccatggggaacccggagaagctgatgaatcagatcttcgacctcaagttcacctccaagtcgctgcagcggcaggcgcgcaagtgcgagaaggaggagaaggagcagaagctcaaggtcaagaaggcgatcgagaagggcaacatggacggcgcccgcatctacgccgagaacgccatccgcaagcgcaccgagcacatgaactacctccgcctcgcctctcgcctcgacgccgtcgtggcccgcctcgacacgcaggccaagatgcaggtcatcggcaagtccatgcagtccatcgtcaagtcgctcgactcctcgctcgccaccgggaacctccagaagatgtccgagaccatggacaatttcgagcgccagttcgtcaacatggaggtccaggccgagttcatggagggcgccatggccggctccacctccctctccacgccggagaccgaggtcaacagcctcatgcagcaggtcgcggacgactacgggctcgaggtctccgtcggtctgccgcaggca

SEQ ID NO: 10781 - DNA, 632 bp, Zea mays
  unsure (1)..(632): unsure at all n locations; Clone ID: LIB3279-183-Q1-K6-A3
ctcaacttctgcttatgttcatagaagttaaatgttctcatcatgacaacaatatctaagaaaggaaaacaatcatattcaggaatgccacgcataattctatgtacacacatagaacctactgcaagcaacaacaatcaccttagcacataacagatgacatccaagttgaagagaggcatcagaggcttctcttctttggattagcaatccataatgaatattccacctaatgggttttacttctagaacgatgattcacatgtatgtttgtttggagagcttgtaaccagaaaccactgctgacaaggcaagagctacaaatgcaaagaaggccatgctgattgctgcagcggttgcgtctgtaaagttattgacaactgcagatctcatgcggttagtgatggggacggcagccgacagcgcggacatcagcaagtatgcaactacctggtcaccgacgaaatcgagaagcctcccagatgctgaggagacggggtcggcgccgccgcgcatccggtacgcgcgccgcaccgnctgcgccagcgagtagagtaaccccagcgacacgattgcaagcaggtacctgtactcctcgtagcggtcgaactgcatccagccgccgtgctggt

SEQ ID NO: 10782 - DNA, 587 bp, Zea mays
  Clone ID: LIB3279-183-Q1-K6-A4
agcgtccgcggccgcgtgggctgctccagcgcagtcgttcagggctcgctcaagtgctcgaggccgacatccagcacgccaacacccttgcagcgggtttctcgagggactacgacggggcctgcctccagatgcgcatgtcctacagccccgccgcccacttcttcctcttcctcgtgcagtggacggactgcagcctagccggcgcgctcgggctgctcaggatactaatctacaaggtttatgtagatgggagtaccaccatgtcgacgcacgagaggaaagcgagcatcagggagttttatgctgttatctttccctccctgatgcaactgcccaagggatcagcgacgtggacgaccggaggcagaaggcggcgtgcacggagaggtaccggaggagggacgaggacgagggcaagaggccggtttcggaggccgacatcgaaagggaggaagagtgcggcatctgcatggagatgaacggcaaggtggtgctgcccagctgcagccatgccatgtgcatcaagtgctaccgccaatggcgatcaagatcgcaatcctgccccttctgtcgggacagcctga

SEQ ID NO: 10783 - DNA, 627 bp, Zea mays
  unsure (1)..(627): unsure at all n locations; Clone ID: LIB3279-183-Q1-K6-A5
cgaccgacgcccctctctccctcgccccgactccccgcccgtggcgcccaggcggagaaagccagcggagaaaaccggcggccgggagaagcggagaagagaccgcagggaagaagcccaggccgagaagcggctgcccgcgtccaagtcctccggcaaggagggcggcgagaagaaggggaagaagaaggccaagaagagcgtggagacctacaagatctacatcttcaaggtgctgaagcaggtgcaccccgacatcggcatatcctccaaggccatgtccatcatgaactccttcatcaacgacatctttgagaagctggccggcgaggccgccaagctggcgcggtacaacaagaagcccaccatcacgtcccgcgagatccagacctccgtgcgcctagtcctccccggagagctcgccaagcacgccgtctccgagggaaccaaggccgtcaccaagttcaccagcaactgagcgcgctgcgggatccgcggatctgttagaagggttctttgctgtgtcctttccccagtcccccaccctacccgcctagtagctagcttgcctgctctatnaatccggcgcgccggtttgtaatggtcctcttagatttgatgtccctg

SEQ ID NO: 10784 - DNA, 653 bp, Zea mays
  unsure (1)..(653): unsure at all n locations; Clone ID: LIB3279-183-Q1-K6-A6
aaaactcatttttgctggggcanngacctggaaataagaccaaagaaagaatttgactactgaaagagaggcaaagaaagaagcatatgagaagtcacatcctaataagagcagtcatggtgaaggctatccaaaggtctgattctggccttcaagctgaagaaaactgcagatgatggtgagacaggaaaaagtggtggtggcaaagtagatgacactgaccttactaagaataatggagcttccgatgctacagagaaatccagtgtagagaatgatgagaagatcactgagaataaaggcaatgtgagtgaggagcaggccgatgccgttgaggaattgaaagggctgtctgctggggaaactttacaatctgttcccaaggttgataaaagcccttcaaataaagatcaagatataatctcgagggaggatttaaaagaagaattcactaaatttggcacagtgcggtatgtggacttcagcattggggaagattctggattcattcggtttgaggatcctgcagcagctgacaaggcccgtgcatttgcagccattgcagatgaaggtggtttgactatgaaaggccacatagtcattttggaacctgtgtctggtcaagctgaaaagattattggagtgcaattcgg

SEQ ID NO: 10785 - DNA, 674 bp, Zea mays
  unsure (1)..(674): unsure at all n locations; Clone ID: LIB3279-183-Q1-K6-A7
accggtnccgganaatgtcccgggtncgnacgccacgcccgtccgctccacgccgtccgcgnaaaccctaacgccgccgccgcttcacaggtaagccgccgtcatggtctccggttccggcgtatgcgcgaagcgcatcgtggtggacgcgcgccaccacatgctgggccgcctgtcgtcgattatcgccaaggaactgctcaatgggcagaaggtggtcgtcgtccgctgcgaggagatctgtatgtcgggtggactcgtacgccagaagatgaagtacctccgctttctccgcaagcggatgaacaccaagccatcccatgggcccatccacttccgcgccccgtccaagatcctgtggcgcaccatccgcgggatgattccgcacaagaccaagaggggggaggcggctctggcgaggctcaagacgtacgagggcgtcccgccgccgtacgacaagaccaagcgcctggtcatccctgacgctcttaaggtcctgaggctgcaacctggacacaagtactgcctccttggtgagctttctaaggaggtcggatggaactaccatgacaccatcagggagcttgaggagaagaggaaggagaaggctaaggtggcctatgagaggaggaagcagctggccaagctgcgcctaaaggctgaggctacagccg

SEQ ID NO: 10786 - DNA, 641 bp, Zea mays
  unsure (1)..(641): unsure at all n locations; Clone ID: LIB3279-183-Q1-K6-A8
cgccgccgccgcctgctctctgctgccgtcgccatggggagaaggcctgcgagatgctatcgccagatcaagaacaagccataccccaagtccaggtactgccgtggtgtccctgaccccaagatcaggatctacgatgttggcatgaagagaaagggtgttgatgagttcccctactgtgtgcaccttgtctcttgggagaaggagaatgtctccagtgaggctcttgaggctgcccgtattgcctgcaacaagtacatgaccaagtctgcaggaaaggatgccttccaccttcgggtccgggttcaccccttccatgtccttcgtatcaacaagatgctttcgtgtgctggggctgataggctccagactggaatgaggggtgcctttggcaagcctcagggcacctgtgctagggtggacattggtcaggtcctcctttctgttcgatgcaaggacaacaatgctgcacatgccagtgaagctctgcgtcgcgccaagttcaagttccctggccgccaaaagattattgagagcagaaagtggggcttcaccaagttcagccgtgccgactacctgaagtacaagagtgagggtagaattgttcctgatggtgtcaacgcanagctgctcggtaacca

SEQ ID NO: 10787 - DNA, 453 bp, Zea mays
  unsure (1)..(453): unsure at all n locations; Clone ID: LIB3279-183-Q1-K6-A9
gggcaagttcatgcgcaagttcgtgctgccgggcaacgccgacgtggacaaggtcgccgccgtgtgcagggacggcgtgctcacggtgaccgtcgagaagctgcccccgccggagcccaagaagcccaagaccatcgagattaaggtcgcctgaggggagaccgttgtcggagcagtgccagtgagctgggtggcaacctgcgggactctggtgaggaagagcaaatggtagaaagcagtagctgtgcttctgaacattgtgtgtgtttgtttcccttgttaccggcaatcatcctacctgatgtgtcgtctggggtttcgtttgaaccatgctgggtttggagctttgtgatgcaaagcagaacgtcctgatgctttctttctccatagaataaatctctcctgttacctangaaaaaaaaaaagaaaaaaaaaaaaaaaggagagaggagg

SEQ ID NO: 10788 - DNA, 670 bp, Zea mays
  unsure (1)..(670): unsure at all n locations; Clone ID: LIB3279-183-Q1-K6-B1
ccccgcgtccgccccgcgtccgngacattttcaagttagctcaggagaatacatagctccagagaagattgagaatgtctatgctaagtgcaagttcattgctcaatgctttatatatggtgatagtttcaactcttccctagttgccattgtagcagtcgaaccggatgtgttgaaggcttgggctgcatcagaaggaatccagtacgaggacttgagacagctctgtgctgatcctagagcaacagctgctgtcctggctgatatggattccattgcgaaggaagcacagctgagaggtttcgagtttgctaaagcggttactcttgttgctgagccattcacattggataatggccttctcaccccaacattcaaggtcaagaggccgcaagccaaagcatactttgcaaaagaaatctcagacatgtattcacggttgctagagacagagttagctaggtcgaagttgtaacttgtgcggtatcagtatcaggagaaaggtcatcaatacagccgtacaggagattggattctgcaattgtttattccacctcacgaaataagtagtaaaatcttttactgatacgggaaataacggatcatgccatgctccggagtcgatagtcgtttttttcacccagacgnagcagtgcttggcgcatgctga

SEQ ID NO: 10789 - DNA, 445 bp, Zea mays
  Clone ID: LIB3279-183-Q1-K6-B10
gttctccaagcgtgccttcgtgcactggtatgtcggtgagggtatggaggagggcgagttctctgaggcccgtgaggatctggcagcgctcgagaaggactacgaggaggttggtgctgagtttgatgagggtgaggaaggtgatgatggtgatgagtactagaagtatcctgatgcggtcatcgtgaggcttgtgtgctgctcttgtccccgttgtggtttgcaacacctgatgttgtaagactttctggttatgtccgccccgctttgccactgggttattaagaacgtcgttatggatggttgtctaaaaaaaaaaaaaaaaaaaaaaaaaaaaaaataaaaaacacacaaaaaaaaaaaaaaaactaaatatcccctcaaaaaacacttatcacaaaactcataaaaaaaaaaaaaaaaaaaagggggggcccgttttaaa

SEQ ID NO: 10790 - DNA, 585 bp, Zea mays
  Clone ID: LIB3279-183-Q1-K6-B11
caggtatctcctatttttttctcctccgcctcgagtgccgccacctccgagcctcccccgccgcgtcccagggaccgggagccccagtcccctagttcgctcgccttccgccggcgcaagagaagcccctatctcctcccatcctatgggcgccgtggcgtcgacggtggcggcgcgcttcgcgtgcttcccgccgaccccgccgtcgtacggggtagagccaccgccgtcgccggccgcggctgcggcggacacggaggtggtggagctcagcggggtgccggtgtcacggggccgcggcgtggaggcgcgccggctgccaacgaagcgcggcaccgaggtggtgtccatgtacgtccgccagcccggggcgcgcctcacgctgctctactcccacggcaacgccgccgacctgggacagatgtacgagctcttcgtcgagctcagcgcccacctcaatgtcaacctcatgggttatgactattctgggtacgggcaatcatctgggaagccaagtgaacaaaatacttatgctgatatagaagctgtgtataggtgtcttctagaaacatatgggagcctctg

SEQ ID NO: 10791 - DNA, 550 bp, Zea mays
  Clone ID: LIB3279-183-Q1-K6-B12
tccaaaacccaaccaaaccctagattcggggggctgaggtgcggtcagaccctccccccttcgaagatgccgaacctcgagtgccggatgtatgagcagcggttcccggaggtggatgccgcggtgatgatccaggtgaagcacatcgctgacatgggcgcgtacgtctccctgctcgggtggggcaacatcgagggcatgatcctcttctccgagctctcccgccgtcgtatccgctccatctcctccctcatcaaggttggtcgccaggagcccgccatcgtgctccgtgtcgaccgcgacaagggctacatcgacctttcaaagcgccgcgtctccgaggaggaggcgcacgcatgcgaggacaggtacaacaagtccaagctcgtgcactccatcatgcgccacgtcgccgagacgctcgaggtcgacctcgagccgctctaccagcggattggctggccgctctaccgcaagtacggtcacgccttcgaggccttcaagctcatcggtgcggaccctgacgctatcctcgacgtactcacctatg

SEQ ID NO: 10792 - DNA, 662 bp, Zea mays
  unsure (1)..(662): unsure at all n locations; Clone ID: LIB3279-183-Q1-K6-B2
cagaggatcatattctacaggnacggtgtcagcgagggacagttctaccaagtattgctgtacgaacttgacgccattagaaaggcctgtgcgtccctggagcccaactaccagcctccagttacttttgtggtggtccagaagcgccatcacactaggctgtttgctaacaaccacaatgatcagcgcacagtcgatagaagcggaaacatactgcctggcaccgtggtcgattcgaagatttgccatcctactgagtttgacttctacctgtgtagccatgctggcattcagggaacgagccgccctgctcactaccatgtcctgtgggacgagaacaagttcacagctgacgagctgcagaccctgacgaataacctgtgctacacgtacgctaggtgcacccgctccgtgtccatcgtgcccccggcgtactatgctcatcttgcagccttcagagctcgcttctacatggagccagacacctctgacagcgggtcactggccagcggtgcccgtggccccccaccaggtgcggcacgcagcacgagaggngcggngagtgtcgaggtcaggcccctacctgctctcaaggaaacgtcaagcgtgtcatgttttactgctgagacgctgggtggctgncttcgccaaggaaatgccct

SEQ ID NO: 10793 - DNA, 484 bp, Zea mays
  Clone ID: LIB3279-183-Q1-K6-B3
ccccgcgtccgtaatgaactcatgttcgagagtgtgagctgttttgacgaccgactttgcaaaggctcgtggataaatttagtcttttgtttgacgaaagggactctagcggttaaggcttcaccatagaatggataaccttcatagacgaaaatgcattctttttttgaagataagtcatttctacatagccaaagtgaccagcataaggtggtcgcccctagtagaaaaagatctttcaaattaatgtcaaaatcatgtagtcaatccctaaatgtgtgttccacactctttgatttcgttttcctaaagctaaataaataattgtccataacgagtgaaccatgaggcatcaaaaaacaagtggttagttgtctcgtttttatgacagaatgatatgataatacaagtgattaggttggttacccgcaacaagtcatgcacataatgatataaaattgaaagtgattaggttcgttacctg

SEQ ID NO: 10794 - DNA, 582 bp, Zea mays
  unsure (1)..(582): unsure at all n locations; Clone ID: LIB3279-183-Q1-K6-B4
taagtttgagagttgatggtaaaaacattagtgacaatattgtttagataaaagtttgagatgtcagaggaagctgctgaaaaggtaggaaattccaaaaaaaactaaaaagaacgtagagagtttttaaaaagattatagaagtaggaaaaatatgtggaagctttgcatgaaagtgatgggttttgttgctcgtccttctacgaccattcttgagcaaattcgtgatgttattagtattcatgtttactttctacttaattttaaattgttggtatgctcgtaggttaactttatctctggggctaagcttcaattcggcatctgcccattcttcagtcttaatgtcattgccgccgagtacaacagtgactcaccggtgcatgcacaccaaggatgtcatcactaccagcaccatcaacgactacaatagtgaagagttagtcttctactctacacgggagtaccacaccaaccaaaatggctcattgttgccaccaaacagaatgtatagcctattatgtctggcacttagggactcgatagctntaagggcaagttatgcactcaagtgactatcat

SEQ ID NO: 10795 - DNA, 600 bp, Zea mays
  unsure (1)..(600): unsure at all n locations; Clone ID: LIB3279-183-Q1-K6-B5
anagattagagggagcgccctgcccaagcaaagagaaaccgcggcgcgagaagagggaggaagggcagacgggcgagcaggatgagagagatcatcagcatccacatcggccaggccgggatccaggtcggcaacgcctgctgggagctctactgcctcgagcacggcatcgagcccgatggcaccatgcccagtgataccacggttggcgtcgcacatgatgccttcaacacgttcttcagcgagaccggttctggcaagcatgtgccgagggccatcttcgtcgaccttgagcccactgtcattgatgaggttcgcactggctcgtaccgccaactcttccacccagagcagctcatctcgggcaaggaagacgcagctaacaactttgcccgtggccactacactgttgggaaggagattgtcgatctatgcctggaccgtgtgcgcaagcttgcagacaactgcactgggctgcagggattcttggtgttcaatgctgttggtggtgggactggctctggacttgngtcacttttattggagcgcctttcagttgattatggcaagaaatncaagcttgggttcaccatttatcct

SEQ ID NO: 10796 - DNA, 662 bp, Zea mays
  Clone ID: LIB3279-183-Q1-K6-B6
gcggtggcggcggcttgtgtgtgcaaactcctgtacggcgtctcacgcctcaccccaactcgctcccttccccgtgcttcccgccgtcgtggagaggtcacgcggctggttcccgccgcttccggacgggttccgagggaggaggatcagctgccgcgatgttcctcaggatctctcgtctcggggcgcggcttctgcgcgagtctggagcggagacgagagctggaaatttgctaagcagtccaggcattttgtatcaagctcatcttaaccagcattcgaccagagtgcggaatgtccttttctcaactgcaacaagtggtgatcaggatgaaagcagtcaggcaaaggataaaatctcggtaacatttgttaacaaggatggctcagaaaaccaatacgtgttccagttggaatgtccatgttagaagctgctcatgaaaatgacatagagcttgaaggagcatgtgagggttcacttgcgtgttctacttgtcatgtaatagtaatggatgtaaactactataacaaattagaagatccagcagatgaagaaaatgatatgcttgaccttgcatttgggctcacagagacatctcgcctcggctgccaagtgatcgcggagcctgaactcgatggtatttcgctggcattacctgtag

SEQ ID NO: 10797 - DNA, 618 bp, Zea mays
  unsure (1)..(618): unsure at all n locations; Clone ID: LIB3279-183-Q1-K6-B7
gnaaaccctcacctcttcccttcctccccgccgccgccaccgccggaaggagaaaaaaatgggtgccgatggggaagaagcgtcgcggatagtcgtgccaatggcggtggaggggacctcggagcagctggcgttcgtggaggagtcgaagctgcagaagcgcaaggagaacgcggactgggccgtcaggaaccgggagcgcagggcggtaaagcgccagcgcatccgcgacgagcacaaggtcaccgtaaggcggcccgaggacttcgttgcggcgttccggaacaaggaacgcgacttcctgcggatgaggacccgcctcaaggtccgcaagcagccgcccgccgaggcgctcagctccaagctcgtcttcgcaattcgcatccctggctccgtggacttgcatccgcacatcaggaaggtcttgaggaagctacggctgacgacggtcctcaccggcgtattcctcagggccaccgagctgacgctgaagaggcttcttgtggtcgaaccctttgtcacctacgggtttccaaacttgaagaacgtgaaagagcttatttacaagaagggccgtgggtttttcgacaggagcctttccctcttaccgtaacgatc

SEQ ID NO: 10798 - DNA, 493 bp, Zea mays
  Clone ID: LIB3279-183-Q1-K6-B8
aggagacaaacgacgtccccaaagctctgggagcctggtcgagttcgctttatccatcaaagagccaggaaaacggcaaggacaggaaatatccaggcaggtgccagttctcgagcaaacaccatcgctggggatggaagaagttcatctcgctggaggacttcaaggactcgtcaaagggttatctcatcaagggcaagtgctgcatcgaggctgaggtcgcaatcagtggctcttcgaagacggagtactctatgtaatttgatttgtgagagctcatgattagtgtttattctcgctagaaccaactatatagcgtgttccatatgtattagcatgccatcgagactctagcttgctctatagatatctcgacgtatccgctcttcaagcttcgttctgtcgagttgaatgtggtctaataagtgaatatatgcaaactgggatcttattattttaggctattctggcaatctatcttgattgcgacgaa

SEQ ID NO: 10799 - DNA, 384 bp, Zea mays
  Clone ID: LIB3279-183-Q1-K6-B9
cggacgcgtgggggcctgccaaagataagccgtttgatctgcccatttttgagtaacgctacagacaagacaaaccaaaagattgaaggaacgaagaaactgaccgtatttattatcaatcatcatttagccggttacaaaaacagccagctgagaatctgtcatactcagccgaaaaaagtgttgtctggtagctaacttgtacggataaaaaataatcacgctgtgtgctgtacgcaattctcttcagataaagcgaaacattgtttttctgggaaaaaaaaaaaaaaaaaaaaaaaaaaaaaaacccaaaaaaaaaaaaaaaaaaaaaaaaaaaaaaaaaaaaaaaaaaaaaaaaaaaagcaaaccacatataaaaaacaa

SEQ ID NO: 10800 - DNA, 641 bp, Zea mays
  unsure (1)..(641): unsure at all n locations; Clone ID: LIB3279-183-Q1-K6-C1
cagtttccctcacattactgccactgacgttcattccgtttccttgcttgctccaggtactcccatcgctatcgaccgggtcctcgagcgcgggagatggcggatcaggagaccccagttgcagttgaggcccctaccccggtccttggggagccgatggacctgatgactgctctgcagcttgtcatgaagaagtcgggtgctcatgatggccttgttaagggtcttcgtgaggctgccaaagccattgagaagcatgctgctcagctttgcgtgcttgcggaggactgtgaccagcctgattatgtcaagctggtgaaggctctttgctctgagcacaacgttcacctggttactgtgcctagcgctaaaactcttggcgaatggtctgggctttgcaagattgattctgagggcaaggcgaggaaggttgtgggttgctcctgtgttgtcgtcaaggactatggcgaagaatctgagggccttaacatagttcaggagtacgtcaagtcacactagatacagtgcatcggtatctggaacttgtgctctacactagctntaagacctgaatttaaatttgtgctggttcttgggcttttctaggagatatctcaattcttgttttaagtgatgtcatc

SEQ ID NO: 10801 - DNA, 217 bp, Zea mays
  unsure (1)..(217): unsure at all n locations; Clone ID: LIB3279-183-Q1-K6-C10
ccccgcgtccgcttttccctgctctgcgtctgcgtctgcgtctgcgtctgcactgcttcgcgtctccctccccccgcctccgcctccgccccggcaaaaagcaaaacacggccatggaaggctacgaccgcgagttctaccagttcagcgaccagctgcgcctgcangacggcncnngccttcntgcgggcccctctnccctcggcgactccattct

SEQ ID NO: 10802 - DNA, 543 bp, Zea mays
  Clone ID: LIB3279-183-Q1-K6-C11
cccggtgtcgacccaacgcgtcctttttccttccgcgtagctctcggttgtcggggaggtggggggcggcgggcaagggacggcaaggggcgggggcaagggccggcgccaagcgccaccgcaaggtgctgcgcgacaacatccagggcatcacgaagccggcgatccgtaggctggccaggaggggcggcgtcaagcgcatttctgggcggggcgacggggagacccgcggcgtgctcaagatcttcctcgagaacgtcatccgcgacgccgtcacctacaccgagcacgcccgccgcaagaccgtcaccgccatggatgtcgtctactcgctcaagcgccagggccgcacgctctacggcttcggcggctaggccgcctccccttctgatgctttgatgtgacggccgtggtcggttgtgtgtctagttggccggtctactgtagtttgttctgtatcttcgtttcgaggtgttccagtttctaacccatttggtgtaatattttcactgctattatcaatggaaagccctcgggtctatc

SEQ ID NO: 10803 - DNA, 577 bp, Zea mays
  unsure (1)..(577): unsure at all n locations; Clone ID: LIB3279-183-Q1-K6-C12
gtgtcaaanaacgcaagcctgtggtctactaaagacgggggcatcgccatcgagggcaaacggaggccacaggattagcagcttctccgaactcccctctcgtgctgctgcgtctcctcctcatcgtcctctccagtgtccagctcggccatggcgttcaccgtctccttctcccccgcgggcgggcagatgctccaggctaggagtggccacggccacgccacctttggaagctgttccgccgtgccaagagccgggccaaggcagcgagcagggcgccgtccgggaggaccatcgaggagtgcgaggccgacgccgtcgctgggaagttccctgctcccccgccgctggttaggccgaaggcccctgaaggaacgccggagatcaggccccttgacatggcaaagcgcccccgtcgcaaccgcaaatcacctgctcttagggctgcattccaggagacgagcatctcgcctgctaactntgtgcttccattgtttatccatgaaggagaagaagatgctcctatcggagctatgccagggtgctataggcttgggtggaggcacgggctgcttga

SEQ ID NO: 10804 - DNA, 646 bp, Zea mays
  unsure (1)..(646): unsure at all n locations; Clone ID: LIB3279-183-Q1-K6-C2
atgtagactcgttaactctattggttatgtgttaaattgcaaggtgcttcaaagattatgtagtctgggttanctgaaacaacatggacaattcacaattcacgaaagcatataaaaatggtcaccattcacggacatttcacccaggggtggatccaggaccggagctggcagagccgcaaccccggtccagcaacccaattagtacttagtaccctgtagtaatttcagcatagtcatagaaagagggcccgcaattacaagacgcgggcgcatcacagcacgttgcagacccatcaggccatcacacatgtttgcaattcgcgcatcatcttcgcggtggctccattcattcatattatggccatctctagcctccccaatccataatccagcccactctttgatctggttcttgatccgccactggtttcatctgctgcagagcacctagacttgtatattcttctaaaaataaacaatattatgatttacgtacatagaaatggttttgctctttcgcttacccaatagatatgttatgaaatcatgaatctctgaaaacggcagttcatttttctttgtaatatgtttcttactttggtgtgccatacttttatctgacttctgtagactaactgtgtca

SEQ ID NO: 10805 - DNA, 662 bp, Zea mays
  unsure (1)..(662): unsure at all n locations; Clone ID: LIB3279-183-Q1-K6-C3
cagagcggcaacatacatcgacatgttttgacaaattcctctcccccgactgagatcactgatccagtgcgcgtgccgccggcgccatggccgcgccaccgccgtcgccagaccaaacctactagcagcgcgtcgggggtgcacctgcggccgatctaggagacagggatttcttctcgtcctgtcctgtggattattacgggcctggatttgcttgggagtgagaggagagagcgagtaatagggtgaaggagtcttggggagaagatggctgcggaaatggtgaaggcggcgacgagcgacaagctcaaggagatggactgggcaaagaacatcgaaatctgcgagctcgtggcgcaggatccggggaatgcgaaggatgtgatcaagtctataaagaagtctgtagggagcaagaacaagagcactcaacactttgctgttatgctattggagatgcttctgaataattgcggagagcctgtccataggcaggttgttgataatagccttcttccaatacttgtgaagatagtgaagaaaaaaaggatttaccagttcgagaaaaaaatttcttctgttagatgccacgcaaacatcccttggtggagctaaagcanagtttcctcagtactatgaggcatactatgagctggtgtctg

SEQ ID NO: 10806 - DNA, 690 bp, Zea mays
  unsure (1)..(690): unsure at all n locations; Clone ID: LIB3279-183-Q1-K6-C4
ggtgattctccacggggaatggttgagtctgctttggaatttgctagaatatgtcggaagttggacttccacaactttgtattttcgatgaaagctagtaaccctgttatcatggtccaagcatatcgcctgcttgtggcagaaatgtataacctaggatgggattatcccttgcacttgggtgttacagaagctggagagggtgaagatggaaggatgaaatctgctattggcattgggacactgttaatggatggtttgggtgatacaatccgtgtctccctcacagaaccaccagaagaagagattgatccttgccaaaggttggcaaatcttgggacgcaggctgcaaaccttcaaattggggtggccccatttgaagaaaagcacaggcgttattttgatttccagcgtaggagtggtcaattgcctttgcagaaggagggtgaggaagttgactacagaaatgtcctgcatcgtgatggttctgtactgatgtcagtttccctggatcagttgaaggctcctgatctcctttataggtctcttgcagcaaagcttgtggttggcatgcctttcaagggatctgctactgtagattccattcttttgagggagctcccccctgtagaagatgctgaagctaggcttgcactcanaagatagntgacatcagcatgggcgtgctgg

SEQ ID NO: 10807 - DNA, 481 bp, Zea mays
  Clone ID: LIB3279-183-Q1-K6-C5
acgctccgcgggcgctgggtgtgaggactgacccaaatggctgagctttgatcaagggtattggatgacatctgtaggcatcttgccccttgaacatgctcttcgtggagcactctgccagcagcaacaagatcctcaagggcatccgcaagaatcttgtcaagaagtgcgttgagctgctttttgagattgcggagaacaaggaggactacaacaagttctatgaggccttgtccaagaacctcaagcttggcatccacgaggactccacgaacaggaccaagattgctgagctcctgaggtaccactcgaccaagagcggggatgagctgaccagcctcaaggattatgtgaccaggatgaagagggccagaacgacatcttctacatcactggtgagagcaagaaggctgtggagaactccccgttccttgagaaactgaagaagagggctatgaggtgctgctcatggaggatgcca

SEQ ID NO: 10808 - DNA, 634 bp, Zea mays
  unsure (1)..(634): unsure at all n locations; Clone ID: LIB3279-183-Q1-K6-C6
ccccgcgtccggagcactcgccgccactcaccagcaaattcccgagccgccccttccccatctctttcgcgacccatttgatcgattcctgatggcgcccaaggccgagaagaagcccgcggagaagaagccggcggaggagaaggccgagaagaagccaagggcggagaagcgcgtgccgagcaaggagggcggcgagaagaagggaaagaagaaggcgaagaagagcgtcgagacgtacaagatctacatcttcaaggtgctcaagcaggtgcacccggacattggcatctcgtccaaggccatgtccatcatgaactccttcatcaacgacatcttcgagaagctcgccgccgaggccgccaagctcgcccgctacaacaagaagcccaccatcacctcccgggagatccagacctcggtgcgcctcgtcctccccggcgagctcgccaagcacgccgtatccgaagggaccaaggcggttaccaagtttacatcctcttagggtgccgccgcacgttgctacgatcctgtttaattctcatatntaggcctgtgctaggttgcttctgcaacaatgtagaatttgttataattgctgaatgaatcagttacccctgttgaagtttctaat

SEQ ID NO: 10809 - DNA, 630 bp, Zea mays
  unsure (1)..(630): unsure at all n locations; Clone ID: LIB3279-183-Q1-K6-C7
cggacgcgtgggcgctctcgctctcgggtctcgggtctccaccagtctccgctctctggacgccggaaatgcagatggactcctacaactacaactacgccagtttcttccacgacgaggctccgtccttctacccgcacgttgccgtgccgccctccccggagctgcccatcggcctcattgcctcgccaggggagccggagccgcccttcgcgccgccgatgccggccgcgttccaggactacccgccgggcgccgtggccgtgggggtgggagcgccgttcgggggggccagcgtgcacgggcaggcgatcgacgcgatgggcgggggcgacgggcagcgcgagcagagcatggcaatggcggaggacggggaggagccgccgccgtcgagagcagccgcgggttccggcacatgatgcgggagcggcagcggcgcgagaagctgagccagagctacgccgacctgcacgcgctggtggcggcccggtccaggggcgacaagaactccatcgtgcaggccgccgccgtgtacatccacgagctgaggggcgcgcggaaccagctgcagcgcccggacgaggagctcaaggcccgcatcctgngccacgacgccgggcagcagtgcgt

SEQ ID NO: 10810 - DNA, 633 bp, Zea mays
  unsure (1)..(633): unsure at all n locations; Clone ID: LIB3279-183-Q1-K6-C8
cagagctcatatttggagcgacagagtatacaacttcaatagacatatggtcagctggttgtgttctagctgagttgcttcttggtcagccactgtttccgggagagagtgctgttgatcagttggtagagattatcaaggttcttggtactccaacccgtgaggagatacgatgcatgaatcccaactatactgagttcaggtttcctcagataaaggctcatccgtggcacaagattttccacaagagaatgcctccggaagccattgaccttgcttcccgtctccttcagtattcgccaagtcttcgctgctctgctcttgatgcatgcgctcatcccttctttgatgagctgcgggcgccgaatgcacgtctaccaaacggccgtccattccctccgctctttaacttcaaacatgagctagcaaatgcctccccggacctcatcaacaggcttgtaccggagcacattagacggcagaacggtgtcaactttgggcatatcgggagctaggagggcaggcggctgccatggtctagtttttggtcttggtaccccatgtgcanggcccgttgcangtgaaggtgatattgctgcaccatctgggagaggaggggctcagcagtacctg

SEQ ID NO: 10811 - DNA, 578 bp, Zea mays
  Clone ID: LIB3279-183-Q1-K6-D1
cggacgcgtgggcggacgcgtgggcggacgcgtgggctgctgtccaggctgccatcctgagcggtgagggcaatgagaaggtgcaggacctgcttctgctggacgtcacccctctgtccctgggtctggagactgctggaggagttatgacagtgctgatcccgaggaacaccaccatccccaccaagaaggagcaggtattctccacctactcggacaaccagcccggtgtcctgatccaggtctacgagggtgagaggacccggacacgcgacaacaacctgctgggcaagttcgagctctccggcatcccccctgcaccccgtggtgtgccacagatcaccgtgtgctttgacatcgacgccaacggcatcctgaacgtgtctgccgaggacaagacaacggggcagaagaacaagatcacaatcaccaacgacaagggccgtctctccaaggaggagatcgagaagatggttcaggacgctgagaagtacaagtctgaggatgaggagcacaagaagaaggtggaggccaagaactcgctggagaactactcctacaacatgcgcaacacgatc

SEQ ID NO: 10812 - DNA, 579 bp, Zea mays
  Clone ID: LIB3279-183-Q1-K6-D10
agcccaccgaattccctgcgattcctctcccctcgcctcctcgtctccccctaggggatcgtcggagaggaatcgcaaagagggccgtctcatccgagttaaggaagccatggagcacaaggaggctgggtgccaggcccccgagggacccatcctctgcatcaataactgtggcttcttcggcagcgcggcgaccatgaacatgtgctctaagtgccacaaggagatgataacgaagcaggatcaggccaagctggctgcctcctctatcgacagcatcgtgaacggcagcgacgccgtcatggagccggttgttgctggcagcaacacggtagtagctgttgcccaagtcgagttgcaaacaatgaacgtgcagcagcccgctgatgttgccggacccagcgagggggtggcggcgatctccaaaggggggaaggtagggccgaaccggtgcagcgcctgcaggaagagggttgggctcacgggattcaactgccggtgtgggaacttgtactgcgcgctccaccgctactccgacaagcacgactgcaagttcgactaccggactgctgccaggga

SEQ ID NO: 10813 - DNA, 541 bp, Zea mays
  unsure (1)..(541): unsure at all n locations; Clone ID: LIB3279-183-Q1-K6-D12
ctcacaatggcggcaacggcatacgggggggggggggggatcccactatgcgtcccaggccacctcgcgtccatgatcgaagccggcaagcggctgctcggcagaagccgctgccccatgtccctcaccgtgctcatcacgcagatgaccatgtccgccaacctgatgtccgacgtgggggggggggtgcgacnggaagccgactccggcctggacatccgcttcgtccacctccccgccgtggagctccccaccgtccaccacggcctcgaggacttcatgatgcgcttcatacagctccacgcgacgcacgtcaaggaggccgtctccggcatgtcgtccccgggcgccgcggtcgtggtggactacttctgcaccaccctgttcgacgtcgcgcgcgagctcgcgctgccggcgtacgcctacatgccgtgcggcgcgtcaatggtcgcgctcatgctgcggttaccggggctggacggggaggggtgcggggacttccaggcgatggaaggaacgggcgatctaccagggatgcccc

SEQ ID NO: 10814 - DNA, 695 bp, Zea mays
  unsure (1)..(695): unsure at all n locations; Clone ID: LIB3279-183-Q1-K6-D2
gagcactcctcttcaatggcgacggcccccgcacccctctcgctctccgcctccaccctgcccgcccggctccgtgccggagtggttccggcgggcacacggtggaggcagccgcggcgcgggcggatggtggtgcgcgccaagatccgggagatcttcatgccggcgctgagctccaccatgacggagggaaagatcgtatcctggtccgcgggcgagggagaccgcgtctccaagggcgatgctgttgtggtcgtcgagtctgataaggccgacatggacgtcgagaccttccacgacggcatcgtggcggtggtcctcgtccaggctggcgagtcagcgccggtgggcgcccccattgcgctgcttgcggagtcggaggaggaggttcccctcgcgctcgccaaggctcaggagctctccaacaggcagccgcagcaggcgcctcctgctccgacggaggccgcagcggcgccgcccactcttccggctccgacgactgctccagcaccggtggccgcggggacgaagggcattgccagcccgcacgctaagaagctggctaagcagcacagggtggaccttgccaaggttactggcaccgggccgtacggtcgaattacgccggcagatatttgaggcgctgccggaatcaagccgaagtcagagcccatcctgctgntgctgctgctgcg

SEQ ID NO: 10815 - DNA, 602 bp, Zea mays
  Clone ID: LIB3279-183-Q1-K6-D3
cggtcgcgtgggcggagacggagacggtcaacgtggaaggcatcccgttcccggcggagatcaccgtcggcaaccctctctccctcctaggcacaggtatcacggacatcgagatccacttcctgcagatcaagtacaacgccatcggagtctacctccacaacgccggcggcggcgacagcaccacgcccacgctgctgggccacctcggggcctggaagggcaagacggcggaggagctcctagcggacgccgccttctgggccgcgctggtcgcggcccccgtcgagaagctgttccgcgtcgtggtcatcaaggagatcaagggctcgcagtacggcgtgcagcttgagagctccgtccgcgaccgcctcgccgccgccgacctctacgaggacgacgaagaggaggcgctcgagaaggtcgccgacttcttccagtccaagtacttcaagccgggctccgtcgtcaccttccacttcccggcaccggcctccgcctccccgggacccgcggcggagatcaccttcgcgacggaggggcagggcgacgccaggatcgcggtggagaacgggaacgtcgccgggatgatccagacctgg

SEQ ID NO: 10816 - DNA, 423 bp, Zea mays
  unsure (1)..(423): unsure at all n locations; Clone ID: LIB3279-183-Q1-K6-D4
gggnaaaagcaaaaccagagcttcagagtacttcacaagaagcacagagaagccaggaaagggttcgcaagcctggtcggcaaaggatccaaggcagagtagcaggccggttccaacctttcagagcttggcgcggtatgactgccgactggcaggaagagagggtcgtgcgcgcagaaggttctctttttgcagtagccatcgagtagttcgttgggtcaattcgtgttaatttctgttaggaaaggaaaaggtgttaataagtgttatgataggaaagaaaatgcacgtcagctttgacaggtcagagcagcctaggtaggcatcaatatgttgctgcgactgcgatgttttaatttgacttggaacctcttatgttgggcgacaagtttgccctctgggggagagatactgtttcgtctc

SEQ ID NO: 10817 - DNA, 586 bp, Zea mays
  unsure (1)..(586): unsure at all n locations; Clone ID: LIB3279-183-Q1-K6-D5
gggaccgtgggtttatagtcgaagaacgtgttcttcgaaccgcagatggattgctgttggagagtcaggtggaaacaacatgggagacatctattggcgcagctgtgaacaagtacggctatcgaatcacacagctgattgaagttctggagaagagtagggacaaataccaccagctgctgcttctggaagaggtgaactggatagcggaggaagcccccgacaacgcgaacgactacatgaacgaggtcctgatctaccttgaaacgttggtgtcgacggcgctcctgaacgacgacgtgaagaggttcaccgtcaacgcggtgttagggatcgatattgacctgaagacgctggaagcgtttgcggacgacaagttcgacagcacggggctgtcagatctggggaaggaaacgactttcagggactgtttggttgagatcaggcagctcacgaatctcctgctcagcaggcagcctgagaacttcatgaacccggtgatcaggcagagaaactacgagtctctggactacaagaagctggccatcatttgtganaagtacaagtactctgcagacagtctgtt

SEQ ID NO: 10818 - DNA, 633 bp, Zea mays
  unsure (1)..(633): unsure at all n locations; Clone ID: LIB3279-183-Q1-K6-D6
cccacgcgtccgcggacgcgtgggcgctctctaccgtccgagaccccaagcaccagcgcggcggcgggggcgggggcggcggcgaccatggnnctgtcggaaagaacaagaggatctccaagggaaagaagggtggcaangaaaaagaccgtcgaccctttctctaagaaggattggtatgacatcaaggcaccgtcggtgttcagtgtgcgcaacatcgggaagactctcgtatccaggacacagggtaccaggattgcttctgagggtctgaagcacagagtctttgaggtttgcctagctgatcttcagggcgacgaggatcaagcttacaggaaaatcaggctccgtgctgaagatgtgcagggcaggaatgtgctcacaaacttttggggcatgaattttaccactgataaactcagatccctagtgaagaagtggcagacattaatcgaagcccatgttgatgtcaagacaaccgacaactacatgttgcgtttgttctgcatcggcttcaccaagaggcgcccaaaccaagtcaagagaacctgctatgctcaggcatcccagatccgtcagatccgccgtaagatggttgagattatgatcaacccagcttctacatgtgacctg

SEQ ID NO: 10819 - DNA, 558 bp, Zea mays
  Clone ID: LIB3279-183-Q1-K6-D7
gtttctatggaggaacaagaggatctctggtggggtgctcgcaggcgcaactgccttctggctgctgtttgaggtcatggattaccacctcctcaccctgctatgccactgcctcatcctcaccctggccatcctgttcctctggtccaatgccacgactttcatcaacaagtctcctcctaacatccccgaggtgaagatcccagatgacctggctgtgaatgttgcacgttccctgagatatgagatcaacaggggttttgctaccttgagggagattggccaaggccatgacctcaagaaatttctgattgtgattgcaggactgtggatcctttctgttcttgggagctgctgcaatttcctcaccttgtcttacatagtttttatggtactgtacactgtaccggtcctgtatgagaaacatgaggataaggttgatgcttttggtgagaaggccatggtcgagctgaagaggtactacgccatcttcgacgagaaatgcctatcaaagattccgaagggcccattaaaagacaagaagcaacattagaagct

SEQ ID NO: 10820 - DNA, 629 bp, Zea mays
  unsure (1)..(629): unsure at all n locations; Clone ID: LIB3279-183-Q1-K6-D8
gtcctttccgagggaaactcaccagcccaccacagnacccgagcggaagaagccatgtccgggcgcggtaagggtggcaaggggctcggcaagggcggcgcgaagcgtcaccggaaggtgctgcgcgacaacatccagggcatcaccaagccggcgatccggcggctggcgaggaggggcggcgtcaagcgcatctcggggctcatctacgaggagacccgcggcgtgctcaagatcttcctcgagaacgtcatccgcgacgccgtcacctacactgagcacgcccgccgcaagaccgtcaccgccatggacgtcgtctacgcgctcaagcgccagggccgcaccctctacggcttcggcggctaggctgatgggctcctcgcgatgttctccccttctgcagatgcgacgttttctggccgtgcccacaagtcttgcggtcaagaaagtttcaggaactcttgttagttcatctctagctgtggtaggtttatctgaatcgtgagactagtaggtttatctgaatcgcgaggctagcaggcttacctgaatcatgaagcagtgatgaaattatgtgtgcatcggatgttggaaatcgaactgtaatgcaatttgtactctttgatgca

SEQ ID NO: 10821 - DNA, 320 bp, Zea mays
  Clone ID: LIB3279-183-Q1-K6-D9
cccttttgtgccttgccccagagagggaggaagaaaaaagaagagaagagaggggagatgagggcataccgtcgcccatcatcgtcgttcctctccaagaattggtggctacactccggatcatgcctagtacatctttcttcttcgatgaaggtatttgattcatgttgggaatgagggaagtagcagcacgtccaccttcactattataataacgctgcccagttgcagccatgatttaattagaaactcgatgtcaaatgatgtttgtttttttctagtcgtgtgcactggttaattcagttcatgttgttatgttt

SEQ ID NO: 10822 - DNA, 616 bp, Zea mays
  unsure (1)..(616): unsure at all n locations; Clone ID: LIB3279-183-Q1-K6-E1
cccagcgtccgcccagcgtccgcccagcgtccggncagttcgaaaccaagnatccatccagaagcgaggaggaagagggagaagggcgcgcgcgcgcgcagcgttcaagtggtgctggtgtcggccatggatcgggttcgcggatccgcgttcctgctcggcgtcctgctcgcaggatccctgttcgcgttttcagttgctaaggaggagaccaagaagctcggcaccgtgatcggtatcgatctcggaaccacctactcctgtgtgggtgtgtacaagaacggtcatgtcgagatcatcgccaatgaccagggtaaccgtatcacaccctcatgggttgccttcaccgatagcgagaggctcatcggtgaggctgccaagaaccaggcagctgtcaaccctgagaggaccatctttgacgtcaagcgtctcatcggaagaaagtttcaggataaggaagtccagagggacatgaaacttgtcccctacaagattattaacaaggatggcaagccatacattcaggtcaagatcaaggatggngagaacaaggtcttcagccctgaggagatcagtgccatgattcttggcaaagatgaagatactgctgagcgta

SEQ ID NO: 10823 - DNA, 633 bp, Zea mays
  unsure (1)..(633): unsure at all n locations; Clone ID: LIB3279-183-Q1-K6-E10
cgacaaaaccataccatcaaacaagtgccagcgccctctcgcagtcgccgcaatggagagcaccttcatcatgatcaagcctgacggcgtccagaggggcctcattggtgagatcatcagccgttttgagaagaagggcttctacctcaaggccttgaagcttgtgaacgtggagaggtcgtttgctgagaagcactacgccgatctcgcctccaagcccttcttccagggcctcgtggactacatcatctctggccctgtggtggccatggtctgggagggcaagagcgtcgtcacaactggccgcaagatcattggcgccaccaaccccctggcttctgagcccggcaccatccgtggcgactttgctgtcgacattggcaggaatgtcattcatggaagtgacagcattgagagtgctaataaggagattgccctgtggttccccgagggccctgctgattggcagagcagccagcacccctggatctacgagaagtaaacatggaaagtttcacatcaaaccttgagagccagaggaagcatgtcaccatttgtgctttagcaatgttttcgaaaagatatgatctgtatcttggaaccttatttnatggaccaaatttcttctttgcc

SEQ ID NO: 10824 - DNA, 639 bp, Zea mays
  unsure (1)..(639): unsure at all n locations; Clone ID: LIB3279-183-Q1-K6-E11
ttcgtgatgatatatttccagatccggtttgtccgacgcagatggtagggctggagaggctgccgatgtgatgcatgaattttgtgttcgtaacgtggattggtgtggggtgggagaggctcctttgccggattggccaggttaccattgtactgttgtagcttggcagttggttgactgtgtgacaactttgagctatgtcatattacgaaagaaggggtggagacaggggtagtggccgtattcaaggaagtggtgggcgaggtggacatgtcctgcgtggaagatcaggattggctccccgaggacttcttggggttaactcccgtccatctgcacgcactattgctaagtcatttagcagaaccaaagacatgacatggcgacctgatctatttagtgatagcatggcggctagtggaatagaaactggtacaaaattgtacatttcaaacttggactatggggtctctaatgaggatataaaggagctgttttcggaagttggtcatttgaaacgctttgctgttcactacgatggttatggccgcccaatggcactgcagaggtggtgtttacacngaggagcgatgcaattgctgcactggagcgttataataaatgtctactggatggaaa

SEQ ID NO: 10825 - DNA, 575 bp, Zea mays
  unsure (1)..(575): unsure at all n locations; Clone ID: LIB3279-183-Q1-K6-E12
ttattatctctcaccacctctcccctgaggtggtgggggggctttggtcaggcaggctcaggcaaagggggcggccaacaaggacgagcgatggcgaccaaggtcatctgcttccttgtgctcgcatccctgctcctcgccgtcgcctttcccgtgtctgctctgcggcancaggtgaagaagggggggggcggaggcggaggcggaggcagtgttagcggaagcggaggcggcaacctgaatccctgggagtgctcgcccaagtgcgggtcgcggtgctccaagacgcagtacaggaaggcctgcctcaccttatgtaacaagtgctgcgccaagtgcctctgcgtgccaccggggttctacggcaacaagggcgcctgcccctgctacaacaactggaaaaccaaggaaggagggcccaagtgcccctagaagatccaccgcagctcccgtccgccattgtcccctcttctccgaatctggaacgtgttgttcatcttggaccaccccctaggcttggcattttattactagtataatgctagtgtccgcccattggttaatctggaatgcta

SEQ ID NO: 10826 - DNA, 610 bp, Zea mays
  unsure (1)..(610): unsure at all n locations; Clone ID: LIB3279-183-Q1-K6-E2
gggaatgtgggctatgaaactgccttccgctgaccagtggtcgtgaagagaactctatcaaccttgactgagcatcctgagggccttcctggcgcagaagaaaccccagagtactctgatcataggaagaaattctagtcttctgtcaaacctgcccattttggcgtgaagatcgcctccagatccctgctgatccttgtgcgcttcatcttcaccggaatcttcatcggcctgctcgccaacttctccttcggcaggtccctcctgctgaagtaccctgagtttttctccgctgggctgttcagcagagccggcccgaccgaggaagaggtgaagagcgcctcgttcaagatgtggtttgtcggtcacggctacagcaacgtggatagctcgttggagctcggaagaagcaagccggacaaggaggtgatcaccaaggtttcgggacccgaggtcggttacgtcacaactccgatcgtgctggtgcagtgcgccctcgtcctgctgagccagcgtgccaacctgcccaagggcggngtatacacgcctggcaccgtctttggccctactgatctccagcagcgcctccagaataacgggctgtnttttc

SEQ ID NO: 10827 - DNA, 645 bp, Zea mays
  Clone ID: LIB3279-183-Q1-K6-E3
agggtcctcgtcacagaacacgcgccccacccgtctcgtcgcgccgatccagcccggcgctcggccccgcggcgtgtgcaatggccctcgacaccgccgacgccgacgcgccgcgcttgcgcctcgatgccagcgccgccgtgcacccgctcctctccgacgacggctccacggccgcgggggagacagcggagcagctggacgccaggtacgccccctacgcgcgccgggacgcgtacgggaccatgggccgcggcccgctgcccgcggcgcaggcggtgcggctggcgctggccgccgccgtgctcctcccgctccgcttcgtcgcggggatgctcgtgctcctgctctactacttggtgtgccgcgcgtgcacgctgttcgtggatgcagatggggggcggccgaggttggcggggtggaggaggaaggccgtgctgcgatcggggtgcgcgctctcacgggcgatgctcttcgtcttcgggttctactggatccgcgagacccgcaggaggtccactaatgctaagggtttaaatcaggaccaatttgaagaatcccaaagcccagggcaattgtatctaatcatgtctcttatgtggatattctttatcacatgtcagcattctttccaagttttgttgc

SEQ ID NO: 10828 - DNA, 617 bp, Zea mays
  Clone ID: LIB3279-183-Q1-K6-E4
cccagccatggcgaccgcgacgcggaggctgctccccgcgctcctcaagaccctagctccagccggcgcgcgcggcctctccaccgagaaggctgttggtgcagccgccgtcgtcggcagccacaccgctaagtggatgcaggacacgagcaagaagtcgccaatggaactgatcaacgaggtacctccgatcaaggttgatggtcgcattgccgtctgtgaaggggcttctgaaggtgttggacttggccacccaattgagtacatctgccttgatctggaggcacctaatgtgtgcaagtactgtggtctccgttatgttcaagttcaccatcactaaattgggaagatactgccgtctaccgctgcagaagctgagttgaggagtttatgtgcacacacatttgttccacaatgttctgtagtgtactttgtactatgcttgcgggcaaaatattacctttgatgatcatcctcttctcgggcgatcgtttattaatcctgtcttagtatggttcatttttctacagatgaattgtgctcctttttcagaatctatacaagctgtgtgtattgaagttttactctaaataagcatggaactaacgagggcaatt

SEQ ID NO: 10829 - DNA, 606 bp, Zea mays
  Clone ID: LIB3279-183-Q1-K6-E5
cgacagctggggatgatcttatgtctgatagctaccacttgagttctgcacctggaaataatgtgttcgtggggtctggagctgcattgaaccctgggaccatattgagccctgtcccagcatgcaaagaggatttctcacggaagaagcttacttcgttcgacaaacttatagaaagaacatgtagttctataaggaatgtaaggcttcattgtgacgctgatctaaagccaagtggaggtgttggaacttctggaatggcaccagatgcagctgagatacagcttaaaagccccaactggttgtttggtcaaaggaagcatacggagacaatttcaaccgcaagagttgccccggttgaaaacgtgaacgaggggaacagagacgagtcaaatgtgtctctttgtggggaactaatttggctatcctcctcagttgaatcatgcgaggaggacattttcagaaggtaccttgcattcacgacagcggatgtagagaatggctggtatggcggaacactgctatatgaccgagatgaaaacagcggggcttacaggcactattctgagctctgccagggagctgtcatggatccctttgagcatg

SEQ ID NO: 10830 - DNA, 629 bp, Zea mays
  unsure (1)..(629): unsure at all n locations; Clone ID: LIB3279-183-Q1-K6-E6
ccgggtgaagaaaaaaaaacctcctgttccctgactatcgctacccctccacatccagtggccatggtgaagaagcccaacgacgttgccaaggccgcggcgacctccgccgacgcggcagccaggccatccaaggcgaatccgtccacccctcagtcggtcaagacctcgaagtttaagaagcggaaggtcaaggccaaccgccagaagccagcggtcgctgccgcagctgttggcgatgtcgccccggtaggcgcaggcactggggatggcgatgcatctgcatccgcggttttaccgcagccatccaatgttgctgaggcatcgcctgtggtgcaaacgccaaagtcgaccacttttgttgaggcgtcacctgtggtacagacgcagaagacagccactgatgctgaagtaccggtgcattcaccaatgccagccactgctgaagcatcagctttgtcgccaaagccaaagccaaaaccagctcatgctaatgctgatgctgcagctgcaatttctgtcagcaagggcaagggcgtgggtgctgataatagncggggtgatggcagaatgaagagcagaaaagagaggctaggagtggcaagggaaggaggttttgggggatggag

SEQ ID NO: 10831 - DNA, 354 bp, Zea mays
  Clone ID: LIB3279-183-Q1-K6-E7
ctggtttctaccgacttccttggtggcgggggggggagcgatcttcgacgccaaggccgggatcgctctgaacgaccacttcgtcaagctcgtctcgtggtacgacaacgagtggggctacagcaaccgcgtcgtcgacctgatccgccacatgttcaagacccagtaggggtttttcccggctggttgtcatggatggttgctgcttgtgtatgccgagaataaatgtggatggcgcgtgcctctgggtcgccaggttcatgctgagtctggacatgttttgcacttttgtttcccttcctgctaccatctgtgacagatccgctcgctaatatgggacctgagattagcttt

SEQ ID NO: 10832 - DNA, 98 bp, Zea mays
  Clone ID: LIB3279-183-Q1-K6-E8
gaaatgtggagcaacgtagatgttctagctaacacagacacatagtactctctccgttcttgttttaaaaatgagttagcgggcgacaaatattcgat

SEQ ID NO: 10833 - DNA, 582 bp, Zea mays
  Clone ID: LIB3279-183-Q1-K6-E9
ctcatcttttcgcgtttagaacctctaaaatttcccccactcgccagtcgcagcagcacctgtagccatggacgccagcggagccggtagcaaggggaagaagggtgcggccgggcgcaaggcaggcggccccaggaagaagtcggtgacgcggtccgtcaaggccgggctgcagttccccgtcggcctgatcgggcgctacctgaagaagggccggtacgcgcagcgcgtgggcactggcgcccccgtctacctcgccgccgtcctggagtacctcgccgccgaggttctggagttggcagggaacgcggcgaaagacaacaagaagacgcgcatcatcccgcgccacgtgctcctggcgatccgcaacgacgaggagctcgggaagctgctggcaggcgtcaccatcgcgcacggcggcgtcctccccaacatccactccgtgctcctgcccaagaaggcggcggagaaggcggccagcgccggcagcaaggagcccaagtcccccaagaagggcgccaagtcccccaagaaggcttagaaagtagggactttatttgcactgtgtgctgtagcatgctc

SEQ ID NO: 10834 - DNA, 290 bp, Zea mays
  Clone ID: LIB3279-183-Q1-K6-F1
caagcccatgagcttagtcttctttgaaagctgatccatgaggctcggtcattactaaagtccttacgaaggcactagagtgcagagtccatgaggcttggccatctatcataaagtccctatgtggtccttagactaccaagtccatgaggcttggacatctatgataattatcccctattaggattctagagcattgagttcatgtaatttggttatcaatgtgtctctataagactaatggaatactaagcccatgagacttggtcatcaatgaacatggttttcct

SEQ ID NO: 10835 - DNA, 646 bp, Zea mays
  Clone ID: LIB3279-183-Q1-K6-F10
atccatgacattcctgaatcatttattatatctaagtagtttatatcgagacattggaggccaccaaatttaggaaagacataatcgagagcgtggtgcgcatctatccaagacaaaaatgatactcactactatagtaagaataggtagggatccaacagcaataatgatgacgacaactttgttagttaggatacctatccaccgtgtcactacaccttatctactattttaaagcaccagtgtaacacactaaaaattcaaatctacaaaatttcttgaactcgttctaaattcaaaataaattttaaaatttcgttttaaaatatttgtatgcgaattgatttcaacaaagaaaatatagtgctctatattctctctaaaattcttatcaaaatgtcatacaaatattttccaagtaattctctttaaatcctttccaaaaatactaactaaatattccagcgatagttctccaaatactacctgatgtttggtgtgctccaatcattcggatctgattttgcttgctctattgccttgaactcttcccctagctgatgtgacacttggttgttgtatttcttggacgaaaatgctggtggaacctgtgctcggcttgatcccacttagatagagtatctgc

SEQ ID NO: 10836 - DNA, 636 bp, Zea mays
  Clone ID: LIB3279-183-Q1-K6-F11
gttcaaacaatctattcttttcgtcctcctcatcgatttatttatatgcttgctggacttgtatttttcatttatcttttttttgataaacatggcattcctggtatgaatatgcagtcacttcattcgttgttattttggctcagctaaccatcaggaggtctggaggatcacaagtgccttggagaaccacaagtatgaaattgctgactgggaccttggtgccggaatatacatagacttctacattctgaagaactcaatgcaagaaagaaatgccatggatgattcggattcactcgaggagatgagtgaatcatgcagaagtttctttggccgactaaacgaatcgttgttagtctggggaagcaaattacctgttgagtcaagggcatgctactcgaagatggcagaggagctatgcgcgcttctggtggacaccccaagcgagacgctgaacctacccatggggtgtcttctgacgatgctcaacgctccagttccggacgagagcaggtcgtcgtacctgcaggacgcactctccgtcttcaccgaaatcctttgcagcgatccgtagcacaagggtccacggtgttgccgtaatctgggtgaaggggagtgaagcctacagcaaca

SEQ ID NO: 10837 - DNA, 510 bp, Zea mays
  Clone ID: LIB3279-183-Q1-K6-F12
ccttatcaaaagtttgcattttgggtgtgggagctgggccagagtgtctccatccatgctcatagagctaatggcgtggtggaaaacaacatcatcagcagagtttttggaaatactagacgccttcaaccgggcaaacctgtaactaaagcgcaagcagctgctgcactgactagtggggcggtgagggaagcagttcatgaagaattgaataaacttgaagcagaaaaccaagcccatctttctcttatagctgaaataatggaagagttaattagtaggggagatatacaacaacaatgggaacaaaagatgaaaaaggagcaagaacgggctcttgaagttgacaataatcttcaacatgtattgcatgagcatgcaaatgagaggacagacagagaagaggaactagcagacttgttgaaagaaagagcagctctagaatgccagaatcaggaactcataaatttaaggtcataaattgacggcattgttgatagattggcaact

SEQ ID NO: 10838 - DNA, 495 bp, Zea mays
  unsure (1)..(495): unsure at all n locations; Clone ID: LIB3279-183-Q1-K6-F2
cagagatctatctgcatttttctggactgttccagctcttttcaatcacttcctaccatacttctacgtgatctttctgactatattattgtttgaccgagcaaagagggatgatgaccggtgctcatcaaagtacgggaagtactggaagatttactgcaacaaagtaccatacagagtcattcctggcatttactgagcatctcgagttctggacgactcttgatattaagctcaacagatgccacgatatccagtcttcataccgatctgctactgattgtgtaatgtcgttggtaggcttggactgtacgcagtattaggtgtaggcaacttggcttttggcatctaccttgtatgtgtcgtgtatctagggctggggcttgctccttcagttgttagacagtagggggtaatctcaggggtgcaatgtactccctccgtcctaaaataaaagcatatctagtatttaaaaaaaaaaaaannnnnnnaaaa

SEQ ID NO: 10839 - DNA, 593 bp, Zea mays
  Clone ID: LIB3279-183-Q1-K6-F3
ggagccctgaggaagccaaccttccctttccccaggcacagatccggctctccgccgccgctatggccgctcgccgcctcctcctgctcctcgccgttgtcgccgcgtccctcctggccgccgacgcgcggccgtgccacggcttcctcgtcgccatcccgtccgatcccaaccccgaccccagcagaggcgacggcgccgtcaaccgccacctcggcgctccccacgtcgccacggtcatcaccgtcttccgcgtccgccgcctcggtccacacgtcccccacggccaccgcaaccaccaccacctccattctatccccgccaacgttcagatccatcgccccgatctcctgcaccccgccacggccgcggccgccctttttttttttttttgctagtcgggcaaggcgccgaaggcacgcacgacccgaatttggtgagtttattgggatttggggcaatgcaaaaacaccccccaaaagcacagagatctttagaaccaagagtgcttaaagcgacagacttcaattacaaatgcaaatactagagcagttcagcaagtgatgatggaaggaaacacccaaacattaccc

SEQ ID NO: 10840 - DNA, 631 bp, Zea mays
  unsure (1)..(631): unsure at all n locations; Clone ID: LIB3279-183-Q1-K6-F4
cgactccgccgccgctccgcctcagcgcgtcgcccgccgccacatcctacagcgacctcatcgatcaccttcaactttcaatcatggcggacgtcgatgtcgaaccggaggttgccgccggcgctcccaagaagaggacgttccgcaagtacagctaccgcggcgtcgacctagatgcgcttctcgacatgtccacggacgacctcgtccagctcttccccgcgcgcgccaggagaaggttccagaggggtctgaagaggaagcccatggcactcatcaagaagctgcgcaaggcgaaaaaggatgctcctgctggtgagaagccagagccagtcaagacacatctccgtaacatgatcattgtccctgagatgattggaagcattgttggggtctacaacggcaagacgttcaaccaggttgagatcaagcctgagatgatcggccactaccttgctgagttctccatctcctataagccggtcaagcatggcaggcccggtatcggtgccacccactcctcgcggtttattcctctgaaatgagctgttacccgtctctgtagtctcccaagagtccgttggcaatgtccattcagcttttctacttgttttgaacaagntaaatgccc

SEQ ID NO: 10841 - DNA, 347 bp, Zea mays
  Clone ID: LIB3279-183-Q1-K6-F5
cggctgacatcgccgtcgacatttgaacgcagggcgtcgtcgcgccgggcgtctgccagcgccgtccggctagccatcagtagctagtacgtagtaccagtatagtttgcagagtcgattgcgccatgtgtggtggctgcgtgcctgtgcctgcctgccggcctggcctggagtgcggttctgctgccgccacagttaattggcccagtttgtctagctgtcgagtttttttttttcaactctctctgtctctctccgactcttcccttctttttgataaagttcgtccctgcggttaaaaaaaaaaaaactaaaatcacaaacaacaaaaaaaatgcgcaaccatg

SEQ ID NO: 10842 - DNA, 669 bp, Zea mays
  unsure (1)..(669): unsure at all n locations; Clone ID: LIB3279-183-Q1-K6-F6
acgacatggcacctttgcaccacgctactgccctgcctactactagtactgtctctttgaaccactttggtggcctaatcccgggcccctctgatgatggcttatgagccccagctttgcgcttgcaggcactgcacggtctggttcttgttcctgagcagttgagctgcgcacaccgacttcttttgcacaaggtacagcagcgcaggcgcagcggcagcccgccgctggatctctcccgaggctccggcgatggaacggtcctgctacttcccgctgcggtgggagagcacgggcgaccagtggtggtacgcgtcgccgatagactgggcggcggccgacggccactacgacatcgtccgccagctgctgcacctcgaccctaacctgctcatcaagctcacctccctccgccggatccgccgcctcgaggcgctgtgggacgacgacgcccgcttcgccgacgcggcccggaaccgcgcgtccgtcgcccgcagcctgctgctggagtgcgagtgcaggaaccaccgccccggcgccggngagaacacgctgctccgggccgggtacggcggctgggtgctctacgcggcggcggcggccggggacgccgcgttcgtgcgggagctgctggagaggacccgctgctcgtgttcggcgagggcgagt

SEQ ID NO: 10843 - DNA, 343 bp, Zea mays
  Clone ID: LIB3279-183-Q1-K6-F7
ggggggggggggggggggggtggaggtgcacaaaaacgggtggatcgaagagtggaacgccggccgtgagaacctcgagttcaatttccgctggacccgtcgcagcctcgccgtcgtcgggctgttcggcctcgctgtccccatcctcttctacagggggggggggggcgaattccatatgcaggacgaggatgcaggccggccatacaggaagttcctgtatgcggcgtccagggccgcaggagacgtcgatccctcgaccggtgctgcgaggaggggagttttctttcagtttgtgtcggttttgttttagtctgaatctgatggcgctgtttggaatgct

SEQ ID NO: 10844 - DNA, 620 bp, Zea mays
  Clone ID: LIB3279-183-Q1-K6-F8
agagattgggcgcgagatccccagcaacaaacgggtagagggagaggagaggagaggagaggagaggttgggtctgggacaccatggctccgatgaagctgtacggggcggtgatgtcgtggaacgtgacgaggtgcgcaacggcgctggaggaggctggctccgactacgagatcgtgcccatcaacttcgccaccgccgagcacaagagccccgagcacctcgtccgcaacccgtttggtcaggttccagctctgcaggatggtgacttgtacctcttcgaatcacgagcaatctgcaagtacgctgctcgcaaaaacaagccagagctgttgagggaaggaaacctcgaggaggcagcaatggtggatgtttggatcgaggtggaggctaaccagtacaccgctgcactgaatcccatcctcttccaggtcctcatcagtcctatgcttgggggaaccaccgaccagaaagttgtggatgagaaccttgagaagctgaagaaggtgctagaggtgtacgaggcacgcctgaccaagtgcaagtacctttgctggagacttcctcagcctcgccgacctgaaccatgtgtctgtcactctctgcctgttcgctacgcc

SEQ ID NO: 10845 - DNA, 337 bp, Zea mays
  Clone ID: LIB3279-183-Q1-K6-F9
ggcggaaatgccctgagcttggggaacaggcgctgcccaccacccaaccccgggccgggggcgtgcgtgggcgcaactcagcaacacgctcatcaaggagaacttggctgggctccgactatgaggctgaaggacgggctgaggatcacggactcctggatcaagggagcagctggagaaggagaaggccgagggcatggatctgccggcctacggatcatccaagggcgagcagacacaggccccggctcagctcgggctccctccgggccgctgagggcaaggagcgaactctggctgcgcccgagagtggcagggcatgagatccaggaataca

SEQ ID NO: 10846 - DNA, 621 bp, Zea mays
  unsure (1)..(621): unsure at all n locations; Clone ID: LIB3279-183-Q1-K6-G1
ctagttctaggagcatgcataggtcancctgaacanaactacagcaacagaggctttaatccacgccagcggcagtcaagcagagcatcacgttcacgttggtacagcaattcagacgattactggtaaagaagccattacatatggagtgggcatgtggtgcgaagcaacttttgcatgtgtggagcaaaaggcctccttgcaccaagatggcacctgcctttctgggtttttttaggtgccggtgctgacgcaccagccttcgcagtctcagctttcgtgtctgtttgctgtgtttcttttccagagggtgaaaatattaggattgatcaactggggatctggtatgattggttgacactaatagtgttgtgacttgattagcacagaaaatacgtgggattaggaagtggtacatcaaattatcttttgttggcctggtgatttctgaacactgactgcttgggagtggctggcatgatggtatccactcttgaggagttgaacaccgagaacaacgtcgaaagttaggagcaaggataaagatgccggttcctcgaatatctgcaggcactctnttgctggatgcatggctactgtttagcacgggcagtttgcagc

SEQ ID NO: 10847 - DNA, 438 bp, Zea mays
  Clone ID: LIB3279-183-Q1-K6-G10
aaaaaaaaggggggggggggggggggagaaaaaaaaaaaaaagggggaggaaaaaaaagaaaagaaaaaaaaaagagaaaaaaaaaaaaaaaaaaaaaaaaaaaaaaaaaaaaaaaaaaaaaaagaaaaaaaaaaaaaaaaaaaaaaaaaaaaaaaaaaaaaaaaaaggggggggagaagaaaaaaaaaacaaaaaaaaaaaaaaaaaaaaaaaaaaaaaaaaagaaaaaaaaaaaaaaaaaaccaaggaaaaaaagaaaaaaaaaaaaaaaaaaaaaaaaaaaaaaaaaaaaaaaaaaaaaaaaaaaaacaaaaaaaaataaaaaaaaaaaaagaaaaaaaaaaaaaaaaaaaaaaaaaaaaaaaaaagaaaaaaaaaaaaaaaaaaaaaaaaaaaaataaaaaaaaaaagaaaaaaaagaaaaagaaaggaagaag

SEQ ID NO: 10848 - DNA, 669 bp, Zea mays
  unsure (1)..(669): unsure at all n locations; Clone ID: LIB3279-183-Q1-K6-G11
ccccgcgtccgattccatcccctcttgccatgatggtggttcacacaaaccacacaacnnttccaacttcccacgtgttcagaaaatcaaaggaatggtccaccatgatgcgcttacaattaatgcctggctctgtcttgaatggaactccatcggaagctatcatggacagacacctctaactcctccccctcctacgaggttcatagcaatggcggcaccggaatctctttccctcagtacaacgatagctacatggtgcaaacattaggtgagctaaggcaggagctattcaaccaagtggtgtttctgtcttcataacatcttcagtacaacgatggctacatggtgcaaacattagggagggagcgaggacaaaagcgagtgataggatgacaggtaacacagcaaaatggtgtagccatgtttgaatatttaacgttgaaaagttatggtttcttttttcttcttgtttttaaaatttgcaagagacaataatgttgagatctatggaggtggaagctgccaccagatgagtttgtgatgttggacgcaatccattcccttgtgtggtggctgtaatggggaccagatgagtttgtgattttgagtaaggtattgggtgttctatgaaatttgcagggagatagatggaattatgggcataat

SEQ ID NO: 10849 - DNA, 620 bp, Zea mays
  unsure (1)..(620): unsure at all n locations; Clone ID: LIB3279-183-Q1-K6-G12
tcgttttttctgttgcaagaatcaggcccgtggatggtggggtgatgtttccacaaactagatctaagataactcacttggaatatgagtactcaagacatgaggatggtagacttgataggactgttcctactcaagacatgnggaagaagcaatcaaacgttatctctttggcctcatgtgtggtgaggcgaagcaatagaagaatgtactggaactgtgaatatgcactcccccgtcagtggtgcagagcatgaatcaaacaatgagagtgcagttgaaaatggctgcaaaatctttggtatctcattggctgaaaagatccgatcatgcgatgaagcagactcttgtagtgcaaaatgtaattctcggctccagcctttgaagtcacaaatgccaaaatcgctaggcagctgttgggccactgttcacgagcaaaggcctgttgttggcagggtggttgacgtctcggcgacggatgtgatctgatccacatggcatatccttgtagaatatgcaggaaggactaccgagtgcaactntcatgggctgaaccacatcctggatgaaagattgctgaaggtgaccttatgattcttgaaacagggatgtttgacaaa

SEQ ID NO: 10850 - DNA, 653 bp, Zea mays
  unsure (1)..(653): unsure at all n locations; Clone ID: LIB3279-183-Q1-K6-G2
cccatgcgtccggtttgttagcgtgacgtgcgtgaggagtctggagtcggacggaatcgaaaggcgaaaactcagtgtctcgagtttcctcggagcggaggcgatggctgggaagggagggaaaggcttgctcgccgcgaagactacggcggccaagtccgccgagaaggacaaggggaagaaggccccaatctcacgctcctcccgcgccggcctccagttccctgttgggcgtatccaccgtcagctgaagcaaaggactcaggcaaatggtcgcgttggtgccaccgcagccgtctactccgctgccatcctggagtacttgactgccgaggttctggagctggctgggaatgctagcaaggatctgaaggtgaagcgtatcacccctcgccatttgcagctagccattcgtggagacgaggagctggacaccctcatcaagggcaccatcgcaggcggaggtgtcatcccgcacattcacaagtccctgatcaacaagtcctccaaggagtgaagactaggggatgtgcatctttagtttaaactagacttctgtgcgctcctcggcgagtccttgtcatncctgtagttntagttgagctgtcaggttggagcctctctgtgtaacgcttgccctgtactgcttcatc

SEQ ID NO: 10851 - DNA, 662 bp, Zea mays
  Clone ID: LIB3279-183-Q1-K6-G3
gtgcccgtcgcgttcaggagagtgccgtgcgtgaagaaggcggcatccggttcaccatcaacgggcactcctacttcaacctggtgctggtgaccaacgtggcgggcgccggcgacgtgcgctccgtctccatccggggctcccgcacggggtggcagcccatgtcccggaactggggccagaactggcagagcaactcgtacctggacaggcaggcgctctcgttccaggtcaccgccagcgacggccgcaccgtcaccagcaacggcgccgtccccgctggctggcagttcagccagaccttcgagggcggccagttctgaggatgaacagctagcgcgcgcgcggctagctattggataattaattacggtactgtcgatttggtttttttgccttgttttttttttgcgcgacgacgacgaagaggaggatgaagacgaagatgaagacgaggcctctctccgggtatattgaaggaaggagaaggcttttgcgcgcgctatgctgaggctgctaatctagcacccgcctagacgtttcccttttctctggtggattacggactggatcggaccaaagatcgatccagctcctagtactaataatatagttgtactttgagaaatgaataattgtaatttattgtttttttggggacc

SEQ ID NO: 10852 - DNA, 438 bp, Zea mays
  Clone ID: LIB3279-183-Q1-K6-G4
aaaaaaaggctttattagcctctaaagcttagacgagcaatgtatgcctatggcattacccaagtgctgtaaggttctgcattatattgacacggcgtgctgcagatctcgtgcgtgcctatgtgaatctaatagcctcgcaaaataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggccgtttttaaaggacccaagttaacgtccccgggcttgcaaggtaatagtttttttatggggccaccaaaattaaattaatgggccgggttttaacaacgtcggaattggaaaaaccggggggttcccaaattaaatcgctttgaaaaaaatccccttttcgccag

SEQ ID NO: 10853 - DNA, 543 bp, Zea mays
  unsure (1)..(543): unsure at all n locations; Clone ID: LIB3279-183-Q1-K6-G5
tccgcgngttctccgtcaggtcgtccagttgaacgctgcccgagngttcgacgaggaggagcagcgcatggcggtcgtccgctccaacagcatccgcatgctcgaggaagaggccacagtggagaagaccgtcggcccgtcccaggccagcagggagatacggtcgccgtcgcccactcctcccccggtggttggccccaagaagcgggtgcggttcgtgctgccggcagcgagcccgaagccgaatgccggcgtgcaggaggagctgcaggagctgtccgacgcgcgggaggccggcatggcgttcatcctgggccactcccacgtgaaggcgaagagcgggtccagcttcctccgccggttcgtgatcaacttctgctacgacttcctgcggaggaacagccggggtcccaactacgccgttttcatcccgcacgcctccacgctggaggtgggtatgatgtactttatctgatctgatgactgaacccctgaaatgagggggggaatataggagcaggagaggaaaggaacaaaaagttt

SEQ ID NO: 10854 - DNA, 478 bp, Zea mays
  Clone ID: LIB3279-183-Q1-K6-G6
ggtctcctgtgtatcagtaacttttacttcagttgccacagctgctgtgatgccaggaggcgtatcttctgcagacaggtttgactcttgaacctgaccagaaatatcagaagataaattttctgactttggatctagtggtggttcatgcaaattcttagcttcatcagaagcactccccatgattatagtagatccagaattcaactccttttcagacattttatttttttctgctgcagtgtccacttcgtgagatttaaaaccctcgttcctatctgcaacttccaccagctttgagtgtaccatagttgatttcaattgtaagtcgacatttgcaaaatcttccaacattccaggacgagagtggtgctcttttggaagtgcacccacagcagtttcatggggcaccggcagtgcagttacaggattttgcaataaagctataccgtccatatttctaaaatcataattgact

SEQ ID NO: 10855 - DNA, 606 bp, Zea mays
  unsure (1)..(606): unsure at all n locations; Clone ID: LIB3279-183-Q1-K6-G7
ccccgcgtccgcctttctctcagtccaacgaaaccctcggaggcacggttcggttcgacgacatgctgtctggcgtgaagctggttccgcgagaccagatccagtctgatcagaagcgtaggggtgaccagggctccgattccgactcctccgacggcaagaggccgtggaagcacagtaaaagagggcgggacaagaaagagaagaagagacgaagcagccggcggcagcggaggcggagcaagaggtactcgtcggaagattctttggggtcagacaccgacgattcaatcggagaggaagaggaggatgatgtcagtcggagcaagcgtcgcgggaaggacaggaggcggcgacgcaacttctctgacgacgatgattccgaatccggcgaatctgaccggggaagagcctctcgcagggggaagcagagacgtgatgacgaggatgaggaggaagagactgaaggtgatgggcttagggcaagtgaggtggtcaggagggagatggggcttgaatggatgctcaagccagcaagcagcagccaaactgagggcaccggtgttcgntaggttgataatgtcgagaaggatgaatctgcacatg

SEQ ID NO: 10856 - DNA, 575 bp, Zea mays
  unsure (1)..(575): unsure at all n locations; Clone ID: LIB3279-183-Q1-K6-G8
cccagcgtccgcaaaaaactaccatatgttccgctgtattgctaggtatgggtataaggatgtacgcaaggagaaccaccaagcattcgaacagcttctgatagaaagccttngaaaagttcatacgccgagaggcccaggaacgctccctggaacgctccctggagagcgaccataatgacgacaaagactctgaagaggagattgcttcttcatcatcaagagttattgacgagtcaggcggtgctgacaactcagccctgggatcaagcatgtcgttggaggagggatcaagcatggacaacgagctatctttcatccacaaggccaaggagtcgggcgtggtgtaccttcttgggcacggagacatcagggcccggaaagagtcgttcttcgtcaagaagctggtgatcaactatttctatgctttcctgaggaggaactgcaggaggggcatcgcgacgctgagcataccccacacgaggctgatgcaggtggggatgcaatacatggtttagggttgcctagctactttctttttctatttcaagatgattactaactcgcggcaatag

SEQ ID NO: 10857 - DNA, 616 bp, Zea mays
  Clone ID: LIB3279-183-Q1-K6-G9
cgacgccacgccgctccgaggtaaattcagctgcagcttgagaagatgaagaaatatgcttctgttatccgtgtcattgctcatacccagattaggaagatgaagggtttgaaacagaagaaggctcacctgatggagattcaggtcaatggtggtaccattgctgacaaggtggactacggctacaaattttttgagaaagaggtccctgttgatgctgtcttccagaaggatgagatgattgacatcattggtgtgaccaaaggtaaaggttatgagggcgtggtcactcgttggggtgtcacccgccttccccgcaaaacccacaggggtctccgcaaggttgcttgtatcggtgcatggcatcctgctagggtctcctatacagttgcccgtgctggtcagaacgggtaccaccaccgcaccgagatgaacaagaaagtttacaagatcggcaaggctggacaagagacccacgatgcctccacagagtttgacaggaccgagaaggacatcactcccatgggtggcttcccccactatggtatcgggaagggtgactacctgatgatcaaggatgctgtgtgggtccaaaaaagaggggggtgaccctccg

SEQ ID NO: 10858 - DNA, 490 bp, Zea mays
  Clone ID: LIB3279-183-Q1-K6-H1
gggggaggcggctctggcgaggctcaagacgtacgagggcgtcccgccgccgtacgacaagaccaagcgtatggtcatccctgacgctcttaaggttctgaggctacagcctggacacaagtactgcctcctcggcgagctctctaaggaggtcgggtggaactaccatgacaccatcagggaacttgaggagaagaggaaggagaaggccaaggttgcctacgagaggaagaagcaattggccaagctgcgtgtcaaggccgagaaggcagccgaggagaagttggggtctcagttggagattcttgcccctatcaagtactgaggagctgtgctttgtcatcagttttggggaacatctagtctttgttttaagtgttcggtaacagtttgtgacagtataatctggtaaaccgtgttatttttctgccactcctatttgaacacattttctagctggtgaatgaactgtttggtcgatcttgttcag

SEQ ID NO: 10859 - DNA, 560 bp, Zea mays
  Clone ID: LIB3279-183-Q1-K6-H10
tctagatcgcgacggccgccctttttttttttttttggggattattaactgcagattccattaccatttgaagttcatcacaagatcgtcagtgatcgtcgccatccagggaactgaactttgcaagaccaacagaaaggtaaacgctgcctcagatcaggcagagacggagcaccaccagagagctactagtactacgactgctctgcaacagaaacgactactgcactccagtaattgaaactactaatacgactagctcatggcaactacgatatggatatggactgcaactacggtatggatatggactgcaactaggagacctgggaggacccatccgatgcacacaccctactcgatcttgatctcgaagacgtccttgcgctcctcgtccttgatcttcgggacggtgaccctgagcacgccgttcttcatgtcagccttgatctggtccatcttgaaagcctgggaggagaggccgatgcggtagctgtaccgcgccgggcccttgtcgtcgtcgccctcgaggtccttgccggcctcccccttgatcacca

SEQ ID NO: 10860 - DNA, 554 bp, Zea mays
  Clone ID: LIB3279-183-Q1-K6-H11
tgtaagaccctctccaagcccagcgaaaatgcgaagaaatggtcagatgcatggcatccatatactatcttctgcgcaccgaggcgccagcaggaaagcctgagaaggcccgctcgccattcttgtcaagatcatccacgaatgtcatccttcctcggcgggtgaacggagaggagaacaggacaccgaacaacaagtgcacggcggtggaaatagcttccatatcagttgacaagaaccagatgccagatgtctcttacgcgatcacccactacaggttgcttgtggaacagcttgaaagagttgatctgagcgtgtcggagaacagcgttaagttggccttctggattaacgtttacaattcgcttatcatgcatgcgtatctggcatatgggattccaaacagctctctgaaaagaatggcgctatttcacaaggctgcctacaatattggaggacatgccattaccgccaatgccatcgagcacgccttgctgtgcttcaggtctccacggatcgggcgttggttcgagtccatcctctcgacggctatg

SEQ ID NO: 10861 - DNA, 590 bp, Zea mays
  unsure (1)..(590): unsure at all n locations; Clone ID: LIB3279-183-Q1-K6-H2
catccgcagagagcttgttccgtccaggcaaccaaaaagcagttgccccgccgcgcagaggaagaagagagcagaggaggatggctcgtacgaagcagaccgcccgcaagtccacgggaggcaaggccccccgcaagcagctcgccaccaaggcggcgaggaagtcggcgccgacgaccggcggcgtgaagaagccccacaggtacaggcccggaaccgtggcgctgcgcgagatccgcaagtaccagaagagcacggagctgctgatccgcaagctgcccttccagcgcctggtgcgcgagatcgcgcaggacttcaagacagacctccgattccagagccacgccgtgctggcgctccaggaggccgccgaggcctacctcgtcggtctcttcgaggacaccaacctctgcgccatccacgctaagcgcgtcaccatcatgcccaaggacatccagctcgcccgccgcatccgtggcgagcgcgcgtagccatcatctccggngatctgatgaatgtctagttaccaaacaaataggctgtattagcgtcgttgttctgtattcgttattttggattcggttgcagtg

SEQ ID NO: 10862 - DNA, 628 bp, Zea mays
  unsure (1)..(628): unsure at all n locations; Clone ID: LIB3279-183-Q1-K6-H3
gctgattgtcccattcaataaanaaagcgaagggcatagataccagaagcaacactgagcccatcttgcttggaattctatctgctgttggaacaacttacaccaatatcatggcaaaccttgctgattcttttctagcggatcttgatgaactgtcagacaatgaaggctatcctgaagaagacaatgctgaggcagcgggtagggatgacgacgaagatgatgatatgcctgaccttgagtctcttaattatgatgaccttgatagtgtctcaaagttgcaaaagacacaacgctataatgatataatgcaaaaagttgaaaatgcacttcagaaaggtactgatttctctaatcaaggttccatcctggaggaggatccagagtaccagcttattgttgactgcaatgctttatcagtagatattgagaatgaaataatcataatccataatttcatacgggacaagtataggnttgaagtttcctgaactggagtcccttgttcatcacccaatcgattatgcccgtgttgtcaagaagattggaaacgagatggatttaacactagtagatctggaaggacttttaccttctgcattataatggttgtctcagtgacagcatc

SEQ ID NO: 10863 - DNA, 576 bp, Zea mays
  Clone ID: LIB3279-183-Q1-K6-H4
ataggatatgctgataccgatgttgctgagtttgtatacaaaaataacccctcggtcgatcagcttatgaaatttctctgcaaagatctttcgaaagcatgtgccaaggacccaccgccagttccaaaagatcgtgtccctggggaaccatttgcaaggaagccatcaaaggatgctgagatggaaaagatattgagatcaatggagggtatgccgggagccccaagcatgaaaatgtactccagggacgatctgatgaaaaataactttggtactgaagacgacgacgaggaggatgacgaagatgaggatgacaacttcccaaagaacttggggaaagctctgaaaaacagggctctcaaaagaaagatttgaaacagcaagtcgtgcagcagttcaaggataccagcaagaagttgaaagggcatgtaaacaaggtgtccggtatggtaaagaaatggtggaaaggggcaaagaagcctgccaaatccagcaaaagcaaaattgagctctgaagcattgttgaatcacgtcagtaaatctcatccgtcttccacttctcctggagcaaatttt

SEQ ID NO: 10864 - DNA, 667 bp, Zea mays
  unsure (1)..(667): unsure at all n locations; Clone ID: LIB3279-183-Q1-K6-H5
cggacgcgtgggcggacacgtggngaattttggagaaaaacaaatcaatgattgattttattgaatttacttgagataaggggaccatgcaagtatcggtgcaacagttttatttcagttgctagtttgtacaaaaatcagttatggtggatataatttagggtgttgagactaaagctcgacaaaaaaaattaatacagtaaaattaattaaggagatgtttgcgactactccgatccaccattttaagttctgctccaccaactccaccatgaagttgctccatgatcgaagtttttagagttttcaaactgcttagcttatagggggacttggtgggtggagaatgacttattataggtcgaccacgcgttcttcttgtttgacacaggtgacatgaggacgctgctttctggaggcgacgacgtcgtcgattttgctgtcttctcgggattcgtgacccgacacttcttgatccccgggaccacgatcattgcaacttctatggtattgaggcatctcgagctccgtgctaaaccgcatggcatgcttaatgaccgaagtcaatgtatgctcagtcatggaagttaagcggcataaaaacaagagaccaagacttcagcataatgttgtgactaaggtcaaggcgactatggtcatggatgta

SEQ ID NO: 10865 - DNA, 593 bp, Zea mays
  Clone ID: LIB3279-183-Q1-K6-H6
cggacgcgtgggcggacgcgtgggctcggggcagttgctgcagctgcaacccccctgcgcctctcttctcccggtcccacccgcccctccgccgcctagggcttccaaatcccctcagcttccccggattccgctttcccccgtcgctgcaaggttccgggaggttctaatctcctttgagcgccgcctgcccgccgtggctgtttctcggtgttcaccgcgttcctccgtgcaatgccgggcctaaacgcggctggggttagggttcctggcccgcagctcgcttcaatttgatttttttggaggtttttatagggaggagaaagagtccggatttcgaggagttagtggttgcgtgattgtctcggcggaggggaatctcaagtttcgtggccggggttttagcccgtgtggaatgaaaacccggtaatttttgaatttttgggcggtaaaaccctgctggttagcctggtgtggtttccatggccggggcgccgagggcccggtccctgaacatcgcggttccggaggcagaggcgaggcccgtgctggggccaggaggcaacaaggccaggtcgggcccggcgaacgcc

SEQ ID NO: 10866 - DNA, 588 bp, Zea mays
  unsure (1)..(588): unsure at all n locations; Clone ID: LIB3279-183-Q1-K6-H7
gttttactctgaggtgtctgctcttcttggacgtgtgccatctgctgtgggataccagccaacccttgccactgatcttggaggactgcaagagcgtattacgacaacaaagaagggttctattacatctgtgcaggccatctacgtgcctgccgatgacttgacggatcctgctcctgctactacctttgcccatcttgatgctacaactgtgttgtcacgacagatctctgagcttggtatttatcctgctgttgatccactggattccacatcaagaatgctttctccccacgtgctgggtgaggatcactacaacactgctcgtggtgtgcagaaggttcttcagaactacaaaaatcttcaggatattattgctatcttgggtatggatgagctcagtgaggatgacaagctgacagtcgcccgtgcaagaaagattcagcgtttcctgagccagcctttccatgtcgctgaagttntcacgggtgctccaggaaagtatgtggagctgaaggaaagcgtgaagagtttccagggtgttttggatggggagtatgatgaccctcctgagcagtcattctacat

SEQ ID NO: 10867 - DNA, 547 bp, Zea mays
  unsure (1)..(547): unsure at all n locations; Clone ID: LIB3279-183-Q1-K6-H8
ttaaattcaaaagttgtggggtggggggggggtactcacaatattgtttagataaaaatttgagatgtcggagaaagctgctgaaaaagttaactttatctctagggctaaccttcaattcgacatctgcccattcttcagtcttaatgtcattaccaccaattacattggtgggggcccggtgcatccacaccaaggatttcatcaccaccagccccatcaacgactacaatggtgaagagtttgtcttctactctacaacgaagtaccgtgccaaaaaactcaataatagagtaccacaccaaccaaaatggctaattgttgccactagagagaatgtatagcctattatgtctggctcttactgaatcgatagctttaagggcaaancnntnccctcccctccatacatcaacaaaaccttttcccccccctcccttcacacccttccacccccccttttcttctggccctccctctctcctcctccctctcccaccttcccttctactcaaacaaaaaaaaaaaaaaaaaggcgcgcccccct

SEQ ID NO: 10868 - DNA, 397 bp, Zea mays
  Clone ID: LIB3279-183-Q1-K6-H9
attctcaccaacagtgaacttcactgtgctgcaccacatacacccagctataaatacacctagctaccctctccctctccacacacactcaacaccctcagccaaagcaaacaccccacccactcagttactccgctctgccggctacacgcatagtgtcgcttcgcctccagtccaccctcctgttatcggagcgttcgtgtcgtctcgtggaggccagatccgcaagtctacgctaggcggtggagccagaagccagttccgcgagctccccttcccccttcgccgaataagcacgacaaactcactggatccctttgatgcataaattacctatgtttttcaaccacaaccctcagcctgttattttatgcatgatatgattttgagacaagtt

SEQ ID NO: 10869 - DNA, 551 bp, Zea mays
  Clone ID: LIB3279-183-Q1-N6-A1
aactaaagcattgatcttgatgccctaaattagagactattatgggtacagtacaatttgcaaagtgaggatacaaggacttcagttggtcgatatccaaagctcgagatagacatgacaattaagacaacgaaactaaacatgggtaaaaactactactacaaatgtctgcagactggcacataggcatacaaacaataaatcaggcctaactgcagctctacaacctacaaagcgacaaacatagcacggcttctttatctgatcgttacaaacttatttgtaccatgcttagcccaaaacgtcttcaagtcaattggattaacaagattgtacccttcaccagcaagcttctcaagcacctttttgaatgcaccttggctcatcttccttccagcaatacgtgcgccccggcgctttgtgttcattggcagtggatacgttgaaatagaagtcgtgcagcatgcagactgccacccacctgcaccccaccggtagcactgctggggagcttccgtgcacgagcacactggtgttggtatgttggcaag

SEQ ID NO: 10870 - DNA, 484 bp, Zea mays
  Clone ID: LIB3279-183-Q1-N6-A2
ccgcaatcgcccaaattattggattttaaagtacaataagacagcaaagtttccatcgggtcacacaaaccccacatgggaatgccaacacacgccttcaagcatataacaggggtttttacgaatctaccaaacatgagtggcagtccacaggacaatgggtcattggggctcaacagcataagcctgaatcgcatttgataaagcctgaaacaacctttcagccgggggccttaagctcggcgaggcggcgagaaaggtcatcctcgtcgactttctccttatccttggcggcagggatggcgtgggcggctgcctgcggcaaaccgacggagacctcgagcccgtagtcgtccgcgacctgctgcatgaggctgttgacctcggtctccggcgtggaaagggagggggagccggccatggcgccctccatgaactcggcctggacctccatgttgacaaactggcgctcgaaattgtccat

SEQ ID NO: 10871 - DNA, 632 bp, Zea mays
  unsure (1)..(632): unsure at all n locations; Clone ID: LIB3279-183-Q1-N6-A3
gtctttgccttagtcgctctcgtgctcgtcgcgtccaaccagcacggcggctggatgcagttcgaccgctacgaggagtacaggtacctgcttgcaatcgtgtcgctggggttactctactcgctggcgcaggcggtgcggcgcgcgtaccggatgcgcggcggcgccgaccccgtctcctcagcatctgggaggcttctcgatttcgtcggtgaccaggtagttgcatacttgctgatgtccgcgctgtcggctgccgtccccatcactaaccgcatgagatctgcagttgtcaataactttacagacgcaaccgctgcagcaatcagcatggccttctttgcatttgtagctcttgccttgtcagcagtggtttctggttacaagctctccaaacaaacatacatgtgaatcatcgttctagaagtaaaacccattaggtggaatattcattatggattgctaatccaaagaagagaagcctctgatgcctctcttcaacttggatgtcatctgttatgtgctaaggtgattgttgttgcttgcagtangttctatgtgtgtacatangaatatgcgtggcattcctgaatatgattgttttcctttcttagatattgttgtcatgatga

SEQ ID NO: 10872 - DNA, 601 bp, Zea mays
  unsure (1)..(601): unsure at all n locations; Clone ID: LIB3279-183-Q1-N6-A4
gtgtgtttttttttttttttttttttttttttttttttttttttttttttttttttttttttttttttttttttttttttttttttttttttttttttttttttttttttttttttttttttttttttttttttttttttttaaaggggggggggggggggggacccccctttaaaaaaaaaaaaaaggggtgggtaaaaaatcccaaccccgggcaaagggttaaaccctttttaaggaaaggaaaaaacctttatttttttggaaaaaaaataaaaaagggaggggtaaaaatttttaaggaaaaaaaaaaaaaaggggggggggggaaaaaaaaaaggaagctccaattttttaaaaaaaaaaaagggggggaaaaaaaattttttggggggaaaaagggggaatttttaaaaaaaaaaaaaaaaccctagaggtttaatttaaaaacgtgaaaaagaaaaaaaagtccggggagggggggaaaaaaaaaaggggccggggaaaaaataggtaaagggtgtgcccaaaaaagggggaaaaagnaaatatttaagcgcttgggggggaagattagaaaaaaagagatgggtaagagggg

SEQ ID NO: 10873 - DNA, 431 bp, Zea mays
  unsure (1)..(431): unsure at all n locations; Clone ID: LIB3279-183-Q1-N6-A5
agcaagcggggagatacaactatattccacaacagggacatcaaatctaagaggaccattacaatccggcgccccggatttataaagcaggcaagctagctactaggcgggtagggggggggactggggaaaggacacaacaaaaaacccttttaacagatccggggatcccgcagcgcgctcagttgctggggaacttggggacggccttggttccctcggaaacggggtgcttggcgagctctccggggaggacttggcccacgggggtctggatctcgcgggacgtgatggggggctttttgttgtaccccgccagcttgggggcctctccggccagctttttaaagatgtcgttgatgaaggagttcatgatggacatggccttggaggatatgccgatgtcngggggcacctgcttcaacaccttg

SEQ ID NO: 10874 - DNA, 588 bp, Zea mays
  Clone ID: LIB3279-183-Q1-N6-A6
actatgacttttagaattagtataactaatgagtaatagtacaatatacttaaacaaccatagagggagccaagccccttccattatcagcatgcctcgtggttcatatagattgctcttcaaagtgcaggccaacattcacaaagagaaaataaacataaaaaacaaatgacaattccatgatgcaaactgaagaagcgcaaaataatgttttcctcattatatatggagattaaatctatatcctgcatctaaactttctgagctttattggaggccctgtcacgggagtcgaagtggcgaccccgcttcccaccgccaaactggtttccgcctctgttgttcttccagtcccgtcctctgttgtttcggctatctttatatttctcctgaacgccccgaattgcactccaataatccttttcagcttgaccagacacaggttccaaaatgactatgtggcctttcatagtcaaaccaccttcatctgcaatggctgcaaatgcacgggccttgtcagctgctgcaggatcctcaaaccgaaagaatccagaatcttccccaatgctgaagtccacataccgcact

SEQ ID NO: 10875 - DNA, 533 bp, Zea mays
  Clone ID: LIB3279-183-Q1-N6-A7
gttcggaatagcactcaagattatactgtcacaacttttaaaacgatggatcagatgttccacaaattcagtacttgatcggagtaagaatgtccagctgggaccctaacttctcctcggctgtagcctcagcctttaggcgcagcttggccagctgcttcctcctctcataggccaccttagccttctccttcctcttctcctcaagctccctgatggtgtcatggtagttccatccgacctccttagaaagctcaccaaggaggcagtacttgtgtccaggttgcagcctcaggaccttaagagcgtcagggatgaccaggcgcttggtcttgtcgtacggcggcgggacgccctcgtacgtcttgagcctcgccagagccgcctcccccctcttggtcttgtgcggaatcatcccgcggatggtgcgccacaggatcttggacggggcgcggaagtggatgggcccatgggatggcttggtgttcatccgcttgcggagaaagcggaggtacttcatcttctggcgtacg

SEQ ID NO: 10876 - DNA, 604 bp, Zea mays
  Clone ID: LIB3279-183-Q1-N6-A8
ccatgcataacgatgttcagcacgagataagcaggttcacacaaggcactgtaataccccatacacttaaaattcatgttgcacaaagcaaaataagataggctaaaccaaaacgtctggatgcgcattccaactgtgggtggggcttaagcaactgtctttaggaaagccttcccaggagcacgcttctcaagtcttccatggttaccgagcagctttgcgttgacaccatcaggaacaattctaccctcactcttgtacttcaggtagtcggcacggctgaacttggtgaagccccactttctgctgtcaataatcttttggcggccagggaacttgaacttggcgcgacgcagagcttcactggcatgtgcagcattgttgtccttgcatcgaacagaaaggaggacctgaccaatgtccaccctagcacaggtgccctgaggcttgccaaaggcacccctcattccagtctggagcctatcagccccagcacacgaaagcatcttgttgatacgaaggacatggaaagggtgaacccggacccgaaggggaaggatccttttctgcaaacttggctgtactgttgaaggcaatacggcag

SEQ ID NO: 10877 - DNA, 489 bp, Zea mays
  Clone ID: LIB3279-183-Q1-N6-A9
gtgttttttttttttttttttttttttttttttttttttttttttttttttttttttttttttttttttttttttagggaacaggggagatttattttttggggaaagaaagcatcaggacgttctgctttgcatcacaaagctccaaacgcggggggggggcaaacgaaaccccagacgacacatcagggaggatgattgccggtaacaagggaaacaaacccacacaatgttcaaaagcacagctactggtttctaccatttgctcttcctcaccaaaggcccccagggtgccacccaacttactggcactggtccgacaacgggttccccttaggcgaccttaatctcgatgggcttgggctttttgggctccggggggggcagttttttgacgggcaccgggagcaccccgtccctgcacacgggggggaccttgtccacgttggggttgtccggcagcacgaacttgcgcatgaacttgccccc

SEQ ID NO: 10878 - DNA, 446 bp, Zea mays
  Clone ID: LIB3279-183-Q1-N6-B1
aggattgcatttgcaataccacaatatattttctgggaactaccttccagggggggtgttcaaatccaatatacactctgtaaaaacatttctttataatagaaccattttttcagcatgcgccaagcactgcctccgtttggggaaaaaaacgactatcggctccggagcatgggatgaaccggtatttcccgtgatcagtaaaaagattttactacttatttcgggagggggaataaacaattgcagaatccaatctcctgtacgggtggattgatgacctttctcctgatactgataccgcacaagttacaacttcgacctaactaactttgtctttagcaaccgtgaatacatgtttgaaatttcttttgcaaagtatgctttgggttgcggcctcttgaccttgaatgttggggggagaagggcattatccaatgtgaatg

SEQ ID NO: 10879 - DNA, 592 bp, Zea mays
  unsure (1)..(592): unsure at all n locations; Clone ID: LIB3279-183-Q1-N6-B2
gacaacaaataatttggttcatcatgacataacactagagggtgactggttacaacttacaacagatactttacacggcactaagctcctacaactgccgcgtcatcacattacgaatacacaacactacaacagtcgtacaagaaatttcccagatcactgtaagtcttaacgcgcaaaatcggcgttagatagtactgtatcaccgaaacagtgcgggtacatgggaatgctccagggcattttccttggcgaaggcagcccaccagcgtctcagcagtaaaacatgacacgcttgacgttctccttgagagcaggtaggggcctgacctcgacactccccgcccctctcgtgctgcgtgccgcacctggtggggggccacgggcaccgctggccagtgacccgctgtcagaggtgtctggctccatgtagaagcgagctctgaaggctgcaagatgagcatagtacgccgggggcacgatggacacggagcgggtgcacctagcgtacgtgtagcacaggttattcgtcagggtctgcagctcgtcagctgtgaacttgntctcgtcccacaggacatggtagtgagca

SEQ ID NO: 10880 - DNA, 489 bp, Zea mays
  Clone ID: LIB3279-183-Q1-N6-B3
catgcaggtaacgaacctaatcactttcaattttatatcattatgtgcatgacttgttgcgggtaaccaacctaatcacttgtattatcatatcattctgtcataaaaacgagacaactaaccacttgttttttgatgcctcatggttcactcgttatggacaattatttatttagctttaggaaaacgaaatcaaagagtgtggaacacacatttagggattgactacatgattttgacattaatttgaaagatctttttctactaggggcgaccaccttatgctggtcactttggctatgtagaaatgacttatcttcaaaaaaagaatgcattttcgtctatgaaggttatccattctatggtgaagccttaaccgctagagtccctttcgtcaaacaaaagactaaatttatccacgagcctttgcaaagtcggtcgtcaaaacagctcacactctcgaacatgagttcattacggacgcgtggg

SEQ ID NO: 10881 - DNA, 603 bp, Zea mays
  Clone ID: LIB3279-183-Q1-N6-B4
accaacaaacaatgtacgtgtgaacattattgttggaaaggggttatcacaaccgacaacaagcaccttttttccttggaaggcctcccttccctatgatagtcacttgagtgcataacttgcccttaaagctatcgagtccctaagtgccagacataataggctatacattctgtttgggggcaacaatgagccattttgggtggggtgggactcccgtgtagaggaaaagactaactcttcactattgtagtcgttgatggggctggtagtgatgacatccttggtgtgcatgcaccggtgagtcactgttgtactcggcggcaatgacattaaaactgaaaaatgggcaaatgccgaattgaagcttagccccagagataaagttaacctacgagcataccaacaatttaaaattaagtagaaagtaaacatgaatactaataacatcacgaatttgctcaagaatggtcgtagaaggacgagcaacaaaacccatcactttcatgcaaagcttccaataattttcctacttctataaactttttaaaaactctctacgctctttttagtttttttgggattttctacctttttcagcag

SEQ ID NO: 10882 - DNA, 527 bp, Zea mays
  Clone ID: LIB3279-183-Q1-N6-B5
gaacaacaatcatggccaatagggggctacgaacaatttatcacaaaatacaaaatggaaacacacagcagcagcacgcaatggagtggacccatacagagtatactcaaaataactcaaccattaagcaccagctaactaattattaaccggctactcaatagtcatcgccctcgtcaccctcgtcatctgcaccctttgcgccgacttcctcatagtccttctcaagagcagccaagtcctcacgggcctcggagaactcacccttttccataccctcaccgacgtaccagtgaacgaacgcccgcttggcgtacataaggtcgaacttgtgatcgatgcgcgagaacacctcaacaacggcagtgttgttgctgatcatacacacgggacgctggacctttgccaggtcgcctccagggacaacagacgggggctggtagttgatgccacacttgaatccggtggggcaccagtccacaaactggacagttctcttggtcttgatggttgcgactgcagcattg

SEQ ID NO: 10883 - DNA, 624 bp, Zea mays
  unsure (1)..(624): unsure at all n locations; Clone ID: LIB3279-183-Q1-N6-B6
aaacgaaagagtttattcgcccagatgaaggaagcactgttatctgggagtaatggaggggttcatcaatgaacgaaccctccctcaacaaggtagtcctaagctaccccgactacaagtagcaaaggtgtagttaggttatacaggttataaactacaaaattgacttgtacgaatccgtgccccccaagatgactgcctcagtgtggtgtacataactgtcttcagtgtggtgtacataactgtcttcagtgtggtttcggtacatagccatctaccgcgaagtttcttgtggctacaggtaatgccagccgaataccatcgagttcaggcttcgcgatcacttggcagccgaggcgagatgtctctgtgagcccaaatgcaaggtcaagcatatcattttcttcatctgctggatcttctaatttgttatagtagtttacatccattactattacatgacaagtagaacacgcaagtgaaccctcacatgctccttcaagctctatgtcattttcatgagcagcttctaacatggacattccaactggaacacgtattgtcttttctgagccatccttgttaacaaatgttaccgagaatntatcctttgcctgactgctt

SEQ ID NO: 10884 - DNA, 527 bp, Zea mays
  Clone ID: LIB3279-183-Q1-N6-B7
catagaagtaatgtttgcatatatgtccgttcacagttgcaagtgtgcatacattataagcgtctgcactatactagcacgctacatcattcataacacagctgatatattgtcgcaccaaccgaagaggcatgtggagcagaacgcaaggggatgaccaaagaagcgcctgctatttcatgacctgatcgcacaagcgcaggtaaggtttcaaagccgaaggtacacccagctaatgctattacaaaaccgacaaggtaataacagatccatcgctccaacgcaaaacgacagccggaggaggcaaggtctgcgcttctagttcagcttctcgattagttcgttgatcttgtcgccacggtcgcccgagtcgccgccatccttgtagggtttcctcttcatctgcagcctcctctccggacacttgagcctgaagggcatgaggaacctcgatgcttctcggaagtgcggcccaaccgtggcgatcacgtgcacaacgtcttccaagcatatgatgccgtgatctc

SEQ ID NO: 10885 - DNA, 475 bp, Zea mays
  Clone ID: LIB3279-183-Q1-N6-B8
ggggggtgtttttttttttttttttttttttttttttttttttttttttttttttttttttttattattttttgctttattttttttaaataaatttatgctttttttgtttttttttttttttttcccccccccaaaaaatcagtagccaagggggggggggggaaaaaattccccatttagaaaaaatgccatagtgaaaccggcacgccaccccaaaaggaaaacgcaaaagggggggccccgaggagattaaaaaccaagcaaaagccctgaggggggagaaaaaaaagagggaaccccctaaaaggggcgcctgggggggagaaaacccttaatggagcccttaacaaaaaaaaaaaaaaaagggcccgggtcctgaaaggcccccagggggaaaaacctgctccaggccaaacttgggcgtggggaaaaaaaaccgttacccaccccgaaaaatcctccccgagaaaaa

SEQ ID NO: 10886 - DNA, 278 bp, Zea mays
  Clone ID: LIB3279-183-Q1-N6-B9
cccaaaaaaaaaggggtccctttatatgaaaaaaaatgggggggggggaagaggggttttattttttatccggccaaggtaagttccaaaaaaaaattatttggggggggttaaaacagattaaaaaatgggtggtaataaaaccgggtaaattatgattgaaaaaaaaaacgggaagggtcttggttccttaaatttttaaggaggggctgaaaaaaggggtacttaaaaagggggaaacaaaacgggttatttttgggggggcccccacgcgttcg

SEQ ID NO: 10887 - DNA, 484 bp, Zea mays
  Clone ID: LIB3279-183-Q1-N6-C1
gaagcagaataccaccgcttaatgatttgtattaacaccagatgacatcacttaaaacaagaattgagataatctcctagaaaagcccaagaaccagcacaaatttaaattcaggtcttaaagctagtgtaaagcacaagttccagataccgatgcactgtatctagggtgacttgacgtactcctgaactatgttaaggccctcagattcttcgccatagtccttggcgacaacacaggagcaacccacaaccttcctcgccttgccctcagaatcaatcttgcaaagcccagaccattcgccaagagttttagcgctaggcacagtaaccaggtgaacgttgtgctcaaagcaaagagccttcaccagcttgacataatcaggctggtcacagtcctccgcaagcacgcaaagctgagcagcatgcttctcaatgggtttgggagcctcacgaagacccttaacaaggccataatgagcacc

SEQ ID NO: 10888 - DNA, 600 bp, Zea mays
  Clone ID: LIB3279-183-Q1-N6-C2
acagataatgttacgttccctgatatccaatggtacttacaaacgaactgacaaattctaggagcatgggataacttcgtttctccaaagcatataactacaacacaagcaacctccctattagttctgtacaattccgcagcaacattaattcttgctgaggattgaagttcgctattttcatcatttagcaagctaatgttctacctactgcagacacctgcttggcaatccagtatatgatagagacgggcacagcaataaatcaaaccaagggttagcaggtgtctgcatactggaccttcgatttaccaataaaccagtatatgaataaaccaagtgtatatgttgcatactggaccttcgatttaccaatctgtccattatgatcagcgattaaaccgtaaggtttaggaaatttctgcagtaggtgcatgtgatctcattcagatgacaactcaaaagcatgggcaagtcgcatagaagaggctattcggtagccatttgagattcggggcaatagggttattcaccttgcagcacaaccatgagttctccaccttggctgagcacactgtcaaggaacccaatcacgttttc

SEQ ID NO: 10889 - DNA, 599 bp, Zea mays
  Clone ID: LIB3279-183-Q1-N6-C3
agatcacaatcatctatagatctgaaagaaaagaacccacaccgccaccaacacaacggtctcccaataatgtcacggcaaaggtgaaaaggaggaacaaaatgctaccaagtgtacacaggtcagcatgaagaagaagctcacggccaagccaaactccggcgcaacaccaatgtatggcctgcctggccaagtgggagaccaacaacccccaagaagggaacccctatatgtaccactgctcccccttcagtcgccataatcagtgctgccgctacacgagctgctgctgtcccggctgtgctgcgacaggcccctcaggtgacccggcaggctggccactccgccgtcgatgctcgtcgatgctcttctcctggaagaacctctccctctcggcgtgctttgcgggcggcggcgggatcagcggagcgggatcatgccttggctcctcaccgtccggcaagtggatgttcagcgcgcccagtctcttgtcagggtgaggtgattggatggtcagcagccgccgcagcttgtcctcgggcatggaccggaacgacggtaccgagtcatctgtgtagtcctgtgacagagctttcccc
